United States Patent 10,696,975 (GENES AND USES FOR PLANT ENHANCEMENT) - sequence listing, part 14

SEQ ID NO: 61065 - protein, 363 aa, Glycine max
MATPNNSNINNATAKPGTLGVGVGAAPTPPKSQRGHNKPKCKQCGNVARSRCPYECCKSCCSRNQNPCHIHVLKANSTFPDKASSSGASPLDQQSGFFVFYFRSAGRVASLRQLSNSFAQFNNLHLSLRSKKPLTRKDAASINEWRFAKIKEYKERNVEVENEAFDRYMQNVDLLEEVLAVKSLDANVPSALESNATPMESNEAMIPGIKLQLRSNSMRSDGLRMRIQQIVNEGLKKLEKSAVDGDINESIDGESNEASKRGKGIERLSAISDLMDKINKARTEEDLKPCLEMKTQLFNLDEGSSAKDLQDNEMHANETAESDVVQTEGLDYSLPKFVTITEIDLEVLHTIDKHFSTQDIEQL

SEQ ID NO: 61066 - protein, 673 aa, Desulfovibrio vulgaris subsp. vulgaris str. Hildenborough
MARVIYGIWDGTVHDNRGKALFEIPDAPGFEGFDTFNQGNSIRAFVGDRGFFVFEPGVNLLDALWQYMERAARESCGKCTPCRVGTGIIRDSLAALLRDGVGSGGLGTLVELAEQVRSTSLCGLGRTCTVALCGALEHFQDMLVEGARTASGQQHGMSYVTAPCIEACPARVNVPRYIDYIRDGMPSHSLGVILQKYPMAATCGRVCVRFCEQACRRGLVDEPVGIKILKRYVADHESHLAQGWFSPDIVRDRKPGHLKVAVVGAGPAGISCAYHLLLNGYPVDVFEARNEAGGMAACGIPSYRLPKDVLRTETDIVERLGGRFFYGQRLGHDVSLDGLREQGYKAVFLALGCPEGRLLGIEGEDTSLEGYQPGIDFLLRVHDHVESQADASLSGVVVVVGGGNVAMDCVRSALRLGAREVHLVYRRTRDAMPADHEEIEAAEKEGVVFHYLTNPVRIITRQMVDSAGVTRDRVVGVEVVDMREGEPDARGRRGVVAVSGSGRVIPCDTLIPAIGQQMDSTALSPEDGVDVDARGRVVSDQTTLATTRPGVFAGGDCALGPSTLIQAMATGLKGARSIDDYLRYGRVRFFPRSRMRRIIRDFKPLSQQWVDTPVRHLYRIHAQELDPAYRRQLFDEVECPISAEDAYHEAGRCLRCYRVYSVITEAAIPQCDD

SEQ ID NO: 61067 - protein, 537 aa, Phytophthora syringae
QELVGMLNTAKIPANVEVVVAPSQVHAATVKSALRGDVRVSGQDVWQQGNGAFTGETSAEMLKDLGAEYTLVGHSERREKGESNAVVAKKAAYALEKGLAVIACIGESKETREANQTVAYITEQLDAYAAEIKDWTNVVIAYEPIWAIGTGLTASPEQAQDVHASIRAWLKEKVSAEAADKTRVIYGGSVGAKNAPELSQKADIDGFLVGGASLKPDFLHIINAQNPTENVGGPVNVAINGFGRIGRLVLRAAAKNPLINIVAINDPFISTTYMEYMLEYDTVHGTFDGTLSHDEQHIFVNGKPIRVFNEMNPTNIKWGEEQVQYVVESTGAFTTLEKASTHLQNGVEKVVISAPSSDAPMFVMGVNDELYEKNMHVVSNASCTTNCLAPLAKVVNDKFGIKEGLMTTVHAVTATQKTVDGPSKKDWRGGRGACFNIIPSSTGAAKAVGKVIPDLNGKLTGMSFRVPTADVSVVDLTARLVNPASYDEIKAAIKSASENEMKGILGYTEKAVVSSDFIGDSRSSIFDASAGIALTDD

SEQ ID NO: 61068 - protein, 115 aa, Triticum aestivum
  misc_feature (96)..(96): Xaa can be any naturally occurring amino acid
MKEATASGGGATAGANDPRQPGTARPYAPPKLSSQDLPVDYAGFLAVVFGVVGVMLHYKVCSWIAIIFCAQSLANMKNFENDLKQFSMAFMFAVMXLLQFPNIAESYRRFPRPFC

SEQ ID NO: 61069 - protein, 214 aa, Desulfovibrio vulgaris subsp. vulgaris str. Hildenborough
MNQHLLEQFGTTHERVERGLAALRTGQGVLVADDADRENEGDLIFAAETLTPAQMAMMIRECSGIVCLCLPEERVSRLGLPMMVAHNTSSMGTAFTISIEAAEGVTTGVSAADRVRTVKAAIDDAACPGCLRSPGHVFPLRASPGGVLERRGHTEATVDLMRLAGLKPYGVLCELTNPDGTMARLPQLVDFAQRNRMTVLTVEDLVAYRQDKGL

SEQ ID NO: 61070 - protein, 265 aa, Arabidopsis thaliana
MALAYDPLFITSDKSLSAFDVASSPPQPMNLTQDELKRIAAYKAVEFVESGMVLGLGTGSTAKHAVDRIGELLRQGKLENIVGIPTSKKTQEQALSLGIPLSDLDAHPVIDLSIDGADEVDPFLNLVKGRGGSLLREKMIEGASKKFVVIVDDSKMVKHIGGSKLALPVEIVPFCWKFTAEKLRSLLEGYGCEANLRLGEKGKAFVTDNGNYIVDMHVEEDMGDLGAVSDAILRLPGVVEHGMFLDMASTVIIAGELGVKIKNKH

SEQ ID NO: 61071 - protein, 335 aa, Geobacillus stearothermophilus
MAVKVGINGFGRIGRNVFRAALKNPDIEVVAVNDLTDANTLAHLLKYDSVHGRLDAEVSVNGNNLVVNGKEIIVKAERDPENLAWGEIGVDIVVESTGRFTKREDAAKHLEAGAKKVIISAPAKNEDITIVMGVNQDKYDPKAHHVISNASCTTNCLAPFAKVLHEQFGIVRGMMTTVHSYTNDQRILDLPHKDLRRARAAAESIIPTTTGAAKAVALVLPELKGKLNGMAMRVPTPNVSVVDLVAELEKEVTVEEVNAALKAAAEGELKGILAYSEEPLVSRDYNGSTVSSTIDALSTMVIDGKMVKVVSWYDNETGYSHRVVDLAAYIASKGL

SEQ ID NO: 61072 - protein, 981 aa, Mycobacterium sp. JLS
MTAGRRTAGFDFLEQPALPAPRVSEAEAQRILATHYGIEGDAVSLGSQQDKNFLVRRTGTGEVAGVLKAANPAFTAVELAAQDAAATLIAEAEPGLRIAVPLPNADGAKVTTVDGLLVRLLRYLPGGTLIDADHLGPAAVAGLGEVAARVSRALTGFEHAGLDRVLQWDLRYGADVVAALIDHVADPVQRERLSTATRDAAERIGRVADALPRQAVHLDITDANVVVSRAADGTRRPDGVIDFGDLTDTWAVSELAIAASSVLGHSGTEPVSILPAVRAFHGIRPLTVEEIDALWPMVVLRTAVLIVSGAQQAELDPDNAYVTDQSDGEWRMFEQATSVPIDVMTAAIQADLGFAAPPADVTATVPMIAGVTADDVVTLDLSPTSDAYDFAFTPGGWLPPDVDDRLARRAVDDGAAVVVTRFGEPRLGLTPALSQRSGDVVPTGVRLWPAQPLTLLAPWDGEVRSDGAGDMVTVRGDAHEVTLTGVRPVGGVSAVRAGDPIAQADAAQWADVAVRPVGGVTAPPLVRPEVATGWLAQARDPRPVLGLPPDAVTSPAADLVERRDRSFAPVQEHYYRRPPQIERGWRHYLMSTAGRCYLDMVNNVTVLGHAHPRVADTAARQLRKLNTNSRFNYAAVVEYSERLAAELPDPLDTVFLVNSGSEASDLAIRLALAATGRRDVVAMREAYHGWTYGTDAVSTSTADNPNALATRPDWVHTVESPNSFRGKYRGAEVGRYATEAVAQIERLVADGRAPAGFICESVYGNAGGMALPDGYLQQVYAAVRGAGGLAIADEVQVGYGRLGHWFWGFEQQGVVPDIVSMAKSTGNGYPLGAVITSREVAEAFRSQGYFFSSTGGSPLSCAIGLTVLDVLRAEDLQGNAVRVGGHLKARLEALADRHPIIGTVHGVGLYLGVEMVRDRQTLEPATEETAAICERMLELGVVIQPTGDHSNILKTKPPLCIDTESADFYVDALDRVLTEGW

SEQ ID NO: 61073 - protein, 683 aa, Oryza sativa
MEVEEEAFFDTREELLPPSPAAALPWSGGLDSVRQRRERFMRSMGLERSPSLRQADFADVVGDVEEEGEVAAEAAAAEIGRWSSQSDENECSMSSWSTEETTSYDDGASDDNSVSGSGKASRSFSSLSFIQRLMSRNGKPSGAPKTIDRRRNGWLRRLGVSACVVDSGAADEASTSSSDSEQIEAGRYERIKVHSYRKRSKELSAVYQGQVIKAHDGAILTMKFSPDGQLLATGGEDGVVRVWAVMQSEDCKIPLDDPSCVYLKARRKYGLAPVNAESEKKSKINGLKKSDSACIVVPTMVFQISEEPVHEFRGHSGDVLDLSWSSNKHLLSASTDKTVRMWEIGYANCIRVYPHSNFVTCVQFNLADENLFISGSIDGKIRVWDITRSSVVDWVDIRDIVTAVCYRPGGKGVVVGTITGNCRFYEISDNLLKLETQIALNGKKKSSLKRITGFQFCPSNPSKLMVTSADSKIRILDGTNVIQNYSGLRSGSCQLSATFTPEGQHIISASEDSNVYVWSHENQYECACKQAKTTQTSEHFRSNNAAIAIPWNGTKPRSPVPLSSQILPPQGDTFWSMSKAIKYNSSLCGKDSSIKKIVSTPAAPGIFNLNQEFFIESSCKSSATWPEEMLPSTTASVNLDESQFKLLRNCFQGTSNSWGQVIVTAGWDGRIRYFQNFGLPVHQ

SEQ ID NO: 61074 - protein, 597 aa, Physcomitrella patens subsp. patens
MVSDASKKKAAAKKLAAAEKRGSKSAAVVAQTKLKDVTNGTSADTLAEELAAANITDRTCTGVLASHAQSRDIHIESLSVTFHGHELVADSTLELNYGRRYGLLGLNGCGKSTLLTAIGLREVPIPEHMDIYHLTREIDATDMTALQAVMNVDSERLLLEKEAEKLSQQDDGGGEPLERIYERLEAMDSATAEMRAAQILHGLGFTKKMQNKKTRDFSGGWRMRIALARALFMNPTILLLDEPTNHLDLEACVWLEETLKKFERILVVVSHSQDFLNGVCTNIIHMQNKQLKFYTGNYDQYCQTRAELEENQMKQYRWEQEQISAMKEYIARFGHGSAKLARQAQSKEKTLAKMERGGLAEKVVRDKVLTFRFTDVGKLPPPVLQFVDLKFGYTPDQLIYEKVDFGVDLDSRIALVGPNGAGKSTLLKLMTGELEPLDGMVRRHNHLRIAQYHQHLAETLSLEMSALQYMMSEYPGLEEEKMRSAIGRFGLTGKAQVMPMGNLSDGQKSRVIFAWLAWRLPHLLLLDEPTNHLDIETIDSLAEALNEWDGGLVLVSHDFRLINQVAKEIWVCEKKTITRWNGDIMDFKRHLKRSAGL

SEQ ID NO: 61075 - protein, 928 aa, Cryptococcus neoformans var. neoformans JEC21
MPVRPSRSNSDSSIPYVTNSSLASSYRPTSIRERETSPINTFNQLSLERSLTPPKAPRLAPQVTHDPKYTRHKRTQVLRNTSGTPSAASTDDEDDQDERGRGGIDEEVKSWLELRDGQGWKRIGKYKSVNKRGEIKNDLTNQLPPEILIQIFRYLPGNKDLLSVLLVSRFWCLCAFSLLWYKPTLPTITQLASIVRVIHSPTRSLPYANAIRRLPLIQLGPTLTDELFTSLLVCSRLERLNISGADKLTSGALRNVIACMPNLVSLDLTGVINTDDAVLVIVGETCQKLQAINLSECRLVGDEGVLALAKESRALRRIKFEKCHRITQKSLIPLIRACPLVLEYDFQDVISLSSSVLHTVFLHASHLREIRVNGCVSLNENCIPNLLDLSEMQDDGVAKVSEDVGIKIEPAEGVTMWRPVTTTFEYLRVVDMTGCTDLGDKAVDNLITNAPKLRQLTLNKCPALTDKSLESIGKLGKHLHNLHLGHVSLITDDGVINLARSCTRLRYLDLACCTLLTDACVAEIGENMPKLKRFGLVKVTNITDEAIYSLVRKHTSLERVHLSYCDQLSVKAIAYLLNKLAHIKHLSLTGVSSFKVPELQEFCRPPPDFFNDHQRAAFCVFSGSRVVDLRDYLNNHYLPSMEVDTSEDSGHDGAASSTSSLTIPRAAPTPDHSSISNSVAQHSNLVYRQSLSNLNDVWEDAPSPISPTPMSRPQPPHILTASIQYQSVQPGEGAPFPIASTSTSPPTFTSSSSARLTPNPTSAAPSYFNISSSPSLHNRFAYGGTTLPTHLDYLVPPSQESSRSSSMSSNGDRFPFIPHQVLSERSRGPDAPSRRDRPSGPRVPSDSYNVSPSYANEFASYWSREGRLPPASDAEVGMARTHIAEEPMTQVPNLSHRPGANGSSSSSAGAQREGGRGSRWLQRFGNGR

SEQ ID NO: 61076 - protein, 395 aa, Arabidopsis thaliana
MASSKGSQSVRNLMYPGKHALLPPKIPFPSVSASYSEYIPTGLIGSRHGQKLSNEKTHHQRTSSESHLVEELPFWLDDLLNEQPESPARKCGHRRSSSDSYAYLDVANATNISLTLQNDFSYRNTVLSTQRGVQELDRNKNAQDAAFYSGASFLKQKSRQRDSLVATGACPSWLPFARENGGGKNLGALYMSQDATVISSERKNYAEPFSHDPKMLSSEENNSNPSPVTYEADNTKRAKQQFAQRSRVRKLQYISELERNVQTLQAEGSKVSAELDFLNQRNLILSMENKALKKRLESIAQEKLIKQSSYQDSTVLKIVYLMSSVYYPVEQEVLEKEIGRLRALYQQQQQTQKPSASRGRATSKDLDSQFSSLSLNTKDSNCRRDSVSVMGQFHF

SEQ ID NO: 61077 - protein, 344 aa, Xanthomonas oryzae pv. oryzae KACC10331
MRRFVCSDRWRRPFVCAFPRITAMTILITGAAGFIGAYTCRALAARSEAVVGLDNYNRYYDPQLKHDRVAALCPGVDIRTLDLTDRDGLAALFDEIQPTRVVHLAAQAGVRYSLENPSAYVDSNLVGFVNMLELCRHRGVQHLVYASSSSVYGDSATPPFSEDQRVDQPRSLYAATKAANELMGYTYAQLYGLRATGLRFFTVYGPWGRPDMAPLIFSRAVLAGRPIEVFNHGKMQRDFTFVEDIVAGVLGALDTPSSEPVPHRVFNLGNHTPVELEYFIDVIAQAAGRPAEKVYRPMQPGDMIRTMADTQRAQAAFGFDPATPVERGLPQVVNWCRQYFGKRA

SEQ ID NO: 61078 - protein, 294 aa, Trichodesmium erythraeum IMS101
MTETTAKVRKAVIPAAGFGTRMFPVTKVVKKELFPIIDKDGRAKPIIQIIIEEAISGGIEEVGVVVQESDRQIFTDYFQGVPSYYEKLSPEKQEYCQYLQNLGNKITFLTQEQQAGYGHAVFCAKDWVRDEPFLLLLGDHLYTSEVTKSCTSQFLQVYEQTNKSVLGVRIIPGTEIHHYGCIGGTLVADSLINIDTIYEKPDLNYAREKLHVLGMKKEHFLGVFGIYVLTARIFDYLEENIKQNAREKGEFQLTSCLDKLQKAEGMTGYLVKGRCFDTGMPDVYWQTMIDFRNA

SEQ ID NO: 61079 - protein, 196 aa, Brassica napus
  misc_feature (193)..(193): Xaa can be any naturally occurring amino acid
DDVEAIRRFCPASEKLYSTFRLLRVDGLPDWANTSCVSINDVVEGDVVAAILSNYMVDLDWLLSACPKLVNIPQVMVVHGEGDARQEYIQRKKPANWILHKPRLPISFGTHHSKAIFLLYPRGVRVVVHTANLIHVDWNNKSQGLWMQDFPFKDDDDDKDSTKSCGFEDDLVDYLAVLKWPEFTASLPGLGNXQIN

SEQ ID NO: 61080 - protein, 129 aa, Triticum aestivum
  misc_feature (53)..(53): Xaa can be any naturally occurring amino acid
  misc_feature (72)..(73): Xaa can be any naturally occurring amino acid
  misc_feature (84)..(84): Xaa can be any naturally occurring amino acid
  misc_feature (86)..(86): Xaa can be any naturally occurring amino acid
  misc_feature (90)..(90): Xaa can be any naturally occurring amino acid
  misc_feature (92)..(92): Xaa can be any naturally occurring amino acid
  misc_feature (97)..(97): Xaa can be any naturally occurring amino acid
  misc_feature (100)..(101): Xaa can be any naturally occurring amino acid
  misc_feature (103)..(103): Xaa can be any naturally occurring amino acid
  misc_feature (105)..(105): Xaa can be any naturally occurring amino acid
  misc_feature (108)..(108): Xaa can be any naturally occurring amino acid
  misc_feature (111)..(111): Xaa can be any naturally occurring amino acid
  misc_feature (113)..(113): Xaa can be any naturally occurring amino acid
  misc_feature (117)..(117): Xaa can be any naturally occurring amino acid
MAPAVMASSATTVAPFQGLKSTAGLPVSRRSSASLGSVSNGGRIRCMQVWPIXEGIKNSETLSYLPPLSTEXXWKQVDYLIRPXGXPCLXFXKVGSXSRXXKXPXGNXNGXIXEIWXCQWVETKQQGEK

SEQ ID NO: 61081 - protein, 143 aa, Desulfovibrio vulgaris subsp. vulgaris str. Hildenborough
MKPSREELKKRLTPLQYDVTQEEGTEPPFRNEYWDEKREGLYVDIVSGEPLFSSRDKYDSGTGWPSFTRPVDPQGIVERVDRKLFTTRTEVRSRNGDSHLGHVFPDGPQPTGLRYCINSAALRFVPVEDLEQQGYGHLLHLFQ

SEQ ID NO: 61082 - protein, 520 aa, Zea mays
MERTINSLMYKGSIPDAINQSRREKKLFVVYISGEDEASSSLEQSSLIDENVVEVIGRCCILLHLKQGNVDASQFSAIYPQKSVPSISVIGLNGVLLWNHDGYINSENLKESIEKAWAALHLQETAATLLTASLATRNSEPVNSATTVLPAQGGSSTLENPSDLSSQSPDVSGASEVAHSTDLVSQIPNSTALYEPLEINEKEGSKSNSDDKTVEKLGSTSTEFDCDLLDSSRKSNTVSSADSKGEDITPSAKRKNKDDGSHTSIPLEDTPSTLTNKGVSSQSRVEQDKATSFVSVKSDDIQLSIRMPSGNRLEIKLTKQDVLRKVKNFVDENQGNGLGSYDLSLVYPKRVFSEQDMEATLSELGIQNRHAMIVVPHRQSGQVSRRHSSASYDMGVNSGADDVGGNSGAGGYFGYLRTVLSYVNPLSYLRGNTNSSNTELQSNEGLRQLRHGSGPWSEPRPLGNRGHEVTDADSANTLRRRPRPFGANIHTLGSEDHGPSDERNVFWNGNSTEFGGDDRK

SEQ ID NO: 61083 - protein, 214 aa, Ostreococcus tauri
MPMRTSGFFIGPGLGMGRCRGGDGLVSGGDSITVVKIQVGLLGTARSLQRDLERIADRADTSAPDGLHYVLQETVLALLRNPEYAIYGFAKSKVCRGPEQAEELFNDLALDERGKFEQETLVNVNNRKKATTAGSVPGADTNDYILVTIIAACDGGVKMPEITDALDMKTALKRLGAVRVDALQAVEVLWTPQEDGDVLTQTELLRDYPILVNL

SEQ ID NO: 61084 - protein, 365 aa, Bordetella petrii
MTAMMKAAIFVEPGRIELADKPIPEVGPNDALLRITTTTICGTDIHILKGEYPVAAGLTIGHEPVGIIEKLGSEVAGYQEGQRAIAGAICPNFNSYAAQDGRASQDGSYLIPRGLCGCHGYKATAGWRFGNIIDGTQAEYVLVPDAQANLAPVPDGLTDEQVLMCPDIMSTGFKGAENAGIRIGDTVAVFAQGPIGLCATAGARLSGATTIIAIDGNDHRLDIARKMGADVTLNFRQCDVVQEIMKLTRGRGVDAAIEALGTQATFESALRALKPGGTLSSLGVYSEDLRIPIDAFAAGLGDHKIVTALCPGGKERMRRLLNVVEAGRVDLELLVTHEYRLDDIVAAYDLFANQRDNVLKIAVKP

SEQ ID NO: 61085 - protein, 209 aa, Oceanicola granulosus HTCC2516
MHDPIETYMNLVPMVVEQTSRGERAYDIFSRLLKERIIFLNGPVHDGMASLIVAQLIHLEAENPKKEISMYINSPGGVVTSGLSIYDTMQYIKPPVSTLVIGQAASMGSLLLAGGEKGMRLSLPNSRIMVHQPSGGYQGQATDIMIHAEETLKLKRRLNEIYVKHTGQTLKKVEAALERDNFMSPEEAKDWGLIDEIFENRAGAPGAGA

SEQ ID NO: 61086 - protein, 388 aa, Zea mays
  misc_feature (306)..(306): Xaa can be any naturally occurring amino acid
MCMEDLSQQGLCIKCGEGGQLLECNGCFLAAHSSCFGSSATFEGTNFFYCPVCLYKKATEAYKKAKKTYCETRKNLVAFLGTAQATNQPDKQLNGAQPGAANRDEEPHDEQHSKGCGASKGAHENEVYNLAHQDEEHHQQRKKQKINAIGKSYPKEVLTEKVIFQNSDPASINKHSVLQNNNKTPVKDPEKKQQAVNEEARKEGGNDNSSHETGASSPRRCDPPSNQDVEADQDDSLTTSNQSGGSDEIEATSSNDSAKQSSPPWRGMGHNKKGLHEKEPAVSSKSGKGIGKQDQHMHTSRRKKKXAHLQKRYSNPVAPPGRRKQLCWTEKEVAILRDGMAKFSPHNNGKIPWTQILQYGRRVFHKTRLPCDLRVKWRNMERKKWAGY

SEQ ID NO: 61087 - protein, 537 aa, Phytophthora richardiae
QAQELVGMLNTARIPADVEVVVAPSQVHAATVKASLRADVRVSGQDVWKQGNGAFTGETSAEMLKDLGAEYTLVGHSERREKGESNEIVAKKAAYALEKGLAVIACIGESKETREANETVAYITEQLDAYAAEIKDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVNDKPIRVFNEMNPSNIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALT

SEQ ID NO: 61088 - protein, 231 aa, Vitis vinifera
MTLKSVLEFLTVGRPIPLLYALNPFQIPLALLLTWADVLTSRCHVKGETFKGDIGDYYQKYYRGNIFLLRGAKSLTLSVALSITFTERFETNGCKGCNCGAHVEYGRPSYRKKERTFHGQALRTLHEDPNLGVLTTPQQPTLGKFRDHVPITGTTLRSVHPDQLGYPGWQCKARQSAVVKDKRDKQQKDKRLILTMEDLSKALREYGVNVKHQEYFADSPSSGMDPASRDE

SEQ ID NO: 61089 - protein, 236 aa, Triticum aestivum
  misc_feature (208)..(208): Xaa can be any naturally occurring amino acid
NKFVQKSRLVPVRNSRDIVDPRVRPRVRGMIFVLVYCTAGVSGGHINPAVTFGLFLARKVSLVRALLYIIAQCLGAICGVGLVKGFQSAFYVRYGGGANELSSGYSTGTGLAAEIIGTFVLVYTVFSATDPKRSARDSHVPVLAPLPIGFAVFMVHLATIPITGTGINPARSLGAAVIYNNEKAWDDHWIFWVGPFIGAAIAALYHQXYVLRASATKFGSSASFRQPLDSAGRRLR

SEQ ID NO: 61090 - protein, 543 aa, Phytophthora quercina
KCNGSLGQAQELVGMLNTAKIPANVEVVVAPSQVHAATVKASLRADVRVSGQDVWKQGNGAFTGETSAEMLKDLGAEYTLVGHSERREKGETNEVVAKKAAYALEKGLGVIACIGESKETREANQTVNYITEQLNAYAAEIKDWTNVVIAYEPIWAIGTGLTASPEQAQDVHASIRAWLKEKVSSEAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIFVNGKPIRVFNEMNPENIKWGEEQVQYVVESTGAFTKLDNASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEKAVVSSDFIGDSHSSIFDASAGIAL

SEQ ID NO: 61091 - protein, 556 aa, Debaryomyces hansenii CBS767
MAPTLLPKVSIGSSTFSRMPLLERRKYHKLGTLSCMSLIVNKMIGTGIFLTPAIIFQYCQGNVGLYLFLWLVGGIIIFSGLVIFLEFALNLPFTNGGEKNYLLRVFRKPKGLMGCIYSFQMVLLGFSSGNAFAFGKYVLFAVNGEEIKEEEWSVKIIGVLCISFCIFLHIKFPNQGTSLFNLLGVFKIFILVLIIAIGLLVSVDIIKLPTTVDNFSNLFESTTKKDNNYYSISVALLEIIYSFKGWENANYVLLEVSDPYHVLTIAAPSAVVITTILYFLVIISYLIVIPKQELLDSGVLVAGIFFNKVFGESITSRILPIIISSSNLGNVMVVSFAHAHVNQELARNNYLPFSKYFEDINNSLLLHWFITVIIMVAPPSSEIYEFVVNLYIYPGTWINLLITIGLIYLHLNSRGEKWGKHNTGNGLETNSANNSIYDDNDNLILQLNDDSYTEFDSLISVENDNDTSKFSAPIICIVIFLFSNIFLAVFPFFPPPSDSSSSQLIIPYWCFPVVGTSVLLLGVAWFYIRRWFHTWRYDKYKIGEPNVKYEDDYSTN

SEQ ID NO: 61092 - protein, 476 aa, Rhodococcus erythropolis
MTILAPVTKSESSTDPRDPLARLENLFDPGTTVPLHARDKSGVLAASGNIDGVRTIAYCSDATVMGGAMGVDGCKHLVKAIDTAIEEESPIVGLWHSGGARLAEGVEALHAVGLVFEAMVRASGLIPQISVVLGFAAGGAAYGPALTDVVIMAPEGRVFVTGPDVVRSVTGEQVDMVSLGGPDTHTKKSGVAHIAAHDEADALHRARRLVSMMCEQGEFDQRAAELGDSDLRAMMPASAKRAYDVRPIVHEMLDNVEGESSFEELQGNYARSIVTGFGRMAGRTVGVIANNPLRLGCLNSESAEKAARFVRLCNAFGVPLVVVVDVPGYLPGVSMEWEGVVRRGAKLLHAFAEATVPRVTVVTRKIYGGAYIAMNSRALGATAVFAWPNSEVAVMGAKAAVGILHKRALAAAPDDEREALHDRLAAEHEAIAGGVDRRCRNRRRRRGNRPGEDSQHRHAALASAPSVRARHKNIPL

SEQ ID NO: 61093 - protein, 195 aa, Brassica napus
  misc_feature (154)..(154): Xaa can be any naturally occurring amino acid
MFAVENGLQGDPRLQAISDAIRVIPHFPKTGIMFQDITTLLLDPVAFKHVVDIFVDRYKHMNISLVAGVEARGFIFGPPIALAIGAKFVPLRKPGKSPGRVISEEYELEYGHDRLEMSVEAVKSHERALVIDDLVATGGTLSASINLLAPNYTXLERAGAEVVECACVVGLPKFKGECRLKGKPLYVLVEPSQLD

SEQ ID NO: 61094 - protein, 534 aa, Phytophthora nicotianae
ELVGMLNTAKIPADVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVTYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLHIINAQNPTTNVGGAVNVAINGFGRIGRLVLRAAAKNPLINIVAINDPFISTTYMEYMLEYDTVHGKFDGSLSHDEKHIFVNGKPIRVFNEMNPANIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLMNPASYDEIKAAIKSASENEMKGILGYTEKAVVSSDFIGDSHSSIFDAEAGIALT

SEQ ID NO: 61095 - protein, 546 aa, Phytophthora alni
QELVGMLNTAKIPANVEVVVAPSQVHAATVKAALRPDVRVSGQDVWKQGNGAFTGETSAEMLKDLGAEYTLVGHSERREKGETNEVVAKKAAYALEKGLAVIACIGETKELREANQTVAYITEQLDAYAAEISDWTNVVIAYEPIWAIGTGLTASPDQAQEVHASIRAWLKEKVSVEAAEKTRVIYGGSVGAKNAPELSQKADIDGFLVGGASLKPDFLQIINAQNPTTNVGGAVNVAINGFGRIGRLVLRAAAKNPLINVVAINDPFISTTYMEYMLEYDTVHGKFDGTLSHDEQHIFVNGKPIRVFNEMNPANIKWGEEQVRYVVESTGAFTTTEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTDDFVKLVSWYD

SEQ ID NO: 61096 - protein, 394 aa, Synechocystis sp. PCC 6803
MSLNWISRADRLQALPPYVFARLDELKAKAREQGLDLIDLGMGNPDGKAPQPIIEAAIAELENPESHGYPPFEGTQSFRQSITRWYARQYGVDLDPDSEALPLIGSKEGLGHLALAYVNPGDLVLVPTPSYPAHFRGPLIAGAEIYPIMLSAKDDWLIQLDQIPEAIAQRAKILYFNYPNNPTTATAPREFYEAITDWARHYQIMLVHDLCYAELAFDGYQPTSLLEIPGAKDFSVEFHTLSKTYNMAGWRVGFVVGNQEIIQGLRTLKTNLDYGIFRVVQKAAETALSLPESYIEVVRKRYQERRDFVINGLSKLGWSITPSQATMYLWVPCPVGMSSTDFALTVLEKTGVVMTPGNAFGEGGERYVRLSLIADGDRLGEALQRIEQAGIRYS

SEQ ID NO: 61097 - protein, 357 aa, Leuconostoc mesenteroides subsp. mesenteroides ATCC 8293
MTSVKKIVVLKGDYIGPEIMTAGLAVLDAATKDTTFAYELIDAPFGGDGIDRAGDPLPQSTIDVSKQADAVLLSAIGGPKWDNAPRRPEQGLLEIRSKLNLFANIRPTKVTAAQIDRSPLKPEYVENTDFVIVRELTSGAYFGKPRKLEAHQAIDTMYYSEEEVTRIMHQGFKMAQKRNKHVTIVDKSNVLATSKFWRKIANEVGKSYQDVTIDYYYVDAMTMAIMAKPTTFDVVIIPNLFGDILSDEAAQITGSIGQIPSMSVGESGPNLYEPIHGSAPDIAGQGIANPISMVNTVAMMLTESFDEKRIADKITAAVDYIIENHCVTPDMGGTMTTDEVTQKMVDYIKNYESADIK

SEQ ID NO: 61098 - protein, 471 aa, Escherichia coli
MIIPIIMAGGSGTRLWPLSRSLYPKQFLSLINENSLLQETLKRLDGLNCLPPVIVSNNEHRFIVAEQLRQFGVDDFQIILEPVGRNTAPAVALAALKSLELHGDHHMLVLAADHAIQDIEAFHAAVLAAEQESVDNKLVTFGIVPTKPETGYGYIKKGEQVKNSVFKVNSFVEKPDLETAKNYLEQKCYLWNSGMFMFKASVYLDELKKFRPDILAACKESLSSASTDLDLIRLNSDVFAECPDESIDYAVMEKTQDCVVIPLDADWSDIGSWTSLWEISEKDEHENVSHGDVINYNSRNNYIYSEGSLISTVGVNNLIIVQTKDALLVAQQDNVQDIKKIVEILKKQKRSEHVSHREVYRPWGRYDSVERGDRYQVKRITVKPGECLSTQMHHHRAEHWVVVAGTAKVTCGERTFFVTENESTFIPIGTVHTLENPGKIPLEVIEIQSGVYLGDDDIVRLSDKYGRVEDK

SEQ ID NO: 61099 - protein, 424 aa, Thermobifida fusca YX
MTRELDVETIRADFPILSRTVRNERPLVYLDSGATSQKPRQVLDAEREFYERYNAAVHRGAHQLAEEATDAYEAARATIAAFVGAPADEVVFTKNATEAINLVAYAMSNAVTAGEEFSRFAVKPGDEIVVTEMEHHANLVPWQELCRRTGATLRWFGVTDEGRLDLSNLDDLINERTKLVALIHQSNVLGTVNPVQLIAERAHAVGALVLVDGAQSVPHMPVNVTELGVDFLVFSGHKMCGPNGIGVLWGRRELLCAMPPFITGGSMIGTVHMEHSTWADPPQRFEAGVPMAPQAVGLAAACDYLNSIGMDAIAAHEHALVEYALKHIGSIEGVRIVGPADAEARGGAVSFTVDGIHPHDVGQVLDDLGVAVRVGHHCAWPLHRRFEAVATTRASFYLYNSFADVDALAEGIREAQRFFGVARS

SEQ ID NO: 61100 - protein, 295 aa, Oryza sativa
MASAAVAADGAADGKKMILLVSSDGVKFELSEAAASLSKTLGNMIEDDCATNGAIPLANVAADILAMVVEYCNRHAAAAANASGQEELIRKFDAEFVNIDRKKLFGLINAANFLNMPCLLELTCQRTADLIKDMMPEQVREVFGIENDFTPEEEAEVRNENAWAYEIPAQSAAARARPLPLTAVAVAREGRRRVRRRVAVLVRPFVAAEDRRSVIAAVDPKVPAASSLSPSPSVGLPPPFWSPVSSPCRPLRLGALRLRPSAAVRRRACAARAVQAAEPPPPSVTSLPTSSGPFV

SEQ ID NO: 61101 - protein, 457 aa, Physcomitrella patens subsp. patens
MRRVFFDFIYVIEVFVSTIVHATYGLNLFLTVVWVDLMSGFMSSPQQSARVSPVIETGATETDDRETAPIVLVHGIFGFGSQKMGHLSYWGGAEKQDDRILAPDLGALSSIHDRACELFYYLKGGTVDYGAERSQKYGHSRFGHTYHQGHYPEWDSKHPVHLVGHSTGAQVIRLLQNMLADKCFPGHDSTSADWVLSVTSLSGALNGTTRVYYDGIRAEDGKSMKSFSLLQVLRVGVLLYEWLDIPFLKRYYDFGFDHYNLQWHKAGITGLLDTLFNRSGPFVHDNWVLPDLSIQSSVELNKKLRTFDKTFYFSYATKGTKRWFSLWTLPGSIFSTHPLLFIRSLQICLWRHPEDLPLPYEGYRDEDWQDNDGALNTISQLYPCLPCVHSNCELGADLNDLKDGRVLQPGIWYYSTLVADHIYFIINRERAGVHFDVLYDNIFQRCRKQIKPSLISS

SEQ ID NO: 61102 - protein, 408 aa, Leuconostoc mesenteroides subsp. mesenteroides ATCC 8293
MKTIRHDFPILNQTVNGQELLYFDSAATSQKPQYVIDSLVNYYQNNNANVHRGIYELSERATQQYEQARDKVQKFIHAQKREEVLFTRGTTESLNWLASTYGAENVKQGDEILISYMEHHSNIVPWQQLAQRVGAHLKYVELNDDGTLNMADLERKITDKTKIVSITHASNVLGVVNPIKKIAKIAHKHDAIMIADGAQSVPHMRVDVQDMDVDFFAFSGHKMLGPTGIGVLYGKHDILENMKPAQFGGEMIELVDLQEATFQPSPWRFEAGTPNIAGAIALGSAIDYLTNIGMKEVENYEQSLVDYALPKLKSIAGVTIYGPQNSEQHSGVIAFNLAGVHAHDLATALDQEGIEVRAGHHCAQPLMKYLNIAATVRISLYIYNTREEIDRFISVIEDIKEYFNREFA

SEQ ID NO: 61103 - protein, 612 aa, Mycoplasma penetrans HF-2
MKKNKVKIDKIPNYEDFKKMKLHELLDLAVLLRKKIIDISENKSAHLSSNLGIVELSMALLYVFDSPQDLIAYDTGHQCYVHKMITDRADKISTIRESNGLSGFQEPNESIHDFISTGHSGNILSICQGFIEKNNSKSKSVIPVIGDAAISNGLAFEALNNIAYNKTPMLIIINDNGMSISKNVGALHKIMSKFQMSKSVFLTEKILRKILFKKEWSKKIYWSIYKSFSKLSKFFKGKNFFESLGFHYFGVIDGNNLKKTINVLKRIKNIVPFGPTILHVKTIKGLGYKEAELDDKGLYHSLKLSDPNLNSNNQTYGSVAANFLEKLIEYDNNIQIINPAMTLSSNFLNLSKKFPNNYEDVGIAEEHAVTKAAGMAIANKKVFVSIYSTFLQRSYDNLLHDVARLELPITFLVDRCDLSYSDGDTHHGIYDIGFLKSIPNTIITCASNKFELERLIILAYQNKSNPFFIRYTKEKCEDIEVKKEFSFGSWVYALQTKESKTCIISYGDIINDLKKEIKTKSIDLINAVFITNYQKENVLRILSTYKNIYVVEKVFDSNCLGDDLIILANENKLSCNIKKINIRNNKIGFGNKEDIDKKLNIDMNSIFAEIKS

SEQ ID NO: 61104 - protein, 197 aa, Azoarcus sp. EbN1
MLFNVPNSLTWARIALIPLFVGVFYLPDSWLDAEEKNFAATIIFIIAAATDWFDGYLARALNQTSAFGAFLDPVADKLMVAAALILLVQLARVDSIIAVVIIGREITISALREWMARVGQSAGVAVAFVGKLKTAAQMTAIPLLLYNAPLLSLDLRVIGNVLIYIAAALTLWSMGYYLHRAMPQLARYDRDIRNKSG

SEQ ID NO: 61105 - protein, 136 aa, Zea mays
  misc_feature (33)..(33): Xaa can be any naturally occurring amino acid
  misc_feature (86)..(86): Xaa can be any naturally occurring amino acid
  misc_feature (104)..(104): Xaa can be any naturally occurring amino acid
  misc_feature (118)..(118): Xaa can be any naturally occurring amino acid
MASRWVLVGEVIGRLEKRGLYLLVLKLPKMEKXLVEQHCENLSFNTFAVVVQCMVSGLVVTKVCEGKKVVSAGRGIIGAAGPSGFXSATIRGVVAVDLCRNVIXGMYSVESSSKEISXWLGDGTAEWRSRSALLSL

SEQ ID NO: 61106 - protein, 504 aa, Rhodopseudomonas palustris CGA009
MQSRRPVMLVILDGWGWREDPADNAVLQAKTPTFDALWTNGPHAFLRTSGKSVGLPNGQMGNSEVGHLNIGAGRVVMQDLPRISDAIANGEIERAPGLVAFIDKLKASGGTCHLMGLVSPGGVHSLQDHACALAKILAKAGVKTVLHAFTDGRDTPPKSAVDDIVRLRAELPPNVPIATVSGRYYAMDRDNRWERVSKAYGVIADADGPRFADANAVIADGYAAGVNDEFIVPAVIGDYQGMRDGDGVLCFNFRADRVREILAALLDSAFAGFPRKQVKQIAAAAGMTQYSTALDALMGTIFPPQSLVNGLGQVVADAGLHQLRMAETEKYPHVTYFLNGGEEVPYPGEDRIMVPSPKVATYDLQPEMSAPELGDKAVAAIESGKYDLIVLNFANPDMVGHTGSLPAAIKAVETVDTQLGHIVAAIRKAGGALLVTADHGNCEMMRDPETGGPHTAHTTNPVPVLLVGDNGPLADGQLSDLAPTLLKLMELPQPAEMTGKSLIG

SEQ ID NO: 61107 - protein, 584 aa, Bartonella quintana str. Toulouse
MLHDTPLITTIVAGLCLAFLLGMVASRLRISPLVGYLLAGVLVGPNTGGFRIDSSIINQLAEIGVILLMFGVGLHFSLKDLLSVKAIAIPAALAQMAFSTFLGLCLGLIMGWGFSSSLVFGLALSTASTVILLRALQERHLIETEKGRIAVGWLIIEDLAMVLILVLIPSLANILGNTKKEAIDPVIKWLDPSIWGVFGLTILKVIVFIILMLVIGRRIIPWLLKVSAQSGSRELFRLSVFATALGVAFGAAHLFGVSLSLGAFFAGMVMSESELSHRAAEESLPLRDAFSVLFFVSVGMLFDPGKILSHFFPLLATLLIIIIGKSAVAFFIVKALRHSNAIACTISASLAQIGEFSFILASLSLNLGFLNNDAHDLILGGAILSILLNPLVFIAFDKIKKHLENLLTNLQDVQTIIDIDLKDPDQEFLPITSKTNHIVIIGYGRIGKCVALSLINKGELVVIVEESKRLADKAIADGLEVICGNIIKQDIMSAANISNAYKVVITMRSTIEVGECIVNIRNMKKDIQIITHALSDVETAYLIDLGADIVVTDDEEIANGIIEYITGQKSVKNMHNYELNLQKT

SEQ ID NO: 61108 - protein, 446 aa, Rhodopirellula baltica SH 1
MQPEHVAGANMPNAVGNHDPMMRQTVTVILAGGRGSRLEPLTRDRAKPAVPIGGAYRIIDFVLSNCLNSDMRRLLLLTQYKAQSLDRHINVAWRNYFCRELGEFIDVVPPQQRIDDNWYQGTADAVYQNIYAIEREAPEYVVILAGDHLYKMNYESMVNFHHRKGADVTVGALRVSREEARQFGVMQVDTDNRLVEFQEKPENPRPTLDDPDVCLASMGIYVFNTRFLFERLCDDATQPDSDHDFGKNIIPGAIEDSQVFAFPFTDENRKRDAYWRDVGTLEAYYEANMDLVGVDPQLNLYDRQWPIRSFQPQLPPPKFVFGSEGRSSRRGEALDSIVCQGAIISGGCVRRSVIGTGCRINSYAQVEDSILFDDVNVGRHSRIRRAIIDKGVQIPPETEIGYDLALDRARGLTVTDSGLVVIARGEMIASPVSTNGSHDPTSSLTS

SEQ ID NO: 61109 - protein, 181 aa, Triticum aestivum
MGLAFGKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDSVLLVFANKQDLPNAMNAAEITDKLGLHSLRQRHWYIQSTCATSGEGLYEGLDWLSSNIASKA

SEQ ID NO: 61110 - protein, 467 aa, Bartonella quintana str. Toulouse
MNCKQNLEENLQNKLQRGLDNRHVQLIAIGGTIGTGLFMGSGKTISVAGPSIILVYAIIGCALYFVMRAMGELLLSNSQYRSLIDFSTDILGPGIAFFAGWSYWLSWVVTGAADIIAIITYMHFWWPTLNPWIIVFACVTFFLTLNLLAVKMFGELEFWFGLIKVVAILALIIVGFYMIATGFTSPNGTVASLSHIWNDGNIFPRGITGFFAGFQIAIFSFVGIEIAGTAAAEVKEPKKVLPKAINAIPIRIVLFYIFSLVVIMSVTPWDQVIPDKSSFVTMFWLAGIPTAAGLVNFIVLTSAASSANSGIFSTSRMIYGLATQKGAPRLLGKLSNHHVPANALFFSCLCILLGYTIASLSPSIINAFTIVTSISAISFIFVWSVILVSYIVYRRNRPQLHIESIYKMPGGVIMCWIILAFFAFILYLLTLESDTLIAFKYSLLWFIFLGVTYFIMFVRKKTAQHTK

SEQ ID NO: 61111 - protein, 242 aa, Methanosarcina mazei Go1
MFPPEKMPFKGKITDITVPISPSTPIFPGDPEPSIESAFTIEKDGCAVSRLILGSHTGTHVDAPSHILKDGLAVDDLNLENLIGQAVVLDFSFRNGALTDYILDKAYNHLKNTDHVSILLLKTKPSFHYENNSRVSGLQAGESNKGIEFEEPPENSVYLDSGAAEWIVRNGFKTVGIDSFSVDNLSSENLSAHHILLSNNVNIVECLDMSSVEAGIYFFLCLPLKIEGCDGAPARALLIPYS

SEQ ID NO: 61112 - protein, 560 aa, Phytophthora bisheria
VGGNWKCNGSLGQAQELVGMLNTAKIPANVEVVVAPSQVHAATVKASLRSDVRVSGQDVWKQGNGAFTGETSAEMLKDLGAEYTLVGHSERREKGETNEIVAKKAAYALEKGLGVIACIGESKETREANQTVAYITEQLEAYAAEIKDWSHVVIAYEPIWAIGTGLTASPEQAQEVHASIRAWLKEKVSSEAADKTRVIYGGSVGAKNAPELSQKEDIDGFLVGGASLKPDFLQIINAQNPTTNVGGAVNVAINGFGRIGRLVLRAAATNPLINIVAINDPFISTTYMEYMLEYDTVHGKFAGSLSHDEKHIFVNGKPIRVFNEMNPEDIKWGEEQVQYVVESTGAFTTTEKASAHLKNGVEKVVISAPSSDAPMFVMGVNHELYEKEMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWYD

SEQ ID NO: 61113 - protein, 546 aa, Phytophthora capsici
QELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSSDAAEKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALTDDFVKLVSWYD

SEQ ID NO: 61114 - protein, 542 aa, Synechocystis sp. PCC 6803
MTTQIPVPPVVSDQALPDRISDRLKGQIIVILDFGSQYSELIARRIRETEVYSEVLSYRTTAQQLREIKPKGIILSGGPNSVYDQGAPECDPEIFQLGVPVLGVCYGMQLMVKQLGGRVERAKRGEYGKASLHIDDPTDLLTNVENDSTMWMSHGDSCVDLPTGFEILAHTDNTPCAAIADHQKALFGVQFHPEVVHSVGGIALIRNFVYHICHCEPTWTTAAFIEESIREVRSQVGDRRVLLALSGGVDSSTLAFLLHRAIGDNLTCMFIDQGFMRKGEPERLVELFDHQFHIPVQYVNARDRFLKQLEGVTDPEEKRRLIGHEFIQVFEEESNRLGPFDYLAQGTLYPDVIESADSNVDPKTGERVAVKIKSHHNVGGLPKNLRFKLVEPLRKLFKDEVRKLGRSIGLPEEIVRRHPFPGPGLAIRIIGEVTSERLNILRDADFIVRDEISKRGIYHDYWQAFAVLLPIRSVGVMGDKRTYAHPVVLRFITSEDGMTADWARVPYDILEAISNRIVNEVKGVNRVVYDITSKPPGTIEWE

SEQ ID NO: 61115 - protein, 171 aa, Gloeobacter violaceus PCC 7421
MIDLSKIPARPKEGLINVLVEIPGRSHNKFEFDKDLGIFTLDRVLYAAVYYPGDYGFVPNTLADDGDPLDGLVLMDEPTFTGCLIAARPIGVLGMIDSGEGDEKILCVPVKDPRYAGVKDLSDIAQHRLDEIAEFFATYKRLEKKVTEITGWQGVEVAQQLVDKAIAAYTP

SEQ ID NO: 61116 - protein, 437 aa, Physcomitrella patens subsp. patens
VTNCYRNHGSTFYFTVGRTVRLSIADPPLIKDILIANSESYSKPLHIRKLGVLGDGIFASSGSTWSPQRSLFTGAFHTKEVKSKIPTMIDCAHSAVEKWSRELNDGYSELDMYQKFAELTLDVIGKTAFGTEEIGGASEAASVIGSFNRYLLYCRELVFGPPATFPTSLNSHHSGAAETVSDRHDLLDVIIGAVDNIGHSEEGAKKALNEAPDQTISEKRKRAAEMTRLTEKQLLDNALTVLLAGHETTASLLTWTIYLLAKHPLWQKRARAEVEEFCPGGVVEPQVLSHLKLLGMILLESLRLFPPVPLIGRMCIKDNKVGPDLLIPEGLEIVIPVAVLHRDRTIWGDNADEFAPARFGNGISGACGNPLAFLPFGAGPRTCIGQTLALSEAKAVLAVMLPLFSWKLSTSYRHSPDVTLTMMPEFGMPVVLEKIEK

SEQ ID NO: 61117 - protein, 471 aa, Escherichia coli
MIIPIIMAGGSGTRLWPLSRSLYPKQFLSLINENSLLQETLKRLDGLNCLPPVIVSNNEHRFIVAEQLRQFGVDDFQIILEPVGRNTAPAVALAALKSLELHGDHHMLVLAADHAIQDIEAFHAAVLAAEQESVDNKLVTFGIVPTKPETGYGYIKKGEQVKNSVFKVNSFVEKPDLETAKNYLEQKCYLWNSGMFMFKASVYLDELKKFRPDILAACKESLSSASTDLDFIRLNSDVFAECPDESIDYAVMEKTQDCVVIPLDADWSDIGSWTSLWEISEKDEHENVSHGDVINYNSRNNYIYSEGSLISTVGVNNLIIVQTKDALLVAQQDNVQDIKKIVEILKKQKRSEHISHREVYRPWGRYDSVERGDRYQVKRITVKPGECLSTQMHHHRAEHWVVVAGTAKVTCGERTFFVTENESTFIPIGTVHTLENPGKIPLEVIEIQSGVYLGDDDIVRLSDKYGRVEDK

SEQ ID NO: 61118 - protein, 266 aa, Ehrlichia canis str. Jake
MSNLERSITIHNKEDFQYMRNAGKLAAEVLDFITSYVKPGVSTNELNNLCHDFIINAGAIPAPLGYRGYPKSICTSKNFVVCHGIPDDIPLKNGDIVNIDVTVIVDGWHGDTSRMYWVGEPSIKAKRLCEAAYKALMVAIEQVMPGQKLNQIGLAIEKEMKKYGYSIVRDYCGHGLGRVFHASPNVVHYYDPDDTVIIREGMFFTIEPMINAGKCNTMLNKKDGWTVTTRDLSLSAQFEHSLGVTENGVEIFTLSPQNMHYPPYMC

SEQ ID NO: 61119 - protein, 547 aa, Phytophthora fragariae
QELVGMLNTAKIPANVEVVVAPSQVHAATVKAALRPDVRVSGQDVWEQGNGAFTGETSAEMLKDLGAEYTLVGHSERREKGETNEVVAKKAAYALEKGLAVIACIGETKELREANQTVAYITEQLDAYAAEISDWTNVVIAYEPIWAIGTGLTASPDQAQEVHASIRAWLKEKVSVEAAEKTRVIYGGSVGAKNAPELSQKADIDGFLVGGASLKPDFLQIINAQNPTTNVGGAVNVAINGFGRIGRLVLRAAAKNPLINVVAINDPFISTTYMEYMLEYDTVHGKFDGSLSHDEQHIFVNGKPIRVFNEMNPSNIKWGEEQVRYVVESTGAFTTTEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTANVSVVDLTARLVNPASYDEIKAAIKSASENEMKGILGYTEEAVVSSDFIGDSHSSIFDAEAGIALTDDFVKLVSWYDN

SEQ ID NO: 61120 - protein, 340 aa, Synechocystis sp. PCC 6803
MFGLIGHLTSLEHAQAVAEDLGYPEYANQGLDFWCSAPPQVVDNFQVKSVTGQVIEGKYVESCFLPEMLTQRRIKAAIRKILNAMALAQKVGLDITALGGFSSIVFEEFNLKQNNQVRNVELDFQRFTTGNTHTAYVICRQVESGAKQLGIDLSQATVAVCGATGDIGSAVCRWLDSKHQVKELLLIARNRQRLENLQEELGRGKIMDLETALPQADIIVWVASMPKGVEIAGEMLKKPCLIVDGGYPKNLDTRVKADGVHILKGGIVEHSLDITWEIMKIVEMDIPSRQMFACFAEAILLEFEGWRTNFSWGRNQISVNKMEAIGEASVKHGFCPLVAL

SEQ ID NO: 61121 - protein, 334 aa, Thermobifida fusca YX
MAFNLRNRSFVKELDFTPQELMFLITLAADLKAAKYAGTEQPQLSGKNIALIFEKTSTRTRCAFEVAAHDQGAHVTYLDPSGSQIGHKESIKDTARVLGRMFDAIEYRGASQATVEELAEYAGVPVWNGLTDEWHPTQMLADFLTIMEHTDKPLREVTLAYMGDARNNLGNSLTVTGAMLGIDVRMVAPRELWPDEERVAAPARAIAETTGARVTFTDDIAEGLAGADFIYTDVWVSMGEPSEVWDERIRQLLPYQVNAEALKATGNPDVKFLHCLPAFHDLGTEVAREIHARTGLTALEVTDEVFESPASIVFDQAENRMHTIKALMVATLGR

SEQ ID NO: 61122 - protein, 320 aa, Leuconostoc mesenteroides subsp. mesenteroides ATCC 8293
MNTIKSLSKFLTKYFTFFVILVALLAIFIPGPGTTLATTKVGNLSAVSILLMIVLFGMGITLTPNDFKRVARNPLQVILGTIAHYIIMPFIAFLLVHLFGLTGAAAVGVILVGSAPSGTSSNVMSFLSGGDVALDVSIGLLSTLLAPVMIPTLLKLLAGKWVNVPFSSMFFSAFQIVVIPIVLGIIVHTIFKEHVQKVIEIMPLISQVAILVIILAVLSANSKTILAVSTLILVPVIILHNLLGYLLGYGFSKLMKMDTPQQKAITFEVGMQDSALASTLAISFFEPASAIAAVMFSVWHNISGSVLASLWKNHTEKAPD

SEQ ID NO: 61123 - protein, 99 aa, Physcomitrella patens subsp. patens
TDNDWTTGILGCMEDVPNCVFTMVCPCLAFGRVVEHLDDGNTPCITAALVWYVIQQLTSCGCVYSYGYRKKLRRKYNLPSRPLPDWFVHYFCWSCAICQ

SEQ ID NO: 61124 - protein, 173 aa, Zea mays
  misc_feature (73)..(73): Xaa can be any naturally occurring amino acid
  misc_feature (85)..(85): Xaa can be any naturally occurring amino acid
  misc_feature (123)..(123): Xaa can be any naturally occurring amino acid
MRSRLRLGYARIEQKMQRAVQAARPHGNDLKYAVLQHISAPKPAMLPAAFSSFMNASSARLEDRGFETATVAXMVLNVYKGKSSXDVSLGLWRTTEDSAYDAVKYMTQHSEGAWRLSNRTDKXIVDCTEERLSQKHRQGMSCKTTNAGDMMTDENRLSTVNTDTEVLQAMQLM

SEQ ID NO: 61125 - protein, 233 aa, Symbiobacterium thermophilum IAM 14863
MFSLFKRLRRDIEAVFERDPAARSVLEVLLCYPGLKAIWAHRVAHWLWQRNFKLLARVISQISRFFTQIEIHPGAKIGEGVFIDHGCGVVIGETAEVGNNVTIYQGVTLGGTGKEKGKRHPTIGDNVVIGTGARILGSFTVGANSRIGAGAVVLREVPPNSTVVGNPGRVVVQNGVRTDQLDMIHMPDPIANMFDQMQRQIDKLTQRIERLEEENRALRRLQEGLAHGHPHLQ

SEQ ID NO: 61126 - protein, 498 aa, Mycoplasma penetrans HF-2
MKMIKKTKITATLGPSITGKIFTLADFNKPENKGVIETAKKNLAALFDAGVNVVRFNFSHGDYEEQTIRLNLVREVAKEKGVNISTMLDTKGPEIRVYKTSEKEVEIKSDSKVRIYTTKKEIGTSEKFSVLDSTGTYNMAKDVQPGNTIFVDDGKLKLEVISSNVEEGIIETIARNTWILRENKRINLPDSNYSIPFMSDKDRNDIIFAIKNKFDYIAASFVNTGDNVREIKKILKEHGGEHIQIISKIETMTGIKSLDDIIDESDSIMVARGDLGLEVPYYDVPTYEKYIIKDCRHKGKTVIVATQMLDSLETKIQPTRAEVTDVFFAVERGTDCTMLSGETANGMYPINAVEVMAKIDVSSENFFDYGRAIDVYFKETPFMKEKVGTLATTIATLVAPKRVIDNHGFDYSSIVVFGNDTRLIQALSNIRCAAPIFFVTDKKEYATRFGLNYGVFVKVVDNVEHAIANKTEIIDAINSQLPEVKKTVVVINDSIYKH

SEQ ID NO: 61127 - protein, 471 aa, Escherichia coli
MIIPIIMAGGSGTRLWPLSRSLYPKQFLSLINENSLLQETLKRLDGLNCLPPVIVSNNEHRFIVAEQLRQSGVDDFQIILEPVGRNTAPAVALAALKSLELHGDHHMLVLAADHAIQDIEAFHAAVLAAEQESVDNKLVTFGIVPTKPETGYGYIKKGEQVKNSVFKVNSFVEKPDLETAKNYLEQKCYLWNSGMFMFKASVYLDELKKFRPDILAACKESLSSASTDLDFIRLNSDVFAECPDESIDYAVMEKTQDCVVIPLDADWSDIGSWTSLWEISEKDEHENVSHGDVINYNSRNNYIYSEGSLISTVGVNNLIIVQTKDALLVAQQDNVQDIKKIVEILKKQKRSEHISHREVYRPWGRYDSVERGDRYQVKRITVKPGECLSTQMHHHRAEHWVVVAGTAKVTCGERTFFVTENESTFIPIGTVHTLENPGKIPLEVIEIQSGVYLGDDDIVRLSDKYGRVEDK

SEQ ID NO: 61128 - protein, 157 aa, Symbiobacterium thermophilum IAM 14863
MLIGFGYDVHRLVPGRPLVLGGVEIPSKRGLEGHSDADVALHALMDALLGAAGLGDIGTHFPPTDPAWAGANSLDLLRRVVGLLAEEGYRPVNCDITVVAERPKIGPYVPAMRERIGAVLGVEPRRVSIKATTNEQMGFVGREEGIAAYAVALIAGR

SEQ ID NO: 61129 - protein, 557 aa, Glycine max
MESYALHSLSTSFSRFSQLHHPPPPVISRSQFNQSQSLSLRSPITISQRFSFPSSTFKFNPFSKPHYPIQASPSSPPPPPPPTPIQGAKPIPFIISISIGLIVRFLVPKPVQVTPEAWQLLSIFLSTIAGLVLSPLPVGAWAFLGLTASVVTKTLTFTEAFGAFTNEVIWLIVISFFFARGFVKTGLGDRIATFFVKWMGKSTLGLSYGLTFSEVLIAPAMPSTTARAGGVFLPIIKSLSLSAGSEPASPTSKKLGAYLIQNQFQSAGNSSALFLTAAAQNLLCLKLAEELGVIVPNPWVTWFKAASLPAIVCLLLTPLILYKLYPPVIKDTPEAPALAAKKLESMGPVTKNEWIMVGTMLLAVSLWIFGDTIGIASAVAAMIGLSILLLLGVLDWNDCLNEKSAWDTLAWFAILVGMASQLTNLGIVSWMSDCVADNLRSFSLSWPASLAVLQAAYFFIHYLFASQTGHVGALYSAFLAMHRAAGVPGILAALALGYNTNLFGAITHYSSGQAAVYYGAGYVDLPDIFKMGFIMAFINAIIWGGVGSVWWKFLGLY

SEQ ID NO: 61130 - protein, 380 aa, Cryptococcus neoformans var. neoformans JEC21
MWRPSISRVLFRPSFRKNLRLLCCPYKKTSRWAQSHCPSPSPISPPQSAILQSVPHALRQKHPITLWLFQYITDSELGHGAPLSITHPLLPDCDHLKQPPSSPISSTGSGSSSDAEDVWTCTCTSYYESEKQTYLCSAECGDLCDCVAQFGNFYSSTNPQTLKLDALPDNWPLVECSPSCLCGLSCSNRVTQQGVRTPLTIRPTPPKGYGLFYTPSTPQFLPRGAFISLYAGEYILPSEIRSRWSPRSTTDLASDKEGYGEEGQGNYVLSLRLPDQTIHIDPRWKGNVGRFLNHSCGANCVVHYVKWGRGRGWPRAAIFTNRDIHPEEELTFDYANASGEPQRAIQLIQESKTKEDTKGRTRCLCGAEQCRGWIPFDETL

SEQ ID NO: 61131 - protein, 367 aa, Zea mays
MGGVTSSVAAKMAFFPPTPPSYALVEDAGAGVTTLSGQPHRENVELLRFRTRKGNTLAAMYVRHPDAASTVLYSHGNAADLGHLYQLFLHLSFNLRVNILGYDYSGYGQSSGKPSEHNTYADIEAAYKCLIEKFGAKEEEIILYGQSVGSGPTVDLASRLSQLRAVVLHSPILSGLRVMYPVKRTYWFDIYKNIDKIPQVTCPVLIIHGTADEVVDWSHGKQLWELCKDKYEPLWLRGGKHCDLELFPEYIRHLKNFFHSLEKSPSHRQAWRENVDRIEPSRKSTDFFEPSRKSTDQRKKSRSTRDKTRNTEHRYSNVEKVDKLKISFDQFEKSRRSVDIFERPKRNIEQLDCGRKSVDRLDRIWAS

SEQ ID NO: 61132 - protein, 364 aa, Oryza sativa Japonica Group
MSSGGAKAYAAVVLIRIMYSGMHVMSKIALDQGMNPLVFLFYRHTTAALVLIPITFVLERRKAKPVTLKIAGKMFVHALYGVTACGDLFNLGLNYTSAASSSALYNVQPVVTFVLAVVFGMESMKLKKFHGNVKAAGILFCIAGVTILAFYEGPMFKSFNHHHLFQQGSSSSTSSSGDTHSKKQWAFGIFLMTLSNILAGLWTVLQGPLIEDTSKLMNTTLQICCASVQAFVVAVAAERDFSKWKLGWNVELGAVIYSGVVVTALSYYMQMWTIAKRGPVFLAMSMPLTFIFTIIMSSFILGDAVSLGSIFAGILLIGGLYNVLWGKNIEEKDEMNKIGASKTGLELELHDSEAQVPDDDAAKV

SEQ ID NO: 61133 - protein, 288 aa, Arabidopsis thaliana; identical to SEQ ID NO: 1204

SEQ ID NO: 61134 - protein, 502 aa, Alkalilimnicola ehrlichei MLHE-1
MKVVDVFKFRSPEIKALHLTWIAFFITFYVWFNMAPLATSMLRSVDWLTQDDIRLFAICNVALTIPARIIVGMALDRFGPRRVFSILMILMALPALAFAFGNNMTQLLISRLVLSSVGASFVVGIHMTALWFRPRDIGFAEGFYAGWGNFGSAAAAMTLPTIALTLFGGEDGWRWAMAVSALVMAGYGVFYWFAITDGPHATSHKRTRNAMAMEVSSWGDMIKLIICTLPLVGVLALLVWRIEQMGYLSTTGATILYLVIGGIVLYQVVQIFRVNVPILKKGVPKDDKYHFNSVIALNSTYFANFGAELAVVSMLPMFFEQTWGLGAAAAGAIAASFAFVNLVARPMGGLVSDRMGNRRFVMLCYMFGIGIGFVLMGLLDSNWPLIVAIAITIFTSFFVQGSEGATFGIIPSIKRRITGQISGMAGAYGNVGAVVYLTIFTFVTPTQFFFIIATGAFLSWLICLLLLKEPEGAFAEDYHVSSVDRMIEEEDLKRERQKAWAR

SEQ ID NO: 61135 - protein, 360 aa, Arabidopsis thaliana
MNEIHQPLARRVWRSNVDEEMARMAECLKRFPLIAFDTEYPGIIFRTYFDSSSDECYRAMKGNVENTKLIQCGFTLFNAKGEIGGVWEINFSNFGDPSDTRNELSIEFLRRHGLDLQKIRDEGVDMFGYGFFPKLMTVFRSQKHVEFVTFQGAYDFAYFLSILNHGKLPETHGEFATEVVKVFGQVYDTKVMAGFCEGLGEHLGLSKLAQLLQITRVGRAHHAGSDSLMTALVFIKLKHVYEDSRFARGLIYGIGKSNLVAAPAPAPVPEPTLPLMCQQNVASYPVFHNGYVQNYEQPQLVSYDPSGAPWAFCNATGTYVQLTHLPASTFAYPSQTPSATVDYLGPVPNYYNNNACYVVE

SEQ ID NO: 61136 - protein, 500 aa, Triticum aestivum
RASPPSESRAPLRAPQRSATRQHQARQGPRRMCNGGRGPPYWTAGVTSAPARQTPLFSGRPSGGLSDPNEVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAWRKIIWVLEDYYKNKSIEHILILSGDQLYRMDYMELVQKHVDDNADITLSCAPVGESRASEYGLVKFDSSGRVVQFSEQPKGDDLEAMKVDTSFLNFAIDDPAKYPYIASMGVYVFKRDVLLNLLKSRYAELHDFGSEILPRALHDHNVQAYVFTDYWEDIGTIRSFFDANRALCEQPPKFEFYDPKTPFFTSPRYLPPTKSDKCRIKEAIILHGCFLRECKIEHTAFSRLNSGSELKNAMMMGADSYETEDEMSRLMSEGKVPIGVGENTKISNCIIDMNARIGRDVVISNKEGVQEADRPEEGYYIRSGIVVIQKNATIKDGTVV

SEQ ID NO: 61137 - protein, 266 aa, Campylobacter coli RM2228
MRIKFNGKELDTKLSTSLDFFKSVSKNENDVWIINGFATKENIKIHENDELFCIERNALPPKDALDAMMRARHTPKLHDKLKISSVAVCGLGGLGSHIAINLARSGVGYLKLIDFDVVEPSNLNRQAYRVSDLGKFKTEALKEQISEINPYIKTEICTLKIDEENLPDLFKGIDIVCEAFDGALAKAMIAQNFHRFYKDTTLICASGLAGYGDSNSIQTRKIAKNFYVCGDLVNGAKVGNGLMAPRVNICAGHQSNLVLELLANKE

SEQ ID NO: 61138 - protein, 376 aa, Cucumis sativus
MAMHRYEHADDDAQTHLFPLDSLFCEEEKWEEEEDEADLEPTYHTHLFSLGFLEEDLSGDDERLLSMLSKETEQLKQSNLELEALLMDPSVSAARSSAIHWMLKVQSHYGFSTLTAILAIAYFDRFLLSFHFKSDKPWMNQLVAVTCLSLAAKVEEIQVPLLLDLQVEDAKYVFEAKTIQRMELLVLSTLQWRMHLVTPYSFLDHIVKRIGLKNNLHLEFFRRSEYLLLSLLSDSRFVGYLPSVLATATMMEVIDQIEPHKKLEHQDKLLGVVKMNKEKVQCCYDLVVEHSKAYNNGFYHPINPHKRKHEQQAPDSPNGVIDAGFSSDSSNDSWAFRATSVCSSPEPSFKKSKSEEPKMKFRSLNRAFLDIVGSPS

SEQ ID NO: 61139 - protein, 237 aa, Oryza sativa Japonica Group
MAGRGGGGELRLLGTWSSPWVIRVRVALGMKGLSYEYTEEDLSSKSDHLLRSNPVHEKVPVLIHGGRPVCESLVVLEYIDETWGATGTPQLLPADPYDRATARFWTNYVNDTFFPSWKVLFRSTAAEQRAEAFKNVVPRVEALERAFGECSKGKAFFGGDDAGLVDVALGSHLVWIKVVDEVAGANLLDEAKFPGLAAWAERFLAVDAVRQVMPDAGDVLKQYKGFLAKWTAGAGSS

SEQ ID NO: 61140 - protein, 400 aa, Ehrlichia canis str. Jake
MSEIQVKAENLGGESILEAPIRVSVNVGDTVKQGDMLFIIETDKTSLEIVSPEDGVIGEIFVTDEAMIQRGQVLCTINTVQSSAVESSDTSSAHNATTTAADCMQQFIQKKDAPSATKLMKENSIDRDQISGSGVSGRITKSDVLNYMKSTASEGSNINRLAVVSEGKREDRVKMSKIRQVIAARLKESQNTAAILTTFNEVDMKNVMDLRAQYRENFEKKYSIKLGFMSFFIKAVILALKELPVINAEISGNEIVYKHYYDIGIAVGTDKGLVVPVIRDADKMSFSELELTLAALGKKAREGKLEVSDMAGATFTITNGGVYGSLLSTPIINPPQSGILGMHSIQKRPVAVDDKTIEIRPMMYIALSYDHRIVDGQGAVTFLVRVKQYIEDPSRMFLEV

SEQ ID NO: 61141 - protein, 172 aa, Ehrlichia canis str. Jake
MHNIISYGIFVPNIDGTVFVASTASIVGSVYISKNASIWYNSVLRGDVGMISIGEGTNIQDNTVIHVDRNQGDTEVGKMVTIGHGCILHACQIHDYVFVGMGSIIMDKVIMEENTMLAAGSLVTKGKVIKSGELWAGRPAKFFRMLSEEELNHIKESADNYIRLSQEYLECR

SEQ ID NO: 61142 - protein, 195 aa, Glycine max
EHIAMVKGDIGDGHDVLVRVHSECLTGDIFGSARCDCGNQLALAMQQIEAAGRGVLVYLRGHEGRGIGLGHKLRAYNLQDDGRDTVEANEELGLPVDSREYGIGAQILRDLGVRSMKLMTNNPAKYVGLKGYGLTISGRIPLVSLITKENKRYLETKRVKMGHVYGSEFNSKLNHQDTGNGKANSDDDSNAAAGL

SEQ ID NO: 61143 - protein, 428 aa, Phytophthora nicotianae
  misc_feature (78)..(78): Xaa can be any naturally occurring amino acid
  misc_feature (363)..(363): Xaa can be any naturally occurring amino acid
AYITEQLDAYAAEIKDWTNVVIAYEPIWAIGTGLTASPEQAQEVHASIRAWLKEKVSPDAADKTRVIYGGSVGAKNAXELSQKEDIDGFLVGGASLKPDFLHIINAQNPTTNVGGAVNVAINGFGRIGRLVLRAAAKNPLINIVAINDPFISTTYMEYMLEYDTVHGKFDGSLSHDEKHIFVNGKPIRVFNEMNPANIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLXNPASYDEIKAAIKSASENEMKGILGYTEKAVVSSDFIGDSHSSIFDAEAGIALTDDFVKLVSWYD

SEQ ID NO: 61144 - protein, 541 aa, Nicotiana tabacum
AITGYGLGGSSMALFGRVAGGIYTKAADVGADLVGKVERNIPEDDPRNPAVIADNVGDNVGDIAGMGSDLFGSYAESSCAALVVASISSFGVNHEFTAMLYPLLVSSVGILVCLLTTLFATDFFEVKAVKEIEPALKQQLVISTALMTDGIAVVTWIALPSTFTIFNFGAQKEVKSWQLFLCVGVGLWAGLIIGFVTEYYTSNAYSPVQDVADSCRTGAATNVIFGLALGYKSVIIPIFAIAVSIFVSFSFAAMYGIAVAALGMLSTIATGLAIDAYGPISDNAGGIAEMAGMSHRIRERTDALDAAGNTTAAIGKGFAIGSAALVSLALFGAFVSRAAISTVDVLTPKVFIGLLVGAMLPYWFSAMTMKSVGSAALKMVEEVRRQFNTIPGLMEGTAKPDYATCVKISTDASIKEMIAPGALVMLTPLIVGILFGVETLSGVLAGSLVSGVQIAISASNTGGAWDNAKKYIEAGVSEHARTLGPKGSTAHKAAVIGDTVGDPLKDTSGPSLNILIKLMAVESLVFAPFFATHGGLLFKLF

SEQ ID NO: 61145 - protein, 536 aa, Phytophthora ramorum
QELVGMLNTAKIPAGVEVVVAPSQVHAATVKASLRADVRVSGQDVWKQGNGAFTGETSAEMLKDLGAEYTLVGHSERREKGETNEVVAKKAAYALEKGLAVIACIGETKELREANKTVAYITEQLDAYAAEINDWTNVVIAYEPIWAIGTGLTASPEQAQDVHASIRAWLKEKVSPEAAEKTRVIYGGSVGAKNAPELSQKEDIDGFLVGGASLKPDFLQIINAQNPTENVGGPVNVAINGFGRIGRLVLRAAAKNPLINIVAINDPFISTTYMEYMLEYDTVHGKFDGSLSHDEQHIFVNGKPIRVFNEMNPTNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDASAGIALTD

SEQ ID NO: 61146 - protein, 194 aa, Lactobacillus sakei subsp. sakei 23K
MNLPNKLTMFRIILIPIFTILLAFNVPAGEVLVAGTAIPVSELIATVIFIVASLTDLLDGKIARSQHLVTNFGKFADPLADKLLVMTAFIFLVELGAAPAWVVAIIIWRELAVTGLRLLLSQGGEVMAAAMPGKIKTTTQMLAIILLFLHNVFFANIGLPMADIMLYVCLFFTIYSGTEYFIKNRGIFKDSFSK

SEQ ID NO: 61147 - protein, 519 aa, Physcomitrella patens subsp. patens
MAPSPIQEAPTREAERVSVHVSPRRRLPDFLQSVNLKYVKLGYHYLITHLLTLLFIPLLLAILLEAGRMGPEDLWQLWENLQFNLVSVIACSALLVFVGTVYFMSRPRPIFLVDFACYLPDEKLQVSVPLFMERTRLAGFFDEKSMEFQEKILERSGLGAKTYLPAAMHSLPPCPSMKAAREEAEQVMFGCLDELFEKTKIKPKDVGVLVVNCSLFNPTPSLSAMIVNKYHMRGNIRTYNLGGMGCSAGVIAIDLARDMLQVHGNTYAIVVSTENITQNWYFGNRRSMLIPNCLFRVGGAAILLSNKRRDGSRSKYQLNHVVRTHKGADDKCYNCVYQEQDEQGNMGVSLSKDLMAIAGETLKANITTLGPLVLPLSEQLLFFSTLVARKVFNMKVKPYIPDFKLAFDHFCIHAGGRAVIDELEKNLQLTPGHCEPSRMTLHRFGNTSSSSIWYELAYMEAKGRMRRGNRVWQIAFGSGFKCNSAVWQALRNIKPSEKSPWAHCIDEYPQHVDDIQKVS

SEQ ID NO: 61148 - protein, 765 aa, Nicotiana tabacum
MGAALLPDLGAEIVIPVCAVIGIVFSLVQWYLVSNVKLTPESSSPSNNGKNGYGDYLIEEEEGINEQNVVVKCAEIQNAISEGATSFLFTEYQYVGIFMIAFAILIFLFLGSVEGFSTKSQPCTYNKEKLCKPALATAIFSTVSFLLGAVTSVVSGFLGMKIATYANARTTLEARKGVGKAFIVAFRSGAVMGFLLAANGLLVLYIAINLFKLYYGDDWEGLFEAITGYGLGGSSMALFGRVGGGIYTKAADVGADLVGKVERNIPEDDPRNPAVIADNVGDNVGDIAGMGSDLFGSYAEASCAALVVASISSFGINHEFTAMLYPLLISSMGILICLITTLFATDFFEIKAVKEIEPALKNQLIISTALMTVGIAIVTWTCLPSSFTIFNFGAQKVVKNWQLFLCVAVGLWAGLIIGFVTEYYTSNAYSPVQDVADSCRTGAATNVIFGLALGYKSVIIPIFAIAIAIFVSFSFAAMYGIAVAALGMLSTIATGLAIDAYGPISDNAGGIAEMAGMSHRIRERTDALDAAGNTTAAIGKGFAIGSAALVSLALFGAFVSRAAITTVDVLTPQVFIGLIVGAMLPYWFSAMTMKSVGSAALKMVEEVRRQFNTIPGLMEGTAKPDYATCVKISTDASIKEMIPPGALVMLTPLIVGIFFGVETLSGVLAGALVSGVQIAISASNTGGAWDNAKKYIEAGASEHARTLGPKGSDPHKAAVIGDTIGDPLKDTSGPSLNILIKLMAVESLVFAPFFATHGGLLFKIF

SEQ ID NO: 61149 - protein, 507 aa, Glycine max
MDLGHQNIPSLAILPFFLFMFTVFSLFWRTKTKPSNSKLPPGPPKLPLIGNLHQLGAMPHHGLTKLSHQYGPLMHIKLGALSTIVVSSPEMAKEVLKTHDIIFANRPYLLAADVISYGSKGMSFSPYGSYWRQMRKICTFELLTPKRVESFQAIREEEASNLVREIGLGEGSSINLTRMINSFSYGLTSRVAFGGKSKDQEAFIDVMKDVLKVIAGFSLADLYPIKGLQVLTGLRSKVEKLHQEVDRILEKIVRDHRDTSSETKETLEKTGEDLVDVLLKLQRQNNLEHPLSDNVIKATILDIFSAGSGTSAKTSEWAMSELVKNPRVMEKAQAEVRRVFGEKGHVDEANLHELSYLKSVIKETLRLHIPVPFLLPRECSERCEINGYEIPAKSKVIINGWAIGRDPNHWTDAKKFCPERFLDSSVDYKGADFQFIPFGAGRRMCPGSAFGIANVELLLANLLFHFDWNMPNGKKPEELDMSESFGLSVRRKHDLYLIPSICLSFGN

SEQ ID NO: 61150 - protein, 389 aa, Symbiobacterium thermophilum IAM 14863
MSAELIYLDNAATSWPKPAAVVRAMAECLENEAGNPGRSGHRLSLAAGRRVWAVRQAVAELFGAPDPLRVIFTHNGTMAVNLALGGLLSPGDRVVCTGMEHNAVIRPLRDLEELGIEVVIAPCDSEGRLDLEAFRRVVEAAPTRMVALNHASNVTGTICPVAEAAAIAHRAGALVLVDAAQSAGSVPIDMGAMGIDLLAFTGHKGLLGPTGTGGLILGERVNAAEMKPLVRGGTGSRSAMERQPPDLPDRFEAGTVNFVGIAGLGAGIQALAELGGPEEIGRRERQLARQLWEGLSEIPGVRLYGPADFSQRVAVVSFTVEGRTVSEVGGRLDEEFGILARVGLHCAPVAHRTLGTFPQGTVRLSPGPFNTPEQIARAVAAVRRLAEGA

SEQ ID NO: 61151 - protein, 180 aa, Brassica napus
  misc_feature (172)..(172): Xaa can be any naturally occurring amino acid
MAGEGEEDVPRDAKIVKSLLKSMGVEDYEPRVVHQFLELWYRYVVEVLTDAQVYSEHASKSTIDCDDVKLAIQSKVSFSFSQPPPREVLLELAASRNKIPLPKSIAGPGIPLPPEQDTLLSPNYQLVIPKKSASTEPEETEDDEEMADPAQSSSQEQQTSELPSQTPQRVSXFPLSRRPK

SEQ ID NO: 61152 - protein, 314 aa, Pyrococcus furiosus
VVSLAGRDLLCLQDYTAEEIWTILETAKMFKIWQKIGKPHRLLEGKTLAMIFQKPSTRTRVSFEVAMAHLGGHALYLNAQDLQLRRGETIADTARVLSRYVDAIMARVYDHKDVEDLAKYATVPVINGLSDFSHPCQALADYMTIWEKKGTIKGVKVVYVGDGNNVAHSLMIAGTKLGADVVVATPEGYEPDEKVIKWAEQNAAESGGSFELLHDPVKAVKDADVIYTDVWASMGQEAEAEERRKIFRPFQVNKDLVKHAKPDYMFMHCLPAHRGEEVTDDVIDSPNSVVWDQAENRLHAQKAVLALVMGGIKF

SEQ ID NO: 61153 - protein, 562 aa, Cryptococcus neoformans var. neoformans B-3501A
MADLDKVLELLNNLTVKQEQLAQELKNHTCSCGAQYHYDPTAHHSPPTSPTAGGVDTFRASRGSISSLSALLGSSPTSTSGFSPAPNGVVNSSGASNGSSTPYGNLSLDAAARGSGAPGGLVPPEKDAKKKHKGLYPSRVILTTYPSQAGINPIPINWGAGPTARERGPVVCSRIKSNLPIRNAIGAHAGSYSIYRALSIAMGQLRPDWRPDLTNTHPPFVLPPTDGWFGNKIVSFDPWGAMSQEVWAKEYAAGLDVRPTISQTKAHIKIQELDELFRKGEFPCDGEIVIKSPDLPAFPGADQGIEVNTYKAAIDPVWYLPGVADRLGIEEGVLRRALFEDTGGMYPELLTRPDIKTFLPPIGGMTVYIMGDPAKLQDPDTEVTCRPHDSCSGSDVFGSDICTCRPYLIFGISEAIKCAQRGGVGVIVYFQKEGRALGEVVKYMVYNRRKRGGDTAAEYFNNTERVAGVKDARHQALMPDVLHFLGIKHIHNLISMSNMKYDAIIGSGITVGKRYEIPEELIPADGRVEIDAKIQSGYFSKKEVTEELVKETKGRNWEDIIH

SEQ ID NO: 61154 - protein, 525 aa, Alkalilimnicola ehrlichei MLHE-1
MTQDIHAHRILILDFGSQYTQLIARRVREAGVYCEIYAWDAPETAIRDFGAAGFILSGGPESMTVDNGPRVPEAVFQAGVPVLGICYGMQAMAGQLGGRVEASDHKEFGYARVRARGHSRLLRDIEDHASPEGWGLLDVWMSHGDRVTGLPPGFKLIASTESCPIAGIGDDERGYYGVQFHPEVTHTPQGARILSRFVHEICGCPADWTPGNIVDDLIERVRRQVGGDKVLLGLSGGVDSSVVAALLHRAIGDQLTCVFVDNGLLRKDEGDQVMATFARHMGVNVIRVDAEARFLEALKGVDDPERKRKIIGNMFIEVFDEQAARLTEVDWLAQGTIYPDVIESAGSATGKAHVIKSHHNVGGLPEDMTLKLVEPLRELFKDEVRRIGLELGLPADMVYRHPFPGPGLGVRILGEVRKEYADLLREADAIFIEELRAHDLYDQVSQAFAVFLPVKSVGVTGDGRRYEYVVALRAVETIDFMTARWAHLPYEFLDHVSRRIINEIPGISRVAYDISGKPPATIEWE

SEQ ID NO: 61155 - protein, 125 aa, Zea mays
MAAASGRAPSACALLLLLVVGGAAAVVVDANRGEQEQDRDWEQLSAASPSPWRSPAPAPSPVSFIDCGSACGARCALSSRWNLCRRACGSCCARCNCVPPGTAGNHDVCPCYAAITTRGGRPKCP

SEQ ID NO: 61156 - protein, 313 aa, Gibberella zeae PH-1
MSEHLAVISSKSQFDSLLKSSRIVVADFYADWCGPCKQIAPLYESLAITLSRPNLVTFAKINSDEQAELSQEYSVSTLPTFLVFRDGKEIDKVQGADPNKLKAIIQKLVTEVDSLGESSGSGSGDGVNWKGAEAPRGYSDITDQIELRDLEVLNADEAAGGVRVLFEGSKPSGLGNGKGTSKDYVQSGADDQLLLYVPFQSILTSLPPKDDEDVMRPGNVHLYINRTHNLDFSEADDTDPTQAIEIGPEDWNADGTVNLSLRYVKFQKTSSLVIYVQQGEGDGETVRLDRVRLIGEAGAKREMGKLQKVGEDE

SEQ ID NO: 61157 - protein, 321 aa, Arabidopsis thaliana
MKKIQIGAVALLVFLSVVSLFEIGLASPNTVPAFLWSPHLQSANGELDEAVNYQVMSAKDLVGSVFTQGGWSNFLCSEKKLEQPVDVALVFIGRELLSSDVSSKRNSDPALVNTLNNLFTASNFSLAFPYIAAPEEERMENLLLSGLKEACPNNVGVSNIVFSDSCFVEDGTIQKLSDLQSFKDHLLARRETRKEGETDLVVLCSEGSESNSQAGQSHSERESFLELVSSVEQSGSKYTALYVSDPYWYTSYKTLQRFLAETAKGNSTPEIATGCDELCKFKSSLLEGILVGIVFLLILISGLCCMAGIDTPTRFETPQDS

SEQ ID NO: 61158 - protein, 387 aa, Zygosaccharomyces rouxii
DPRVLDTMLKFYTGLYGNPHSNTHAYGWETNKEVENARKNVANVINADPKEIIFTSGATESNNMVLKGVPRFYKRSKKHIITTRTEHKCVLEAARAMVNEGFDVKFLNVDNEGLVNLKELEEAIRPDTCLVSVMAVNNEIGVMQPLKEIGSICKKHKVYFHTDAAQAYGKVPIDVNEMNIDLLSVSSHKIYGPKGAGAVFVRRRPRVRLDPILSGGGQERGLRSGTLPPPLVAGFGEAARLVVQENDADIAHIKRLSEKLTKGLLSIPDTSLNGSAEHRYPGCVNVSFAYVEGESLLMAMRDIALSSGSACTSASLEPSYVLHAIGKDDALAHSSIRFGIGRFTTEEEVEYVVDAISKRVKFLRELSPLWEMVQEGIDLNSIEWSGH

SEQ ID NO: 61159 - protein, 185 aa, Ehrlichia canis str. Jake
MVDDFRRTLPNLLTILRVFAIPAIVCSFYIGDNNSNYIAFIIFIFACVTDFFDGYLARIWKTQSKFGKLFDPIADKLIVAATVIMLIYIGKITGITIIPVVIIICREILISGLREFLISMNVELPVIKLGKIKTFIQMAAIAMLMLNDSLILYIGEVILYFAAALTIYSAYLYVCIAIKYICLQK

SEQ ID NO: 61160 - protein, 532 aa, Phytophthora nicotianae
LVGMLNTAKIPADVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVTYITEQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLHIINAQNPTTNVGGAVNVAINGFGRIGRLVLRAAAKNPLINIVAINDPFISTTYMEYMLEYDTVHGKFDGSLSHDEKHIFVNGKPIRVFNEMNPANIKWGEEQVQYVVESTGAFTTLEKASAHMKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLMNPASYDEIKAAIKSASENEMKGILGYTEKAVVSSDFIGDSHSSIFDAEAGIAL

SEQ ID NO: 61161 - protein, 552 aa, Bradyrhizobium japonicum USDA 110
MSCKPGFSERARRARARPKRARIRMRNFHFPGRSTVHATNAMVATSHPQASLAAIEVLREGGTAVDAAVAGSAVLGVIEPQSTGIGGDCFALIQPRGEGKIIAYNGSGRAPKAANAHWYLERKITSVPLTSAHAVSIPGVIDAFATVLRDHGKFGFDRLLQPAIKAAEEGYVVAPRIAFDWKNQFEKLKGGTNTVRYLLPGGKPPVAGDIIRQAELGKTLRAIAKDGRDAFYKGAIAEDMVETLRGIGGLHTLDDFAAHTTEVTTPIGTMYKGYDVWQCPPNGPGVTALLMLNILSRFDLTKYAPVSVERFHLEAEAARIAYMNREMHVASPDHMKINVAEMLEKGFADEYISKIRMDGMLDLPNVAPPMNPSTIYITVVDKDRNVCSFINSVAHSFGSAIVSNKTGVLLQNRAGGFRIQPGHPNCIEGGKRPLHTIMPGLLTKGGRSTMPFAVMGGQYQPTGQTHLLTNILDYGCDVQEAIDMPRGLHYEGQYQLEDSVPADIVEGLKKLGHKTTSVVGPLGGAQAIWIDWDKGTLTGGSDPRKDGCALGY

SEQ ID NO: 61162 - protein, 546 aa, Phytophthora bisheria
QELVGMLNTAKIPANVEVVVAPSQVHAATVKASLRSDVRVSGQDVWKQGNGAFTGETSAEMLKDLGAEYTLVGHSERREKGETNEIVAKKAAYALEKGLGVIACIGESKETREANQTVAYITEQLDAYAAEIKDWSHVVIAYEPIWAIGTGLTASPEQAQEVHASIRAWLMEKVSSEAADKTRVIYGGSVGAKNAPELSQKEDIDGFLVGGASLKPDFLQIINAQNPTTNVGGAVNVAINGFGRIGRLVLRAAATNPLINIVAINDPFISTTYMEYMLEYDTVHGKFAGSLSHDEKHIFVNGKPIRVFNEMNPENIKWGEEQVQYVVESTGAFTTTEKASAHLKNGVEKVVISAPSSDAPMFVMGVNHELYEKEMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKDASESEMKGILGYTEEAVVSSDFIGDSHSSIFDAEAGIALTDDFVKLVSWYD

SEQ ID NO: 61163 - protein, 433 aa, Porphyromonas gingivalis W83
MTIDEMLRLDRNHLWHPYTSTIDPLPVFPVKRAEGVRIYLEDGRELIDGMSSWWAAIHGYNHPRLNAAVERQLREMSHIMFGGFTHRPAVELAELLLSILPSELNKIFYADSGSVAVEVAMKMALQYQQACGQSRRTRFATIRSGYHGDTWHAMSVCDPVTGMHGIFSGALPVQYFLPQPKSRFGGEWLPADIEPLRDLLSAKGAELAALILEPIVQGAGGMYFYYPRYLVEARRLCSEAGVLLIFDEIATGFGRTGELFALRHAATVPDILCLGKSLTGGYMTLSATITTEAIARTICSGEAGCFMHGPTFMGNPLACAVAAESIRLLLESPWQERVRAIEAQLREELSPAISFDGVAEVRVLGAIGVVEMKRPVDMATLQQRFIREGIWVRPFGRLCYLEPPFIISPEDLRILTHGLLRVLGQDRSISFTR

SEQ ID NO: 61164 - protein, 541 aa, Phytophthora phaseoli
LVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIQWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEITAAIKSASENEMKGILGYTEKAVVSSDFIGDSHSSIFDAEAGIALTDDFVKLVS

SEQ ID NO: 61165 - protein, 744 aa, Oryza sativa Japonica Group
MATHERKTIDLEQGWEFMQKGITKLKNILEGKPEPQFSSEDYMMLYTTIYNMCTQKPPHDYSQQLYEKYRESFEEYITSMVLPSLREKHDEFMLRELVKRWSNHKVMVRWLSRFFHYLDRYFISRRSLPQLSEVGLSCFRDLVYQEIKGKVKSAVISLIDQEREGEQIDRALLKNVLDIFVEIGLTSMDYYENDFEDFLLKDTADYYSIKAQTWILEDSCPDYMLKAEECLKREKERVAHYLHSSSEQKLLEKVQHELLTQYASQLLEKEHSGCHALLRDDKVDDLSRMYRLFSRITRGLEPVSQIFKQHVTNEGTALVKQAEDAASNKKPEKKEIVGLQEQVFVRKIIELHDKYVAYVTDCFQGHTLFHKALKEAFEVFCNKGVSGSSSAELLATFCDNILKKGGSEKLSDEAIEDTLEKVVRLLAYISDKDLFAEFYRKKLARRLLFDKSANDEHERSILTKLKQQCGGQFTSKMEGMVTDLTVARDHQAKFEEFISTHSELNPGIALAVTVLTTGFWPSYKSFDINLPAEMVKCVEVFKEFYQTRTKHRKLTWIYSLGTCNINAKFEAKTIELIVTTYQAALLLLFNGVDRLSYSEIVTQLNLSDDDVVRLLHSLSCAKYKILSKEPNNRSISPNDVFEFNSKFTDKLRRLKIPLPPVDEKKKVVEDVDKDRRYAIDASIVRIMKSRKVLGHQQLVMECVEQLGRMFKPDFKAIKKRIEDLITRDYLERDKDNPNVYRYLA

SEQ ID NO: 61166 - protein, 541 aa, Phytophthora brassicae
LNTAKIPANVEVVVAPSQVHAATVKAALRADVRVSGQDVWQQGNGAFTGETSAEMLKDLGAEYTLVGHSERRENGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWYDN

SEQ ID NO: 61167 - protein, 157 aa, Porphyromonas gingivalis W83
MKIVLLVVGKTDSKLMVQATEEYIRRLSHYVSFEVEVIPDVRLGSKLSSEQQKDAEGREILARLRPSDSTVLLDERGREYSSMEFSAFLQKKMLIGTRRMVFVIGGPYGFSPAVQEAVTDRISLSRMTFSHQMIRLFFTEQVYRAMTILNHEPYHHE

SEQ ID NO: 61168 - protein, 390 aa, Symbiobacterium thermophilum IAM 14863
MAVVQLARGRHRRVQAGHPWIFQGEVEEIRGEFAPGDVVTVVDFRGRLLGKGYINPASQILVRMLTAHDEPVDREFFRRRLERAWAYRQKLLPDTGACRVVFGEADFLPGLIVDKFGDILVVQTLALGIDKWLPDIVDILVDLLRPRGIYERNDVPVRRLEGLEERKGFLRGEFDPRITIVENGLEIAVDVAEGQKTGYYLDQRENRHAVRRYAAGGRVLDCFCNVGGFALNAAAAGAREVVAVDASAEAIAAAEENAARNGLRDRIRFQVGNAFDILRQMEAQRERFDVIVLDPPAFAKNKAALEGAARGYKEINLRALRMLTEGGFLVTCSCSYHMTPDLFKAVVAEAAQDARRRLRLVEERAQAVDHPIVVGYDESHYLKCLIYEVI

SEQ ID NO: 61169 - protein, 434 aa, Bradyrhizobium sp. BTAi1
MAIIVASEPNEPKRSARSLFRLLGPGLVTGAADDDPSGIATYSQAGAQFGYGLLWTVFLTTPFMIAIQLVSARIGRVTGKGLAANISSLAPRSIVLGLVALLVGANTFNIAADIAAMAESLSLVIGGLNHEHALIFAAASTLLQVFLPYRRYAPFIKVLTLSLFAYVATALTVKVPWSTALLAAVWPSPSTDPDYLLTVVAVLGTTISPYLFFWQASQEVEEMNQGKVDRPLRELSRKNHPELRRMRIDTAIGMIFSNAIAFFVILTTATVLHAHGVTKIDSATQAAEALRPLAGDFTFLLFALGIIGTGMLAIPVLAGSAAYGVAEVFGWHATLEAKPDEAAGFYSIIAAATLIGFGLGFTGIDSIHMLVWSAVLNGIVAVPIMAMMMVIVSNGRLMGRFRARSWLIALGWIGTAIMAIAVLALLWSFAAGRA

SEQ ID NO: 61170 - protein, 543 aa, Bradyrhizobium sp. BTAi1
MTAPTLPTYSPRGLALLRDPLLNKGTGFTEQERDALGLRGFLPAGVLSMQAQAERILVNLRSLPSDLEKYVALNALHDRNEALFFRVVCDNIDEIQPLIYTPTVGLACQKYGLIFQRPRGLFISANDRGRIAEILANWPYRAKLIVVTDGERILGLGDLGANGMGIPVGKLSLYSACAGIHPEECLPVMLDVGTNNEEFLKDPYYIGLRQKRITGAAYDEFVDEFMTAARAAFPGVLIQFEDFANHAAFKLLHKYRDDACVFNDDIQGTAAVALAGLFSALRITGGRLRDQRVLFLGAGEAATGIADLVVSAMMAEGLSEAEALQRNWLTDSRGLVVKGRENLHGHKLRYAHEQAPIGDFLTSIRTLKPTAIIGVAAVGGAFTPEVLQAMAELNERPIIFALSNPTSKAECSAEAAYRYTQGRALFACGSPYDPVKLDGKTFVPRQGNNSYIFPGVGLGAIASGARLVTDEMFMAAAHTLANCVTGADLEQGSLYPALPRIREVSALIGAAVAGVAYQNGLASGPAPNDLLGFVEQKMYDPRY

SEQ ID NO: 61171 - protein, 509 aa, Gossypium hirsutum
MAINPSLLFLSLLFLFNGCLARQTFSSQQSQNECQINRLRASAPQTRIRSEAGTTEWWNPNCQQLRCAGVSVMRQTIEPNGLVLPSFTNAPQLLYIVQGRGIQGIVMPGCAETFQDSQQWQHQSRGRFQDQHQKVRRFRQGDIIALPQGVVHWSYNDGNERVVTINLLDTGNSANQLDNIPRRFHLAGNPEEEQRQLRRLAQQMQGRSERGEESEEEEGEGEEEEEEDNPSRRSRHQEEEEQGRESSSCNNLLCAFDRNFLAQAFNVDHDIIRKIQRVRGNRGTIIRVRDRLQVVTPPRMEEEEREERQQEQRYRHTRGGSQDNGLEETFCSMRIKENLADPERADIFNPQAGRISTLNRFNLPILQRLELSAERGVLYNRAGLIPQWNVNAHKILYMLRGCARVQVVNHNGDAVFDDNVEQGQLLTVPQNFAFMKQAGNEGAEWISFFTNSEATNTPMAGSVSFMRALPEEVVAASYQVSREDARRIKFNNKNTFFFTPSQSERRADA

SEQ ID NO: 61172 - protein, 145 aa, Triticum aestivum
  misc_feature (30)..(30): Xaa can be any naturally occurring amino acid
  misc_feature (40)..(40): Xaa can be any naturally occurring amino acid
  misc_feature (71)..(71): Xaa can be any naturally occurring amino acid
  misc_feature (73)..(73): Xaa can be any naturally occurring amino acid
  misc_feature (79)..(80): Xaa can be any naturally occurring amino acid
  misc_feature (83)..(83): Xaa can be any naturally occurring amino acid
  misc_feature (90)..(90): Xaa can be any naturally occurring amino acid
  misc_feature (96)..(96): Xaa can be any naturally occurring amino acid
  misc_feature (109)..(109): Xaa can be any naturally occurring amino acid
  misc_feature (111)..(111): Xaa can be any naturally occurring amino acid
  misc_feature (113)..(113): Xaa can be any naturally occurring amino acid
MASSSDPWMKEYTEASKLVDDISSMIADRXSLPQSGPEIXRHTSTIREKNNILGTRLGYLGDMLSKIPPKXLXGQGEHXXKDXFPFGNLXQNRGDXFNVSNFPNRKFLXRXRXTDDMTRRQQGLQRNFEKQIRKGEEPTQNIITS

SEQ ID NO: 61173 - protein, 749 aa, Physcomitrella patens subsp. patens
MSARPKSYIVSMVRDAKPDIFVNSHGWFSSVLRTAKLDASQGPLHLYSTVFHGFSATLTEEQARVMESMPGVNGVFPDTKKQLHTTHTPEFLGLNGSIGLWPSSKFGEDVIVAVLDTGIWPEAFSFADHSVGPVPRRWKGACEIGTGFNSTVCNRKLIGARSFSKGYEAMTGPINETMEPRSPRDTDGHGTHTASTAAGHYVYKASLLGYAEGTARGMAPRARIAAYKVCWTQGCFDSDILAAFDQAVADGVDVISLSVGGGVVPYYLDSIAIGAFGAMKKGIFVACSAGNSGPDPITVANVAPWITTVGASTLDRDFPANVVLDNGDTIKGVSLYSGKGLGTTPYPLIYAQDAGFKNNGSDTYSASLCLAGSLDPNLVKGKIVLCDRGNNPRVAKGGVIQAAGGVGMILANTATDGEGLIADSHVLPATAVGALEGNLIKAHIRNSKNPTATVTFGGTQFNTRATPVVASFSSRGPNSETPEILKPDLLGPGVNILAAWTGDMGPTGLPLDTRRVRFNIISGTSMSCPHVSGLGALVKDAHPTWSPAAIKSALMTTASIFDSTDSVLLDEATGNMSSPFGFGAGHVRPDRALDPGLVYDLAPQDYVNFLCGLNYTDKIIQLISHDLSTCPTNPPKPQDLNYPTYSVVFDQSTSKVLATTLTRTVTNVGPARSTYRSTVVSPSGVSISVRPAILQFSAVNQKKTFTVHISTSPTGLVPGESETVFGFLTWSDNTRLVQSPIAITRAEAY

SEQ ID NO: 61174 - protein, 535 aa, Cryptococcus neoformans var. neoformans B-3501A
MDMYFPDHTPTPLPQIEQIYDTVNKRFDSGVTCSLAYRLFNLKQLAYLIKDNEALIRAAVENDQGKGPFDVTIGELWPALNEIDLAVKNVENWMKDESRTADAILSMKAMPSRVKKQPKGVALIISTWNYPWQLSLCPLVGAISAGCPAILKLSEHSPTSSALLADVLPKYLDPEGYVAVLGEVEQSQALLAKPWGHILYTGSSDVGKIVAGAAAKTLTPTTLELGGKSPVIVASDANFKIAARRLFSIKQMTGGQTCVAPDYVLCVKDKVDEFISVCKSTLDELFPPLPSSKSLLNSPSGSSFLRSPADFSRQLSYIEKAEMEGKLVYKGEMDEKTRRMGISLIRLNENGEREEGGVMVDEIFGPVLAIIPVEDIDGAIAYVNARPKPLALYVCAGKRSIFEKVISQTTSGSATWNDFAMATFARNLPFGGVGASGWGSYHGKDGFNAFTHHKAVLEIPYLFEPLISLRYPPISSFAKKILPFLMFAGIKFSRPKSIEHEEESLRRRKWRWRVIVLGFLMGALVGGKRLLGNGQ

SEQ ID NO: 61175 - protein, 702 aa, Chlamydomonas reinhardtii
MMLSGRTCNHAFSTRQMSHQRGALALRSARSEPAQKTASSANNGDAAPSEARTVPSERALAIWRSADAVCFDVDCTITINDGLDLLAEFMGVKEEVEELTNKAMDGTMSLTRSLEERLNLINCSPDDIRRFIKAYPPQSRLAPGIKELIKALQKRGVAVYLISGGFRELLLPIAAHLGIPKDRVFANRMHWQWDDETGMPTKLVGFDTSEPTARNQGKPEAIARIRENNPYNTVVMIGDGITDLEAVQTSGGADLFIGSGVVVEREAVVAEAEWYVYDYKALVSALSRYKVAMVGSGAWACAAVRMIAQNTSQDDPEDEFDDDVRMWVHQGGELVDTINSTHENPAYFPGIPLGPNVIATGNLAEAVADADLLVFCAPHQYIRGICKQLMGKVKPGAAAISLTKGMRVTPEGPELISQIVRRTLGVDCSVLMGGNIAEDVGREQLSEAVIGYYNLEHAQRFKKLFQRPYFRVTLLPDPVGAELCGTLKNIVALGVGMVDGLGMGPNSKAAIIRQGLLEMRDFCQALYPSVRDDTFLECCGVGDLVATCIGGRNRRVAEAWTRSAVEGAEAGEGNGAGRSWAELEKELLQGQKLQGVLTSNEVQQILRTRGWESKYPLFTTINRIVNGHLPPHLVVDYLEGAKADIAVDVEEDIVPLPRQPASAMARLFGQLVGGITQQGGAAAGAAASAAAGAASGAASNSV

SEQ ID NO: 61176 - protein, 619 aa, Chlamydomonas reinhardtii
MPTEVEQKTGTTSNNGNVTPLEARTVPSERALTIWRSADAVCFDVDCTITVNDGLDLLAEFMGVKEEVEALTNKAMDGTMSLTRSLEERLNLINCSPDDIRRFIKAYPPQSRLAPGIKELINALQKRGVAVYLISGGFRELLLPIAAHLGIPKDRVFANRMHWQWDDETGMPTKLVGFDTSEPTARNQGKPEAIARIRENNPYNTVVMIGDGITDLEAVQTSGGADLFIGSGVVVEREAVVAEAEWYVYDYKALVSALSRYKVAVLGSGAWACAAVRMIAQNTSQDDPEDEFDDDVRMWVHQGGELVDTINSTHENPAYFPGIPLGPNVIATGNLAEAVADADLLVFCAPHQYIRGICKQLMGKVKPGAAAISLTKGMRVTPEGPELISQIVRRTLGVDCSVLMGGNIAEDVGREQLSEAVIGYYNLEHAQRFKKLFRRPYFRVTLLPDPVGAELCGTLKNIVALGVGMVDGMGMGPNSKAAVIRQGLLEMRDFCQALYPSVRDDTFLECCGVGDLVATCIGGRHRRVAEAWTRSAIESAVAGEGNGAGRSWAELEKELLQGQKLQGVLTSNEVQQILRTRGWESKYPLFTTINRIVNGHLPPHLVVDYLPRCYPRHMS

SEQ ID NO: 61177 - protein, 540 aa, Chlamydomonas reinhardtii
MPVTRSFNSAATGLSALRAGGGGGGSRSCSSSSIFSTGGSSGTRGNWSSRASSTHAFKSAASYAGSSGQPYSSGSSSDDRSGSSSSSSGRDTPKAQGFRMPGEWEPHAGTWMAFPHDPHLWRAAARPAQQQLAAVARAVAQFEQVWMLVDPKVRAEARAAFRGVSGVELVEARTNDVWTRDWGPTCLVRDVPVGSSSGGGGSSSGGGRRRREVGALHFDYNCYGSPLKEHPLMPDWSLDRAAGRALPARHPDVVRREHLWRAPPGLHLEGGAVLSDGEGTLLVTEECLLHPSRALPPPAWRRRHPHPLDSLALGRPADAPAAAAVAAVAAAVAAAEATSGGGGGAPDEAGLGRRVERESRKAAVGEMLCEWLGADKVLWLPHGMAGDEEGTNGHVDNVAAFAAPGMVLLAWCDSPDQDPDQTRLAAENLAALADQTDARGRKLRVVPVPCPLPVLKVTREEAGGAAAVAAAAAAAGYGGRMAAGARLPASYINHYIVNGGVVVPLFGGEQVSGISLVLGCRSLGGAIALLIAYISAEAIL

SEQ ID NO: 61178 - protein, 175 aa, Brassica napus
  misc_feature (43)..(43): Xaa can be any naturally occurring amino acid
MAYSMLSSAAVVTSPAQATMVAPFTGLKSSSAFPVTRKANNDXSGRVSCMKVWPPVGKKKFETLSYLPDLTEVELGKEVDYLLRNKWIPCVEFELEHGFVYREHGSTPGYYDGRYWTMWKLPLFGCTDSAQVLKEVQECKTEYPNAFIRIIGFDNNRQVQCISFIAYKPPSFTGA

SEQ ID NO: 61179 - protein, 940 aa, Debaryomyces hansenii CBS767
MTWSQLELEKAHIAYACIGIFSTIFSLVSLFVKERLYIGEATVATIAGLILGPHCLGWFEPVTWGNSDYITLEICRIVLCIQIVAVAVELPRKYMKKHWLSVAIFLLPVMTCGWLVVGLFIWVLIPHFNFSSALLVSACVTATDPVLAAAVVGKGKFAERVPGHLRNVLSAESGCNDGMAFPFIFLSLNIILHPGNAGEIVKDWFLLTILWECFFGVALGVILGLLMRYAVAFAEKKGLIDRESFLAVFVFLAFNSAGIGSMLGVDDLLVSFAAGTAFGWNGDFAKKTEESHVSTVIDLILNLSFFVYFGAIVPWPEFNNAAIGLNVWRLIILALVIIFLRRMPAVLILKPFTPDIKSWREALFCGHFGPIGVGAIFAAILARKDLEAHFTSEETPLALLPENNFPHYQLLACIWPIVCFIVITSIIVHGSSVAVLTLGKRLNRMAITMSFTTTNTQDQGPSWMSRLQKLDKASTSFSLHRIDTQAPSTEKGHKLQQSNTVETSGIKVRPAGGAKRRKHKKKRDPRSRLKKSLSRASADSEADEIVPSQRHKPQAEFLQLGRTPSTAIRTPSDEESEPESAVGIDNSKEDFDDSPGSSNSIEVVANEDQGRMVFAVPPYDSHGRVEQDEDQDNGKVSFARNAMEGRKSVPSTAFQEGEKIIIEDQAGEIIETLPLKSLQGQPENEDDLSIHSMNSLSRQLSKYSTAQSDRTSTETSLNTKEKPNSPLGKLARSSSLSLGRKGKRKGYYKKNDPKHRKVFAHQVDNFIVIENADGDIIRRYKVNRHTANRARSNTGNSMVGKALNFVGLKKNNPKNNVDANDLEKNDIENILIPEHDDTNNPNHPLKNPKFENAIESKLTKILLDDRSKSSNFLSVGNKSETIQEDSERGVSDDDYDTSSGSEETDEDEDQVLEETDIEKKRRLAALGQMPTHRRKEDEED

SEQ ID NO: 61180 - protein, 510 aa, Phytophthora erythroseptica
ELVGMLNTARIPADVEVVVAPSQVHAATVKASLRADVRVSGQDVWKQGNGAFTGETSAEMLKDLGAEYTLVGHSERREKGESNEIVAKKAAYALEKGLAVIACIGESKETREANETVAYITEQLDAYAAEIKDWTNVVIAYEPIWAIGTGLTASPEQAQDVHANIRAWLKEKVSPEAAEKTRVIYGGSVGAKNAPELSQKEDIDGFLVGGASLKPDFLQIINAQNPTENVGGAVNVAINGFGRIGRLVLRAAAKNPLINIVAINDPFISTTYMEYMLEYDTVHGKFDGALSHDEQHIFVDDKPIRVFNEMNPSNIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKA

SEQ ID NO: 61181 - protein, 352 aa, Porphyromonas gingivalis W83
MKYLSLILISMASFSFSLSAGSCSSSAKHNDSIPETKTIYFAGGCFWGTEHFFKQVRGVVATEVGYANGNVEDPSYEEVCSQTTGFAETVRVEYDPSELSLSLLLDLFFKTIDPTILNRQGNDVGSQYRTGIYYTDQEDLSLISSALSALATKYDRPIVVENEPLKNFYPAENYHQDYLDHNPRGYCHIDPSLFELARKANPARFYKKADDAELRARLTPEQYAVTRNNATEPAFDNEYWNEFREGIYVDVTTGEPLFLSTDKFDSGCGWPSFSKPIGKELISERIDRSFGMTRTEVRSTTGDAHLGHLFNDGPLEKGGLRYCINSASLRFIPKEDMKKEGYGSLLPLLNKR

SEQ ID NO: 61182 - protein, 435 aa, Debaryomyces hansenii CBS767
MTSPNFNISSELAVKYETDYSAHNYHPLPVVFTKAKGAHVWDPEGKEYLDFLSAYSAVNQGHCHPKIVEALVDQASKLTLCSRAFSSDVFGVFAKYITEYFDYEMVLPMNTGAEAVETGLKLARRWGYVEKGIPEDEAVILSAVNNFHGRTLGVISMSTDPEATSKFGPYLQGVGPQIPGEPKGTLLRYGEIEDVEKAFNNAGDKIAAILLEPIQGEAGIVVPPEGYLTKVQALCKKHNVLLICDEIQTGVARTGKMLCYEHSANVKPDVILLGKAISGGVMPVSAVLSSKKIMLCLEPGSHGSTYGGNPLACRVATAALQVVKDENLVDRSNKLGELLRSKLEELKAKSNGVISEVRGKGLLCAIVIDDSKTNGRTAWDLCLLMKDHGVLAKPTHDHIIRLAPPLVISEADLLKGVDSIEKSLLELNDAPKAAH

SEQ ID NO: 61183 - protein, 545 aa, Phytophthora brassicae
LVGMLNTAKIPANVEVVVAPSQVHAATVKAALRADVRVSGQDVWQQGNGAFTGETSAEMLKDLGAEYTLVGHSERRENGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEQVQYVVESTGAFTTLEKASTHLQNGVEKVVISAPSSDAPMFVMGVNHELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWYDN

SEQ ID NO: 61184 - protein, 117 aa, Porphyromonas gingivalis W83
MTTEIKLEEMRFYARHGVLEQERQVGNRFVVNLSLSVDVTQAVISDAIEDTIHYGHVYEAVKEEILQPSNLIEHVAGRILQRIRHDFPQVNEVTVSLSKLNPPIGADIRSATIVLRG

SEQ ID NO: 61185 - protein, 306 aa, Zea mays
MAAAAEIGGFAAARVAVATLRPAAHPAPAAAPQQPRRAVAAQSLRTTATEALTADLAGTTNGAVHARMNSKATSEITSQAVTANSRRKTKIVCTIGPSTNTREMIWKLAETGMNVARLNMSHGDHQSHQKVINLVKEYNAQNTDGNVIAIMLDTKGPEVRSGDVPEPIMLRTESSIYNPTTSPSVIASAQGLQNEEFSPSQLSKMFGSHATMMANTLRTPIIVFTQTGSMAVLLSHYRPSSTIFAFTNEERVKLRLALYQGVIPIHMEFSDDAEETFSRAISSLLKAQYVKKGDYVTLVQSGVTSI

SEQ ID NO: 61186 - protein, 533 aa, Phytophthora heveae
LVGMLNTAKIPANVDVVVAPSQVHAATVKASLRADVRVSGQDVWKQGNGAFTGETSAEMLKDLGAEFTLVGHSERREKGETNEIVAKKAAYALEKGLGVIACIGETKETREANQTVAYITEQLNAYAAEIKDWTNVVIAYEPIWAIGTGLTASPDQAQEVHASIRAWLNEKVSPEAADKTRVIYGGSVGAKNAPELSQKEDIDGFLVGGASLKPDFLQIINAQNPTANVGGAVNVAINGFGRIGRLVLRAAATNPLINIVAINDPFISTTYMEYMLEYDTVHGKFAGSLSHDDKHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALT

SEQ ID NO: 61187 - protein, 534 aa, Phytophthora katsurae
  misc_feature (229)..(229): Xaa can be any naturally occurring amino acid
ELVGMLNTAKIPANVDVVVAPSQVHAATVKASLRADVRVSGQDVWKQGNGAFTGETSAEMLKDLGAEFTLVGHSERREKGETNEIVAKKAAYALEKGLGVIACIGETKETREANQTVAYITEQLNAYAAEIKDWTNVVIAYEPIWAIGTGLTASPDQAQEVHASIRAWLNEKVSPEAADKTRVIYGGSVGAKNAPELSQKEDIDGFLVGGASLKPDFLQIINAQNPTAXVGGAVNVAINGFGRIGRLVLRAAATNPLINIVAINDPFISTTYMEYMLEYDTVHGKFAGSLSHDDKHIFVNGKPIRVFNEMNPANIKWGEQQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSHSSIFDAEAGIALT

SEQ ID NO: 61188 - protein, 479 aa, Pasteurella multocida subsp. multocida str. Pm70
MSRRLRRTKIVCTMGPSTERGNNLEKIIMAGANVVRMNFSHGTPEDHIGRAEKVREVAKKLGKTVAILGDLQGPKIRVSTFKDGKIFLNIGDKFVLDADLPKGEGTQEGVGLDYKTLPQDVVPGDILLLDDGRVQLKVLSTEGNKVFTEVTVGGPLSNNKGINKLGGGLSADALTEKDKNDILLAAKIGVDYLAVSFPRSSADLNYARELAEAAGLKAKIVAKVERAETVATTEAMDDIILASDVIMVARGDLGVEIGDPELVGVQKKLIRRARQLNRVVITATQMMESMISNPMPTRAEVMDVANAVLDGTDAVMLSAETAAGQYPAETVATMAKVCLGAEKMPSINVSRHRMDITFDSIEESVAMSAMYAANHMKGVAAIIAMTHTGRTALLMSRISSGLPIFALSRNQDALNLCALYRGVTPVHFDEVSRNSKGAAAAIRLLKEKGFLVSGDLVLLTQGDELLASGTNTCRTLVVE

SEQ ID NO: 61189 - protein, 516 aa, Arabidopsis thaliana
MGSGQWHMEKRSTLKNDSFVKEYNPITETGSLSIIVLGASGDLAKKKTFPALFNLFHQGFLNPDEVHIFGYARSKITDEELRDKIRGYLVDEKNASKKTEALSKFLKLIKYVSGPYDSEEGFKRLDKAILEHEISKKTAEGSSRRLFYLALPPSVYPPVSKMIKAWCTNKSDLGGWTRIVVEKPFGKDLESAEQLSSQIGALFEEPQIYRIDHYLGKELVQNMLVLRFANRLFLPLWNRDNIANVQIVFREDFGTEGRGGYFDEYGIIRDIIQNHLLQVLCLVAMEKPISLKPEHIRDEKVKVLQSVIPIKDEEVVLGQYEGYRDDPTVPNDSNTPTFATTILRINNERWEGVPFILKAGKAMSSKKADIRIQFKDVPGDIFKCQNQGRNEFVIRLQPSEAMYMKLTVKQPGLEMQTVQSELDLSYKQRYQDVSIPEAYERLILDTIRGDQQHFVRRDELKAAWEIFTPLLHRIDKGEVKSVPYKQGSRGPAEADQLLKKAGYMQTHGYIWIPPTL

SEQ ID NO: 61190 - protein, 545 aa, Phytophthora arecae
  misc_feature (121)..(121): Xaa can be any naturally occurring amino acid
  misc_feature (317)..(317): Xaa can be any naturally occurring amino acid
LVGMLNTAKIPSNVEVVVAPSQVHAATVKASLRADVRVSGQDVWKQGNGAFTGETSAEMLKDLGAEYTLVGHSERREKGETNEIVAKKAAYALEKGLGVIACIGETKEHREANQTVAYITXQLDAYAAEIKDWTNVVIAYEPIWAIGTGLTASPEQAQEVHASIRAWLKEKVSPDAADKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEKHIIVNGKAIRVFNEMNPANINWXQEQVQYVVESTGAFTTTEKASAHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYEEIKAAIKSASENEMKGILGYTEKAVVSSDFIGDSHSSIFDAEAGIALTDDFVKLVSWYDN

SEQ ID NO: 61191 - protein, 313 aa, Porphyromonas gingivalis W83
MNNENNFSVFSGTNSRYLAEKICNSLGCPLGRMNIEHFADGEFAVSYEESIRGRDVFLVQSTFPSSDNLMELLLMIDAAKRASAHYITAVIPYFGWARQDRKDKPRVSIGAKLIADLLSKAGITRLITMDLHADQIQGFFDVPVDHLYGSTVFMEYIRKNMPLENLVVATPDVGGTKRANSYAKHLGVPMVICHKSRLKANEIAEMRIIGDVQDKDVLLVDDIVDTAGTITKAADLMKENGARSVCAIASHAVMSDPASMRVDQSTLKEMIFTDSIPYPHKCEKVKILSVADLFAEAIKRVCSHESITTLYYF

SEQ ID NO: 61192 - protein, 515 aa, Arabidopsis thaliana
MGSGQWHVEKRSTFRNDSFVREYGIVPETGCLSIIVLGASGDLAKKKTFPALFNLYRQGFLNPDEVHIFGYARTKISDEELRDRIRGYLVDEKNAEQAEALSKFLQLIKYVSGPYDAEEGFQRLDKAISEHEISKNSTEGSSRRLFYLALPPSVYPSVCKMIKTCCMNKSDLGGWTRIVVEKPFGKDLESAEQLSSQIGELFDESQIYRIDHYLGKELVQNMLVLRFANRFFLPLWNRDNIENVQIVFREDFGTEGRGGYFDEYGIIRDIIQNHLLQVLCLVAMEKPISLKPEHIRDEKVKVLQSVVPISDDEVVLGQYEGYRDDDTVPNDSNTPTFATTILRIHNERWEGVPFILKAGKSLNSRKAEIRIQFKDVPGDIFRCQKQGRNEFVIRLQPSEAMYMKLTVKQPGLDMNTVQSELDLSYGQRYQGVAIPEAYERLILDTIKGDQQHFVRRDELKVAWEIFTPLLHRIDKGEVKSIPYKPGSRGPKEADQLLEKAGYLQTHGYIWIPPTL

SEQ ID NO: 61193 - protein, 422 aa, Physcomitrella patens subsp. patens
ASFMFVVVLGYCTQGFRCFPWLAMCYFFKDNLQVDPGTMQFLMSTTMLPMLAKPLYGIISDSIYIQGAHRIPYLSIAAALQVVAWGAIVMHPGVSSSVAVLTGVLTMSNMGAAISEVTNDALVAEAVKSKQGAGQGELQSLAWLALAAGGLLGNLMGGFALQRIDATTMFSIFMMLVGAQLLLCTTTNVAHVECLNLSQTDGNKPQTLSMQGQLSLLSDVLKKPAVLGPLLWFLSSYAVIPNLGSSMFFYQTQHLGLDSSVIGLVKVVGQAGLLGGSILYNRSLKKVPIRKLFVGIQVLLSLCMVSDIVLVNRVNLQMGVPDEYFVLGASAFIEAIAQFKILPFMVLLSQLCPAGSEGSLLAFFMSAQCLAGLTSAYLGVGLASLLHISANSFEELPLGILIEAGFALLPVMWINIIPEEAE

SEQ ID NO: 61194 - protein, 207 aa, Leuconostoc mesenteroides subsp. mesenteroides ATCC 8293
MKHLDYREQEDWRKADDTIYQSPIDIPLTSIQQQENSQLIIHFEDRVQSDDRIIGEQFLVQGNLRVDGTVWALERFHFHDGAEHLVDGKRYDAEIHFVFQRDNQTLVLAVFGETADTDNGIEVRNIYDEHVNADGLMKLIPDNRSYYRYTGSLTTPPLGQNINWLILTSAIQISKQDKAFLHADYPNNYREVQDLNGREIDFFPEKK

SEQ ID NO: 61195 - protein, 335 aa, Phaseolus vulgaris
MAQSFGQTEINWDKLDKTRFYVVGAGLFTGVSVALYPISVVKTRLQVATKDAVERNVLSVMKGILKTDGVPGLYRGFGTVITGAIPARIIFLSTLETTKVAAFRMLEPFKLSETTQAAIANGVAGMTSSIFAQSVFVPIDVVSQKLMVQGYSGHAQYSGGLDVARKVLRSDGIRGLYRGFGLSVITYSPASAVWWASYGSSQRYIWRLTVNYIKSGKALGGIIAGASSSCITTPLDTIKTRLQVMGHENKSSIKQVAKDLINEDGWKGFYRGFGPRFFSMSAWGTSMILTYEYLTNVIVLVFIFRSNVALEKATEMKLNLKAVTNVYAQKMNRGN

SEQ ID NO: 61196 - protein, 97 aa, Synechococcus sp.
ATYKVTLVRPDGSETTIDVPEDEYILDVAEEQGLDLPFSCRAGACSTCAGKLLEGEVDQSDQSFLDDDQIEKGFVLTCVAYPRSDCKILTNQEEELY

SEQ ID NO: 61197 - protein, 97 aa, Aphanizomenon flos-aquae
ATYKVTLIDAEGTTTTIDCPDDTYILDAAEEAGLDLPYSCRAGACSTCAGKLVTGTIDQSDQSFLDDDQVEAGYVLTCVAYPTSDVTIETHKEEDLY

SEQ ID NO: 61198 - protein, 337 aa, Mycobacterium tuberculosis
MSKLAIIAGDGIGPEVTAEAVKVLDAVVPGVQKTSYDLGARRFHATGEVLPDSVVAELRNHDAILLGAIGDPSVPSGVLERGLLLRLRFELDHHINLRPARLYPGVASPLSGNPGIDFVVVREGTEGPYTGNGGAIRVGTPNEVATEVSVNTAFGVRRVVADAFERARRRRKHLTLVHKTNVLTFAGGLWLRTVDEVGECYPDVEVAYQHVDAATIHMITDPGRFDVIVTDNLFGDIITDLAAAVCGGIGLAASGNIDATRANPSMFEPVHGSAPDIAGQGIADPTAAIMSVALLLSHLGEHDAAARVDRAVEAHLATRGSERLATSDVGERIAAAL

SEQ ID NO: 61199 - protein, 455 aa, Physcomitrella patens subsp. patens
MGKSKKKGAAAVCLLPLTVSVYLSCNLLHFFQDIHVLEHDLSFQVTAVVPAKDAEDKATTKRAVEAGAGVPPLKKSKGQKKSVPPPKVVEKSSEEESEEEEAASSDEEVLPKITNGKAAKGKPTETNGENDSEDDEPMNDSGASNSADSEEENREEEVPVKTPPKQSGGGSKTLFVKNLAWAADQDKVFEFFSDCGTVADVRIAQDDNGRSRGFGHVEFETEEAAQKALQKSGQNLEGRDIFCDLAREKGSTPGGAASLISMLDFSANGATPGRAGSDKTAYVRGFDKYQDEDSIRSGLTEFFSDCGEVLNVRIPTDRESGEIKGYVTVPCAASSGFDGLESTRFAYVEFSSKDQLSKATEMDGSDYNGRSLVVNEASSGGTPGGRGGGRGGFGGRGGGRGGGGGRGFGGRGGGRGGDRGRGGRGGGRGRGDFGGRGGRGGRSSAPAGKKMRFDD

SEQ ID NO: 61200 - protein, 528 aa, Pseudomonas putida [sequence omitted]

SEQ ID NO: 61201 - protein, 327 aa, Rhodopseudomonas palustris CGA009
MDAMVLTAPGTSLQWQSRDTPQPGDGEVLVTVSACGVCRTDLHVVDGELPNIRYPIIPGHEIVGRVAAVGAGVTTHQIGDRVGIPWLGHTCGLCRYCRGGMENLCDAPLFTGYTRDGGFASHAIADARYAFPLGEAGDDVAIAPLLCAGLIGWRSLAIAGDAERLGIYGFGAAGHIVAQVARWQGRQVYAFTRGGDVAAQDFARSLGAVWAGASEEQPPQPLDAAIIYAPVGSLVPAALKAVRKGGRVVCAGIHMSDIPSFPYDLLWEERQLVSVANLTRQDGVDFLEVAQQASIRTETHAFPLREANTVLNKLRAGELLGAAVLVP

SEQ ID NO: 61202 - protein, 534 aa, Cryptococcus neoformans var. neoformans B-3501A
MSLPKHISTSLSQIDQLYDTVNKRFNSGVTLPLAYRLYNLKQLAYLIKDNETLIQAAIEKDNGKGPFDATLGDIWPTLNEIDLAVKNVKKWMKDESRTGDAILAMKSMPSRVKKQPKGVALILATWNYPWQLALCPLVGAISAGCAAVIKGSEHAPTSSALLADLLPKYLDPEGYAVVLGEVEQAQALLAKPWGHILYTGSAVVGKIVAEAAAKTLTPTTLELGGKSPVIVASDADLKIAARRMFSIKQMTGGQICVAPDYVLCVKDKVDEFISICKTTLDEFFPPSPSPQSLLNNQSASSFLRSPADFSRQLSYIQTAEKAGKLVYKGEMDEQTKRMGISLIRLNENGEGEEGGVMVDEIFGPVLTIIPVDSIEAAIAYVNARPKPLSLYVCSSKRSVFEDIITKTTSGSATWNDFGIATLSRNIPFGGVGESGWGSYHGKDGFNTFTHHKAVLEIPYLFEPLMSLRYPPMSILAKRIMPFLMFSGIHFSRPKSVEHEQRALRRRKWGSRLVWFGVILVGALVGGKLIVGKGY

SEQ ID NO: 61203 - protein, 432 aa, Gibberella zeae PH-1
MPKAPPQPASSPGVAAPAAASSIPNLKDRLPKLEPRKRRSGPSNPTPIPETPALPTPPDTSSNWTFKTPSRRILSKKDHDIFLSSPTCKLVTAWVFGLAESIVDTPNSAIRDADLSALIKTILHILDETEQLVTKSPPNEQGGSRFGNKAFRGLLDLAQKNSAAWHHDIGVQNEDAINELSTYFCESFGNANRIDYGSGHELNFMIWLLCLYQLGLLKQSDFKPIVLRVFVRYLEVMRVIQMTYYLEPAGSHGVWGLDDYQFLPFLFGATQLLHHPYITPRAIHQDLTLEEFGHEYMYLGQVSFVNSTKTVKGLRWHSPMLDDISSARSWTKIDGGMRRMFVAEVLGKLPVMQHFLFGSLVPADDSMSEDTGAGDEADVEDDPHAGHDHTGKAHDGTGWGDCCGIKVPSSIAAAQEMKKRGMNQGLRRIPFD

SEQ ID NO: 61204 - protein, 449 aa, Zea mays
  misc_feature (57)..(57): Xaa can be any naturally occurring amino acid
  misc_feature (101)..(101): Xaa can be any naturally occurring amino acid
PPPPPPAVDHASEEVLNYDQVFVRDFVPSALAFLMNGEPDIVKNFLLKTLLLQGWEXKVDRFKLGEGAMPASFKVMHDAKKGVETLHADFGESAIGRVAPXDSGFWWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDRAMLKPVLKRSASWTN

SEQ ID NO: 61205 - protein, 223 aa, Campylobacter coli RM2228
MIFAANLKCNHTRSSFKIYANILNQYLEAKNDDIIVFPPSIAFLENELNFIQGAQNFYPCVNGAFTGELGKEHLDEFGIKCVLIGHSERRALGDENLIKAKFDFAKEHAYKIVFCIGEDLKLKNSNQTLDFLKKQLEVIDLDYKNLIIAYEPIYSIGSGVSAKKEDIAKVLEFLSSLTQAPLLYGGSVNEDNIKDILNIKHCSGVLIGSAALKAENFIKLIKG

SEQ ID NO: 61206 - protein, 114 aa, Oryza sativa
MGAADDANHRHEEASPLLPPGGGGAGAGGKKLNQSPPPSPPEAAKCCADGVPVVMGEPLGAPAPPRESWNSGVLSCLGRNDEFCSSDVEVCTCMSISDLSGVGLGGVAFACVSR

SEQ ID NO: 61207 - protein, 400 aa, Campylobacter coli RM2228
MSDIISIKDIDLSKKKVFIRCDFNVPQDDFLNITDDRRIRSAIPTIRYCLDNGCSVILASHLGRPKEISSKYSLEPVAKRLARLLDKEIVMAKDVIGEDAKSKAANLKASEILMLENLRFEKGETKNDENLAKELASMAEVYINDAFGVCHRAHASVEAITKFFDENHKGAGFLLQKEIEFAENLIKRPARPFVAVVGGSKVSGKLQALTNLLPKVDKLIIGGGMAFTFLKAQGFDIGNSLLEEELLEEANKILTKGKNLGVKIYLPVDVVAAPACSQESPMKFVPSQEIPSGWMGLDIGPASVRLFKEVISDAQTIWWNGPMGVFEIDKFSKGSIKMSHAISDGHATTVVGGGDTADVVARAGDADEMTFISTGGGASLELIEGKELPGVKVLRSGGVQ

SEQ ID NO: 61208 - protein, 332 aa, Campylobacter coli RM2228
MAVKVAINGFGRIGRCVARIISKRDDIELVAINDTTDIELTKYLFKYDTVHGEFEGSVENEGDDLIINGKKIKVFKSRDIKELDFAKYGAQIVLECTGAHLTIEKCQGFLDMGVQKVIMSAPAKDDTPTYVLGVNSQNYKGENIISNASCTTNCLGPVCRVLQDDFGIEKGLMTTIHAYTNGQSIIDAKTKDKRRSRAAAQNIIPTSTGAAKAMKLVMPELNGKLHGQSMRVPVIDVSSVDLTAQLSKKVSKEELNEAFRKAAATNLKGILMVDDDERVSSDFITCSYGAVVVSDLTQVIADDFVKVVAWYDNEWGYSSRLVDMAVYIANKA

SEQ ID NO: 61209 - protein, 241 aa, Cicer arietinum
ILCHKSLESALSNYLAVKLSSVSVPSTTLVDLFVKVLESDKQIMDAVKYDLKVVNERDPACISHVHCFLNFKGFLACQAHRIAHDLWLKGRKVLAVMIQNRVSEVFGVDIHPGAKIGSGILLDHATGIVVGETAVIGNDVSILHGVTLGGTGKACGDRHPKIGDGVLIGAGTCILGNIKIGDGAKIGAGSVVIKDVPPRTTVVGNPAKLVGGKNNPVKLDKIPSHTMDHIAHISEFYDYCV

SEQ ID NO: 61210 - protein, 330 aa, Methanosarcina mazei Go1
MRLAVIEGDGIGREVIPAAVEVLDAFGLEFEKVPLEIGYARWERTGTAMSEEDMEIIKSCNAVLFGAVTTVPDPGYKSVLLTIRKELDLYANVRPVKPLSGVVGVSGRSDFDFIIVRENTEGLYSGIEEIGHDLSWTKRVITRKGSERISEYACELAKKRSGKLTIVHKSNVLKSDKLFLDVCRETASSYGVEYGDMLVDSMAYSLIMHPEKYDVVVTTNLFGDILSDMCAALVGSLGLVPSANIGKKYAFFEPVHGSAPDIAGKGISNPLAAILCVKMLLEWMGKPEARLIDAAIADLLQKKIITPDLGGRASTAEVGNAVAKYIMQNL

SEQ ID NO: 61211 - protein, 420 aa, Rhodopseudomonas palustris CGA009
MSQGVTAPFARHAMAYVLAGGRGSRLMELTDWRAKPAVYFGGKSRIIDFALSNALNSGIRRIAVATQYKAHSLIRHLQRGWNFFRPERNESFDILPASQRVSEEMWYRGTADAVFQNIDIIESYDPKFIVLLAGDHVYKMDYEKMLQQHVEQGADVTVGCLEVPRAEATAFGVMHTDTTDRIISFLEKPADPPAMPGKADKSLVSMGIYVFETKFLLDELRRDAADPNSSHDFGKDIIPYIVKHGKAVAHHFDKSCRRSSSEAVSYWRDVGTVDAYWAANIDLTDIVPELDLYDREWPIWTYGEITPPAKFVHDKEGRRGEAVSSLVSGGCIISGASLRHSLLFTGVRVHSFSHVENTVVLPYADIGRSCRLKNVVIDAEVKLPAGLVVGEDPEFDAKRFRRTENGICLITRAMIEKLDA

SEQ ID NO: 61212 - protein, 162 aa, Yarrowia lipolytica CLIB122
MAAVQKGQEVPAVTVREGTPSCQFDLQDVTKEGTHIIVGVPGAFSPACSAGHVPGYINLFPKLKERGVKTVWVVAVNDAFVTNAWAESLDAPADDVRIISDQAGEFSLAFGTLFDASEFFGNKRSARYAAVIMDGKVVEVFEEPDKTGLDVSKAENVLKSLG

SEQ ID NO: 61213 - protein, 169 aa, Triticum aestivum
MAADAASAAVKKLTLKSSDGEDFEVEVAVAMASQTIKHMVEDGCADNIIPLPNVTAKILSKVIEYCTQHAPKADDAAAADSATAVKPDEEKLKAYDVEFVKVEQATLFDLILAANYLDIKGLLDLTCQTVADMIKGKTPEEIRKTFNITNDFTPEEEEEVRRENQWAFE

SEQ ID NO: 61214 - protein, 142 aa, Cicer arietinum
AQLLGSIVASLLLVFATGLSVPAFSLSAGVGVGPALVLEIVLTFGLVYTVYATAVDPKKGNIGIIAPIAIGFIVGANILVGGAFTGASMNPAVSFGPAVVSWSWSNHWIYWAGPLIGGGLAGLIYEVVFISHTHEQLPTTDY

SEQ ID NO: 61215 - protein, 430 aa, Methanosarcina acetivorans C2A
MAETKSMGLWASASIGVGAMVGAGIFSIFGTAAQISGNAVYVSFIIAGMIALLNTYSYAKMGVRYPSAGGPVEFMLKGFGDGILSGGLNLLLWVGYVFGLALYAKGFSYYAITFLPAGSAPVWTSFFATAIILAFTAINFRGAKTVGKSELFIVSIKVGILLLFAAAGMFYVTPGNLSISAWPAPKNLFFGAGMVFLAYQGFGLITNAAEDMKNPEKNLPRALYLSVVLVIIIYVSVSLAVIGNLSVPEIQNAQDYALAAAAKPFLGDIGFKIMAFAALFSTSSAINASLYGGANVSYILAKDGELPEIFERKVWHRSPEGLFITSSLVILCANFLQLEGIGMLASTCLLMVYVAVNISHLRLLKETGAKSYIIWASLLSSLTFFCVLLYYEFMHSKTTLGLLGFTVFCCFAAEWTYRKYSGRLIKERTG

SEQ ID NO: 61216 - protein, 545 aa, Phytophthora primulae
LVGMLNTAKIPANVEVVVAPSQVHAATVKSALRADVRVSGQDVWQQGNGAFTGETSAEMLKDLGAEYTLVGHSERREKGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEHVQYVVESTGAFTTLEKASTHLQNGVEKVVISAPSSDAPMFVMGVNQELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWYDN

SEQ ID NO: 61217 - protein, 544 aa, Phytophthora primulae
ELVGMLNTAKIPANVEVVVAPSQVHAATVKSALRADVRVSGQDVWQQGNGAFTGETSAEMLKDLGAEYTLVGHSERREKGETNEVVAKKAAYALEKGLAVIACIGESKETREANKTVAYITEQLDAYAAEIKDWTNVVIAYEPIWAIGTGLTASPEQAQDVHASIRAWLKEKVSSDAAEKTRVIYGGSVGAKNAPELSQKEDIDGFLVGGASLKPDFLHIINAQNPTENVGGPVNVAINGFGRIGRLVLRAAAKNPLINIVAINDPFISTTYMEYMLEYDTVHGTFDGSLSHDEKHIFVNGKPIRVFNEMNPANIKWGEEHVQYVVESTGAFTTLEKASTHLQNGVEKVVISAPSSDAPMFVMGVNQELYEKNMHVVSNASCTTNCLAPLAKVVNDKFGIKEGLMTTVHAVTATQKTVDGPSNKDWRGGRGACFNIIPSSTGAAKAVGKVIPSLNGKLTGMSFRVPTADVSVVDLTARLVNPASYDEIKAAIKDASENEMKGILGYTEKAVVSSDFIGDSRSSIFDASAGIALTDDFVKLVSWY

SEQ ID NO: 61218 - protein, 355 aa, Oryza sativa Japonica Group
MENGGGGGGDGGKSDVPADANEHCPGTQSEEAGKADACAGCPNQQICATAPKGPDPDLVGIVERMATVKHKILVLSGKGGVGKSTFSAQLSFALAEMDCQVGLLDIDICGPSIPKMLGLEGQDIHQSNLGWSPVYVESNLGVMSIGFMLPNPDDAVIWRGPRKNGLIKQFLKDVDWGEIDYLVVDAPPGTSDEHISIVQYLQATGIDGAIIVTTPQQVSLIDVRKEINFCKKVGVPILGVVENMSGLRQVLSDFRFVKQGEGGEMDATEWALNYIKEKAPELLTMVACSEVFDSSKGGAEKMCNEMGVPFLGKVPMDPQLCKAAEEGRSCFVDQKCSASAPALKSIVKKLIENQD

SEQ ID NO: 61219 - protein, 715 aa, Bradyrhizobium japonicum USDA 110
MHRRRARRRHADRGGVTMDSRIMTALGDRVLTLGPQPAADSPYKHFKLTRDADGVAWLLFDRADASANTLSSDVMEEFDAVLAAIETERPAGLVIRSAKPSGFIAGADVNEFRGASDPEMVETRIRAAHAVVDHLEALRLPTVAVIHGFCLGGGLEIALACQSRIAIEGARFGFPEVMLGLHPGLGGTARFTALVNPTQSMALMLTGRTIDARRAKSLGLVDTVTQERHVRGAVKDVLFGRLKRAKPGLLTRAANLGPVRGLLAKRMRSEAAKAAPREHYPAPYALIDLWETHGDSKAAMLAAEQASFAKLMVTPTAQNLIRVFFLREQMKKAAGAGNAVKHVHVIGAGAMGGDIAAWCAGQGLRVSLADMKAEPIAGAVKRAAELYGKIIRKPTEVRDALDRLIPDMDGEGVRNADLVIEAVPEKLELKQKVYAGLEPKMKPGAILATNTSSIPLQDLRTTLARPDRLVGLHFFNPVSRLQLVEVVSHDGNDAQVLREALAFVGAIDRLPLAVKSSPGFLVNRALTLYMLEAMVMLDEKIDQRLIDAAAEQFGMPMGPIELADQVGLDICLDVGDMLRTKFGDLLPPTPAWLREKVAKGELGRKTGRGFYTWKDGKAEKVPLPETGPRVTDQMIDRLVLPMSNVCVAALREGIVEDPDAVDGAMIFGTGYAPFRGGPLNYARTRGVDNVVSTLRELADRFGGRFAPDPGWDNLK

SEQ ID NO: 61220 - protein, 544 aa, Phytophthora ipomoeae
LVGMLNTAKIPVNVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIALTDDFVKLVSWYD

SEQ ID NO: 61221 - protein, 288 aa, Triticum aestivum
  misc_feature (187)..(187): Xaa can be any naturally occurring amino acid
MKIFVDTDADIRLARRIRRDTVERGRDVLSVLEQYGRFVKPAFDDFILPSKKYADVIIPRGGDNHVAIDLIAQHIRTKLGQHDLCKLYPNVCVVQTTFQIRGMHTLIRDREITTPDFVFYSDRLIRLVVEHGLGNLPFTEKQVVTPTGSVYSGVDFCKKLCGVSIVRSGESMENALRACCKGIKIGXLRFYHKLPMDIDERHVLLLDPVLGTGNSANQAIDLLRRKGVAEERIIFLTLISAPEGIQCVCTRFPKLKLVTSEIDTGLSEEFRVIPGLGEYGDRYFGTDN

SEQ ID NO: 61222 - protein, 456 aa, Colwellia psychrerythraea 34H
MNSVQSTSSLTVAKFGGTSVADYQAMLRCANIIKNDNSNRLVVVSASSGVTNLLVRLSQKNVSVIEQKDIVENIRAIQVNITQHLSSDVEAQLNQEINSLLDELTQHALTQLLQYSTKTADAILAFGEQFSSRIFAQVLQSVDIPGEYFNVQQVMKTNSLYGKAVVDLNQLSEQSTQLLAPKLIDKVIVTQGFIGQDSQGHTTTLGRGGSDYSAALLAEALNGTNLSIWTDVVGIFTTDPRITDQARAIKEISFGEAAEMATFGAKILHPATLIPAMRRNIPVFVGSSKEPEKGGTQIKQKVDSNPTYRSIALRREQTLVTVKSPAMLHASGFLAKVFGVLAKHELSIDLITTSEISVALTFDNPSGSTQSLITNAVVAELEQLCEVSVEHGLSLVAVIGNGLTCAKGIGQSIFETINDVNIRLICHGASANNLCFLVNEDEANYVVEKLHNTLFA

SEQ ID NO: 61223 - protein, 841 aa, Arabidopsis thaliana
  misc_feature (197)..(197): Xaa can be any naturally occurring amino acid
MAAVIRKLLPFPSPNPKRDNRESDDDDETSSGYRIEYSFASEYKGPLIANVPRALPVEVDQIPTALPVSFSSLRSGISYPVAPLVMTKDTKRPPDSGIEKKNGFVDSAAGSSVVLIGRDVVSGSSSSSSSKRLDVPEEVKSPADFRLSPSSPLSASAREEDHLDDDRVSDVGPRAVRFVEPFQSSECDESSYVSDGXSIAATHRAERKGKRGSCYRCQLGNRFTEKEVCIVCDAKYCFNCVRRAMGAMPEGRKCQACIGYRIDESKRASLGKCSRMLKRHLTDSELRQVMNAEITCKANQLPSRLIIVNDKPLSEDELYTLQTCPNPPKKLKPGHYWYDKVAGYWGKIGEKPSQIISPNNSIGGYISEKVSNGDTEIYINGREITKPELTMLKWAGVQCEGKPHFWVDSDGSYREEGQKHPIGNIWSKKRAKIACAVFSLPVPPASSAVEPYDVPLYEQKMLNKLLLIGSEKGGATTIYKQARSLYNVSFSLEDRERIKFIIQTNLYTYLAMVLEAHERFEKEMSNDQLKHFSDWVLKEKEDGNLKIFPPSSRENAQTVADLWRVPAIQATYKRLRDTLPRNAVYFLERILEISRSEYDPSDMDILQAEGLSSMEGLSCVDFSFPSTSQEESLESDYQHDTDMKYQLIRLNPRSLGENWKLLEMFEDADLVIFCVSLTDYAENIEDGEGNIVNKMLATKQLFENMVTHPSLANKRFLLVLTKFDLLEEKIEEVPLRTCEWFEDFNPLISQNQTSRHNPPMAQRAFHYIGYKFKRLYDSILEPVNMRGRSFKPKLFVCQVSLESDTVDNALRYAREILKWHVEETSMFQEMSTTSIEASSSS

SEQ ID NO: 61224 - protein, 546 aa, Phytophthora ipomoeae
ELVGMLNTAKIPVNVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAYITEQLDAYAAEINDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIALTDDFVKLVSWYDN

SEQ ID NO: 61225 - protein, 340 aa, Lactobacillus sakei subsp. sakei 23K
MTVNVAVLGAGSWGTILANLLVENGHHVELWGNDPEKVAEINEQHTNKHYLPEFKIDSRLHATLDLNEAFEAVDVVLFVIPTQVIRLVAEQIAPVLEAKGVKPVIVTASKGLEQGSHKRISEVLTETIPADIRNGIVVLSGPSHAEDVAMKDITTLTAASTDLVQAQWIQEIFMNDYFRLYTNTDVIGVEMGAALKNVIALGAGALHGLGYGDNTKAALMTRGLAEISRLGVAMGANPLTFIGLSGVGDLIVTGTSVHSRNWRTGNALGEGQKLDDVLENMGMVVEGVATCKAAYELAQQRSVDMPITNAIYNVLYRGCDIRTEIGNLMQRSGKPEIDFK

SEQ ID NO: 61226 - protein, 275 aa, Debaryomyces hansenii CBS767
MEDYTIAVLGCGVMGTAVTSAILKAKFEPYPSKIICCTNSEKLSTELKSKLDSDVIETSYGSESNNKAVSKADIVILGCKPFMFKDVYEQVKGSLSGDQLIISLLAGTTIEELSIMSPYVAKVMTNTPAQFGCGMAVVSFSDEAESKYSDLVMKLIDPVGKAMKLPEKNMDAATALVGSGPAFCLLIMEALVDGGVRMGLPYAVAKESAAKVMEGTAKMVLETGEHPAALRSKICTPGGTTIGGLLKMEDAGVRGGIARAVEEAANISASFAKKK

SEQ ID NO: 61227 - protein, 545 aa, Phytophthora ipomoeae
  misc_feature (129)..(129): Xaa can be any naturally occurring amino acid
LVGMLNTAKIPVNVEVVVAPSQVHAATVKASLRSDVRVSGQDVWKQGNGAFTGETSAEMLKDLGAEYTLVGHSERREKGETNEVVAKKAAYALEKGLGVIACIGETKDHREANQTVAYITEQLDAYAAXINDWTNVVIAYEPIWAIGTGLTASPEQAQEVHASIRAWLKEKVSPEAAEQTRVIYGGSVGAKNAPELSQKEDIDGFLVGGASLKPDFLQIINAQNPTANVGGAVNVAINGFGRIGRLVLRAAAKNPLINIVAINDPFVSTTYMEYMLEYDTVHGKFDGSLSHDETHIFVNGKPIRVFNEMNPENIKWGEEQVQYVVESTGAFTTLEKASTHLKNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEEAVVSSDFIGDSHSSIFDAEAGIALTDDFVKLVSWYDN

SEQ ID NO: 61228 - protein, 111 aa, Zea mays
WTCALCYNNVHVFRGVVKMRRGLTARIIDETNSMTDVYTAFYEFSSLIESKIDDSDPNAALTQRRVDSIKQTCKSSGLVNQRGYHLEKSPYRPMLIMIVLLLVAILFGVMF

SEQ ID NO: 61229 - protein, 535 aa, Xanthobacter autotrophicus Py2
MAIIEDAVDRRSDTFRRNSQALEASVADLRTTVERVAEGGGEVARERHLKRGKLLPRDRIRTLLDTGSPFLELSQLAAHGMYGDEVPAAGIITGIGRVSGRECVIVANDATVKGGTYYPITVKKHLRAQAIARENHLPCIYLVDSGGANLPNQDEVFPDREHFGRIFFNQANMSAEGIPQIAVVMGSCTAGGAYVPAMADQSIMVKNQATIFLGGPPLVKAATGEVVTAEELGGADVHTRTSGVADHMAENDAHALGIARSIVADLNATKAHSLDIREPRAPLYDTKDIYGIVSADPKQPFDVRQIIARIVDGSEFDEFKPLYGPTLVTGFARIFGYPVGIIANNGILFSESALKGAHFVELCCQRNIPLVFLQNITGFMVGRKYEAGGIAKDGAKFVTAVSCAAVPKFTVVIGNSFGAGNYGMCGRAFDPRFLWMWPNARISVMGGEQAAGVLGQVKRDGIEARGGTWSAEEEEAFKAPIRTQYEVQGHPYYSSARLWDDGVIDPADTRMVLALALSAALNAPEQETRFGVFRM

SEQ ID NO: 61230 - protein, 330 aa, Zea mays
MAEEPAIVVAASSSCEVDLGNLMAYDPCHHVAAAASASREELRQECLRKGTELAQAVADALFALPPTEDRDGPIVHLPPHTVRLPREKHLPKPKPPTKWELFAKAKGITKRKKNKREWDEQTQSWKRTYGYDRVNDDKDVPILEAKLTDEPGVDPFAQRRDEKKKRVEKQEKNRLDNLKKAAKVGALPSHIQLAAKALPITGTKADLPKKSRKEDLESVVGMASSATASGGKFDEKLPGEKPPKHPGKHRKFLPVAEGKGMGSLEKQQNDKILSSLLARNSDEPLDVSKAITMYKVKKEKQRRKEKNMPSKSDKLKPQKKPHKKSSKKRA

SEQ ID NO: 61231 - protein, 479 aa, Savia dictyocarpa
  misc_feature (2)..(2): Xaa can be any naturally occurring amino acid
SXLEKKNLGRIAQIIGPVLDVAFPPGKMPNIYNALVVKGRDTVGQQINVTCEVQQLLGNNRVRAVAMSATDGLMRGMEVINTGAPLSVPVGGATLGRIFNVLGEPVDDLGPVDTRATSPIHRSAPAFIQLDTKLSIFETGIKVVDLLAPYRRGGKIGLFGGAGVGKTVLIMELINNIAKAHGGVSVFGGVGERTREGNDLYREMKESGVINEENLAESKVALVYGQMNEPPGARMRVGLTALTMAEYFRDVNKQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPQIVGEEHYETAQRVKQTLQRYKELQDIIAILGLDELSEEDRLTVARARKIERFLSQPFFVAEVFTGSPGKYVSLAETIRGFKLILSGELDSLPEQAFYLVGNIDEATAKATNLE

SEQ ID NO: 61232 - protein, 324 aa, Bradyrhizobium sp. BTAi1
MTSAIRFHKTGGPEVLVWEDVTVGKPGPGEARIRHTAVGLNFVDIYNRSGLYPVQLPSGLGSEGAGVVEELGEGVTDLKVGDRVAYGSSPLGAYSEARLIPAAQLLKLPDGIDDKTAAAMMLKGLTVQYLIRQTYRVKAGETILLHAAAGGVGLILSQWAKHLGASVIGTVSSDEKAEQARAHGCDHTIVYSREDFVARVGEITAGRKVPVVYDSVGKDTFLKSLDCLAPLGYAVLFGQSSGTVDPLNLGLLAQKGSLFVTRPTLFTYAAKRENLVAMANELFDVVKSGAVRIEVNQTYPLKDAAKAHADLAARKTTGSTVFLV

SEQ ID NO: 61233 - protein, 516 aa, Oryza sativa
MVIARGLLRSNASSSSSQAINLLKYVTSTGSLQGHTQNLCDASTRHFSSVPSPQSNSTEENGFKGHGMLAPFTAGWQSTDVHPLVIERSEGSYVYDIDGKKYLDSLAGLWCTALGGSEPRLAKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGETEEEFATRLANNLEELILKEGPETIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLVRVAGDNIMMSPPLIMTPDEVEELVSIYGDALKATEERVAELKSKKNN

SEQ ID NO: 61234 - protein, 287 aa, Triticum aestivum
MDMGLEVSSSSPSSSSASSSPEHAAGRASLAKRPAGRTKFRETRHPVYRGVRRRGNAERWVCEVRVPGKRGARLWLGTYATAEIAARANDAAMLALGGRSAACLNFADSAWLLAVPPALADLSDVRRAAVEAVADSQRREAANGSLTVTATVTEEASCGAPEESSSESDSVGSSETSEPSADGEFEVPVAVDTDMFRLDLFPELDLCSYYASLAEALLLDPPAPVTTTYAYWDNGDGGADVALWSYCRALELLASTVDNSPRKKKIVVPIIPSSVAIFPLLQSFPLV

SEQ ID NO: 61235 - protein, 379 aa, marine gamma proteobacterium HTCC2143
MTVPAILALEDGSIFRGVAIGATGHSVGEVVFNTAMTGYQEILTDPSYARQIITLTYPHIGNTGTNSEDEEAADIWSAGLVIRDLPLLASSFRNEQSLQDYLVARNVIGIADIDTRRLTRILRDKGAQNGCIMAGDIDEEAAMRYAKGFDGLKGMDLAKVVSTTSEYTWQQGSWDSEREQSYREYSDNDCDYHVVAYDFGVKRNILRMLVDRGCRLTVVPAQTSAADVLAMNPDGVFLSNGPGDPEPCTYAVEAIQCLLETDIPVFGICLGHQLLAIASGAKTVKMKFGHHGANHPVQNLEDGTVLITSQNHGFAADESTLPDNLRVTHKSLFDGSLQGIHRTDKAAFSFQGHPEASPGPHDAAPLFDHFIELIRQRLN

SEQ ID NO: 61236 - protein, 511 aa, Mycoplasma penetrans HF-2
MDKILILDFGGQYTQLIARRIRDLNVYSEIVDYDISIEEIIKKNPKGIILSGGYDSVYGDRSIKPNKGIWDLNIPILGICYGFQVMMQENGGQVENDKDSEEYGSTDIRLTTNELFENIELDNNCWMSHSDSVIFLPKGFKVIASTNKCLVASACNREKKFYGVQFHPEVTQTTFGNQLLQNFVYSICDVAGDWEPKNIKLEKIEEIKSIVKDDYVLCAISGGVDSLVAAVLTAQAIGDKLYCVFVDHGLLRKNESQEVCALLKKLIGKNIFLVDQKQLFLSKLKGVVDPEQKRKIIGKTFIEVFEKVANKINVPFKYLLQGTIYPDIVESGSKFSKTIKSHHNVGGLPERLQFELLEPLKYLFKDEVRKLGLSLDIPYQNVYRQPFPGPGLAVRVLGEITEDKLEIVREADFLFRSYIDQLYKNSEHKPWQYFTVLTNSKSVGVVGDNRSYGYTLALRAVDSMDAMSAKWYKIPLEHLEKISSIICNKVKNISRVVYDITNKPPGTIEWE

SEQ ID NO: 61237 - protein, 485 aa, Photobacterium profundum SS9
MEFQMSEQLRRTKIVTTLGPATDRDNNLEKIIAAGANVVRMNFSHGSPEDHIQRTKMVREIAAKLGKHIAILGDLQGPKIRVSTFKDGKIQLAIGDKFTLDSDLPKGEGHQDAVGLDYKELPNDVVTGDLLLLDDGRVQLKVTAVSGNKVHTEVTVGGPLSNNKGINKKGGGLSAEALTEKDKADIITAAQMGVDYLAVSFPRNGEDMKYARSLALDAGLEAKLVAKVERAEAVATTEAMDDIIMASDVVMVARGDLGVEIGDPELVGVQKKLIRRARSLNRTVITATQMMESMITSPMPTRAEVMDVANAVLDGTDAVMLSAETAAGDFPVETVQAMSSVCVGAEKEPSINVSNHRLTRTFASPEETIAMSTMYAANHMEGVKAMVAMTESGRTALMMSRISSGLPIFAMSRNESTLNRSSLYRGVTPVYFDRDSDAGLEAAKHALVVLKEHGYLATGDLVIITQGDVMDTIGSTNNMRILTVE

SEQ ID NO: 61238 - protein, 456 aa, Campylobacter coli RM2228
MSQCPFFPKPYKNKASTLLTFLLKRRSWLDGLYERSYKMQTGYVKMPNFDLYVINDTKEVKRMMVDEVKEFPKSAFLHELLSPLLGESIFTTNGEVWKKQRELLRPSFEMTRISKVFNLMSEAVSDMMKRFEKYPNASIIEVDEAMTFITADVIFRTIMSSKLDEEQGKKILDAFVTFQEQSVHTAMRRMFRFPKWLSYVLGDRKRAKAGDVIRQALSDIIKPRYDAVSSGKAENFEDILGSLLLVVDAQTNQRFSFEEILDQVAMLFLAGHETTASSLTWTLYLLSLYPDEQEKAYKEIIQVLQGENIQISHLKQFRYLTHIFKESLRLYPPVGFFAREAKKDTKVRDKMIKKGSGVVIAPWLIHRHEGFWTNPHEFKPSRFEGEYKKDAYLPFGVGERICIGQGFAMQEAILILANILKKYKLELEEGFVPDVVGRLTIRSANGMRIKFSKREP

SEQ ID NO: 61239 - protein, 408 aa, Hyphomonas neptunium ATCC 15444
MPDTLPPELPVTLSDIQAAAKVLEGQIERTELAHSKTLSAITGAEVWVKLENRQYTAAFKERGALNKLSKLSDNEKKYGVIAASAGNHAQGVAYHARRLGIPATIVMPQTTPFNKVEHTRDHGARVLLEGMTFDEAKAHAYAVCEREGLTFVHPFDDADIIAGQGTIALEMLADNPGLDTLVVPIGGGGLISGIAIAAKALKPEIRIIGVQTAMYPAMHAAMRGKPAKTGGATIAEGIAVRDVGDITRQICERMVDDVVLVEEEHLERAITLFVEVEKTIAEGAGAAGLAALLAHPSRFYGRKVGLVLCGGNIDTRLLASVLTRALVRENRLARIRIVGDDRPGLLALVSKIIGDNGANIMEVAHNRIALDVPAKGAEFDILMETRDSQHTQEVIDALAQAGYPPRAI

SEQ ID NO: 61240 - protein, 274 aa, Rhodopseudomonas palustris CGA009
MSYVDATETAQRKTGQIKLHGPAGFAGMRKAGQVVARCLDELVDIVKPGVPTSRIDDFVREFAFSNGAYPATLMYRGYRYSTCTSLNHVVCHGMPGDRPLKEGDIVNVDVTMIVDGWYGDSSRMYPVGPIARKAERLIDVTYESLLRGIAAVKPGATTGDIGHAIQSFVEPQQMSVVRDFCGHGLGRLFHDEPNIIHVGSPGQGAVLKPGMFFTIEPMINLGKPYVKILSDGWTAVTRDRSLSAQFEHSIGVTEDGCEIFTASPKGLDKPPFQG

SEQ ID NO: 61241 - protein, 597 aa, Rhodopseudomonas palustris CGA009
MESLDSVSIAILLGSVLVMAGILSSLLALRFGAPLLLVFLVIGILAGESGPGGINFNDLGTTYLVGSVALALILFDGGLKTRFSSIKAVLAPSMGLATVGVLLTALVTAPVARYALDLSWVEALLASAVVASTDAAAVFLLVHAQGLRLRPRVGATLEVESGTNDPFAVFLTLMLVELITRGESSILHVLIEFVREAALGAVIGVVGGRVVVMALNRVALPQGLHAPFVTTAALVVFGAAQMSHASGFLAVYLAGMIIGNQPTRAHNSVVAFLDAATWLAQIVMFVLLGLLVSPQRLMGSIGPAVVIALALMLVARPLAVFICLAPFRFNWRERLFIAWVGLRGAVAIFLASIPMLVGLSKAYLYFDVAFVVVLISLMLQGWTLAPAARKLLVALPRSDRGPRRIELDLPGQLEQQLVGYAVRPKSLYLKRGLIPSWSKPTLVIRDQRILTPEEAEPVAPGDYVYLLAPPEKAAALDRFFVDMPPSTAPDPHLLGDFIVPGETSLGDLAAAYGISVPPGQEALTLADYFDIYLDQAPMVGATLPLDSIVLVARSLGGGRVNVVGLRLPEEEDEAPPPTRLAKVRTKLSEVWSLLAGV

SEQ ID NO: 61242 - protein, 419 aa, uncultured bacterium
  misc_feature (310)..(310): Xaa can be any naturally occurring amino acid
  misc_feature (320)..(320): Xaa can be any naturally occurring amino acid
MGGKMSRSTNREYGRAIMTASQKNIFKSMPVKSQVWMSHGDHVTKLPKGFEKIGSTPSVAITAFAEPKRKIFGVQFHPEVAHTEQGMRILNNFIFDISKCKPSWSPKSFIDNTVNEIRETVGKGKVICGLSGGVDSSVVAMLLNKAIGNRSVPIFIDNGLLRHNEARKVKEAFTKFGVKIKTIDASDLFLRRLKGIADPELKRKKIGRAFIEVFSAEAKKFKGAHFLAQGTLYPDLIESVSYKGPSATIKTHHNVGGLPKRMKLKLIEPLKELFKDEVRLVGRKLGLPKEFIERHPFPGPGLAVRILGAXTPKRLDILRXADDIFITELRKWKLYDETWQALAVLLPIKSVGVMGDERTYENVAALRAVTSLDAMTADWAHLPADFLAHISNRIINEVKGINRVVYDISSKPPSTIEWE

SEQ ID NO: 61243 - protein, 403 aa, Hyphomonas neptunium ATCC 15444
MAADIRLSDAIARVKPSATIAVTTKANEMKRQGLDVIGLGAGEPDFDTPENIKEAAIRAMREGKTKYTPSDGIPELKEAIVAKFARENGLTYKPSQVNVSPGGKAVLFNAFMATLNAGDEVVIPAPYWVSYPEMVLLCGATPVAVPCGADTAYKLSPEKLEAAITPKTKWLILNSPSNPTGAAYTGAELKALADVLLRHPQVWILTDDMYEHLVYDGFEYKTIAQVEPALYDRTLTMNGVSKAYAMTGWRIGYAAGPEKLIGAMRKVMDQSTSNPCSISQWASVEALNGPQDFLPVFRAAYAKRRNLMVDGLNQAAGIVCPKPEGAFYVYPSCAGLIGKKTAGGAVIDSDKTFAAELLEQEKVAIVFGEAFGLPETFRISYATSDAALTEALVRIQRFCASLS

SEQ ID NO: 61244 - protein, 181 aa, Triticum aestivum
  misc_feature (27)..(27): Xaa can be any naturally occurring amino acid
HYLEEINCDALVKLKASFQKENKDHDXFIEEANEVTLKGSHNIGVAMATAQGLVVPSIKKVQSLSILEITKELSRLHEMALQNRLSTNDITGGTITLSNIGAIGGKFGSPVLNLPEVAIIALGRIQKLPRFDDEENVYPSSTINVTVGADHRVVDGATVARFCNEWKSLVEKPELLLLHMR

SEQ ID NO: 61245 - protein, 273 aa, Haemophilus somnus 2336
MSREDIMAIPLRTEQEIIKLRTACKLASDVLVMIEPYVKAGITTGELDRICHEYIVNEQKAIPACLGYYGFPKATCISLNEVVCHGIPTEGKVLKNGDIVNIDVTVIKDGYYGDNSKMYIVGETNIRSKKLVEAAQEALYVGLRVVKPGIRLNEIGRAVQKYTESQGFSVVREYCGHGIGTEFHCDPQVLHYYADDGGVILREGMVFTIEPMINAGKKEVRLMGDGWTVKTKDRSHSAQYEHQLVVTKDGCEVMTIREEEEKVGRISRIMVNI

SEQ ID NO: 61246 - protein, 445 aa, Escherichia coli
AVMGRNLALNIESRGYTVSVFNRSREKTEEVVAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAEDPQIANLLLAPYFKQIADDYQQALRDVVAYAVQNGIPVPTFAAAVAYYDSYRAAVLPANLIQAQRDYFGAHTYKRI

SEQ ID NO: 61247 - protein, 157 aa, Haemophilus somnus 2336
MKVLEGIVTAPNAKIAVVIARFNSFINESLLEGALDALKRIGQVKDENITLVRVPGAYELPLIARRLADSKKYDAIVALGTVIRGGTAHFEYVAGEASSGLGQVAMQAEIPVAFGVLTTENIEQAIERAGTKAGNKGAEAALVALEMVNLLAQIDKA

SEQ ID NO: 61248 - protein, 409 aa, Streptomyces fungicidicus
APQGMFEDLGLKYVGPMDGRDIEALESALTRAKRFGGPVIVHCLTEKGRGYQPALQDEADRFHAVGKIHPDTGLPIASSGADWTSVFGEEMVKLGEERDDVVAITAAMLQPVGLDRFAKRFPDRVYDVGIAEQHGAVSAAGLAHAGVHPVFAVYATFLNRAFDQVLMDVALHRCGVTFVLDRAGVTGTDGASHNGMWDMSILQVVPGLRLAAPRDADQVRAQLREAVAVEDAPTVVRFSKGAVGPAVPAVGRVGGMDVLREPGTDTPDVLLVSVGALAPMCLEIAGLLDRQGISTTVVDPRWVKPVDEAMAPLAEKHRVVVTVEDNSRVGGVGSTIAQALRDAGVDVPLRDFGIPPRFLDHASRAEVMAEIGLTAPDIARQVTGLVAKLDGRYERSAADAIDSVEPARD

SEQ ID NO: 61249 - protein, 487 aa, Colwellia psychrerythraea 34H
MSLVRYRNFVDGAYMANDSGETFDVINPATGKVIYQVEVADGKIKQEAITSAQSGFATWSAMSAIQRSRILLKAVALLRERNDELAEIEVLDTGKPWQEASVVDVESGADSIEFFAGLAPGIEGNQQQVDGDFYYTRREALGICAGIGAWNYPLQIACWKAAPALACGNSMIFKPSEETPLGALKLAEIFTEAGIPDGVFNVVQGAGEVGSWLSHHPDIAKVSFTGEVGTGKKVMAGAATTLKDVTMELGGKSPLIIFDDADIDNAVSAAMLGNFYTQGEVCTNGTRVFVQESAYPKFIEKLLQRTRQNIIVGDPMDPETNFGALISKKHFDLVSDYIKVGIKEGATLLHGGTSLQPDNAPNGYFIAPTIFTDCTDGMTICREEIFGPVMSVLIFIDEDEVVARANATDYGLAAAVFTQDINCAHRVIHKMEAGICWINSFGASPAQMPVGGYKQSGIGRENGLVTLNHYTQIKSVYVGLQPLDSPF

SEQ ID NO: 61250 - protein, 846 aa, Debaryomyces hansenii CBS767
MTFNKDLLVPCPIVTPTMEEFSDPIKYLSSEEVAKLGSEYGLIKVVPPKGWQPTFLISPEFKFHTRLQKLSDLGLTTRSRKFFIDNINRFMKMSRKRQLKLYFRVGLNDAKEFSPTRLKVYYYDLHVMVEKMGGYDNMNGDKWAQINDLFGLKKESTHIEDEYLINLRSYANFLSYNQKNYDFPESDSEDDYDNCLICGKHDNPSQTLLCDNCDNPFHLSCLEPSLETVPSGSWYCDKCLIGTGEYGFEEQVDLKYSIPEFYQLCNEFERKFEHEYNNDEPLSVDKIEQKFWEFIDVEKSDLEVRYGADIHNLKPGEISGFPMANTPGISPEDPETKYYMNHPWNLTKLPFAEGSLLNYINTSISGMTVPWIYIGSLLSTFCWHVEDHYTLSANYCHLGATKKWYGIPSYDADKFEKLMKDSAPDLFQKQPDLLHQLVTLLSPMTLVKNGIKCVYADQRPNEFVITYPRVYHAGFNCGFNFNEAVNFTMNTWLGFGEKSISDYRLIKKENVFNHYQLVENILKKINTQDDINHTNLRLAEASLKCLREFVQTQLKYISMIDISKFEVKFEPKLFKQRKFEDEQNGTFEATSEQEDEEDLCDICRTHISFQYCIINNRDRNLFSTHGVTGESLAPPHTVPPITLVKHELQDFPKISIHQLLTPESSPHELLVPQATPKTVHRISDSSSSTRLSALSETSITDTTSNPLPKLSEEQEFQNLIRAAKRSSSPDSSLCKTGKIDKTAPKRRKSSRIESLSKKAHITSFAARTLAGPRRGKMSVVQNNSRFKHLNDKPQIRLCLACLVSSCPKSIISIPLGSVMLYEVDPSTMLQFISQTSRKIALLSTNI

SEQ ID NO: 61251 - protein, 503 aa, Burkholderia vietnamiensis G4
MLITDPQATASTGNQSDAHAKEIHNFINGEYVPGQRWFEKRSPLNNAVIAKVAEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAMRRPVGVVGVICPWNLPLLLMTWKVGPALACGNTVVVKPSEETPQTAALLGEVMNTAGVPPGVYNVVHGFGPNSTGEFLTTHRGINAITFTGETRTGAAIMKAAADGARPVSLEMGGKNAAIVFADCDLDAAIEGTLRSCFANCGQVCLGTERVYVERPIFDRFVSALKKGAEGMQLGRPEDLATGMGPLISQEHRDKVLSYYKKAVEAGATVVTGGGVPDMPEALKGGAWVQPTIWTGLGDDSVIAREEIFGPCALVMPFDSEEEVIRRANDNDYGLATAIWTTNLSRAHRVAGAIEVGIAWVNSWFLRDLRTPFGGAKQSGIGREGGAHSLEFYTELKNVCIKL

SEQ ID NO: 61252 - protein, 542 aa, Phytophthora capsici
ELVGMLNTAKIPANVEVVVAPSQVHAATVKASLRSDVRVSGQDVWKQGNGAFTGETSAEMLKDLGAEYTLVGHSERREKGETNEVVAKKAAYALEKGLGVIACIGETKELREANQTVAYITEQLDAYAAEIKDWTNVVIAYEPIWAIGTGLTASPEQAQEVHASIRAWLKEKVSSDAAQKTRVIYGGSVGAKNAPELSQKEDIDGFLVGGASLKPDFLQIINAQNPTDNVGGAVNVAINGFGRIGRLVLRAAATNPLINIVAINDPFISTTYMEYMLEYDTVHGKFAGSLSHDEQHIFVNGKPIRVFNEMNPANIKWGEEQVQYVVESTGAFTTTEKASAHLQNGVEKVVISAPSSDAPMFVMGVNHELYEKNMHVVSNASCTTNCLAPLAKVVNDKFGIKEGLMTTVHAVTATQKTVDGPSKKDWRGGRGACFNIIPSSTGAAKAVGKVIPSLNGKLTGMSFRVPTADVSVVDLTARLVNPASYDEIKAAIKSASENEMKGILGYTEKAVVSSDFIGDSRSSIFDAEAGIALTDDFVKLVS

SEQ ID NO: 61253 - protein, 503 aa, Debaryomyces hansenii CBS767
MVFPRLFNSASRNAFTAAKRNFVFNRGLASAAPVAGKVRAVIGAVVDIQFDEGNLPAILNALTLKNGDQDLVLEVAQHLGENTVRAIAMDGTDGLVRGAPVNDTGAPISVPVGRETLGRIINVIGEPIDERGPIKTKQKNPIHADPPSFVEQSTSSEVLETGIKVVDLLAPYARGGKIGLFGGAGVGKTVFIQELINNIAKAHGGFSVFAGVGERTREGNDLYREMQETGVINLEGDSKVSLVFGQMNEPPGARARVALTGLTIAEYFRDEEGQDVLLFVDNIYRFTQAGSEVSALLGRIPSAVGYQPTLATDMGLLQERITTTKKGSVTSVQAVYVPADDLTDPAPATTFAHLDATTVLSRGISELGIYPAVDPLDSKSRLLDIAVVGKEHYDVASGVQQTLQAYKSLQDIIAILGMDELSEQDKLTVERARKIQRFLSQPFAVAEVFTGIPGKLVRLQETVKSFKEVLDGKHDHLPENAFYMVGGIEDATAKAEKLASESK

SEQ ID NO: 61254 - protein, 134 aa, Magnetococcus sp. MC-1
MSNDTKKTDAQWKEILTPEVYHVCRQKGTERPFSGQYTHNKEPGLYCCACCGQPLFNADAKYDSGSGWPSYFQAISEHAIRAETDLSHGMRRVEVLCSSCDAHLGHLFDDGPQPTGLRYCINSLALQLNPKPTA

SEQ ID NO: 61255 - protein, 516 aa, Bradyrhizobium japonicum USDA 110
MRLLERIFDLAIIGGGVNGCGIARDAVGRGNTVFLCEMNDLASGTSSWSTKLVHGGLRYLEYYEFRLVREALIEREILWGIAPHIIRPLRFVLPHHAGLRPAWLLRLGLFLYDHIGGRHLLPATRSVDLGRDEVGRPLIPNRYSRAFEYSDCFVDDARLVVLNARDAADKGAEIRTRTRATEIRQADGVWTVSMVNTLTGARSQVQARALVNAGGPWVEDVLGRGAGVNAKAKVRLVQGSHIVVKKLYDHDRAYMFQNADGRIIFVIPYQDDFTLIGTTDRDYDGDPAKVKATPEEIQYLCAAASEYLAKPVTSEDVVWTYSGVRPLYDDGASEAKAATRDYVFELDTPGGSPLLSIYGGKITTYRRLAEEALERLSPYLRSAKAREGWTGKWPLPGGDMDVSDIDGLIAELQRGYPFLGHAHARRLARAYGTRAIKLLGDAKSAADLGQAFGATLTEREVRYLMANEWAVTAEDIVWRRSKLGLRLSADEVAALDDWIRTNAVLQSPLLEAGGRS

SEQ ID NO: 61256 - protein, 391 aa, Colwellia psychrerythraea 34H
MSIIKMADLTLANQRVLIREDLNVPVTDGKITSDARLRAALPTLKLALEAGAKVMVMSHLGRPTEGQPEEKFSLKPVTDYLSAALNYPVRLVTDYLDGVDVAAGELVVFENIRFNLGEKKNDDTLAKKLAALCDVFVMDAFGTAHRAQASTHGVAKFAATACAGPLLSGELEALGKALDNPARPLVAIVGGSKVSTKLTVLDSLAGIVDQLVVGGGIANTFIAADGHNVGKSLYEADLVEEATRLTKQAKANNGDIPVPSDVVVATEFSASATATLKPVNEVTADEMIFDIGPETAKALTEIIANAGTIVWNGPVGVFEFDQFGEGTKVIAQAIADSSAFSIAGGGDTLAAVDKYEIADKISYISTGGGAFLEFLEGKKLPAVEILEQRAK

SEQ ID NO: 61257 - protein, 389 aa, Synechocystis sp. PCC 6803
MRLTQRVSQVVPSITLEITAKAKAMRTEGIDVLSFTAGEPDFTTPPHIVEAAKLALDEGKTRYGPAAGEPALRQAIAKKLREKNNLPYEAANILVTNGGKHSLFNLMLAMIEQGDEVIIPAPYWLSYPEMVRLAEGTPVIVNTTAATDYKITPEQLRQAITSKSKLFVLNSPSNPTGAVYTPAEIRALAAVILEYEDLYVVSDEIYERILYDGTEHLSIGAVNDEIFQRTIISNGFAKSYSMTGWRVGYLAGELPLIQACSTIQGHSTSNVCTFAQYGAIAALENPQTCVETMVKAFTERRQVIVEGINQIAGLSCPNPKGAFYVFVDIAKTGLNSLEFSARLLESHQVAVIPGAAFGADDCVRFSYATDMDTIKQGLAELERFVSTLA

SEQ ID NO: 61258 - protein, 208 aa, Oryza sativa Japonica Group
MATSIVDDFGDGTYTVAFDEDYIHTTVTYSGDDVDDWLDEILRIHRRRLNYLVVGLDVEWRPATYYHGPGPVAVLQICVGRRCLIFQILHADYVPDSLFDFLADGRFTFVGVGIHDDVAKLRSHHGLEVENVVDLRYLAAQTIGKPALRSAGLQGLVREVMGVWAPKPYHVRVSAWDSWNLTPEQVMYACADAFASFEVGRSLYYDYD

SEQ ID NO: 61259 - protein, 267 aa, Synechocystis sp. PCC 6803
MEKYNIQVLGNVNSQETLVFAHGFGSEQNAWRSIYPAFEENYRIVLFDFPGSKPANSKDFDIQNYNSLKDYADDLMEIAHLAGVRQGILIAHSASCMIGVLASLRDPNLFKGMVFICGSPRYRDDGDYKGGFSQEKIATILNEMSHNYAEWIRTYAPAAVNDPNKPELVEEFSHCLLQLRPDIGLVVFSLIIMSDYRREVAQVEIPTLIVQPQEDIFVPPTVGAYLYRIMKNSELYWIDTPGHFPHLANPTEITKAIADYLQENEFV

SEQ ID NO: 61260 - protein, 361 aa, Picea sitchensis
MLRSSASRLRNLKLGTHGRKVSATSTTTRVSPAEISQQSSSGGLISWLPGNKSKSPPPLDYPLPGVKPPPTLPDYIEPTKTIFTTVPNGLKVASEASATLMGGAGSFSAGGTGKGMYYRLYLRVLNEYRQVQSFSAFNSMYNDNGRFGNHATAGISTSRERHVEASSETNIQPMPSPLSQVPALLSGKTEEESSVQRKRTVQAVLKKIKQSPKKVNLVAALVRGMRVEDALLQMQVTVKRAAKTVYKVIHSARANAVHNHGLDGDRLIIAQAFVGKGLFRKTISYHAKGRSGIRVRPQCRLTVIVRELTPEEEAEIAKLRVRKFRKLSKREHRLVPHKLVETQWRWHRKPKDQVASGSTMA

SEQ ID NO: 61261 - protein, 194 aa, Arabidopsis thaliana
MTGTGQKLNIRRRVGEVNSLSFCCLSPTPTSLDNRCVNMIANLFHAPVGQDEAVISCGIVASSESAGLAFKMKWQHRRKAQGLPIDKPNIVTGVNVQVCWEKFARYFEVELKEVKLSEDYYVMDPAKAVEMVDENSICVAAILGSTFTGEFEYVKLLNDLLAEKNAKTAWETPIHVDAASGGFIASMGEEYQCQ

SEQ ID NO: 61262 - protein, 219 aa, Triticum aestivum
  misc_feature (57)..(57): Xaa can be any naturally occurring amino acid
FQILARLPRIHYLKMKLVSQTWKAAITGAELAQLRKELGLTEEWLYILTRVEANKLXCYALDPLFQKWQRLPSMPSFANEADSTGRTQYSVFRMWNVVGSSIRIADFFRGWFWRRYGLDQMPFCGCSVGVADGCLYVLGGFSKAVALNCVWRYDPCVNLWQEVNPMISGRAFSKASLLESKLYVVGGVSRGRNGLLPLRSGEVFDPKTGLWSELPEMPF

SEQ ID NO: 61263 - protein, 194 aa, Lactobacillus sakei subsp. sakei 23K
MLVPTVIEQTSRGERAYDIYSRLLKDRIIMLSGEVNDQMANTIIAQLLFLDAQDSDKDISIYINSPGGSVTAGLAIMDTMNFIKSDVQTIAMGMAASMASVLLSAGTKGKRFALPNSTVLIHQPLGGAQGQQTEIEIAAREILKTRKRLNQILADNSGQTFEKLQADTDRDNYMTAQEAKDYGLIDDIMVNQPK

SEQ ID NO: 61264 - protein, 197 aa, Glycine max
GKGLAEVFSRDGVSFSTTCQNLVPRPWIIDDLETFRIAWSKKSWKKVIIFVDNSGADVILGILPFARELLRRGSQGILAANDLPSINDVTYSDLIEIIPKLKDEEGRLTGVSTSNLLIANSGNDLPVIDLTRVSQELAYLANDVDLVILEGMGRGIETNLYAQFKCDSLKIAMVKHPEVAEFLGSRLYDCVIKYDEL

SEQ ID NO: 61265 - protein, 655 aa, Oryza sativa
MADTFFPGAKLGWNKITGLNRRIISKKNLVDPATGMYCEELDPTGVNQVFLALVNSSTPYWSSGAWNGEYLSSILEMASHNFFIPSFVNNDQEKYFTYNLANENIVSRQILDVGGQSKTFLWLEGSKDWVMVNAQPKAQCDVYSICGPFTVCTDNELPNCNCIKGFTITSLEDWVLEDRTGGCSRNTPIDCISNKTITRSSDKFYSMPCVRLPPNAQNVGSVDSSSECAQVCLNNCSCTAYSFSNGGCSVWHNELLNIRKNQCTGSSNTDGETFHIRLAAQELYSQEVNKRGMVIGVLSACFALFGLLLVILLLVKWRNKTKLSGGTRKDYQFCNGIIPFGYIDLQHATNNFTEKLGGGSFGSVFKGFLSDYTIVAVKRLDHACQGEKQFRAKVSSIGIIQHINLVKLIGFCCEGGRRLLVYEHMPNRSLDHQLFQTNTTLTWNIRYELAIGIARGLAYLHENCQDCIIHCDIKPENILLDHSFSPKIADFGMAKLLGRDFSRVLTTTRGTAGYLAPEWISGVPITTKVDVYSYGMVLLEIISGKRNSYASCPCGGDHDVYFPVLVACKLLDGDMGGLVDYKLHGGIDKKEVEKAFKVACWCIQDDEFSRPTMGGVVQILESLVEVDMPPMPRRLQAIAGSSNSTCSLYSLPANI

SEQ ID NO: 61266 - protein, 887 aa, Fulvimarina pelagi HTCC2506
MPQRIFPFQKGRAERPADPLESLGLKGADLSLLASLNLPVPPGFTISTYAWREAKGGRDDLPMGLRADLRDQVEALEEVTGRRFDGDRRPLLLAVRSSAKTAMPGLAESVLDVGLNGRTVEILAEELDDATFAFRSYRRLIESYAQLVFDTDPTDFEEIADEEAGEKGWTGEPASIDDWRSLIARLNAFLADELDVVMPQTPFEQLVEIVNAVFKSWRSAPAQAYRALHGIPENSGLAVTIHSMIFNERNAQSGRGRALSRDMATGRPQLTGEFQLGSGHVLRNGEHRTIDLAGALADGGSDYPADIADLDDHVRAVEAYLGDLAEVEFMIGDGELFLLQSRVGRRSASEAVRLAVEFVRDGLIDEAEALTRIDATSLDQLLHPSIQRDESFVVMARGMPASPGAATGEIVFSSDRAQAVAAEGRKVILVRHETFPEDIHGMHVSEGVLTIRGGTTSHAAVVARGIGKPCVTGAGTLRLNAATGELHAGNKVLRQGDAITIDGASGEVIEGAVTLVRPSLDGDFATLMEFADRARQMKVRTNAETPAEARAARDFGAEGIGLTRTEHMFFEGDRVRAMREMILASDENGRRAALEKLLPIQRADFVELFEIMAGLPVTIRLLDPPLHEFLPQAENDIDEAAEFLGVNVSSLRERIAALQEFNPMLGHRGCRLAISYPEIAEVQSRAIFEAAVEAGAKTGAAVTPEIMVPLVSLRRELDFVKERIDAVAAQVIEETGTKLTYRVGTMIELPRAIVRADTIAEAADFFSFGTNDLTQTVFGISRDDAGTFLSTYVREGIVERDPFQTVDVEGVGELIQIAVEKARRTKPDIELGVCGEQGGDPASIAFFAEAGLDYVSCSPFRVPIARLAAAQAAIREGRITRGGRSRR

SEQ ID NO: 61267 - protein, 798 aa, Oryza sativa
MALPITVLFLLFTLHIPASCKVTDTISAGETLAGNDRLVSSNGKFALGFFPTSSKSSHNASNWYLGIWFNQVPKLTPAWVANGDEPVTGPTSPEATISGDGNLVILDQATKSIIWSTQADITANTTMVKLLDNGNLVLQNTSNSSVVLWQSFDYPTNTHLAGAKLGRNKVTGLNRRLVSRKNSVDPASGMYSYELTDNNGSARFILAALNSSITYWSSGEWNGHYFGSIPEMTGQRLIDFTFVHNDEEVYFTYTLLDNATIMRFMLDISGQTKIFLWVEHVQDWVPTYTNPKQCDVYGICGAFTACEESKLPICKCMKGFSVRSPNDWELDDRTGGCVRNTPLDCGINRNTSMQDRFHPMPCVGLPSNGQIIEDVTSAGGCAQVCLSNCTCTAYYYGNTGCSVWNDELINVKQLKCGDIANTDGATLYLRLAAKEVQSIKSSGRSIIIGVAVTASVASFALALFLIAKIPRNKSWLLGHRRKNFHSGSGVIAFRHADLQHATKNFSDKLGAGGFGSVFKGLLNESTVIAVKRLDGARQGEKQFRAEVGSIGIIQHINLVKLIGFCCEGDRRLLVYEHMPNLSLDTHLFHSDATVLKWSIRYQIALGVARGLAYLHDSCQDCIIHCDIKPENILLDASFVPKIADFGMAKFLGREFTQVLTTMRGTIGYLAPEWISGTVITSKVDVYSYGMVLLEIISGTRNSSKEFATRDDYEYFPVLVAHKLLDGDAGSLVDQNLHGDVDLEQVERAFRVACWCIQDNELDRPTMSEVVQYLEGLLEVGIPPVPRLLQAIAGNPYSK

SEQ ID NO: 61268 - protein, 319 aa, Lactobacillus sakei subsp. sakei 23K
MTHKMILDLDTGIDDALAIAYALGSPEVELIGITSEYGNVLTERSVVNSQQILHLLGHPEIPVYLGAGHSTMTNDFSVLPISAEIHGQDGVGEIHLTQPHPDAASESAVDFILAACQQYGADLSIVATGPMTNLALAIQKDLPTLQKVGQIVIMGGALTVCGNVSPYAEANISQDPEAADLLFKSGLPVTMVGLDVTLRTLFTKKDTQEWRALATDAAKAYADMVDYYIKAYEVTSPHLHGCALHDPLAVAVAINPSLVTTFPLNLKTEVEGPSRGRTIGDNARLDDPKTRTAVCVQVDTPRFLNAFKTRIGQLLKAVK

SEQ ID NO: 61269 - protein, 337 aa, Gibberella zeae PH-1
MASNPKYDNYDFPAQGAEKQDGHAGYLTEDQTAKLEQFRMMLESEGCTDRLDTLTLLRFLRARKFDVEASKAMFLDTEKWRKETKLDETVPVWDYPEKAEINKYYTQFYHKTDKDGRPIYIETLGGIDLNAMYKITTAERMLTNLAVEYERVADPRLPACSRKAGHLLETCCTVMDLKGVSIGKVPQVYSYVKQASVISQNYYPERLGKLYMINAPWGFSTVWSIVKGWLDPVTVSKINILGSGYKGELLKQIPAENLPKAFGGECQCEGGCENSDAGPWHEAEFARPAWWEKKQDANVIENKGSEIEEPAKAPEAAPVAEGADATQTAPAPAPAAA

SEQ ID NO: 61270 - protein, 372 aa, Hordeum vulgare subsp. vulgare
MGNCAGVQGNAEINPTFSAPNTSGNNSKSSSSNATDTSTFGKSSSSSVPPTPRSEKEILQSSNLRKFTFSELKSCTRNFRTDSLLGEGGFGSVFKGWIDERTFTPVKPGTGMIVAVKKLKLDSFQGHKEWLAEVNYLGQLSHPNLVKLIGYCLEDEQRLLVYEFMPRGSLEHHLFRRAPHFQPLSWNLRMKVALEAARGLAFLHSDEAKVIYRDFKTSNVLLDSEYNAKLSDFGLAKDGPSGDKSHVSTRVMGTQGYAAPEYLATGHLTTKSDVYTYGVVLLELLTGQRALDKNRPPGQHNLVEWARPYINSKRRVIHVLDPRLGSQYSLPAAQKAAALAMQCLSMDARCRPDMDQVVTVLQKLPEVKKTYK

SEQ ID NO: 61271 - protein, 837 aa, Oryza sativa
MAMRRLTILLELLFSLAIPGIPVVMVASRDTISPGESLAGNDRLVSSNGNYALGFFQAGGGGGGAPTWYLGTWLNRVPRGVVTPVWVANGDSPIAVDDPATAELAVSPDDGNLVIIVAKKSIAWSTSTALVANATTTTTNTTTTAAAVVATLSDGGNLILRRSSSNASSSHILWQSFDHPTNSLLPGAKIVRDKVTGLTSRLVSRKSTADQAPGAYSLQLDPSGAAQFVLVELTSGVVYWSSGEWNGRFFDSVPDMGAGSAFVSNSREEYFTSPTETATVITRLSLEVSGQLKSFLWYEGLQDWVVAASQPKSQCDVHATCGPFAVCDDGVLPSCGCMEGFSVRSPVDWELEDRTGGCARDAPLDCTAAAGNSSKSSDKFYSLPCVRLPHNAQNMAAATDESECANLCLSDCSCTAYSYGHGGGCRVWHDELFNVQQQQFNDHGTAKVELLHLRLAAKEVEKNGENGRRRMLIWILAGATLGFLVLVLLTLMICRNQKKWPGSSILGNVQGGNGIIAFRYIDLQRATKNFSERLGSGGFGSVYKGSLGDSNTIAVKMLHGVCQGEKQFRAEVSSIGVIQHINLAKLIGFCSQGSRRLLVYEYMPNHSLDVHLFQSNTTSMLSWTSRYQIALGIARGLAYLHESCRDRIIHCDIKPQNILLDASFVPKIADFGMATFMQRDLSRVLTTVRGTVGYLAPEWISGVPITTKVDVYSYGLVLFEIISGRRNSCDGHTSQGHNAAYFPLHVAHSLLKGDIQNLVDHRLCGDANLEEIERACKVACWCIQDADFDRPTMGEVVQVLEGVRELRVPPVPHLLQAVAGEPASACTEIFFKAFTSD

SEQ ID NO: 61272 - protein, 281 aa, Streptomyces coelicolor
MGSSHHHHHHSSGLVPRGSHMATQDSEVALVTGATSGIGLEIARRLGKEGLRVFVCARGEEGLRTTLKELREAGVEADGRTCDVRSVPEIEALVAAVVERYGPVDVLVNNAGRPGGGATAELADELWLDVVETNLTGVFRVTKQVLKAGGMLERGTGRIVNIASTGGKQGVVHAAPYSASKHGVVGFTKALGLELARTGITVNAVCPGFVETPMAASVREHYSDIWEVSTEEAFDRITARVPIGRYVQPSEVAEMVAYLIGPGAAAVTAQALNVCGGLGNY

SEQ ID NO: 61273 - protein, 494 aa, Arabidopsis thaliana
MVLATNSDSDEHLHSTFASRYVRAVVPRFKMPDHCMPKDAAYQVINDELMLDGNPRLNLASFVTTWMEPECDKLIMDSVNKNYVDMDEYPVTTELQNRCVNMIANLFHAPVGEDEAAIGCGTVGSSEAIMLAGLAFKRKWQHRRKAQGLPIDKPNIVTGANVQVCWEKFARYFEVELKEVKLSEDYYVMDPAKAVEMVDENTICVAAILGSTLTGEFEDVKQLNDLLAEKNAETGWETPIHVDAASGGFIAPFLYPDLEWDFRLPWVKSINVSGHKYGLVYAGVGWVVWRTKDDLPEELVFHINYLGADQPTFTLNFSKGSSQIIAQYYQFIRLGFEGYKNIMENCMDNARRLREGIEMTGKFNIVSKDIGVPLVAFSLKDSSKHTVFEIAESLRKFGWIIPAYTMPADAQHIAVLRVVIREDFSRGLADRLITHIIQVLKEIEGLPSRIAHLAAAAAVSGDDEEVKVKTAKMSLEDITKYWKRLVEHKRNIVC

SEQ ID NO: 61274 - protein, 378 aa, marine gamma proteobacterium HTCC2143
MSKRDYYEILGVARDSAGKDIKKAYRRVAMKFHPDRNPDDKDSEEKFKEASEAYEVLSDSQKRAAYDQYGHDAVNGNAGAGGFGGGNGNFGDIFGDVFGDIFGGGGGGGGRSRGPARGSDLRYNLDVDLEAAVKGTEVKIRIPTLVSCEPCSGSGAKKGSAPVTCTTCGGIGQVRMQQGFFSVQQACPNCRGKGKMISDPCNSCHGQGLKEETKTLSVKVPPGVDTGDRIRLSGEGEAGPDGGPSGDLFVQINVRSHSIFERDGKNLYCEVPISITDASLGGELEVPTLDGRVKLKIPEETQTGKLFRLRGKGVAPVRGGSTGDLLCRVVLETPVNLTKSQKDLLQQLQESFEKEGNQSPKKSSWFAGVKSFFDDMKV

SEQ ID NO: 61275 - protein, 807 aa, Oryza sativa
MLLPCHVLLGLLLLSLYTPASYAAATDTVSPGHSLAGSDRLVSNNSKFALGFFKPGNESSSYTNHNSYLGIWFNKVSKLTPLWTANGENPVVDPTSPELAISGDGNLAILDHATKSIIWSTRANITTNDTIAVLLNNGNLVLRSSSNSSNIFWQSFDYPTDTLFAGAKIGWDKVTGLNRRLVSRKSSVDQAPGIFSLELGLNGEGHLLWNSTVAYWSSGDWNGRYFGLAPEMIGDVMPNFTFVHNDQEAYFTYTLYDDTAIVHAGLDVFGIGFVGMWLEGNQEWFKNYRQPVVHCDVYAVCGPFTICDDNKDLFCDCMKGFSVRSPKDWELDDQTGGCIRNTPLSCGSSKDRTSLTDKFYPMQSIRLPNNAENVQAATSGDECSQVCLSNCSCTAYSYGKGGCSVWHDELYNVKQLSDSSSDGNGGVLYIRLAARELQSLEMKKSGKITGVAIGASTGGALLLIILLLIVWRRKGKWFTLTLEKPEVGVGIIAFRYIDLQRATKNFSEKLGGGSFGSVFKGYLSDSTIAVKRLDGARQGEKQFRAEVNSIGIIQHINLVKLIGFCCEGDNRLLVYEYMPNRSLDVCLFEANGIVLDWTTRYQVAIGVARGLAYLHNSCRDCIIHCDIKPENILLDASYVPKIADFGMAKILGREFSRAMTTMRGTIGYMAPEWISGTVVTSKVDVYSYGMVLFEIISGRRNSSHECFRDGDYSFFFPMQVARKLLNGDIGSLVDASLKGDMNLVEVERACRIACWCIQDNEFDRPTMAEVVQALEDLLELDMPPLPRLLSAITGGSHSVIPQYFDSV

SEQ ID NO: 61276 - protein, 808 aa, Oryza sativa
MPLLRHVLLGIVLLFLHTLASSAATDTVSPSQALAGSNRLVSNNSKFALGFLKPGNESYNNHNSYLGIWFNKVPKLTLLWTANGDNPVVDPTSPELTISGDGNLAILDHATKSIIWSTRANITTNDTIAVLLNNGNLVLRSSSNSSKIFWQSFDYPTDTLFAGAKIGWDKVTGLNRRIVSRKNSIDQAPGMYSLEVGLNGDGHLLWNSTVPYKSSGDWNGRYFGLAPEMIGVALPNFTFVYNDQEAYFTYTLRDDTAIVHTGIDVFGRGFAGTWLEGSQDWLIHYRQPIVHCDVFAICGPFTICDDKKDPNNNPFCDCMKGFSVKSPKDWELDDRTGGCMRNTPLSCGSSKDRSDLTDKFYPMQSIRLPNNAENVQAATSGDQCSQVCLSNCSCTAYSYGEDGCSIWHDELYNVKQLLDAASDGNGVVLYVRLAAKELQISERKKSGTLIGVAIGASTGTLFLITLLLILWRIKGKWIIAHPLEKSEDSIGIIAFRHIDLRRATKNFSEKLGGGSFGSVFKGNLSDSTIAVKRLDGARQGEKQFRAEVNSIGIIQHINLVKLVGFCCEGDNRLLVYEYMPNCSLDVCLFKANDIVLDWTTRYQIAIGVARGLAYLHTSCRDCIIHCDIKPENILLDASYVPKIADFGMAKILGREFSRAMTTMRGTIGYLAPEWISGTVVTSKVDVYSYGMVLFEIISGRRNSSHENFRDGDYSFFFPMQAARKLLDGDVGSLVDASLEGGVNLVEVERACKIACWCIQDNEFDRPTMGEVVQSLEGLLELDMPPLPRLLNAITGGSHPVTPQYFYSL

SEQ ID NO: 61277 - protein, 273 aa, Hyphomonas neptunium ATCC 15444
MSKPSPVGAVMIAAALAAGRSLARDFGEVENLQVSRKGPADFVTSADMRAEEIIHASLTKARPGYGFLMEERGIVEGTDKSNRFIVDPLDGTLNFMHGQPHYAVSIGLERDGKPFAGVVFDVAKNEIFWAEVGRGAWLDQRKLRVAVRKKLGEAVVATGTPWMGKSEESHITFAREMAAMTPTCAGIRRYGSAALDLAWVAAGRFDAFWEHGLKPWDIAAGIVLVREAGGIVEEINGGDVMKTGSILAGNEDIVPPVMHQLRHAASFGKAAKV

SEQ ID NO: 61278 - protein, 281 aa, Xanthomonas oryzae pv. oryzae KACC10331
MGHACASTAQQRPFSCVLKRGTHVTTHRWRLDGQTALITGASAGIGLAIARELLGFGADLLMVARDADALAQARDELAEEFPQRELHGLAADVSDDEERRAILDWVEDHADGLHLLINNAGGNVSRAAIDYTEDEWRGIFETNVFSAFELSRYAHPLLTQHAASAIVNVGSVSGITHVRSGAPYGMTKAALQQMTRNLAVEWAEDGIRVNAVAPWYIRTRRTSGPLSDPDYYEQVIERTPMRRIGEPEEVAAAVGFLCLPAASYITGECIAVDGGFLRYGF

SEQ ID NO: 61279 - protein, 305 aa, Polaromonas sp. JS666
MTQPTVTADDPDLSHVGPRDKAEILAQALPYIRKFHGKTMVIKYGGNAMTDPALQADFAEDVVLLKLVGMNPVVVHGGGPQIEAALNRLGKKGHFIQGMRVTDEETMEVVEWVLAGQVQQDIVGLINQAGGKAVGLTGRDGGLIRAQKLKMVDKDDPAKEHDIGFVGDIVSIDPSVVKALQDDAFIPVISPIGFGESNESYNINADVVAGKLATVLKAEKLVLLTNTPGVLNKAGELLTDLTAREIDDLFADGTISGGMLPKIEGALDAAKSGVNSVHIIDGRVPHAMLLEILTDQAYGTMIRSH

SEQ ID NO: 61280 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLDYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 61281 - protein, 333 aa, Nectria haematococca
MMLILSILSIIAFAAASPVPSIDENIRVLEHRAVTVTTQDLSNFRFYLQHADAAYCNFNTAVGKPVHCGAGNCPDVEKDSAIVVGSVVGTKTGIGAYVATDNARKEIVVSVRGSINVRNWITNFNFGQKTCDLVAGCGVHTGFLEAWEEVAANIKAAVSAAKTANPTFKFVVTGHSLGGAVATVAAAYLRKDGFPFDLYTYGSPRVGNDFFANFVTQQTGAEYRVTHGDDPVPRLPPIVFGYRHTSPEYWLDGGPLDKDYTVSEIKVCDGIANVMCNGGTIGLDILAHITYFQSMATCAPIAIPWKRDMSDEELDKKLTQYSEMDQEFVKQMT

SEQ ID NO: 61282 - protein, 372 aa, Hyphomonas neptunium ATCC 15444
MTKKAQAAVIERTDDPFVIQDITLDAPRPDEVIVRMVATGICATDAHVRQQSIPAPLPAILGHEGAGVVERVGSAVTHVKAGDHVVLSFHACGQCKPCLSSHAAYCDKVWEANFAGARLDGSTGIRREGPDRLHAHFFGQSSFATYALAHQRNTIKVPSDIPLEILGPLGCGMQTGAGAILKALKVPVGATVAIFGVGAVGLAAIMAARIADAMTVIAIDVNAGRLELAGELGATHVINAASNKNIAAAIRQIEPRGIEFVLDTSGRASNLDAGIAALAPMGHFGFVAFNDHSGAVVDASRLTLGQTLQGIIQGDAVPALMIPELIGLYRSGRFPFDRLITFYDFADINQAFEDVAAGRVIKAVLRFKPSAE

SEQ ID NO: 61283 - protein, 398 aa, Bartonella quintana str. Toulouse
MTQTIPSPNPWSISRPTALLILADGTVIEGKGAGATGVAEGEICFNTAMTGYEEILTDPSYKKQIINFTFPHIGNVGTNSEDIEDLTPLNCHGAVGAIFKADITYPSNYRANENLNQWLKTRKIIALCGVDTRALTVLIREKGSLNGIIIHDPNGNFDIHALKKHAQKWTGLINLDLAKEVTSKQFVEWNEKPWVWNKGYSTNDACNFHIVAIDYGIKRNILRLMAAHGARITIVPANTNVEKILAMNPDGVFLSNGPGDPTATANYAVPTIQALIDSNIPLFGICLGHQLLALAVGAKTIKMHQGHHGANHPVKDFITRKVEIASMNHGFAVETTSLPEHVEETHISLFDNSNCGLRIIGKPVFSVQHHPEASPGPQDSHYLFQRFFNLIMDYKRTA

SEQ ID NO: 61284 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQCDYFGAHTYKRI

SEQ ID NO: 61285 - protein, 435 aa, Methanosarcina mazei Go1
MYPKQFLKFGETSLFQETVLRCLEVSDISEVFVVTNEAQKFFVIGQIKEAGYSIPPENILIEPEGKNTLPAIFFGMKEIEKKFGDSIVGVFSSDHVLDRAAMATISSAENLASDYLVTFGVVPTFPHTGYGYIKASEACSPGYRVSEFREKPDFETAKKYIEEGCLWNSGMFLFETRLFFEEARKHAPSVYGCFEKEGDINQIYECVDNISIDYGIMEKSDKVAVVRLDHKWSDLGNFAAIYDELEKDSVGNVIHDCDPMLLNSDGNLVYSRCGKIVSLIDVKDMVVVDTSDALLICPKSSSQKVKEIVSELKGRKDERAFIGQTVYRPWGSYTLLDASPGHKIKNITVLSDHKLSLQLHYHRSEHWVVVKGMACVEVDGKQFFLGPGESTFIRAGQKHRLSNPGKLPLEIIEVQLGELVDEEDIVRFDDVYGRR

SEQ ID NO: 61286 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKEIADDYQQALRDVVAYAVQNGIPVPTFAAAVAYYDSYRAAVLPANLIQAQRDYFGAHTYKRI

SEQ ID NO: 61287 - protein, 198 aa, Thermoanaerobacter tengcongensis MB4
MIFMSLVPIVVEQTNRGERAYDIFSRLLKDRIVFLGDEINDTTASLVIAQMLFLEAEDPDKDIWLYINSPGGSITAGLAIYDTMQYIKPDVVTLCVGMAASMAAFLLAAGAKGKRFALPNSEIMIHQPWGGMQGQATDIKIHAERLLRLRDKLERILSENTGQPLEKIKADMERDYFMTAEEAKTYGIIDDILVRHKK

SEQ ID NO: 61288 - protein, 200 aa, Solanum lycopersicum
MATEAPVEATEIPSVAAAETVEKQPHKLERKWTFWFDNQSKPKQGVAWGSSLRKAYTFETVEEFWSLYDQIFKPSKVTVNADFHLFRAGIEPKWEDPECANGGKWTATSSRKANLETMWLETLMALVGEQFDESEDICGVVASVRRSQDKLSLWTKTATNEAAQMGIGRKWKEIIDAEKISYSFHDDSKRERSAKSRYTV

SEQ ID NO: 61289 - protein, 400 aa, Bartonella quintana str. Toulouse
MAFIADKLSRIKPSATIAVSQKARNLKALGRNVITLGAGEPDFDTPNNIKNAAIEAIRRGETKYTPVSGIPELRQAISAKFKRENNLTYQPEQIIVGTGGKQILFNALMATLNKDDEVIIPSPYWVSYPEMVTLNGGIPIFVETKAEFSYKLQPQELEAAITHKTKWFIFNSPSNPSGAAYTHNELKKLTDVLVKYPHVYILTDDIYEHLIYGGFTFVTPAQVEPNLYNRTLTMNGVSKAYAMTGWRIGYAGGPPELIKAIDTIQGQQTSGTSSISQWAAVEALNGPQDFIAQNKSIFQARRDLVVSILNQAPGINCPTPEGAFYVYPSCAELIGKKTPEGNVINDDEDFVTALLEAESVAVVHGSAFGLGPAFRISYATSEKLLEEACLRIQRFCNNLL

SEQ ID NO: 61290 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPKIANLLLAPYFKKIADDYQQALRDVVAYAVQNGIPVPTFSAAVAYYDSYRAAVLPANLIQAQRDYFGAHTYKRI

SEQ ID NO: 61291 - protein, 327 aa, Oryza sativa Japonica Group
MVADPPLQKVTLGSTVHGSALLEDGPNPLPSHLSPSPSLLPSPKRTPTCRLSPSSRRLDRSGRGREEGRGKGVVRRDTGSLATQYLTSGPNTCGLSVISDSLRENYSGLNLKTPKAERDLSTSIVNDFGDGTYTVAFDEDKIYTTVTDSGEEVEEWLDEIVRIHHRRLDHLIVGLDVEWNPASGFCALGPVAVLQICVGRRCLVFQIIHADYVPDQLGDFLGDGRFTFVGVGIHDDVDKLREHYDLEVENAVDLRYLAAQTIGKPALRSTGLQGLVWEVMDVWMEKPHHVRVSAWDSRQLTLDQVMYACADAFASFEVGRSLYDDYE

SEQ ID NO: 61292 - protein, 469 aa, Methanosarcina mazei Go1
MQELHGEKTGKAKKERTPMPEQPAGERRKNFNEVALGYTKEDALAEASRCLACKEPKCVEGCPVNVDIPGFIQLICEENFEGAIERIKATNALPAICGRVCPQESQCEAHCVLGKKGQPVAIGRLERFCADYEREKGVKSPQVMPPTGKRVAVVGSGPAGLTAAADLAKLGHKVTIFESLHKAGGVLSYGIPEFRLPKEIVRQEIEYIEKLGVEVRPNYIIGRIKTLDELCDDFDAVFLGTGAGLPSFMGIEGENLNGVYSANEFLTRVNLMKAYDPEYDTTVRRGKNVVVVGGGNVAMDAARSALRLGADEVSIVYRRGEDEMPARREEIEHAKEEGITFRLLTNPVRILGDEKFNVTGVECIRMELGEPDKSGRRSPVPVEGSEFLVPADVVVIAIGTSPNPIIFKGSEGLEQNKRGTVVADEETGATSKCGVFAGGDVVTGAATVISAMGAGKKAAKAIDEYLKEK

SEQ ID NO: 61293 - protein, 709 aa, Streptomyces fungicidicus
MSTTAELLKGAAELFPGEVVTSAHVRHFDLPLGAGRFALITLDNGHDHTKPTTLGPQSLANIDAAIDRVEKEAADGEIVGVGVTGKPFIFAVGADLKGVELLKRHEDALAIGKGGHDVFKRLSTLAVPTFAYYNGAAMGGGVEVGLHCTYRTVSAALPAFSLPEVFLGLVPGWGGCTLLPNLIGAEKAVSVIIENSLNQNKQLKGAQVFELGIADAIFEGADFLEQSLIWTAAVLKDEIRIERPVIDRGEAWDQAVAKGRFIADSKVHGAAPAAYRALDIIAAAKNGDLQQGYDAEDQALADLIMGGELRSGIYAFNLVQKRGKRPAGAPDKSLARPVTKVGVVGAGLMASQLALLFLRRLEVPVVLTDIDQARIDKGVGYVHAEIDKLLGKGRINQDKANRLKALVTGVLDKAEGFADADFVIEAVFEEMGVKQQVFAEVEAVAPAHAILATNTSSLSVSEMASKLKHPERVVGFHFFNPVAILPLLEIVRGERTDDAALATAFGVAKKLKKTAVLVKDAPAFVVNRILTRFMGEIQNVIDEGTPVEVAEKAVEPLGLPMSPLVLLELVGPAIGLHVSETLNRAFPERFTVSPNLRAVVEAGKRGFYLYDSGKPELDPEVAALLKQGDTVLTEEQVRARVLDAVAQEIGLMLDEGVVAEAQDIDLCLITGAGWPFHLGGITPYLDREGVSERVNGKRFLEPGTASVPA

SEQ ID NO: 61294 - protein, 102 aa, Triticum aestivum
  misc_feature (54)..(54): Xaa can be any naturally occurring amino acid
  misc_feature (82)..(82): Xaa can be any naturally occurring amino acid
  misc_feature (89)..(89): Xaa can be any naturally occurring amino acid
  misc_feature (91)..(91): Xaa can be any naturally occurring amino acid
  misc_feature (94)..(94): Xaa can be any naturally occurring amino acid
MDSSRRPSGIQQLLAAEQEAQQIVNAARAAKTARLRQAKEEAEREIAEYRAQMXEADSKRKSLRPAVTLGANVKRLGARDNXLKIEHSXQXAAXISPEVIKA

SEQ ID NO: 61295 - protein, 1115 aa, Arabidopsis thaliana
MAEPSFARLFLLFFSFLLIFATYSWVFGPDSGFLFGTRVRKTLGSNRQVHVDHSLEKPHHPLDPLTVREINRVRTILSNHDPGFGSGSATIHSMALDEPEKSRVVQWKKGNKLLSRRAAVVAYWGGQTHEITVDLDSGRVVSDVINRTSGYPILTLNDVFAASQVPLKSLEFNRSIEARGVKFSDLACITPFAGWFGSEEEGRRVIRVQCFTLQGTTNYFMRPLEGLYVTVDLDKLEVIKIIDKGPIPIPKASGTEYRFGVQNKPVHMDRINPISMEQPDGPSFRVEDGHLVKWANWVFHVKADQRAGMIISQATVRDSETGEPRSVMYKGFPSELFVPYMDPEEGWYYKGYMDAGELGLGPTAMPLVPLNDCPRNSYYIDGVFASPDGKPIVQPNMICLFERYAGDISWRHSEILFANADIRESRPKVTLVARMATSVGNYDYIFDWEFQTDGLIRVTVAASGMLMVKGTPYDNVDDLGDREDDAGPLISENVIGVVHDHFITFHLDMDIDGPMNNSLVKVHLEKQRVPTGKSPRKSYLKVKKYIAKTEKDAQIKLSLYDPYEFHIVNPNRKSRVGNPAGYRIVPGGNAASLLDHDDPPQIRGAFTNNQIWVTPYNRSEQYAGGVLIYQSQGDDTLQVWSDRDRSIENKDIVLWYTLGFHHVPCQEDYPVMPTVAASFELKPANFFESNPILGSAPFFEKDLPSQHTGCCFVEFASLNEAEKALETKKGETFYSRKIILDVAEMAPDPFRLKYNLVIFACRDDPSPVKLNLSAGTYRTEEGKPLVLDVVRRAEQQLANDLPALKENRVVTTQCLSGTGSLRVGAEFLATHNKESVIFVPNPTWGNHPRIFTLAGLSVQYFRYYDPKSRGLDFKGMLEDLGAAPPGAIVVLQACAHNPTGVDPTFEQWEKIRRLVRSKSLLPFFDSAYQGFASGSLDADAQAVRMFVADGGECLIAQSYAKNMGLYGERIGSLTIVCTSEDVAKKVENQVLLVVRPMYLTPPIHGASIVATILKNSDMYNDWTIELKGMADRIISMRQQLYAALEARGTPGDWSHIIKHIGMFTFTGLSEEQVRLMAKEYHIYMTYDGRISMASLSSKTVPQLADAIHAVVTRIA

SEQ ID NO: 61296 - protein, 219 aa, Pasteurella multocida subsp. multocida str. Pm70
MAKIQRVTEANLPTEFGMFRIVGFEFPDTKKEHVALVLGEVENTDEPILARIHSECLTGDALYSLKCDCGFQLAAALRQISQEGRGVLIYHREEGRGIGLINKIRAYSLQDKGMDTIEANLALGFAADERNFEVCADIFALLGINKVRLLTNNPNKIDTMKKAGINIVERVALNVGENRYNTEYLDTKAKKMGHFIIHNQQKYPLECPYCSEEVPVQEK

SEQ ID NO: 61297 - protein, 592 aa, Phaeosphaeria nodorum
MGKRPIEDDAVASSELSRKKSKKEKSGKSKKSVIGEGADTNGHAPAAETTVDGSENEALSKAERKAAKKAKKEAKEASKAGKADAPTVENDEEAAKAARKAARKAEKKKLKEAEKTASSAPTEASSVPAQTLSSSNAGSYTEHTELAQLPQSEIDAFLTKNTMTIEDPKPAARKLRPIVNFKYLPVTDESQRAPFAGFTAPTPIQAATWPFLLSGRDMVGVAETGSGKTLAFGVPCVRAILSLPKDKRKGIKAVIVSPTRELAVQIYDQLVALAHPAGLSVVCVYGGVPKDPQVAACRKAHIVVATPGRLNDLIGDGSADLSNADYVVLDEADRMLDKGFEEPIRQIISQTPKKRQTLMFTATWPPSVRDLASTFMVSPVRITIGDNQSGELRANVRIKQLVEVLDPHAKEQRLLQLLKQYQSGKNKDDRILVFCLYKKEAMRIENFIRMKGFRVGGIHGDLSQEKRSASLAAFKEGQVPLLVATDVAARGLDIPAVKLVINVTFPLTAEDYVHRIGRTGRAGKEGLAITFFTEHDKGLSGSLINVLKAANQEVPEELLKFGTTVKKKEHGAYGAFYKDVDNTKAATKITFD

SEQ ID NO: 61298 - protein, 413 aa, Colwellia psychrerythraea 34H
MTNFRQRALDYHALPTPGKISVALTTAAETSDDLSLAYSPGVAEPVREIAANPDDVYKYTAKGNTVAVITNGTAILGLGNLGPMASKPVMEGKSLLFKRFANIDSFDIEVKHKTVEEFVNTVSNIADSFGGINLEDIKAPECFAIEKALIERCKIPVFHDDQHGTAIVTAAAMINALDIQGKDIKLAKIVCLGAGAAAIACMELLIKCGAQREKIYMLDTKGIVHTRRDDLNEYKKLFANNTDKRTLDDAIEGADVFVGVSGPNLLSQEQVKLMAPNPIIFACSNPDPEIKPELALAARADAIIATGRSDYPNQVNNVLCFPFIFRGALDVRARTINDEMKVAAVHAIRAIAKEEVPNEVLIASGETELTFGRDYIIPKPMDSRLLPAVALAVAKAAVDSGVAALPFPDNYMQ

SEQ ID NO: 61299 - protein, 363 aa, Glycine max
VDMVTPLCSQLTYEGLLDEFLHINNGSVELDASIMGLQQEGKKTKVPLNSSDKLFKEIRDLNFEVVVQILRQKATSMKQDYTEMTTTTQTVSELKDFVKKLNSLPEMTRHINLAQHLSTFTSKPSFLGQLDMEHTIVEAQSYDICFEYIEELIHKQEPLTTVLRLLILFSITNSGLPKKHFDYFRRELLHSYGFEHIAMLNNLEKAGLFKKQESKSNWLTIKRALQLVVEDTDTANPNDIAYVFSGYAPLSIRLVQHAIRSGWRPVEEILKLLPGPHLEMKRGGFSNSPSFDTLSGIQSSIAKVPDGRRAVVLVVFVGGVTFAEISALRFLCTQEGMAYDLIIATTKIVNGQTLVETFMEKLG

SEQ ID NO: 61300 - protein, 434 aa, Pasteurella multocida subsp. multocida str. Pm70
MTILVIGINHKTASVAIREKVAFSAEKRVEALAQIQQQALAESAVILSTCNRTEVYFHHKAIPPQEAESWTARCMQWFAEIHQLSLDALAGCLYSQQNQQAVLHLMRVACGLDSLVLGEPQILGQVKDAYQLSKMYYQGQNQPLSSEFSRLFQKTFSVAKRVRTETNIGGNAVSVAYGACSLARQIFDSLKTLNVLLVGAGETIELTCRHLLRHGVQRIMIANRTFERAQHLVTKLDGAENVQVLALTQLQEGLNQADIVISSTGSPTILITQDMVKIAQKARCDLPMLLVDIAVPRDIEESVGELDSIYHYTVDDLQTIIQRNLVEREKASAQAWVIIQQECADFFEWLKVHQFSNLIRSYRENAEDIRQILLEKALLALRQGEDSEAVLQALSYKLTNKLLHSPTQVMNAMVKTGNSTGLALFSSTLKSDVE

SEQ ID NO: 61301 - protein, 213 aa, Zea mays
MQARVVVFPVKGRAWCFALPRASAAAPAADGALPRPTLRDLWRGISSGSRTAPEKAEAVVDFVADKMNRAWVGFGSAPEGSMKSRIHSFGLKLLSRVRPSEVLLKSVTKDVSALEIVHPASINSRLVRRRLRHIAVRGASVHKKFLYGSVCLLPVTSVFMVGLQSFFGVVVSSTTNNSKQFCQLKGLIFSSDIIILDLLLILLCQVLAKGQRM

SEQ ID NO: 61302 - protein, 188 aa, Synechocystis sp. PCC 6803
MEFYPNGHRRSPSLPPMKHTLSVLVEDEAGVLTRIAGLFARRGFNIESLAVGSAEQGDVSRITMVVPGDENTIEQLTKQLYKLVNVIKVQDITETPCVERELMLVKVSANAPNRAEVIELAQVFRARIVDISEDTVTIEVVGDPGKMVAILQMLAKFGIKEVARTGKIALVRESGVNTEYLKSLESKF

SEQ ID NO: 61303 - protein, 396 aa, Gibberella zeae PH-1
MKSALLTAAALLGSAQAGVHKMKLNKVPLADQLAMNSVEDHLQSLGQKYMGAARPKNAADYAFATNVPSVEGGHPVPVSNFMNAQYFSEITIGTPPQSFKVVLDTGSSNLWVPSQECGSIACYLHSKYDSSASSTYKKNGSEFEIHYGSGSLSGFVSNDVVSIGDLKIKDQDFAEATKEPGLAFAFGRFDGILGLGYDRIAVNGMVPPFYQMVNQKLLDEPVFAFYLDGQEGQSEATFGGVDKSKYTGDLEYIPLRRKAYWEVDLDAIAFGDEVAEQENTGAILDTGTSLNVLPSALAELLNKEIGAKKGYNGQYTIECDKVSSLPDITFTLAGSNYSLPSTDYILEVQGSCISTFQGMDFPEPVGPLVILGDAFLRRYYSVYDLGKNAVGLARAK

SEQ ID NO: 61304 - protein, 372 aa, Lactobacillus sakei subsp. sakei 23K
MKIKAAVVEQQGAPFVIKDNIELAPLHPDDVQVHMVASGICHSDEALRKGDAIIGYPIILGHEGSGIVEKVGSNVQSLKVGDHVVLSFYACGICENCLKGMPTQCLNYAENNLSGVRPDGSSHFTENEHHVADMFDQSSFTTTTVVRERNAVKVPDDLDLRELGPLGCGYVTGSGTVLNTLKPKLGDTIAVFGTGAVGLAAMMAGKISGCTKVIAVDIIDERLALAKELGATDTINSRQTDDVVAAIQALTNGRGVNFCVDTTGITPVMEDSIKALCQGGVSATIAVTPNHIDLDTWNDLCVNDKSVVGVNMGDSIPQIDIPRLIEFYRQGMFPFDKTEKFYDFEDINLANEASIKGETIKPVLIIDPDYQI

SEQ ID NO: 61305 - protein, 278 aa, Oryza sativa
MAAASVLLLLPSPFLRPSSPAHRARCCIATTTTTSTSGRRGLFLFASRCRPGPRRRAASAAVPPEHGLSQPQPQARAVGSYEAALGNAKDALYAALEGMNRGIFGMTSEKRSEIHALVELLESKNPTPEPTDKLQDKVDGCWRLVYSTISILGKKRTKLGLRDFISLGDFFQMIDVKEEKAVNVIKFSARALKILSGQLTIEASYKITTKTKVDITLDSSTITPDQLMNIFQKNYDMLLAIFNPEGWLEITYVDESLRIGRDDKANIFVLERADPSEV

SEQ ID NO: 61306 - protein, 852 aa, Oryza sativa Japonica Group
MPFFIPPSVCALGFLSIDCGLEGDDSYPDDQTGITYVPDGPYVDSGENHRVTTVYRNYWGQDYRTLKTLRSFPSASGKRNCYSLPTNVGDKYLVRLEFLYGNYDSMDSSLLKFNLSLGVNHWNTVNLDTTDDQDGYNFYEAVFVAWASWAPVCLINIGQGIPFVSTVELRLLGTLPYPAIIGNQSLSLYVRRSIGSSADDDMRYPDDQYDRYWIMGETTGAADMSNISTPTIIPPSVPFAVPSPILQKAVVPADNSMKLVFHSDQLDAQLRDHLVILHFADFQNNKSREFTVSIDSGVQSGPFSPPYLKVLSITTDWSSDTEGKYNFTLTATSTSSLPPILNAYEVYGRIIHDNPMTFSQDFDAIMAIKYEYGIRKNWMGDPCFPPEFAWDGVECSSDGKTMRIISLDLSNSELHGLISNNFTLLTALKYLNLSCNQLNGAIPDSLRRKNGSMVLSYESGGDMCKKPVSPSSRNRAAALAVSVVVPMLAVAILGLAYLFWRAKRKHNNDPPTVLELTGAPGHKTNHWDRLQKPENRRFTFEELQKFTDNFKRLIGHGGFGHVYYGSLEDSTEVAVKMRSESSLHGLDEFLAEVQSLTTVHHRNLVSLFGYCWDDDHLALVYEYMSSGNLCDYLRGKTSMTETFNWATRVKIALEAAQGLDYLHKGCNLPIIHGDVKTNNILLGRNLKAKIADFGLSKTYHSDSQTHISASIAAGSMGYIDPEYYTTGRLTESSDVYSFGVVLLEVTTGEPPIIPGNGHVVQRVKQKIVTGNISSIVDTRLGGSYNVSSMWKVLDAAMMCTTNIAAERPTMATVVMQLKESLELEEAHGERGDMENQARDNTYLMSTFGPLAR

SEQ ID NO: 61307 - protein, 270 aa, Zea mays
RLPFYSEAKLMFFVYLWYPKTKGTTYVYGTFFKPYISQHENEIDRNLLELRARATDTVVLYFQKAASAGQSTFFDVLKYVAAQSPSQKSRQRLHQESQQPPQQQQPQVQVQQAQPQKQAAPVMRRASSIAARQAAMAHQSQETKPVSSSPKIKRQTSARSGSVASTKPPVAASAPKPGGSPKKGEVKPAADPVQTPTTGVDSPKPEPSAPSLPGAEGVDKMAIDEASGDAPEGAEELDPAIEEETPMEETIRVTRAKLRRRTATEDPAGN

SEQ ID NO: 61308 - protein, 359 aa, Prunus armeniaca
ETTFPRLAEPLGYVPKEDILYAIKAIVVTQRENGRRDDRKYSRMKYLISSWGIEKFRSVVEQYYGKKFEQFRELPEWEFKSHLGWNKQGDGSYYCGLHVDNGRIGGVMKKALREVIEKYNLSIRLTPNQNIILCDIRTAWKRPITTILAKAGLLHPRFVDPLNLTAMACPAFPLCPLAITEAERGIPDILKRVRSVFEKVGLKYNESVVIRVTGCANGCARPYMAELGLVGDGPNSYQIWLGGTPNQTSIARSFMNKVKIQDLEKVLEPLFYYWRRKRQSKESFGGYTNRMGFEKLHELVDKWEGPKVAPARYNLKLFADKETYEAVDELAKQQDKTAHQLAMEVIRNFVGSQRNGKSE

SEQ ID NO: 61309 - protein, 386 aa, Aspergillus flavus
MTGLDMETIFAKIKDEYARTDDVGKRQIQGHIRELQVGFYSDWDVVMRLSSGPLQVALAKVAIDLGIFRSLKESDTPITLAEFVKKTGASPRLLGRILRTQAAFGLIKETGPQEYTSSAFTDVFANSDAAGAVVQLFDISGPCTQILPDFLAERNYQDITSNKDCVFQKAFGSDLTMFEWMPQHPKHMESLGHLMALERPVSWVDHFPILEELGKFPAPDKVLMVDIGGGFGQQSKALRAKFPNLPGRLIVQDIPQTLANAQPAAGIEFMEHNFFEPQPIQNAKFYYLRHVFHDWPDEQCVLILKQIIPAMGPESQILIDEMVIPSTGVPWQAAFTDLLMMNSLGGVERTRAEWDDLMEQAGLEIIQSKVYDSKEQAILVAVAKRT

SEQ ID NO: 61310 - protein, 194 aa, Thermoanaerobacter tengcongensis MB4
MKIKTAEFVGSAFNESQYPKDKIPQIAIVGKSNVGKSTLINTVLGRKNLAKVSSTPGKTRGINFYLVNRAFYIVDLPGYGYAKVSKEMKKQWAYNIETFLNTSKNLKHALLLIDIRREPTEDDFMMVNWFSFKNLPFSVVLTKADKVNKSEANKAIENICRSFNISSDRVIVFSAVEKTGISEILRIFEEVIEK

SEQ ID NO: 61311 - protein, 161 aa, Methanosarcina mazei Go1
MKHTLAVLVENKSGVLSRVASLFSRRGYNIDSLAVGVTEDPDISRITIVVHGDDHVLEQVTKQLNKLIDVIKVSDIGSDDAVERELALIKVSADVDTRAEIIQIANIFRARIVDVAPKSMTVEVTGDEGKIQAIEKLLRQFGIKEMVRTGKIAMVRGPKKV

SEQ ID NO: 61312 - protein, 369 aa, Polaromonas sp. JS666
MTAYEQLQIRLKSEPRAWLVTGVAGFIGSNLLEALLKLGQRVVGLDNFATGYQRNLDEVQTLVSPEQWANFHFIEGDIRNLPDCQRAMSWPPLPTEDGRGEGSPVDYVLHQAALGSVPRSLADPITTNAANITGFLNMLVAARDAGVKSFTYAASSSTYGDHPALPKVEHTIGKPLSPYAVTKYVNELYAEVFARCYGFNTIGLRYFNVFGARQNPSGAYAAVIPKWTAAMMKGEDVFINGDGETSRDFCYVANAVQANLLAATVSDLPLPLEEGGGEGSPTNQVYNVAVGDRTTLNTLFGLIRDNLIARGVPVSTEPKYRDFRAGDVRNSLADIGKAHRMLGYAPTHRIDQGLQLAIPWYVQNCKVSS

SEQ ID NO: 61313 - protein, 247 aa, Campylobacter coli RM2228
MLRQINLKDITFIAIKAGKSVLEIYNQDFKISYKDDNSPLSEADIISNEIICNELAKFSLPILSEENKTLPYEQRKNWEYFWCIDPIDGTKEFINKNGEFTINIALIYKDTPVLGVVYAPALDLLYSAKKGEGAFKNSVKLPLQRNDDFFKIVASKSHLNEQTKDFIDSIQTTKQKEFVSMGSSLKLCLVASNEADIYPRLAPTMEWDVAAADAIVREVGKMTYDFYTKKPLVYNKENLLNPYFIVE

SEQ ID NO: 61314 - protein, 426 aa, Polaromonas sp. JS666
MQSTSLARTVAIIGLGYVGLPLAVEFGKKRKVVGFDISAARVAELQAGQDHTLEVEPEQMRKAVHLQYTTDPAALQGCDLFIVTVPTPIDEYKRPDLTPLIKASTTIGKVLKKGDIVIYESTVYPGATEEDCVPVLEQYSGLKFNVDFFAGYSPERVNPGDKTHRVTTIKKVTSGSTPEVADLVDALYNEIVTVGTHKAPSIRVAEAAKVIENTQRDVNIALINELALIFNRLGIDTEAVLQAAGTKWNFLPFRPGLVGGHCIGVDPYYLTHKAEAIGYHPEIILAGRRLNDSMGAYVVTQLVKAMTKRRIHVRGARVLVMGLAFKENCPDLRNTRVVDIVRELTDYDVQADVHDPWVSVEEAQLEYGITPVRQPEGGTYDAIIVAVAHEQFKAMGAAAFRALGKPEHVLFDLKYVLTASESDLRL

SEQ ID NO: 61315 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLTGPKAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 61316 - protein, 178 aa, Rhodopseudomonas palustris CGA009
MRIDAIPVGVNPPYDVNVIIEVPVGGEPIKYEMDKAAGTLVVDRFLYTAMHYPGNYGFIPHTLSDDGDPCDVLVANTRGIVPGAVMSVRPVGVLYMSDEAGHDEKIIAVPSSKLTQRYDRIKTYSDLPEITLAQFQHFFEHYKDLEPGKWVKVVRWGGADEAHKLILEGLDRAKKAKG

SEQ ID NO: 61317 - protein, 476 aa, Polaromonas sp. JS666
MKLVSIILSGGAGTRLWPVSRQALPKPFMHLGGSSLLQQAIERGQACGTDDSVIVTNQDYLFLTRNVIKQLSDPPNARYLLEPKGRNTAPAIALAALACTQEHGPEAVMLVLPADHLIPDTEAFVASALEAARQALQGQLVVFGISPTAPETGFGYIEVEKVSRHTQKALRFVEKPDLATAQGYLATGRYYWNSGMFCFTAGTILQALKEHAPEVLEAAEHAWTTSSTESGATQFDAHAFGLQPDISIDYAVMERASNVTLVPAKFGWSDVGTWPAVAQAYTADTSGNTFVDGEGTQFITVDTTGTHVQTDSHTAKVVATVGVHDLVIVDTPDALLIAHKSAAQKVKAVVDTLKERKHESTQLPASVNRPWGTYATLKEESGYKVKRITVNPGQSLSLQYHHQRAEHWVVVQGTAIVQVGDEEHTTLPGQYRYIPLKEKHRLTNTGENELVLIEVQCGGYLGEDDIVRLADTYGRA

SEQ ID NO: 61318 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGLNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKDEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 61319 - protein, 530 aa, Gibberella zeae PH-1
MSGAVARLAHLNLGAPQQQHTSSTSPLSSNANQNATNADNAPSADLGLIGLAVMGQNLILNMADNGFTICAFNRTVSKVDRFLENEAKGKSIVGAHSVEEFVSKLKSPRRIMLLVQAGKAVDEWIEKILPLLDAGDIIIDGGNSHFPDSNRRTKYLAEKSIRFVGSGVSGGEEGARYGPSIMPGGNEEAWPYIKDILQSISAKSDGDACCEWVGDEGAGHYVKMVHNGIEYGDMQLICEAYDIMKRGLGLSSKEIGDVFAEWNKGVLDSFLIEITRDIMYYNDDDDTALVEKILDKAGQKGTGKWTAVNALDLGMPVTLIAESVLSRCLSAIKDERATASTKLEFVSRTTKFEGDKKQFIDDLEQALYASKIISYAQGFMLMQEAAREYGWKLNKPSIALMWRGGCIIRSVFLKDITHAYRSQPDLQNLLFDDFFNKAIHKAQPGWRDVIAKAALLGIPTPAFSTALSWFDGYRTKDLPANLLQAQRDYFGAHTFRIKPEHASEKYPNGQDIHVNWTGRGGNVSASTYQA

SEQ ID NO: 61320 - protein, 445 aa, Escherichia coli
AVMGRNLARNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILSKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 61321 - protein, 524 aa, Trifolium pratense
MLLEIAVALLVIALFIYLRPTPTAKSKALRHLPNPPSPKPRLPFIGHLHLLDHPLLHISLIRLGERYGPLYSLYFGSMPTVVASTPDLFKLFLQTHEATSFNTRFQTSAIRRLTYDNSVAMVPFGPYWKFVRKLIMNDLLNATTVNKLRPLRSKEIRKVLNVMANSAETQQPLNITVELLKWTNSTISTMMLGEAEEVRDIARDVLKIFGEYSVTDFIGPLKIFKKFGNYEQRIDAIFNKYDPIIERVIKKRQGIVNKRKNGEVLVGEEENVVFLDTLLEFAQDETMEIKITKEQIKGLVDFFSAGTDSTAVATEWTLAELINNPRVLKKAREEVESVVGKDRLVDESDIQNLPYIRAMVKEVFRLHPPLPVVKRKCTEECEINGYVIPEGALILFNVWQVGRDPKYWEKPLEFRPERFLENAGVGEGEASSIDLRGQHFTLLPFGSGRRMCPGVNLATAGMATLLSSIIQCFDLQVPGPNGQILKGSDAKVTMDERPGLSVPRAQNLVCVPLARAGAAKLLSS

SEQ ID NO: 61322 - protein, 163 aa, Synechocystis sp. PCC 6803
MYRNDQISLEEVKSLQPDAIVISPGPGRPDDAGISLQLIEKLSASTPILGVCLGHQSIGQVFGGKVVAAPELMHGKTSQIYHQQQGIFAGLASPVQATRYHSLIVERESLPECLEVTAWLADGMVMAFQHRDYPHVQSVQFHPESILTKEGKQMLENFLQSLG

SEQ ID NO: 61323 - protein, 524 aa, Thermus thermophilus HB27
MDLTYYPYPSRRHVVLGRRGAVATSQPLAALAGMEVLLKGGSAVDAAIAMAACLTVVEPTSNGIGGDLFALVWDGTLHGLNASGKSPMALTPERLPGRMPERGWLPVTVPGAVSGWRALHERWGRLPFAEVLAPAIRYAEEGFPVGPETARSWRRAEGVFLPLEGPEFGPFKEVFFPGGRAPRAGEVWRSPLHAKTLREIAESYGESLYRGALAEALLRFSEATGGLLTREDLEAHAPEWVTPLSTEYKGLTVWELPPNGQGVAVLLALNLLEGFDLRPEDPWSYHVQIEAMRLALADTYRFVADPRHMELAPEAFLSKAYAAERRRLIGERALPRVLPGLRPEGTVYLAAADGEVMVSLIQSNYQGFGSGVLVPGTGIALQNRGLGFSLEEGHPNRVGPGKRPFHTIIPGFLAREGKPLGPFGVMGGFMQPQGHVQVVVGLADFGLNPQAALDRPRWQVVPGDEVLLEPGIPQATALFLKDLGHRVRYEAEYGLFGRGQVVFRLGEALVGASDPRAEGLALAW

SEQ ID NO: 61324 - protein, 93 aa, Glycine max
RTSSQVVTTVNRAGAGLVVQLTGLKSMVGFPTRKTNIAFTSIVGTGGGVHCLQGWPPIGKKKLGTFSYLPDLDDAQLAKEVDSLLRKGWIPCL

SEQ ID NO: 61325 - protein, 1184 aa, Solibacter usitatus Ellin6076
MRCNLIFFLMCCPCLLRAAQFSGVVRAADQLVPGATVTARNGGAKVLAFTDESGHYALDLTPGTWEIEIRMFEFAPATGKVTVGDTALVRDWVLNMPKLAERGVKPAPAAATEATTVAKTPAAPAAPGGGARGNRGMRNPDGTFAGRGGRGPAQPGFQSAAVRATPEGQAAAADTQVQTADLGAENDDAMALNGSMSGGLEQSSDDEARRQRAMGGGRGSPGGPGGGPGGPGGAVSAAQGMQNGMGLPPGMSASLTNDSLGLGGFGASAINGGFGVGAAGAGPDGGGGRGGPAGFGAGPGFGGPGGGGPGGGGGGGRGGAGGRLGQNQQGRGQGGRGRGAFNGQFASFGNRRRTTPPISGSIALTVRNSAFNAAPYSLNGQTAQKPYSANNNLNANIGGPLRIPKIVNWQRAQYTISFGGSINRNGRSMVGSVPTLAERNGDFSQAVVANQPVTIYDPLSGSPFPGNVIPEARFNSASAGLLPYFPNATYATIVQNYRFVITDPSHSRNIGVRFNAPLNNKDRLNFNFQKQNSSSNSHQLYGFLDSGTSNGLSFSTGWSHSFRPRLNNSANISISRSRNENDPFFAYTQNIAAQLGITGTSQDPINYGPPSLSFTNFSGLSDGTPNLNRNQTVTFSDSVTWVLKRKHNFTFGFTYNRLQQNSTNYQDARGSFSFSGLTTSALDAAGQPVKGTGFDFADFLLGLPQSSSVRFGSSNNYFRSWSSSAYVQDDYRVNAKLTINLGLRYEYFAPYTELRGHLASLDVSPGFTAVAVVTSGQNGPYSGSLPSSIVRHQPKDLSPRIGVAWRPFPKRNTVVRSGYSVFYSGSSYAQIASSMAAQPPFATSASLTTSLAAPLTIQDGFATSPTTLTNTYAIDPNFRIAYAQTWNLTIQHTLPHGLVLDTEYIGTKGTHLGILENPNRSISGIANGGLQISNATSFNYQTQGGDSSYNAGQLRLTRRLSRSVSANALYTFAKGIDDASTFSGTGGTLVQFLDNRHLERGLSSFDQRHNIVTGFQLSSPVGVRGLLRNGGWKTKLLRSWNLQGNFTATTGTPLTAKVSGNLANTGGLAGGGSLRAEATGLPIQLPGDAYFNTLAFTTPAAGQFGNAGRMTIPGLFRTSLNANMNRSFRFGESRRTLSFAISASNVFNHVTITGVGTTVNSSNYGLPTSASATRAVSLNTRFSF

SEQ ID NO: 61326 - protein, 735 aa, Kluyveromyces lactis NRRL Y-1140
MSHFLTMPSVKPIISNRRYSRKTEGLDEQWAILQNGIDKIFDGKVTELSFEKLYTTVYGLVLTKNGPQLHERLSRQLSDHFGKVRTSFDGITRAEALNLLNQVWEKQKVYLSQISDVFIYMDSVYSKRENKPDVMSLGSRLFLKEVVEHVSGTLKSSLVDEINQARESAAQYSGFDILKNAIAVLNSLELKEGMSSVFLMEFEPFLLDSTEAYYKNLHSQLIAEQDETRWKDFNTLLELLNTENKICCNIFEDQDTILKLHNIAERVLVTDNIQEIAIYNVAKIVNSDKNDVLSRLLAISSSQKDKNVIFDQLSQFIVKEITSIEIDTSAKKKSVAAVAWIQELIKLKDKYQELGSHLNSAQAAGFKCINEAFGKAFSQIKIFPEFLSLYFDNYLKSEPSAMDSNIRKCVQFFKLFKDKDAFEIIYRQQLSRRLLQQRSNVLREQELIFLLQEDVGTSYTSKLRGMLRDLHSSNTFMQKNGKLSKTRDISVNVLTNMFWPLQGSDMNRDVIVPDSFAAIRNEYENRYAKTHSGRLLEWNYHLSTVEIAYQFRNSYHELSMPMFSGIIFMLFKEHESLTFDEIVELTNLPQQEVRKNLISMSVAPKTKILQKSPPGKSISNTDMFSINQGFTAPQRKVKVLMVLMNTRPNATNDSTRSSVEKKLLDSRLSVINAAVTRIMKQDRKLYHSELQDKVALSIPLFEMSPSLFKMSLEYLLNNEYIQRDFDNTTMYHYLP

SEQ ID NO: 61327 - protein, 478 aa, Solibacter usitatus Ellin6076
MLHYDNFINGKFTPSTGTERITCLNPSTGEPICTVPESTAADMDAAIAAAATAQKAWGKRPAIQRAQALRAIAAKIREQVEPLARLITEEQGKTLGLARVEVAFTADYMDYMAEWARRIEGEILESDRPGETILLFRQPIGVIGGILPWNFPFFLIARKAAPALVTGNTIVIKPSEETPHNAVKFCELLAQTDLPPGVINIVHGRGAGAGKTLCASPKIGMISFTGSVETGSAIMAAAAPNITKLNLELGGKAPAIVMADADLDLAVNAVTSSRVINSGQVCNCAERIYVQSKVAAEFTDKLAAAMKSSVCGNPLGEAEVAYGPLINQAGYKKVDALVRGAVAAGATLVTGGNRLPLEGGYYYEPTVLSGCTQGMEIVRREIFGPVVPIVQFDDLDQAIDFANDSDYGLTSSIYTRDLNTALRACQEIHFGETYINRENFEAMQGFHAGWRKSGVGGADGKHGLYEFTQTHVVYMQRA

SEQ ID NO: 61328 - protein, 130 aa, Triticum aestivum
PRVRNSRVGIRATLSKLSQLLKKHDEELWRHMEVITKVYPQYYAFRWITLLLTMEFSFNVCIHIWDAMLGDPEGSPDTLLRICCAMLILVRKRLLVGDFTANIQLLQHYPQTNIDHLLHIANRLRGTMPS

SEQ ID NO: 61329 - protein, 420 aa, Solibacter usitatus Ellin6076
MLATATTPMNAYDVALENFDLAANALGLDDSIRAMIKYPERILSVSVPVRMDTGKIVRFEGYRVQHSTMRGPAKGGIRFHPNVTMDEVKALATWMTWKCAVVNIPYGGGKGGVTCNPKELSMGELERMTRRYASSILPIIGPEKDIPAPDVYTTPQIMAWIMDTYSMNKGYPVHGVVTGKPLSIGGSLGRNEATARGVFYTTMSSCEHLGIQLAGSRVVVQGFGNAGAIAADLFHGAGAKVLAVSDTSGCIFNKNGLHIPAVVAYKARTGRLEGFPEATRITPAELLALECEILVPAALENAITEENAHTIHAKIISEAANGPVTPEADRILGSKGIFLIPDILCNAGGVTVSYFEWVQDENHLFWDEQDVNAKLEKIMKRSFADVLKIHLDKKVDMRLAANMLGVSRVAEACKVRGLYP

SEQ ID NO: 61330 - protein, 401 aa, Wolinella succinogenes DSM 1740
MSDPFDQDQAEILIIDDTPENLRLLGSVLKEAGYLITMAKSGIQGLQAARKHQPDLILLDIRMPEMDGFEVLTRLREEENLGEIPVVFLTAHSDEESILRGLSLGAVDYVKKPFSPSELLLRVRNHLELKFHRDHQNTQKELLAKRVEEELAKRLQSEKLLLRQNKLAHLGEMLGIITHQWKQPLNILSLHSHLLLDWANTHLAGKELERLQRFHDEMSEQIHYMSTTVDDFRNFLRQNKVKDLTTIERTFEECKNIIQPDLIKHKITLEIITPTQSLSLYCYKNELKQALLNLLSNSRDAIIERGIKGGKITLEAKAIAHEKGKKSLVITLLDNGGGISAEPLEVIFDPDFTTKEEGKGTGIGLYMTKMIVEDSLQGEITVQNESEGALFALTLPCLVTP

SEQ ID NO: 61331 - protein, 397 aa, Alkaliphilus metalliredigens QYMF
MKVELSKKGLSVSSSITLAIDSKAKQMKAEGMNVISFGVGEPDFQTPDYIKQAAIKAIEEKSIGYTPAPGMLQLRQSICNKLASDNELEYLPQHIIVSNGAKHSVYNIFQAVCNPGDEVIIPVPYWVSYPEHVKMADAIPVYIDCPEENDFKMKPEDFLAAISSKTKAIILNSPSNPTGAVYSKKELEQIAKIAVDHNILVVSDEIYEKLIYGNEKHVSIASLNSEIKDLTIVINGMSKGYAMTGWRIGYTASNSEIAKIMSNIQSHATSNPNTVAQYASIEALERDQSSIETMRLAFDERRKYMINRVNEIQNLSCIAPNGAFYIMMNISQLIGKVVDGKIINGSMDFAEVLLDRTHVAVVPGIAFGVDHLVRLSYANSMENITEGLNRIDKFLNE

SEQ ID NO: 61332 - protein, 350 aa, Zea mays
  misc_feature (64)..(64): Xaa can be any naturally occurring amino acid
  misc_feature (113)..(113): Xaa can be any naturally occurring amino acid
  misc_feature (170)..(170): Xaa can be any naturally occurring amino acid
  misc_feature (212)..(212): Xaa can be any naturally occurring amino acid
  misc_feature (272)..(272): Xaa can be any naturally occurring amino acid
RPRGPAPPLAAPAKARAQFINAGTAGPTAGATAPAAVSSTPRTVLLFVLSKAPDLTFTTSGASXRHRRLPGGLHSFGCYASPQASSMVANLVEGVSYPFFYSLADMGTLPDHXHKNIARLLKAKRFRKPDISETIQELLGGEVGRGQPSGGLVVDVGANVGMASFVAGWXAVTEFRVLAFEPVFENLQRRCDGVYLNRVQDRIVVYHAASLXASDRVGTITMHKVIGRLDNSAISADGTKLAFKSNAEIAVEVSTIPLDEVVPDTERVLMIXVDVQGWEYHVLGGASNLLSRIKGEAPYPYLIYEEDEHLLQAGNSSAQDIRTFLTSVGYNHCKRHGNGAHCKRNRQICF

SEQ ID NO: 61333 - protein, 525 aa, Salinibacter ruber DSM 13855
MGPRRGRPPPPHLDLDRPHPISSGRGDLLLVARARLLLASLSPRPLPKMTDPVSYDLIVIGAGQGGGPLAGAVAEAGHDVALLERRHVGGTCVNRGCTPTKTMIASARVAHLARRAGDYGVETGDVSVDLETVRQRKRDIVGMFRSGSRSSIEEKDTLDLIEGDGRFVDPNTVEVTLNGDANDGGPRALTADRIVINTGTRPAIPPIDGLDAVDFLTSTSIMELGAVPGHLLILGGGYIGLEFGQMFRRFGAEVTIIDRGEHVLGREDADVAGALEDILREDGIRLLNETSMTAVEEAGGTITAHLEGDDAPARITGDELLVAAGRRPNTDALNPGAAGVATTEQGYVQVDARLATTADGIYAIGDVTGGPAFTHVSYDDYRVLQDHWLHGGDRTTEDRLIAYTLFTDPQLGRVGLTEEQARSRGLDVTVAQMPMTRVARALEVDETRGLMKAVIDSTTNRLLGAAVLGIEGGEVMSVLQTAMMGDLPVGRLRAAPFAHPTLAESLNNLFAGLDLGPAAERRADG

SEQ ID NO: 61334 - protein, 461 aa, Thermoanaerobacter tengcongensis MB4
MKKGYITQVIGPVVDIRFEGDLPPINNAIKIPMGDRELVVEVAQHIGDNTVRCVAMASTDGLRRGMECIDTGGPIMVPVGKGVLGRMFNVLGQPIDELGEVKDVKYMPIHKKPPSFEEQNPATEILETGIKVIDLLTPYPKGGKIGLFGGAGVGKTVLIMELIRNVAIEHGGYSIFAGVGERSREGNELWLEMHEAGVIDKTAFVFGQMNEPPGARMRVGLAGLTIAEYFRDEEHQDVLLFIDNIFRFVQAGSEVSALLGRMPSAVGYQPTLATEMGALQERITSTKKGSITSVQAIYVPADDLTDPAPATTFAHLDATTVLSRSIAEMGIYPAVDPLDSTSRILEPHIVGEEHYYVARKVQEILQRYKELQDIIAILGMEELTEEDRLIVYRARKIQRFLSQPFFVAEAFTGTPGKYVPLKETIRGFKKIVEGEMDDIPEPAFYMVGTIDEVYEKAEKMK

SEQ ID NO: 61335 - protein, 209 aa, Methanosarcina acetivorans C2A
MAFDQDWVPKTRLGKLVVEGQVASMDEAIKSGLPIREPQIIDMLLPDLEDEVLDINMVQRMTDSGRRVKFRATVIVGNRNGYVGLGQAKDVQVGPAIRKAIDAAKLNITYIRRGCGSWECACGLPHTVPYEVTGKAGSVSVTLIPAPRGLGIAAGNTATKVLEKAGIKDVWTKTFGTTRSTLNFAKATYDALNQVNVVRLPVYYGKEEV

SEQ ID NO: 61336 - protein, 694 aa, Clostridium thermocellum ATCC 27405
MIQITTQTIQIVAILISLLSLGVAAWLYSWVKSQPSSNARIAEIGGYIRQGANTFLRREYLILARFTAIAAVLILIFLPHPIWSGNITQNIWMAVSYIFGTVLSALAGKIGIQIATIANIKSAEAAQKGVKPAFMTGFRGGAVMGMAVVGTSLLGVTLVLLIVGDASAVLGFSFGASSLALFAKAGGGIFTKTADISADLVGKVELGLEEDDPRNPAVIADNVGDNVGDVAGMGADLFDSNVASMAAALVMATALGGPDSKNVAMVFAYAAIGLLSSVIGVATARIGKNGDPGKALNSSTYVTTAIFAVLTALSTYIFNFEWRIWGATAIGLIVGTIIGLTSDYFTNDAKPPVRAVANASKSGPAFTILSGFSYGLLSALPSLIGIAVTALISYYICEPLGSGYGMFGISMSALGMLSIVGMIISNDAYGPIVDNARGLAEMGGFGEKVIAIADELDSAGNTVKAVTKGFSISAAGLTVISLLGAFMSEVNTAASELGVQGIANFDIMNPTVFFGLIVGVAIPAVFSAMLMLGVDKNAQRMVAEIHRQWDTIPGLKEGKENAKPDYDKCIDIATTGSLKELIPAGLVAIFSTILVGFIGGASAIGGFLTGNITSGLLLALLMSNAGGLWDNSKKYVEAGNCGGKGSTAHKAAVVGDTVGDPFKDTAGPSINTQITVVSLVSSLLASLFLMYSIF

SEQ ID NO: 61337 - protein, 290 aa, Picea sitchensis
MASSVTLSNSLSVIGGRPSVPSARHDVFPAAVTLAFPSSLFRSLSLSVSSASWPPAAAASIRKRGGVKRAPVMANASEWEQDVGVKTQEEGEEGAGDGEIDFENEFVELPEWTKLFVGNLPFNLDNQQLGELFEGAGEVLDVNIITDRETGNSRGFGFVTMGTVEEAEKGVELFNRHSLEGRLLTVNKAAPRGTKVERPSQAGSSTNKIYVGNLPWQADDNSLLQLFSEHGKVLEARVVYDRETGRSRGFGFVTYSSESEVNDAIAALDGTDMDGRPLRVNIAEDRRRGF

SEQ ID NO: 61338 - protein, 445 aa, Escherichia coli
AVMGRNLALNIESRGYTVSIYNRSREKTEEVIAENPGKKLVPYYTVKEFVESLETPRRILLMVKAGAGTDAAIDSLKPYLDKGDIIIDGGNTFFQDTIRRNRELSSEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKEQRVAASKVLSGPQAQPAGDKGEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 61339 - protein, 445 aa, Escherichia coli
AVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWALNYGEIAKIFRAGCIIRAQFLQKITDAYAENPQIANLLLAPYFKQIADDYQQALRDVVAYAVQNGIPVPTFAAAVAYYDSYRAAVLPANLIQAQRDYFGAHTYKRI

SEQ ID NO: 61340 - protein, 461 aa, Rhodopseudomonas palustris CGA009
MSIAAIDDRPASRAPLIPPTPPRAPENLSALGRLAAIRHNAIASWGDRAYQDDVVRGRFFAHSSYILNTPDAIRHVLVDNTDNYRRTATGIRVLRPMLGEGLLLAEGRAWKHQRRTLAPAFTPRAVATLVPHMASATDEVVEGLRRKTGVPLDLRETMQHLALEIAGRTMFSFEMGTHGQALRGFVIDYGTRLASPRFLDLLLPLGWPTPQDVSRALFRRRWTRFIGELIAARRAAGKAEGAPPRDLFELMLAARDPETGEAFSDAQLGDQVATMILAGHETTATALFWALYLLALDPDAQERLANEVRRVGFGGTEIERLPFTRAVLDETLRLYPPAFLIVREAAGPDRVAGFAVRKHDVMLIAPWLLHRHDKLWSDPNAFVPERFLPGVPSPDRFAYLPFGVGPRVCIGAHFALVEATLALAKIVGTFRIELIDTEPVIPIGVVTTQPDRSPLFRLTPR

SEQ ID NO: 61341 - protein, 445 aa, Escherichia coli
AVMGRNLALNIESRGYTVSVFNRSREKTEEVIAENPGKKLVPYYTVQEFVESLETPRRILLMVKAGAGTDSAIDSLKPYLDKGDIIIDGGNTFFQDTIRRNRELSAEGFNFIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEEGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAQFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 61342 - protein, 445 aa, Escherichia fergusonii
AVMGRNLALNIESRGYTVSIFNRSREKTEEVITENPGKKLVPYYTVKEFVESLETPRRILLMVKAGAGTDATIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQAQAAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVLNGIPVPTFAAAVAYYDSYRAAVLPANLIQAQRDYFGAHTYKRI

SEQ ID NO: 61343 - protein, 100 aa, Picea sitchensis
MDGLITRSNPPPQPKCAMMEAWGECGANVDEENENEVGHGRLLRRIRYYISYGALAANRIPCPPRSGRSYYTRNCYRATEPVRPYHRSCTAITRCLRDTS

SEQ ID NO: 61344 - protein, 510 aa, Arabidopsis thaliana
MDPHKKVALETEFFTEYGEASRYQIQEVIGKGSYGVVASAIDTHSGEKVAIKKINDVFEHVSDATRILREIKLLRLLRHPDIVEIKHVMLPPSRREFRDIYVVFELMESDLHQVIKANDDLTPEHYQFFLYQLLRGLKFIHTANVFHRDLKPKNILANSDCKLKICDFGLARVSFNDAPSAIFWTDYVATRWYRAPELCGSFFSKYTPAIDIWSIGCIFAEMLTGKPLFPGKNVVHQLDIMTDLLGTPPPEAIARIRNEKARRYLGNMRRKPPVPFTHKFPHVDPLALRLLHRLLAFDPKDRPSAEEALADPYFYGLANVDREPSTQPIPKLEFEFERRKITKEDVRELIYREILEYHPQMLQEYLRGGEQTSFMYPSGVDRFKRQFAHLEENYGKGEKGSPLQRQHASLPRERVPAPKKENGSHNHDIENRSIASLVTTLESPPTSQHEGSDYRNGTSQTGYSARSLLKSASISASKCIGMKPRNKSEYGESNNDTVDALSQKVAALHT

SEQ ID NO: 61345 - protein, 485 aa, Pseudomonas putida KT2440
MMIPVILSGGSGSRLWPLSRKQFPKQFLALTGEHTLFQQTIERLVFEGMDTPIVVCNKDHKFIVQEQLAALKLETQGILMEPFGRNTAPAVAMAAMKLVNEGRDELMLVLPADHVIDDQKALQRALALATVAAERGEMVLFGVPATKPETGYGYIRSSQDALLPEGVARVAQFVEKPDEKRAAEFVQAGGYFWNSGMFLFRASRFLEELKKHDGDIYDTCVLALERSQEDGDVLSIDEATFACCPDNSIDYAVMEKTQRACVVPMSAGWSDVGCWSSLWEVHEKDDNGNVTKGDVVVQDSRNCMIHGNGKLVSVIGLENIVVVETKDAMMIAHKDKVQGVKQMVKTLDEQGRTETQNHLEVYRPWGSYDSVDMGGRFQVKHITVKPGASLSLQMHHHRAEHWIVVSGTAEVTCDENVFLLTENQSTYIPIASVHRLRNPGKIPLEIIEVQSGSYLGEDDIERFEDVYGRTSTPIERGVSVKTIAQ

SEQ ID NO: 61346 - protein, 428 aa, Synechocystis sp. PCC 6803
MTPSLLPPRLNLPHVEVLPNGLTIIAEQMPVEAISFQLWLRVGSRWEGDEINGTAHFLEHMVFKGTPRLAMGEFERAIESRGAGTNAATSQDYTQFYFTSAPQDFEHLAPLQLDVVLNPTIADGPFERERLVVLEEIRRSQDDPQRRIFQQVVQLAFPGTPYARPVLGRREIIENLQAQQMRDFHAHWYQPPAMTVTVVGNQSVGNLVETVARSFADCYRVKSPSQTLMPPLVNIPPPFTKVETTTVVDDSLQQARLILLWRSPGLDQFEKTLPLGVLAVILGRGRVSRLFRELREEKGLVTAIGASNSTQATQGMFYISAQLPAENIPMVEQYILDHIERLQNEPIPEKDLERIRTQVANRFIFGNERPGDRANLYGYYYAQIGDLEPALTYPVQIQALTAADLQKSAQTYLSPTAYGKVIALPAED

SEQ ID NO: 61347 - protein, 178 aa, Alkaliphilus metalliredigens QYMF
MNLANKLTILRIFLIPLFMMFLLSRVPYGVTIAAGIFIIAAITDTLDGYIARKKNQITTFGKFMDPLADKLLVSAALISLVQMGRLSAWIVVVIISREFTISVLRAVAAAEGIVISASWWGKAKTITQILAIIFILLDNFPFHYINFPFDVIMLWVAVIFTIISGIDYLRINKHVLKH

SEQ ID NO: 61348 - protein, 207 aa, Glycine max
  misc_feature (136)..(136): Xaa can be any naturally occurring amino acid
MMMAGAAKTLTNLCPSFPFPTKPQNQLTTSHAFPSTRLRHRAISAVANAEQPPLTSATATEGQYRVYVLSESVTFIQKFRDKTIVRQYGGAAMRSPELQDSVIDDIVLLSCDELRPDLVHGDDPKINSWLGRLNIXPDFRDVLRVTDAGTMENASLVLPRKNNKTLVSLIKRADAPAVASLGWDGGFSPTAPVPRAANSLKSLEAHR

SEQ ID NO: 61349 - protein, 175 aa, Desulfococcus oleovorans Hxd3
MHKQDTGILRPRIHESVFIAPGARIYGDVVVGPGASVWFNAVVRADEGRIEIGADTNIQDNVTIHSDLGAPVIIGDRVTVGHGAVIRGCRIGEDVMIGMNATIMSHVEIGAHSVVGAGAFIPYHKSFPPGSMIVGSPARLVRQLTEEELTFNQTAIDIYKELVERYRAGEITGVS

SEQ ID NO: 61350 - protein, 62 aa, Glycine max
CINVDAKQGTTTGVSAQDRATTILKLASRNSRPDDFNRPGHIFPLKYREGGVLKRPGHTEAS

SEQ ID NO: 61351 - protein, 248 aa, Chlamydophila pneumoniae CWL029
MDITLVGKKVIVTGGSRGIGLGIVKLFLENGADVEIWGLNEERGQAVIESLTGLGGEVSFARVDVSHNGGVKDCVQKFLDKHNKIDILVNNAGITRDNLLMRMSEDDWQSVISTNLTSLYYTCSSVIRHMIKARSGSIINVASIVAKIGSAGQTNYAAAKAGIIAFTKSLAKEVAARNIRVNCLAPGFIETDMTSVLNDNLKAEWLKSIPLGRAGTPEDVARVALFLASQLSSYMTAQTLVVDGGLTY

SEQ ID NO: 61352 - protein, 406 aa, Alkaliphilus metalliredigens QYMF
MYKKYTLDNGLRIVTEHIPHVKSISIGLWIKAGSRNEDESNNGVSHFIEHMLFKGTENRSAKDIAEEIDGIGGQINAFTSKECTCYYAKVLDEHYELVLDVLADMFFKSKLDSLEIDKERSVIIEEISMYEDSPEDLAHDLLSQTIYSGNTLGLPILGTQKTLENIDKKSMKDYMENYYTPDNTVIAIAGNFEEKSLLQAIEKRFANWESQPHRSKQASEIKLNFEEKVKKKEIEQVHLCLGFQGTSLDSKNLYPLLVFNNILGGSMSSRLFQNIREEKGLAYSIYSYPSIYTDSGFLAIYAGMNPQQYSVVSELISQELSNLREKGLTETEFRKSKEQLKGNYILGLESTSGRMSSMGKSELLLGKIYSPKEVVDRINRIEIKNVLQVIEDSIGTNNICSATVRK

SEQ ID NO: 61353 - protein, 121 aa, Triticum aestivum
PTPPNESRRAATVAASAATARQLQQQQVTVDVRAVKQQTAEQARMASAERAYAERVRELAKRELELAEREFARARMIWERAREEVERVERMKQIAARRLGSAASAAALEITCHACMQRFHP

SEQ ID NO: 61354 - protein, 304 aa, Streptococcus thermophilus LMG 18311
MKNQKVRKAVIPAGGLGTRFLPATKALAKEMLPIVDKPTIQFIVEEALKSGIEDILVVTGKSKRSIEDHFDSNFELEYNLEQKGKTDLLKLVNDTTSINLHFIRQSHPRGLGDAVLQAKAFVGNEPFVVMLGDDLMDITNDKAVPLTKQLINDYEETHASTIAVMPVSSEEVSAYGVIAPQGKGENGRYSVETFVEKPNPEDAPSDLAIIGRYLLTPEIFGILENQEPGAGNEVQLTDAIDTLNKTQRVFARVFTGDRYDVGDKFGFMKTSIDYALKHPQIKDDLKQYLIELGHKLEGKPTKKG

SEQ ID NO: 61355 - protein, 384 aa, Triticum aestivum
MSTAGKTITCKAAVAWEAGKPLSIEDIEVAPPKANEVRIQIYYTGVCHTDAYTLSGKDPEGAFPIVLGHEGAGIVESIGEGVTNVKVGDHVVALYTPECKECKFCKSGKTNLCGKIRATQGKGLMPDGTSRFKCKGKDLLHFMGTSTFSQYTVVADISVVAIEHDAPMDRTCLLGCGITTGYGAATITANVQAGDNVAIFGAGCVGLSVVQGAAARKAGKIIVVDVNPSKKEWGEKFGATDFVNPTELGDQSIQDKLIEMTDGGCDYTFDCTGNVGVMRAALEACHKGWGESIVIGVAAAGQEISTRPFQLVTGRVWRGCAFGGVKGCSQLNDLVADYKKGDLKVDEFITHRKTLGEINNAFDTMKQGDCIRAVVDMQKLEPKI

SEQ ID NO: 61356 - protein, 699 aa, marine gamma proteobacterium HTCC2143
MAVVSYEIKSGVGIIRLNNPPVNALSQVLREGIQNAVVAAQGDESQVLLIVCEGRTFVAGADITEFGKPAKAPSLPSILDSIENSVKPVIAAIHGTALGGGFEIALAAHYRCALASAKVGLPEVKLGIIPGAGGTQRTPRIIGVDAALDMITSGNPVAAAKAHSMGLVDHIINGDLLEGAMSYAERLIADNAPCKRVSDMTIDPATATDALFDSWRKKMAKKSRGQLAPQKIIDAVQIAVTSSVPEGMVKERELFTECVQSTQSSAMRHIFFAERAAAKVNDLAKDTVDRTISKVGILGGGTMGGGIAMNFANVGIPVVMIEINDDALARGLDIVRKNYSITVSKGKLSEEQMKDCLSLISGSTNYDDLGDVDLVIEAVFEDLDVKKEVFAKLDKACKQGAILATNTSYQDVDKIAAATTRPDDVIGMHFFSPANVMKLLEVVRGEKTAGDVISTTMKLAKKINKIPVLSGVCYGFIGNRMLRCSVRENQLCMMEGASPEQVDAVMQGWGMAMGPLAVGDLAGLDVSYKARQALTEEQKGDPKSYCIVDAMVEMGRLGQKSGAGYYRYDPDTRARSSDPEVMAVIERLSAEHAIERREISDDEILNRITCAWINEGAYILQEGIAQRSSDIDVVYVNGYGFPIYRGGPMHYADTIGVKKVYDMICEFQRQHGDVWKPSALLEQLAAENKTFSQWSDEQT

SEQ ID NO: 61357 - protein, 412 aa, Neurospora crassa
MAGTKKVVKKSGDKKKAVAQPSAQLLAAVEKFLTENNFGDAATEFTKQITKNGWEKKSSDASLVSIFQTWEAKPKQAALATPAPGEDEAKKTKAAAPATNPLKRKAESSSESSSSSSDSSSSDSSSSEDEAPKAKKQKVAESSSSSSESSSDSSSDSSSSSESEDDKKKPAAKAASPKKAAAAKKEESSDSSSSDSSSSDSSSESSSDSSSSDSSSDSDSSSSDSDSSSDSSSDSDSSSDSDSDSDSSESEAEKKEVKKEAKKATKSDSSSSDSSSSDSSSDSSSDSEDEKKTDKKKAASTNGSDSSATLKASTESTPVPTTEEKTNNRGKANGPPPKKEIQPFSRVRKDVVVDPRLASNAFAGHEWGQKAHEDLIVTRGKGFTKEKNKKKRGSYRGGRIDTFAVGGIKFDD

SEQ ID NO: 61358 - protein, 301 aa, Vitis vinifera
MQGGEELSIDELASNLSTYKDQLQQVRKLLVDDPGNSEYVDMEKELEEVIVLTEELLATAKQSEISLPAFGTNADASPIQHQSGGSSEHLMEPGNNSDHYGKFPIGTKVQAVWSEDGEWYEATIDSLTPDGYYVSYDGWGNKEEVDPGNVRPIQEEVNALLEAEKEAEATKQAIKRKIAQAAATDFQSRSLPAKLRIEPDDPEDVKIAKRKKIHAFKSKMRFEQLEVTQNKRQNAWQQFQTTKGRAKKIGFFSGRKRESIFKSPDDPNGKVGVTGSGKGLTEFQKREKHLHLKGGSADTDD

SEQ ID NO: 61359 - protein, 105 aa, Oryza sativa
  misc_feature (28)..(28): Xaa can be any naturally occurring amino acid
MYKRDGVCRPQRGGFGRGFGRSGRGDRXGQPGGRRGPRQEEEKRVPETKLGRLRKEGQDFKIEEIYLHSLPVKEHQIVETLVPGLKDEVMKITPAQKQTPAGQRT

SEQ ID NO: 61360 - protein, 399 aa, Vibrio vulnificus YJ016
MKIMFEKVVAAPADPILGLTEEFKKDPRAEKINLGVGIYKTEQGETPVLATVKKAEAALVETEKTKSYLTIEGTAEYALAVQKLLFGADAELINAQRAKTAQAPGGTGALRVAGEFIKRQLGDVKIWISNPTWANHHGVFRAAGLETVEYAYYNPETKDKDFAAMLADLEKASAGDVVLLHGCCHNPTGIDPTAQEWEALAKLVADKGLLPLFDFAYQGFAKGVEEDAQGLRTFAKFNKEILVASSFSKNFGLYNERVGAFTLVAESQEIAETAFSQVKAIIRSIYSNPPAHGSAVVTHILNDAALRAEWEAEVAEMRDRIQEMRELFVATLKEEGVAADFSFIERQNGMFSFSGLNKDQVARLKEEFAIYIVGSGRISVAGMTKSNMGPLCKAIAAVL

SEQ ID NO: 61361 - protein, 445 aa, Thermoanaerobacter tengcongensis MB4
MEREKEFNSTYYELLDKIESKKAVIGVIGLGYVGLPLAVEKAKAGYKVIGFDIQKHKVEKVNNGINYIGDILDGDLKEVVEQGRLKATNDYAFLKDVDAVAICVPTPLDKNKQPDLSYIINSTKEIAKYLHKGMLVVLESTTYPGTTEEVVKPILDETGLICGEDFFLAYSPERVDPGNKEYKTKNTPKVVGGVTKQCTKIAAALYRNVLESEVFEVSSPKVAEMEKIYENTFRNINIALANEMAIICYRMGIDVWEVIEAAKTKPYGFMAFYPGPGLGGHCIPIDPFYLAWKAREYDYHTRLIETSGEINNYMPEFVVERISRILNRFKKPINGSTILLLGVAYKKDIDDIRESPALKIISILEKEGAVVKYNDPHVPEFKHNGKLYHSENLTDDLLSSSDLVVITTDHTKYDYEHIVKTAKFVFDTRNATKNLKESREKIEVL

SEQ ID NO: 61362 - protein, 445 aa, Klebsiella pneumoniae
AVMGRNLALNIESRGYTVSVFNRSREKTEEVIAENPGKKLVPYYTVQEFVKSLETPRRILLMVKAGAGTDSAIDSLKPYLDKGDIIIDGGNTFFQDTIRRNRELSAEGFNYIGTGVSGGEEGALKGPSIMPGGQKEAYELVAPILKQIAAVAEDGEPCVTYIGADGAGHYVKMVHNGIEYGDMQLIAEAYALLKGGLALSNEELAQTFTEWNEGELSSYLIDITKDIFTKKDEDGKYLVDVILDEAANKGTGKWTSQSSLDLGEPLSLITESVFARYISSLKDQRVAASKVLSGPQAQPAGDKAEFIEKVRRALYLGKIVSYAQGFSQLRAASDEYNWDLNYGEIAKIFRAGCIIRAEFLQKITDAYAQNAGIANLLLAPYFKQIADDYQQALRDVVAYAVQNGIPVPTFSAAIAYYDSYRSAVLPANLIQAQRDYFGAHTYKRT

SEQ ID NO: 61363 - protein, 275 aa, Shigella flexneri 2a str. 301
MANPTVIKLQDGNVMPQLGLGVWQASNEEVITAIQKALEVGYRSIDTAAAYKNEEGVGKALKNASVNREELFITTKLWNDDHKRPREALLDSLKKLQLDYIDLYLMHWPVPAIDHYVEAWKGMIELQKEGLIKSIGVCNFQIHHLQRLIDETGVTPVINQIELHPLMQQRQLHAWNATHKIQTESWSPLAQGGKGVFDQKVIRDLADKYGKTPAQIVIRWHLDSGLVVIPKSVTPSRIAENFDVWDFRLDKDELGKIAKLDQGKRLGPDPDQFGG

SEQ ID NO: 61364 - protein, 245 aa, Triticum aestivum
  misc_feature (228)..(228): Xaa can be any naturally occurring amino acid
FRRILYQRGSANGKRVQANLGAKNHALLSLDANKEHALDSIAGAAFGAAGQRCMALSVLITLGDAKQWVDDLVKKAKNHVAGSGFDSKSDFGPLITPQARDRCEALITSAEKEGAKILLDGRGWKPEGFPDGNWVGPTVIAGVTPEMECYREEIFGPVLLCMEADTLQSGINIINSNAWGNGTVIFTNNGAKASLFQQEIDAGQVGINVPIPVPLPMFSFTGNKRSVXGTGLTNFYGQDGLRFYP

SEQ ID NO: 61365 - protein, 302 aa, Zea mays
  misc_feature (100)..(100): Xaa can be any naturally occurring amino acid
DSETKWVIGCSVPWGFLLLAIVVLYGGTEQRRAEAAEGGSPHRLLATISVSKPSYPTVTTPMSAYGDPVSTPATPYSTFPSLATGNGGAGAGAGGGAGVXGGGGGGGTWCVASQSASPTALQVALDYACGYGADCSPIQQGGSCFNPDTVHDHASYAFNSYYQKNPAPTSCDFGGTATITNTDPSSGSCQYPSSSGGAQSTMPPPSPTSMPPTVPTAPMTPTPMTPDTTPTTGTPVYGLSPPDYGSLSPPDSGSMSPPGYGSTSPPDYNDVGAAATTGQGGAALALALLCVLVATVSLHVSK

SEQ ID NO: 61366 - protein, 468 aa, Shigella flexneri 2a str. 301
MIREPPEHILNRLPSSASALACSAHALNLIEKRTLDHEEMKALNREVIEYFKEHVNPGFLEYRKSVTAGGDYGAVEWQAGGLNTLVDTQGQEFIDCLGGFGIFNVGHRNPVVVSAVQNQLAKQPLHSQELLDPLRAMLAKTLAALTPGKLKYSFFCNSGTESVEAALKLAKAYQSPRGKFTFIATSGVFHGKSLGALSATAKSTFRKPFMPLLPGFRHVPFGNIEAMRTALNECKKTGDDVAAVILEPIQGEGGVILPPPGYLTAVRKLCDEFGALMILDEVQTGMGRTGKMFACEHENVQPDILCLAKALGGGVMPIGATIATEEVFSVLFDNPFLHTTTFGGNPLACAAALATINVLLEQNLPAQAEQKGDMLLDGFRQLAREYPDLVQEARGKGMLMAIEFVDNEIGYNFASEMFRQRVLVAGTLNNAKTIRIEPPLTLTIEQCELVIKAARKALAAMRVSVEEA

SEQ ID NO: 61367 - protein, 438 aa, Physcomitrella patens subsp. patens
MQNMADAEFFTEYGEANRYRILEVIGKGSYGVVCSAVDTLTGEKVAIKKINDIFEHVSDATRILREIKLLRLLRHPDIVEVKHIMLPPSRRDFKDIYVVFELMESDLHQVIKANDDLTPEHYQFFLYQLLRALKYIHTANVFHRDLKPKNVLANADCKLKICDFGLARVAFSDAPTAIFWTDYVATRWYRAPELCGSFFSKYTPAIDIWSIGCIFAEVLTGKPLFPGKNVVHQLDLMTDMLGSPSPETVQRVRNEKARRYLSTMRKKPPMPFVQKFPNADPLAIRLLERMLAFDPRDRPTAEEALADPYFKGLAKVDREPSAQPITKMEFEFERRRINKEDVRELIYREILEYHPQMLKEYLNGSDNATFLYPSAVDQFKRQFAHLEEHYGKGGNNPPLERQHASLPRYIIGFTFLFVRVIYFPQRNISLLSTQQFEC

SEQ ID NO: 61368 - protein, 104 aa, Arabidopsis thaliana
MIFAVLVTVVEVEAQTECVSKIVPCFRFLNTTTKPSTDCCNSIKEAMEKDFSCLCTIYNTPGLLAQFNITTDQALGLNLRCGVNTDLSACSGTLILQDLRPLQL

SEQ ID NO: 61369 - protein, 197 aa, Cryptococcus neoformans var. grubii
MATYALPQIQKPAPNFAGTAVKEGSFEEIKLDDFKGKWTVLVFYPMDFTFVCPTEILAFNKALDQFAAIGAEVICVSTDSEFTHLAWSQTKRSEGGLGPDLKLTLLADRNHAAAKAYGVLLPEEGVALRGTFFIDPKGTLRAMHVHDLPVGRSVEETIRVIKAFQFTDEHGEVCPAGWEEGKDTIDTSAPSAYFSKQ

SEQ ID NO: 61370 - protein, 208 aa, Picea sitchensis
MVTSRMSSAMRMKKEKNAACGENGNEPVQCDEMHVLAVDDCLIERKVIEKLLKTNFFKVTTVDSAERALEVLGFHEEQSTCAASNAFKVNMIITDYCMPGMTGYDLLKKVQETKCLKEIPVVIISSENVPQRITSCLAGGAKDFIIKPLKLADVTKLKGHIKPPKDVVSTSANASSSGPVSSKRKISSGRARGKMSERRPRVGGLTSV

SEQ ID NO: 61371 - protein, 274 aa, Streptomyces fungicidicus
MQLAGKTAIVTGAARGLGRACAVAFAREGADLVLLDLCADLPGVPYPLGGPGQLAHTADLCRGHGAAVLVRQADVRDLGALRHAVDDAHGRFGRIDVLLNNAGIAAPSGKPVDEIDEDEWQLMIDVDLSGAWRATKAVGKIMTAQRAGSIINVASTAGQVGYRNFAGYVAAKHGVIGLTRATALDFAPMRVRANALCPGSVRDDPAVEGRMLSEIARSLQVPVAEHEEAFVQSQPMNALIEPDDVASAAVWLASDGSRQVTGSVITVDGGFTTR

SEQ ID NO: 61372 - protein, 712 aa, Pasteurella multocida subsp. multocida str. Pm70
MSRTIILIPISAGVGLTSVSLGLTHALEQKGAKVGFMKPISQPNSGEDMIDRTTSIIRTSTTIETSEPFMLSVAESLIGQNQSDVVLEKIVENHQQLAKNNEIVVVEGLIPTRKHSYANSINYEIAQALDAEIILVAAPATETPAELKERIKAAASLFGSKNNPNLLGVVINKFNAPIDESGRTRPDLAEIFDSFQHTQNQVSEIYHLFEKSPIKILACIPWSAELIATRAIDLAKHLGAAIIHEGAINERRIRGITFCARNLTNMVEHFRVGSLLVTSADRPDVIVAAALSAMNGVEIAGVLLTGGYKIDAQIKKLCQHAIESTGLPVFRVEGNTWQTALALQSFNLEVPVDDKERIEKIKHYISDLLDSNFIDSLAAASSRLRRLSPPAFRFQLTELARQAQKRIVLPEGDEPRTVKAAALCAERGIAECVLLATPESVMRVAEAQGIQLGKGITIIDPATVRENYVARLVELRKNKGMTEDSAREQLEDNVVLGTMMLEANEVDGLVSGAVHTTANTIRPPMQIIKTAPGNSIVSSIFFMLLPDQVLVYGDCAVNPDPTAEQLAEIAIQSADSAKAFGIDPKVAMISYSTGTSGSGADVEKVKEATRLAQEKRPDLIIDGPLQYDAAVMEDVARSKAPNSPVAGKATVFIFPDLNTGNTTYKAVQRSADLVSIGPMLQGMRKPVNDLSRGALVDDIVYTIALTAIQATQ

SEQ ID NO: 61373 - protein, 799 aa, Oryza sativa
  misc_feature (242)..(242): Xaa can be any naturally occurring amino acid
  misc_feature (277)..(277): Xaa can be any naturally occurring amino acid
  misc_feature (349)..(349): Xaa can be any naturally occurring amino acid
MGGKNLVVLFLVSVVMAMVPGSTQLQASQTWSLLKIQQMLGYPAVLGHWHNYTDFCYGGDYKTTSAFVECYGDSVTQLHIIGGGGGSPTPPPLPKTFSIDSFFTTLSRLPDLRVLTLTGLGLWGPLPGKVSRLAALEIVNVSGNYLYGELPLALSRLGNLQTFIADDNMLSGELPAWLGRLPVLAVLSLRNNSLEGTLPGSGSDMASLRSLSLASNNLSGNLPDMSGAKNLQVIDLANNSLXGPEFPRLGRKVASVVLAGNRFSDGLPPELASFYLXLERLDVSRNRFVGPFMPALLSLPSIEYLSVAGNRFTGMLSGNMSCGNNLKFVDVSSNLLTGSLPTCLAAGAXVGKAADSDSDSSKTVLFSANCLATGDDTQHPSPFCKNQAIAVGIVPDQARRKPSGARSGLVAGVVAAAIAAAVLAGVAVFLAVRKASMRRAQARPPRRLVEHASSAYPSKLFADAYISQTVKLGALGIPAYRSFSLVELEAATNDFEVSNMMGQDSHGQMYRGRLSNGTPVTIRSLKVKRSQTSQSFNHHIEMISKLRHRHLVSALGHCFEYNLDDSTITQLYLVFEYVQNGNLRGRISQGTEGRKLTWVQRISTAIGVAKGIQFLHGGIIPGLFANNLKITNILLDQNLVAKIGSYNIPILSETMKSEGGSGNKYPSDSVPNGDKLDIFDFGVILLEVISGRPITSIYEVEIMKEQLQSALTAEGTAKRRSFVDPAVSKGCSDESVKTVMEICLRCLAKEAVQRPSVEDVLWNLQFAAQVQDDWRGDSRSSEESPLSPSQIPRDLEDDQ

SEQ ID NO: 61374 - protein, 395 aa, Nitrosospira multiformis
MSVIRVTDLDLKGKRVFIRADLNVPVKDGKVTSDARISASMGTIDYCLKQGGKVMVTSHLGRPEEGVWSEENSLKPVADNISERLGKPARLIKDWVDGNFDVAEGELVILENCRFNKGEKKNADETAQKYAKLCDVFVMDAFGTAHRAEASTYGIAKYAPVACAGILLTEELDALTKALLNPARPMVAIVGGSKVSTKLTVLESLSEKVDQLVVGGGIANTFLKAAGQNVGKSLCEDDLVPIAKMLMEKMAKRNATIPIAVDVVVGKKFDASEPAVLKNADAVTDDDMIFDIGPKSARELSDIIMKAGTVVWNGPVGVFEFDQFREGTKTIAMAIADTDAFTLAGGGDTIAAIQKYDIYDRVSYISTAGGAFLEFLEGKKLPAVEILEQRAAGSR

SEQ ID NO: 61375 - protein, 442 aa, Kluyveromyces lactis NRRL Y-1140
MSLVPQAYLSNFHNRVKNEDVPLFTAAQLSRNKRGKQVNYAEFDTDLLDEFIDKNDEDDLEDDVDDSDGRRRGGDYYDQVDGSDGGAAAAAATAAAAAGLGEDGGIGEGTPGSGDPGAVTGGTPAADTGPDGTNDGTAGTSNPSSELDRIKLNDLPDLESQDDSATPLALLKYPRIRETFVQSRIAISYKDLLGDSIQDPQQVDIESPIMVPIRLNVEFSGHKLADFFMWNLNDHSMTPEQFATILCQDLDFPVLSNPNNSPYTQIISMINEQLQEYETLASLQVPDLHVIINLTANLDSKLYDDTFEWNLNDDSLCPEQFAELVVQDLGLQREFVPAIAHSLHESLLKVKKDWLEGNLNLAHVENKAAFGYTSGIRLDIDTLGASWFPKVEVLSQWEIEKREIEKERNMRRLKRESAKVDDGRSRRRGKRRMDDLETTLRI

SEQ ID NO: 61376 - protein, 441 aa, Pseudomonas syringae pv. syringae B728a
METSNPASHGSAATAAGQKTTSSRLKSIFSGSVGNMVEWYDWYVYAAFSLYFAKAFFPKGDTTAQLLNTAAIFAVGFLMRPIGGWLMGLYADYKGRKAALMASVLLMCFGSLIIALTPGYESIGVGAPILLVFARLLQGLSVGGEYGTSATYLSEMATKERRGFFSSFQYVTLISGQLIALGVLIVLQQTLTTEQLYAWGWRIPFVIGALCAIVALFLRRGMEETESFTRKKKEKPKESLMRTLMRHPKELMTVVGLTMGGTLAFYTYTTYMQKYLVNTVGMSITDSTSISAATLFLFMLLQPVVGALSDKIGRRPILIAFGVLGTLCTVPILTTLHTIQTWWGAFFLIMAALIIVSGYTSINAVVKAELFPTEIRALGVGLPYALTVSIFGGTAEYIALWFKSIGMETGYYWYVTACIACSLLVYVFMKDTRKHSRIETD

SEQ ID NO: 61377 - protein, 143 aa, Pseudomonas aeruginosa PAO1
MALQRTLSIIKPDAVSKNVIGEILTRFEKAGLRVVAAKMVQLSEREAGGFYAEHKERPFFKDLVSFMTSGPVVVQVLEGEDAIAKNRELMGATDPKKADAGTIRADFAVSIDENAVHGSDSEASAAREIAYFFAATEVCERIR

SEQ ID NO: 61378 - protein, 216 aa, Chlamydomonas reinhardtii
MNPINGLKTILHRVGFAMRESGQALERVGCRLQGVYSFEEKLNRHATVLPMRHNVPSLDKTSWVAPSGMVSGSVTLGENSSVWYGAIVRGDFQPVVVGSNSNIQDAAYVGATSEFSGPVTIGDNVSVGHGAVLKGCTVGDNVLIGMNSIISEHAEIQSGAVIAAGSYVEEGTTVPSGRCGRAAPPRAARRAGGRGGVPQIAAGTVHGAGGRAHRAS

SEQ ID NO: 61379 - protein, 438 aa, Pseudomonas putida KT2440
MRISIFGLGYVGAVCAGCLTARGHEVIGVDVSSTKIDLINQGKSPIVEPGLEALLQQGIANGRLRGTTDFAEAIRASDVSMICVGTPSKKNGDLGLEYIESVCREIGYVLRDTTRRHTIVVRSTVLPGTVKNVVIPILEDCSGKKAGVDFGVAVNPEFLRESTAIKDYDQPPMTVIGELDSASGDILQALYEELDAPIIRKPIEVAEMIKYTCNVWHATKVTFANEIGNIAKAVGVDGREVMDVVCQDKVLNLSQYYMRPGFAFGGSCLPKDVRALTYRAASLDVRAPLLDSLMRSNESQVQNAFELIEAHDKRKVALLGLSFKAGTDDLRESPLVELAERLIGKGYQLDIYDENVQYARVHGANKDYIESKIPHVSSLLNANLQQVIDNADIIVLGNRDEQFRALALQAPAGKQVIDLVGFMNKPTSTTARTEGICW

SEQ ID NO: 61380 - protein, 128 aa, Pseudomonas aeruginosa PAO1
MAYSEKVIDHYENPRNVGKLDAADPNVGTGMVGAPACGDVMRLQIKVNEQGVIEDAKFKTYGCGSAIASSSLATEWMKGKTLDEAETIKNTTIAEELALPPVKIHCSVLAEDAIKAAVRDYKQKKGLL

SEQ ID NO: 61381 - protein, 429 aa, Chlamydophila pneumoniae CWL029
MISLLKMPKLSPTMEVGTIVKWHKKSNDQVSFGDVIVEISTDKAILEHTANEDGWIREILRHEGEKIVIGTPIAVLSTEANEPFNLEELLPKTEPSNLEASPKGSSEEVSPATTPQAASATFTAVTFKPEPPLSSPLVFKHVGTTNNLSPLARQLAKEKNIDVSSIQGSGPGGRIVKKDLEKAPPKSIAGFGYPESPEVPPGSYHEENLSPIREVIAARLQAAKISIPHFYVRQQVYASPLLNLLKELQAQGIKLSINDCIVRACALALKEFPSINSGFNSVDNKIVRFDTIDISIAVAIPDGIITPIIRCADRKNLGMISAEIKSLALKARNQSLQDTEYKGGSFCVSNLGMTGITEFTAIVNPPQAAILAVGSVTEQALVLDGEITIGSTCNLTLSVDHRVIDGYPAAMFMKRLQKILEAPAVLLLN

SEQ ID NO: 61382 - protein, 232 aa, Streptococcus thermophilus LMG 18311
MTAQKMSAQEIIAFIGNAEKKTNVKVTFEGELATAVPSSVTKLGNVLFGDWKDIEPLLANLTENKDYVVEQDGRNSAVPLLDKRHLNARIEPGAIIRDQVTIEDNAVVMMGAVINIGAEIGAGTMIDMGAILGGRATVGKNSHIGAGAVLAGVIEPASAEPVRIGDNVLVGANAVVIEGVQVGNGSVVAAGAIVTQDVPENVVVAGVPARIIKEIDEKTQQKTALEDALRNL

SEQ ID NO: 61383 - protein, 304 aa, Burkholderia sp. 383
MNYQTILERIHTELAPWIGQGRVADYIPELAKVPADKFGMAVVTLDGNVCTVGDAYERFSIQSISKLFACTLAFQLLGDELWERVGREPSGNAFNSLVQLESERGKPRNPFINAGALVVTDVLCRRFVKAETALVEFVRRLIGANDIDYDSRVAQSELQHAERNRAMAHFMASFGNMQMPPDTVIDAYCRQCAITMNCVELARAALFLANGGVAPVTGERIVDSSSAKRLSALMLTCGTYDAAGDFVYRVGLPAKSGVGGGIVAVLPGEMAVCVWAPGLDANGNSLAGTLALEWLTTYSGRSIF

SEQ ID NO: 61384 - protein, 230 aa, Xanthobacter autotrophicus Py2
MARAYPIIAPSILSADFTRLGAEVEAVLEGGAEWIHFDVMDNHYVPNLTIGPLVLQSLRKVTKAFVDVHLMVKPVDGMIEAFAGAGADLISFHPEASEHVDRSLQLIRSKGVKAGLVLNPATPLSVLDYTLDQLDLVLVMSVNPGFGGQAFIPGALDKLKAIRERIDASGRDIRLEIDGGVKVDNIGAIAAAGADTFVAGSAIYGAKDYGATIAAMKREIESATGTAAAA

SEQ ID NO: 61385 - protein, 517 aa, Crocosphaera watsonii WH 8501
MNRKTRGAIAAGHPKTAEAGQIILELGGNAFDAAIAAMLASFVVESTLTSAGGGGFLLAHTQDQESILFDFFCQTPQLKKSLSEIEFYPVDINFGGATQVFHIGRGSVAVPGSLMGLFTVHQELGQLPFSVLVEPAINYARNGYQVNDYNRVTFEVLEPILRASHESRKIYLSNNELFNIGDIAYIKDFANILEEFAKKGIQEFYQGDIGQQILQDMKEGGYLTQEDLDNYRVIKRKPLNFNYRGYQLLTNPPPSSGGILINYALKILENINLKSYQFGSQDYLQLLALVMNLTNDSREINYDNYLYQDDIISQFLSKKNISDGQNKLQQTINKWGSTTHISVMDEYGNAASVTNSNGEGSSYVIPNTGIMLNNMLGEADLNPLGFHCWPNNCRISSMMSPTIILQEGKPKIVLGSGGSNRIRTVLLQVIFNLLDFNFSLEEAINKPRVHWENNLFNLEPTKQLETIENLRLPPDTEIILWQELNMFFGGVHAVRLKEDNSLEAIGDPRRSGVGIIC

SEQ ID NO: 61386 - protein, 291 aa, Xanthobacter autotrophicus Py2
MSIKHPIIVVTGSSGAGTTSVKRTFEQIFYREKVKAAFVEGDAFHRYNRLEMRELMAAEATKGNRHFSHFSPDTNLLDELGTLFKDYGATGAGRTRHYVHDAQEAKLYGAEPGNFTDWEDVGAGTDLLFYEGLHGAVVTDDINLAQHADLKIGVVPVINLEWIQKIHRDKSTRGYSTEDVTDTILRRMPDYVRYICPQFTETDINFQRVPTVDTSNPFAARWIPTPDESMVVIRFRDPHGIDFPYLLSMIHDSFMSRANSIVIPGNKQDLAMQLLLTPLIMKLIDRKRRAG

SEQ ID NO: 61387 - protein, 371 aa, Xanthobacter autotrophicus Py2
MTTRRTGRAEKTLRETTAMPTADHRAAPGITLACALEEWAGEDARRRDVAATLNALAAGTIQIARAIAEGPLAGDLARTLSSGEAGEGQKALDIISNDMVIDALRKAPVAAVASEENDAPVLLDPEAPLLVAIDPLDGSSNIDTDISVGTIFAVFPHQDGTDAASVTAFLQNGRDMLAGGYVIYGPHTALMLTVGAGTWHFALDRDGSFRLVNAAVRVKEDAAEFAINMSNYHHWDDPIRAYVDDCLAGRKGPREREFNMRWVASMVADAHRIFQRGGIYLYPGDGRKGYTHGRLRLLYEAFPVAFLMEQAQGSAIDGRSSILDLSATGVHQRVPFIFGSRDEVARAARYHLEPSGHGERSPLFARRGLFI

SEQ ID NO: 61388 - protein, 630 aa, Triticum aestivum
MSVRRRSESTEGLFLFDERKDRRSDVENSEDERRRLSIGGSLKKKALNASSKLTHSLKKRGKRKVEHRASSFTIEDVRDEEEERAVFTFQQELLSRNLLCDKQNDYHMLLRFLKARKFDTEKAIHMWAEMLQWRKEFGADTILEDFVFEELDEVLSYYPQGYHGVDRQGRPVYIERLGKVDPNKLMNITTVDRYIKYHVQEFERAFLDKFPACSIAAKRHIGSTTTILDVEGVGFKNFSKTAREMLTRMQKIDSDYYPETLHQMFVVNAGGGFKLLWNSVKGFLDPKTVSKIHVLGTKFQSKLLEVIDGSQLPEFLGGTCTCAGEGGCLKSNKGPWNDPNIMKVAHNKEAKFVRHTRRLSEIEQRRGSFARLHLLKGRNSDTSTAESGSDVDDLGSPMMRSTLGCSRLAPVREEMQMRARESAAYYSCDDHFVVVDKTVDYGRGGSMPDKSSAPQVIVQAQPLGTQNTPGSSRNSRAILVPKEIPEEGKFYRFLRLLLVLVVRVFTFLRTVCSQPETTIVNNPLPPAPEFEPISGDNPAVEAFSVDLVSPVIERLQKLEGRVDELGSKPPEIPLEKERSLLDSWDRIKCIESDLERTKKVLQATVMKQLEIADSVEEVILSKLHRRRFCA

SEQ ID NO: 61389 - protein, 388 aa, Lupinus albus
MVDQVQRPTIMEKVSSQLHLRSGVSSDIQSYDAAFRRPAVYQRRSFGNYSNAALQYPVMPSCRATTDLSSVATASPVFAAAPAEKGHFLIDFLMGGVSAAVSKTAAAPIERVKLLIQNQDEMIKSGRLSEPYKGIGDCFKRTMADEGVVALWRGNTANVIRYFPTQALNFAFKDYFKRLFNFKKDRDGYWKWFAGNLASGGAAGASSLFFVYSLDYARTRLANDSKAAKKGGERQFNGLVDVYKKTLASDGVAGLYRGFNISCVGIIVYRGLYFGMYDSLKPVLLTGSLQDSFFASFGLGWLITNGAGLASYPIDTVRRRMMMTSGEAVKYKSSLDAFSQILKNEGAKSLFKGAGANILRAVAGAGVLAGYDKLQVIVFGKKYGSGGA

SEQ ID NO: 61390 - protein, 195 aa, Chlamydia trachomatis
MGSLIGRQAPDFSGKAVVCGEEKEISLADFRGKYVVLFFYPKDFTYVCPTELHAFQDRLVDFEERGAVVLGCSVDDIETHSRWLAVARNAGGIEGTEYPLLADPSFKISEAFGVLNPEGSLALRATFLIDKHGVVRHAVINDLPLGRSIDEELRILDSLIFFENHGMVCPANWRSGERGMVPSEEGLKEYFQTMD

SEQ ID NO: 61391 - protein, 125 aa, Gibberella zeae PH-1
MTLSFCIGAPKLTSTSSVHAITSRLNPVNNIPEATPPGSRPEPPSGLEVLETENFRMQCFTTMTGTKFLLFTDTTQANVDVTIRKIYDLYSDYVMKNPFYSLEMPIRCDIFDRKLLSYIREINNR

SEQ ID NO: 61392 - protein, 318 aa, Saccharomyces cerevisiae YJM789
MSTNSIKLLAGNSHPGLAELISQRLGVPLSKVGVYQYSNKETSVTIGESIRDEDVYIIQTGYGEHEINDFLMELLILIHACKTASVRRITAVIPNFPYARQDKKDKSRAPITAKLIANLLETAGCDHVITMDLHASQIQGFFHIPVDNLYGEPSVLNYIRTKTDFNNAILVSPDAGGAKRVASLADKLDMNFALIHKERQKANEVSRMLLVGDVAGKSCLLIDDMADTCGTLVKACDTLMDHGAKEVIAIVTHGIFSGSARERLINSRLSRIVCTNTVPVDLDLDIVDQVDISPTIAEAIRRLHNGESVSYLFTHAPV

SEQ ID NO: 61393 - protein, 219 aa, Thermoanaerobacter tengcongensis MB4
MLKDLFIIGAGGVGKEVAWIVEEINNINPIWNIVGFIDDNKDLHDRTINGVKVLGGIEYLLNLKRKIYAVCAIADYKSRKRIVTKLERYDHIEFVNIIHPSVYISKTNHLGKGVIIYPGCILTTNIKIGDHVIISPKCGIGHETFIDDFVTLLWDVNVAGNVVINEGCLIGSGATIIQNKQIGKGVIIGAGAVVVDDIPPYCTAVGVPAKPIKFHEEAK

SEQ ID NO: 61394 - protein, 196 aa, Triticum aestivum
  misc_feature (158)..(158): Xaa can be any naturally occurring amino acid
RRIHSFGLKLLSRVRPSETLLKSLTKDVSMLEIVHPASINPRLVRRRLRHIAVRGAAIHKKHLYGSICMLPVTSVFMVLPLPNIPFFWTLFRAYSHWRALQGSERLHLLVSDCSGEGKTLPEKKNGMSTRKDDDSQYAPWNFQPSQKLDGFLKRRGLXQGLDCDTISRICQTYDLDKVDVLKYRDLEWPSSASRTT

SEQ ID NO: 61395 - protein, 90 aa, Brassica napus
MATGGKVSFKVTLTSDPKLPFKVFSVPEGAPFTAVLKFAAEEFKVPPQTSAIITNDGIGINPQQSAGNVFLKHGSELRLIPRDRVGAAFC

SEQ ID NO: 61396 - protein, 210 aa, Shigella flexneri 2a str. 301
MTNLNYQQTHFVMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKALLNMVREAVLAFNGDVQVETFSSLKKQGVDKLRQKLDTWFSEMQPVEETQDGE

SEQ ID NO: 61397 - protein, 613 aa, Glycine max
MASISGICSSSPTLNHSTPKRRRTPLLPSSSFPSKPSPPRSLARETPAPQQQQQQLSAVTKPLHAGLEKKPRALWRRYVEWLYQHKELGLYLDVSRVGFSDDFVREMEPRFHAALRAMEDLEKGAIANPDEGRMVGHYWLRDSARAPTSFLKSQIDNTLVAICTFADDVVTGKIKPPSSPEGRFTQILSVGIGGSALGPQFVAEALAPDNPPLKIRFIDNTDPAGIDHQIAQLGPELASTLVIVISKSGGTPETRNGLLEVQKAFREAGLSFPKQGVAITQENSLLDNTARIEGWLARFPMFDWVGGRTSEMSAVGLLPAALQSIDIREMLAGAALMDEANRSTVIRNNPAALLALCWYWATDGVGSKDMVILPYKDSLLLFSRYLQQLVMESLGKEFDLNGNRVNQGISVYGNKGSTDQHAYIQQLREGVHNFFVTFIEVLRDRPPGHDWELEPGVTCGDYLFGMLQGTRSALYANNRESITVTVQEVTPRSVGALVALYERAVGIYASLVNINAYHQPGVEAGKKAAGEVLALQKRVLAVLNEASCKEPVEPLTLEEVADRCHAPEDIEMIYKIIAHMAANDRALIAEGNCGSPRSIKVFLGECNLDELYA

SEQ ID NO: 61398 - protein, 513 aa, Solanum demissum
MDISFVRAEHRVSDPDQRKVAELVFILGFNLEDMLEDRTCLVQRDCRTESNWTGCMSYHIDRIDAQNGKRPLENDEEGENVQCKLQKQSDGSDLEGEVFSVGNSSASADEQAENQVRAGENFDSATADEQADNQGHAEDDSAAAPPDEQAGNQHQAGDNADVSTLIPAIGRDNSVSSLIRVSRSDYGNVASLNSEFRSLVRSGELYRLRRQMGVVEHWVYFSCQLLEWEVFDPSRRRWMHLPTMNPNECFVFSDKESLAVGTELLVFGKEVLAHVIYRYSLLTNTWTSGMQMNAPRCLFGSASRGEIAILAGGCDSRGKILNSTELYNSEQGTWRTLASMNQPRKMCSGVFMDGKFYVIGGIGGAESKLMTCAEEYDLTTGKWTEIPNMSPVRPNATRNDIPVTSEAPPLVAVVNNQLYAADYAAMEVRKYDKQNKAWVSIGRLPERAASMNGWGLAFRACGDRLIVVGGPRVMGEGYIEVNSWVPSEGPPEWTLLGRKRSGSFVYNCAVMGC

SEQ ID NO: 61399 - protein, 793 aa, Escherichia coli
MVAIVIVSHSLRLAQGVEELALQMSGGDVPLAIAAGIDDPQNPIGTDAIAIMSAIESVWSPDGVLVLMDMGSALLSTEMALELLSEEQRSAIYLLAAPVVEGAMSAVTSAAAGLSVTEIIAEVDLALCAKQQQLTPSSTAGEVIPVISPVNHCDEWQTFCWTIRNPHGIHARPAASILKVSAQYSANIIVIKGDKRASTRSLNELAMLGVRCGDEIIFQAEGTDASDALKAIETLAKNHFGEAHLLASSEIPLTETPVVSAPVDGAISGLSVQNGIAIGPVKWFTCERPEITQRTVDSPQEELSRIESAIDIVVCELADKAAGPEGDIFAAHKMMLEDPEINRQLQQRLAKGKQAEFAWLEVMQALAEQYCQAETLYLREREADIRDLTRQVLNQLCGVSEQHFITTAPCILLANDLLPSQITSLNKAHILGICLHNGGTTSHTAILARAMGIPAIVKAAITPQNVRDNDTVILDGETGRLWLQPDEVTRLDLLQRAEAWRQQRDRQLADAMLPAVTQGGRKISVLANIGDLQDIEAALSHGAEGVGLLRTEFLFHESATLPDEEEQFRVYCSVAQAFGDKPVTIRTLDIGGDKPLPSYPLPAEDNPFLGLRGIRLCLAHPQIFIPQLRALLRAGKEYPTLQIMLPMVSTLEEVNAVKTLIQTQAKLLGLTAENLPALGIMIEVPAAVMIAEKLASEVDFFSIGTNDLTQYIMAADRGNSTVAKLVDYRNDAVINAIAMVCQAGRNNEIPVSMCGEMAGDTQQTARLLTMGIDKLSASPSRLPALKAAIRASH

SEQ ID NO: 61400 - protein, 411 aa, Pseudomonas syringae pv. phaseolicola 1448A
MRALTYHGANSVKVDTVPDPEIQEADDIILKVTATAICGSDLHLYRGKIPTVEHGDIFGHEFMGIVEETGPAVTAVQKGDRVVIPFVIACGSCFFCNIDLFAACETTNTGRGAIINKKSIPPGAALFGFSHLYGGIPGGQAEYVRVPKANVGPFKVPGTLADEKVLFLSDILPTAWQAVTNAGIGQGSSVAIYGAGPVGLMSAACARMLGAEKIFMVDHHPYRLAYAQKTYGVIPINFDDDDDPADTIIRQTAGMRGVDGVVDAVGFEAKGSTTETILATLKLEGSSGKALRQCIAAVRRGGVVSVPGVYAGFIHGFMFGDAFDKGLTFKMGQTHVHRFMLELLEHIEAGRLEPEAIITHRMSLEDAAKGYKLFDKKEEDCRKVILTPGNNTIVVPDATTEELVAGGVPAM

SEQ ID NO: 61401 - protein, 466 aa, Shigella flexneri 2a str. 301
MPHSYDYDAIVIGSGPGGEGAAMGLVKQGARVAVIERYQNVGGGCTHWGTIPSKALRHAVSRIIEFNQNPLYSDHSRLLRSSFADILNHADNVINQQTRMRQGFYERNHCEILQGNARFVDEHTLALDCPDGSVETLTAEKFVIACGSRPYHPTDVDFTHPRIYDSDSILSMHHEPRHVLIYGAGVIGCEYASIFRGMDVKVDLINTRDRLLAFLDQEMSDSLSYHFWNSGVVIRHNEEYEKIESCDDGVIMHLKSGKKLKADCLLYANGRTGNTDSLALQNIGLETDSRGQLKVNSMYQTAQPHVYAVGDVIGYPSLASAAYDQGRIAAQALVKGEATAHLIEDIPTGIYTIPEISSVGKTEQQLTAMKVPYEVGRAQFKHLARAQIVGMNVGTLKILFHRETKEILGIHCFGERAAEIIHIGQAIMEQKGGGNTIEYFVNTTFNYPTMAEAYRVAALNGLNRLF

SEQ ID NO: 61402 - protein, 967 aa, Yarrowia lipolytica CLIB122
MSRQKKSREIRFGDYILGSTLGEGEFGKVKIGWRKDGKQPEQVAIKLIKRETVPPNSNREAKVHREINALKILTHPNIVRLEEVIQNDRYIGIVLEYASGGELFDHILTHKYLKEASACRLFAQLVSGVHYLHSKGIVHRDLKLENLLLDKHKNIIITDFGFANTFSRGSDGHVFDLMATSCGSPCYAAPELVVSDQKYTGRKVDVWSCGVILYAMLSGYLPYDDDPANPDSDNITQLYKYITTTALTFPEYVPPLPRDLLRRILVPDPRKRISLNDVRYHSWLAPHSRFLAITPKEWEDAVGKVAVPVKTHMPRSHSVQLSSGAPVFDSRLTKPSGVNIPNFSYNNRHSVGGTYSKPIQRQGESTIGATVSSNTPAGPRPISAGPCAATAAAASASKSHAAANPPTHASTPSVASLNIPEDTNNNSTSNSRQAPRSATYTGISQLTSPPGASPTSPKFDFDLPKPSIGTITEQPTPPSSPKVKEKGKEADDLGPRDLPAVPDTAPEATPPASAADTIPSAPATAPSAPVLEHQSFGASFGTSFSSSFAASDPSSPLVSSTRLPPGRKPRPTSYQPTPTQSSMQPPDSFPYMHMVNKNASVPGSANSVTPTSSQQSAQPVPLSLVTPSTAGSTFFRRPSSDDSQISFDERRKSGSFLVPQSSLPKVKYSDSMVQGELSSPQFRNSPSQVALSNWSNRNSVASMESGDEGVIGEVESVAEKKETDKEVVDTVAQSDTTLMPPPALPTSAQVPGKSTTPRAVSAESKTTSTSRTSMEKPLPVVPAASAAPAAVIPTAPSGAINPGAPNFSRPRPVSMQAPKAQTRSHRRGVASISYGADKLFGKIIGDNLDNDKDPRESKESVKDAKGGSSSAASGAGAPTAESTSKKRFSFFSNYSKESVESHEAHSTPSTSSRKILEPPALDRSHSMNQRQNRQVSASQVSTAESTHSSTARKVMDFFRRRSRVSAS

SEQ ID NO: 61403 - protein, 138 aa, Arabidopsis thaliana
MRGLSRNSGAAAIFAILLILAVHNWSVAVSSQSTEFAGDFPPFETECRGTIAECSVSAALGDGGDLFYGGGEMGEEFEMDSEINRRILATRRYISYGALRRNTIPCSRRGASYYNCRRGAQANPYSRGCSAITRCRRS

SEQ ID NO: 61404 - protein, 1647 aa, Ustilago maydis 521
MSQPGARRAYHHGSQRGGSTINQKAALASAYQELGKELSSSKLKIVGNYTLQRPIGEGTFGKVRLGLHRLTNTRVAIKQIPKAHSASLTREIHHHRRLHHPNVMQLYEVIATEQYIWMVSELCAGGELYDYLVENQVLAEPEARRIFGQLCLAVAYVHSKGIVHRDLKLENILLDERCNVKLGDFGFTREFERNRLMDTFCGTTGYASPEMLAGKKYTGEQVDIWSLGVILYALLCGALPFDDDDEAVMKQKILQGDFEIPDCLSEEAHDLVVSILQHDPAKRPSIQSILAHPWFTKMMVNSPMSTLEEDQIATDYFASKPSASTSQSKQHDRFPPTLHKALAELDTATELDTADATSAAPPTNPADAFDFEDHDSSNSCHRHHLSASSEQSYHSARSDSESSGRRSTNTDLTDPTTADSLSGTDEVEGLDQAIVQLNASSRPSALANATAAASHPDKNAIGLHRNERLGSNGSDASLSGVPRPSTKTNTASLPTHHELPPVPDGTGQDDHLSIYQSVPLTKRGSQSSSRGHHRTPSRTKRRSLSSGGLSDHHPPMLGRKPVDYVSQLADLQPATFSTSIEQNLLHQLSALGLDVGQMVHSVVTDACDASGATWWMLLRKSKDRHSEQPDITSPIVQVIPAPGDHPAPINASAFSKAGQTVTPSSPAQFSPPPVPVKDPARRSEDKFRTQERPTTLEASSSENAGLAEQSIRRLQTVVSHEELDVSAAPALHTSTSELMMATKPATDRQSSVPASGPMPLAGLPASTVSLPNDRSLTSTPDSVSSRPKSQHRHTTAVASPAKLQHVALTTLEGSPTSEGSKARGNSQNDRPRSNSLSVRQFAQSVLGTKDRGSATSSPVRPPPEQVVVAGEALPLERAKSPTLFGRRNTVSNVKDSMVGRLSGPSTPKKTPVDMLDKPRKSTGKKSCETDLDRVKALERSADSASSSPSRSTTGQAVGVVSNAKVDSSVPSASQDSFSTMSVTPQGSEKSGHRGKAGSFFMSTVRTWLGGNEKPTRKSKTGKQASASHRGLGIDDGPMAAKSPTNSLSTSGSVSTLTYGTPSRSASVRRRSAHYQQTSATRRGGPRSPHLGTSSRRSSNGSSYQAHLELPPNSFQQSMNRPANMRRMSAGSITPTATLHGDYLNDVGGVSGASRHSRPSSSHSLAHSGAASRPGLHGKAGSTGSTSSAYRPGQASSVYSTGSGRRHPRPSQDGGTTVRRHRTYASSSGSPSRRNSFRHDSRPSSIKSRASSPGRAMSGLGELWAADAEADGDGGGTGARRSTRSTPRHSLEMRKTGEAFDSAAPHHQHHQHVVAQSIFVAHKSRSPYRPPSANPNLHGSLVRGSSQLSGRSNVSANSEDAGYVAPNSTLGLPATGTGAWRHSWGRPPPCWAGPVDPPPTSSYSKRSGAAGVEDDGRPKLRDVFANRDDDDWTDEEEEQTYSGGLGQMGTLSSAMSSSVGRVGSGIGASSSPYATRNLAALGSSGYSTQRAVNLDTANAPEIGLREAPFSSRYAGVRNMFQTATAGTPAFGSRSHHSVSLSLGNEFAPRLLSTTIHSPTVSAASLGGGLGCIGESADAHSVTVSSKPKPESSGTQTQAQQQQSSASASASASASQQQQSGGGSSGSGSRITASFHKPVQIIEEEEEDE

SEQ ID NO: 61405 - protein, 258 aa, Pseudomonas aeruginosa PAO1
MFERVREDIQSVFHRDPAARNALEVLTCYPGLHAVWLHRLAHGLWTSGWKWLARLVSNFGRWMTGIEIHPGARIGRRFFIDHGMGIVIGETAEIGDDVTLYQGVTLGGTTWNKGKRHPTLGNNVVVGAGAKVLGPFTVGEGAKVGSNAVVTKEVPPGATVVGIPGRIIMREDSEQQAKRQAMAEKLGFDAYGVSQDMPDPVARAIGQLLDHLQAVDGRLEGMCQALTALGSDYCAKDLPVLREEDFAGVKDEDGNPAA

SEQ ID NO: 61406 - protein, 386 aa, Kluyveromyces lactis NRRL Y-1140
MRLFSNHRNSVESEEVPSSRKSKRPPNSAFRQQRLKAWQPILSPQSVLPLLIIVAAIFAPIGIGLIITVNNVQNLSIDYSDCRTLAGGSYINIPSKYVRYHFKGKPSAAPQWKVNSADGITKCYLKFEVPNDIKKSIYIYYKLTNFYQNHRKYVSSFDIRQLKGEAVDTDDLVSECKPLKESDGKAIYPCGLIANSLFNDTISLSLNNTSNENDSYELTNKGISWSTDRKRYKKTKYNASQIVPPPNWSKKYPDGYTDDNIPDVSTWEELQVWMRTAGLPKFYKLAAKNETSTLKKGTYETTVELNYPVQIFGGSKSYILTTNSIIGGRNMSLGIVYLIVAGIAILFGVIFVIKLIITPRKMGDHTFLHFAEQDDESQLPASSSTT

SEQ ID NO: 61407 - protein, 1467 aa, Ustilago maydis 521
MSDPTSFSGISTPAGPAAMYTPDNRSSANGDHSVSIDDNSGAKDSHVDVDRAKAEFHQLQTSLSRQSETTRQNSQEAQDIEAGQKGGDNDDDDDFDLVQYLRSVQSENAQAGIKSKHIGVSWSDLEVIGNDSMSLNIRTFPDAITGLFLGPLFSIMSRLNKNRGRKLLQNFNGVAKPGEMVLVVGRPGSGCSTFLKTIANQRGGYIGVNGDVKYGGIPSQEFARKYQGEAVYNEEDDVHFPTLTVKQTLEFALSLKSPGKRLPHQTVKSLNEEVLNTFLKMLGIPHTANTLVGSAVVRGVSGGERKRVSIAECMASRAAVVSWDNSTRGLDASTALDYAKCMRVFTDILGLTTFITLYQPGEGIWEQFDKVMVIDEGRCVYYGPRIKARQYFLDLGFKDYPRQTSADFCSGCTDPNLDRFAEGQDENTVPSTSERLEEVYHNSSIYQDMLRQKQEYDAQIAADRSAEEEFRQAVLEDKHKGVRPKSIYTVSFARQVQALTVRQMQMILGNQFDIFVSFATTITIALIVGGIFLNLPETAAGGFTRGGVLFIGLLFNALTAFSELPTQMGGRPVLFKQMNYAFYRPAALSLAQLFSDIPLSLGRVILFSIILYFMAGLERSAGAFFTFFLFVYFGYLAMSALFRLFGTVCKSYDVAARLAAVIISALVVFAGYVIPRDAMYRWLFWISYLNPLYFAFSGLMMNEFKNLSLACVGTYIVPRNPPGSTQYPDNVGQNQVCTLPGARAGQQFVAGNDYLRASFGYDSGDLWLYFGVTVIFFVGLVGITMVAIEIFQHGKHSSALTIVKKPNKEEQKLNQRLKERASMKEKDSSKQLDVESKPFTWEKLCYEVPVKGGKRQLLDNVYGYCRPGTLTALMGASGAGKTTLLDVLADRKSIGVISGERLIDGKKIGIEFQRGCGYAEQQDIHEGTATVREALRFSAYLRQPPSVPKEDKDAYVEDIIELLEMQDIADAMIGIPEFGLGIGDRKRVTIGVELAARPDLLLFLDEPTSGLDGQTAYNVVRFLKKLAASGQAILCTIHQPNALLFEQFDRLLLLERGGKTVYFGDVGPNAKHIVKYFADRGAECPGNVNMAEYMLDAIGAGSMKRVGDKPWSELYKESDLFQHNLAEIEKIKQESSSSTSQGSEQSHKTEYATPFVYQVKTVLHRALLSTWRQPDYQFTRLFQHAAIALISGLCFLNLDNSVASLQYRIFGIFMATVLPAIILAQIEPFFIMSRSVFIREDSSKMYSGVVFAIVQLIQEVPFGIVSTVVYFLLFYYPAGFQTGSDRAGYFFAMLLVTEMFAVTLGQAIAAISPSIYIASLFNPFMIVIMSLLCGVTIPYPNMPSFFRSWLYWVNPLTYLVSGLVTNEMHNLTVECTATELARFNPPSGQTCRAWAGAFVDAFGGYLQNPDATSDCQYCQYRNGDQFYAGLNIDFSERGRNIGLVIVYVAFNAIVTILASRFIKYANR

SEQ ID NO: 61408 - protein, 79 aa, Glycine max
  misc_feature (71)..(71): Xaa can be any naturally occurring amino acid
IERVHISIAISLVIAGDKNVPLKYSKDRSVVMTVAATGILRKGGGLLERPTIETTSPGRESEFDLRKSRKXSPRYRVLL

SEQ ID NO: 61409 - protein, 316 aa, Methanothermobacter thermautotrophicus str. Delta H
MRDMDVAVTGGLGFIGSHLTDELLERGNRVTVIDDLSTGSPDNLRDPHHEDLEIIEGSINDLDLEKVFQGKDYVFHQAALASVPESVRDPLRCHRVNATGTLRVLMASSRAGVRKVVNASTSAVYGNNPEIPLREDARPMPLSPYAVSKVTGEYYCQVFEDQGLETVSLRYFNVYGPRQRPDSQYAAVIPRFIDALLSGRSPEIYGDGEQSRDFIYVGDVVRANIFLAESRGSGVYNVAGGSSVTVNRLFDIISGILESDAEPEYLDERPGDVRHSLADTSRLAAAGFRPEVGLEEGLMRTVEWFLERLKIGSSYQ

SEQ ID NO: 61410 - protein, 104 aa, Streptococcus thermophilus LMG 18311
MIIPKNLEELASYVDSDQKVVFFFTADWCPDCQFIYPVMPEIEASHPDMTFVRVNRDDYMALAQTWNIFGIPSFVVTQNGQELGRLVNKARKTKEEITAFLETL

SEQ ID NO: 61411 - protein, 340 aa, Glycine max
  misc_feature (107)..(107): Xaa can be any naturally occurring amino acid
MATTTTPARSFLQVAATEEAAPPLRVVQIEGLVILKIIKHCKDHSPSLVTGQLLGLDVGSVLEVTNCFPFPMREEDEEIEADGANYQLEMMRCLREVNVDNNTVGWXYQSTLLGSFQTVELIETFMNYQENIRRCVCIIYDPSRSDQGVLALKALKLSDSFMELYRSNNFTGEKLREKNLSWVDIFEEIPIKVSNSALISAFMTELEPDTPVTQCDYDRLQLSTSSLMERNTEFLIECMDDLSLEQQKFQFYYRSLSRQQAQQQAWLQKRRTENMARKAAGEEPLPEEDPSNPIFKPLPEPSRLESFLITNQISNYCNQINGVSGQSFNRLYLMKALHED

SEQ ID NO: 61412 - protein, 219 aa, Brassica napus
  misc_feature (23)..(23): Xaa can be any naturally occurring amino acid
  misc_feature (71)..(72): Xaa can be any naturally occurring amino acid
  misc_feature (81)..(81): Xaa can be any naturally occurring amino acid
MADIKDEGTPKSSASSPLRNPNXTLNERNFAAFTHRSAAAHPWHDLEIGPEAPAVFNCVVEISKGGKVKYXXDKNSGLIKXDRVLYSSIVYPHNYGFIPRTICEDSDPIDVLVLMQEPVLTGSFLRARAIGLMPMIDQGEKDDKIIAVCADDPEFRHYRDIKELPPHRLAEIRRFFEDYKKNENKKVDVEGFLPAQAAIDAIKDSMDLYAAYIKAGLQR

SEQ ID NO: 61413 - protein, 256 aa, Streptococcus thermophilus LMG 18311
MIIGFIGVGKMATAIINGLNKSSHRIIISGSSLARSRQIAEELEVEAAASHQELVENADLIILGIKPQMFDKVLTDLNFHQPIMSMAAGVTLERLASLTSADLPLIRIMPNLNAQILKSTTGLCTNDKVSEDLLVIAKEITDSFGTTVELAEKDFDTFTALAGSSPAYIALFIEALAKAGVKNGLSKQVALTIATQTVLATAENLSLGSDSPHDLIDKVCSPGGTTIAGLMDLERTGLTHSVASSIDTTIAKAKKL

SEQ ID NO: 61414 - protein, 990 aa, Crocosphaera watsonii WH 8501
MVVQLDSTTYEQRTQEIAKELIAQTREKRSLWSKLGDQMRLDDKLLDFAMANPGLRVQLFHFIDTLPALQSNAEIAHHLQQYLGDESVELPSSLKGILNFTDYNSLPAKVAAETISKAVQTLAFKYISGETVPQVIKTVERLRKEKMGFTIDLLGEAVITESEAKAYLDSYLDLMEKLATESKKWSNVAQIDTAGDENLSKVQVSVKLTAFYSQFDPIDPQGSKEKVCTLIRILLRRAQELGVAIHFDMEQYVYKDLTLSILRELLLEEEFRNRSDIGVTLQAYLRDSKQDLHDLISWAKQRGTPITIRLVKGAYWDQETIKSEQNHWPQPVYNQKSATDVNYEEMTQLLLENHQYLYAAIGSHNVRSQARAIAIAETLKVPSRAFEMQVLYGMGDQLAKALVKTGHRVRVYAPYGNLLPGMAYLIRRLLENTANSSFLRQNLEERPIEDLIASPTLSGNTERIAQKESFVNVPDTDYSREVLRDKAEKALAKVKDSLGKTYLPLINGEYVQTDVIVESVNPSKSSEVVGQIGLISVSQAEQALNAAREAFKDWKKTPATERARIIRKAGDLMEERRHELSAWICVEVGKVLQQADAEVSEAIDFCRYYADEMERLDKGYNYDVAGETNRYHYQPRGIALVISPWNFPFAISTGMTVAALVTGNCTLLKPAETSTVIAAKIAEILVDAGIPKGVFQLVPGKGSKVGAYMVNHPDVHLIAFTGSREVGCRIYADAAILQPGQKHLKRVIAEMGGKNAIIVDESSDLDQAVAGAVFSAFGYSGQKCSAASRIIVLDPVYDAFLERFVEATKSLNVGATDQPSTQVGPVIDATAQKRILEYIEIAKQESTLALQMEAPDNGFYVGPTIFGDVLPNHTIAQEEIFGPVVAVMRVKSFAEALGVANGTDYALTGGLYSRSPEHIEQAQKEFEVGNLYINRTITGAIVSRQPFGGFKLSGVGSKAGGPDYLLQFLEPRHISENIQRQGFAPIEGNE

SEQ ID NO: 61415 - protein, 312 aa, Zea mays
  misc_feature (20)..(20): Xaa can be any naturally occurring amino acid
  misc_feature (44)..(44): Xaa can be any naturally occurring amino acid
LAENGPGVRQWMGDPEQGRXAFRVNRGKTPVTFKGIKILPAVSXVTDLLATLTECDLCFVALPSSALRSVLAPHSERLAGKLLVSLTKGIEAHTFKLMSEILEEIAPEARIGVLSGPNLAREVAEHALTATVIASEDEELCERVQAVLHGRTFRVYASADRFGVELGGALKNVYAIIAGMAVALGMGENTKSMLITRALAEMTRFAVNQGANPMTFLGLAGVGDLIVTCSSPKSRNYQVGFALGQGLSLEDAVTRLGEVAEGVNTLKVLKAKAQEVGVYMPLVAGLHAILFEGRTLNQVIELLMRAEPKTDV

SEQ ID NO: 61416 - protein, 288 aa, Hyphomonas neptunium ATCC 15444
MARTAFLGLGVMGFHMAGHLARAGHQVAVWNRSPAKSAAWTGVHRGEAAKDPASAVFGAEYVLLCLGDDPDVRAVFDAFEPSLGAGMTVIDHTTASAALARELAERCRAKGAHFIDAPVSGGEAGAINGKLTIMCGGEEAPFAKAEPVMNAFARAITLIGPSGAGQLAKSVNQICIAGIVQGLAEGLHFAEKAGLDAEKVIAAISGGAAQSWQMENRWKTMTDGKFDFGFAVDWMRKDLRITLDAARENGASLPLTAQVDQYYADVQAMGGNRWDTSSLIARLGRKPD

SEQ ID NO: 61417 - protein, 482 aa, Photobacterium profundum SS9
MNLNDPSLFKQKCYIAGQWVTAENGKVEPVTNPSTGEIIGYVPVMGQEETLHAIEVAQQAFLSWKKVSAKERSNTLRKWYELILENVDDLATIMTTEQGKPFAEAKGEVVYAANFIEWFAEEAKRTYGEVIPSHKTDARIVVSKEPIGVVGAITPWNFPAAMITRKCGPAFAAGCAVVLKPAPDTPFSAFALAELAERAGLPSGLFNVITGDAVAIGGELTKNKVVKKISFTGSTAVGKLLMAQSAPTVKKLSLELGGNAPFIVFEDADLDAAIDGVMVAKFRNAGQTCVCANRLYVHETVYDVFVEKLVQRVSTLIMADGFTDGATIGPLINRASAEKVQSHVTDALDKGATLAFGEKADPATNFFPPHVITHVTDEMRVATEETFGPLAAVFSFATEDEVIARANDTDSGLASYVYTRSLQRAWRMGESLEFGMVGINEGLISTEVAPFGGVKESGLGREGARQGICDYMETKYMLMGGL

SEQ ID NO: 61418 - protein, 262 aa, Namakwa exornata
VDHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKPDIEIISNASCTTNCLAPLAKVMHDNFTIIEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGDMKGIMSYSEDALVST

SEQ ID NO: 61419 - protein, 342 aa, Glycine max
MAPILQSSQPWVEKYRPKQVKDVAHQDEVVRVLTNTLETGSCPHMLFYGPPGTGKTTTALAIAHQLFGPELYKSRVLELNASDDRGINVVRTKIKDFAAVAVGTNQCKNGYPCPPFKIIVLDEADSMTEDAQNALRRTMETYSKVTRFFFICNYVSRIIEPLASRCAKFRFKPLSEEIMSSRILYISQEEGLCLDAEALSTLSSISHGDLRRAITYLQSAARLFGSSISSENLISVSGVVPAKVVEALLKACKSGNFDLANKEVNNFIAEGYPASQMLTQLFESIVEDNDLSDEQKARISKKLGEADKCLVDGADEYLQLLDVVSNTMKAFSNMPETFAYKC

SEQ ID NO: 61420 - protein, 271 aa, Xanthomaculina hottentotta
VEHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIVEGLMTTIHSYTATQKTVDGPSAKDWRGGRTAAQNIIPSSTGAAKAVGKVIPSLNGKLTGMSMRVPTSNVSVVDLTCRLEKSVTYDQIKETMKKASEGDLKGIMSYSEDALVSTDLNGDNHSC

SEQ ID NO: 61421 - protein, 354 aa, Azoarcus sp. BH72
MKICVLPGDGIGPEITAEAVRVLRALDLKIELEEALLGGSAVDATGTPYPEATQKLARAADAVLLGAVGGPKWDTLPREQRPERGLLGIRKDLSLFANLRPAILYPELANASTLKPEVVSGLDILIVRELTGDIYFGQPRGIETREVNGAQQRVGWNTMIYAEYEIRRILKVAFEAAQKRGKKLCSVDKMNVLETTQLWRDIADEMAKDFPDVELSHMLVDNAAMQLVRNPKQFDVMVTGNMFGDILSDEASMLTGSIGMLPSASLDANNKGLYEPSHGSAPDIAGKGVANPLATILSAAMMLRYTFNQEEAAVRIERAVKKVLAQGFRTGDIYEAGTKKVGTREMGDAVLAAL

SEQ ID NO: 61422 - protein, 604 aa, Petroselinum crispum
MATLSSATNCRSSSSSSYSSSSSLFPRIHHQQHFIVSLASPKPLFNKLSFHSNQPSFSFTPAPAPAAASQDGAISTTVPHIENETPLKKVKNANLSVPPPQESKGITPFRLNKDKSSVTITVVGASGDLAKKKIFPALFALYYEDCLPEHFTIFGYARSKMTDAELRDMVSKTLTCRIDKRANCGEKMEQFLKRCFYHSGQYDSEANFAELDKKLKEHEAGTIANRLFYLSIPPNIFINAVKSASISASSANGWTRVIVEKPFGRDSESSAALTTALKQYLEEDQIFRIDHYLGKELVENLSVLRFSNLIFEPLWSRQFIRNVQLIFSEDFGTEGRGGYFDNYGIVRDIMQNHLLQILALFAMETPVSLDAEDIRNEKVKVLRSMRPIQLDDVVIGQYKSHTRGGVNYPAYTDDKTVPHNSLTPTFAAAALFIDNARWDGVPFLMKAGKALHDRRTEIRVQFRHVPGNLYKRNFGTNLDHETNELVIRVQPDEAIYLKINNKVPGLGMRLDRSNLNLLYSTRYSGEIPDAYERLLLDAVEGERRLFIRSDELDAAWSLFTPVLKDLEDKKTVPEYYPYGSRGPVGAHYLAAKYKVRWGDFAGDQ

SEQ ID NO: 61423 - protein, 446 aa, Magnetococcus sp. MC-1
MATEIKVPTLGESVTEATVVQWLKQVGDAVAVDEPLVELETDKVTVEMPSPVAGVITEIYAGVDADVEVGAVLCVVDAQGSARVAVPAKPAAEPAPAPAVATAATPAPAVATPAPTVPVAPPSGGAALSPAVRKLLAEHGLDATQIPATGSGGRLTKGDVLAYLEQPKPAPTAAPTPAPTAAPTPAPTPTPAPAPMATPALAPAAQLPPAVEGPREERVKMSRLRQRIAQRLKEAQNTAAMLTTFNEVDMTAVMALRSQYKEVFEKRNHARLGFMSFFVKAAISALQEFPAVNAEIQGNEIVFKNYYDIGVAVGSPQGLVVPVLRGADAMSLAGIESTIAGMGKRARDGQLSMEEMSGGTFTITNGGIFGSLLSTPILNTPQSAILGMHKIQQRAMVMPDGSIQARPMMYLALSYDHRIVDGKEAVSFLVRIKDCIEDPARILLNA

SEQ ID NO: 61424 - protein, 1973 aa, Ustilago maydis 521
MGVLEVSQPRSPQDAMRCNLDLYHRYTIHSHIAAPYDHQRTSPHSSGEPTGCRLAPLSLTQPSRQKLSSVLHRLSLPCPPDSNLPLTPTTSFRTHRFSTIHHPIAHSTNMPPTANPSNSNATSAATDLPPVLIVPKWQPFAAHLTVADPATGENAPAVPKLAFSELPPCVIQRIDYAGRLEPSTARYGISPTVKELKGLQTEARVHAMDTITQPTSPTPSQVGSPMLATNINLALPPGSTIASFAEIRPSAMHIFTKTVRHAIAVTAVILATLVVAAPGTDRQSGPTIRHEKRKLSKDRGSRDSQEYFIQSRVLFTERRSRKYRHARGFDFGLCAFRIFSRCSSHPHSPGLLHGYRAESRAVLILLTVCFESNRSVRNMARASSSRAGQARKAGDFDDQAWGIESDDDDFVTQIAPRTNVPRSLKASSRSSSYSSTSKHHNHHHQQTSIRPDQNRSQPSSSSLQSSSSASASSTAPASIVRRESHNRRTSWTVIDKQQGAVAAQESLDQTPIAGSPPTDLADAMAAGLDLDRAGNASGAGFQIVDQDQGLASGSETEHVDLTTGKTVRRRRPSAAVSKPSSGTSEAETLRHFLRQDLDHLVRDPSHALTRLAAQWSDSSLRPSPSSDQATGPARLLTTTSRLGVAPTPTKLDFTFDPIAAAGDGLIITGPSFADTADAYASPSSASYMDSADVSFSNDGSVPTDENADGTGGKGSITRKRSVRTSRRRQQLLGCLSKQSVDIAMLRTLAWAGVPDELRPLVWQLLLGYLPAVASVRVSTLSRKRAEYAAGVQLAFAKGMAALDQAIWHQIHIDVPRTNPGIQLWQRQATQRSLERILYVWAIRHPASGYVQGINDLATPFFEVFLSAYIDSDPEMFDVALLPANVLQAIEADTFWCLSKLLDGIQDNYIFAQPGIQRQVRRLGELVARIDAPLHAHLQAQGVEYMQFAFRWMNCLLMREMSVRNIIRMWDTYLAEGPDAFSDFHLYVCSVFLHKWTDKLQTMDFQGIIMFLQSLPTQSWSDKDAEMLLSEAFMYKTLFGNTAHLNKIFFSLNLARLLDTHSYVFPPLPSLTLFDTLRRSHRYGHDITCLKLAMSSMVPAAVAIRATSSTRAGLWLCSRPRCGSSKSQSARPYTSTDGSIIAAFSTSARRKEADRLSAAKPNGVHAKSRKQTGARKVPQQTALLRLDPRHPLLPSLTPAASSSESSESQTLRQRKAKSLGQLHAALQTGSTEAVWNAYLDHRKYSTVDETPFSIYHPSSDSALSAAECESVLRLISNDATKTKRGANRILRLMADIRGQQRRLLFQLQLANDANDSVRSRLLRRELDAWDSVVSPKVLNATIAHIGRSLRSVGLEEIDLMLDQLLSYEANEHSRRSAASHSKTTQNHMTLPGPTGALYNLRSAMLSPVARSRLSQRRGKQRQADFPDLSTYNTILNVITNTIHRSKTKRRLASEQAETFEEEQDDDQGAKFAEMQHDSRTAELDTSIANKLRRLDLDSDAMSLHADEYERADRLFHSVLERMQRRNRIEPDAVTFNIMITMYCLLDRWDMVHRVVRSANKQMLLNIDCINNAMWHWLVRGPASTSRHDRSFTHADAIESAFEVYRQLRQNSVQAELASQNSSILYGQRDMVSEATSCADRNEHLSQDELGPLAWPDRDGPKLTRTHSNWSNSSRSLQNDAVQAVLGIPSLPLQLVPDEITHALMISSLTREGRFADALSVFKDLVSTRTRQAGKSAGDTRASNVEAEAEESKMQPTLAIFDSFFKGFSRHGRPSKAVRFDAQHAECSEWELVPNAASQVTEVDIVREAPHASQDSAQSHQLQLWRIETFQEIFSAFLDHTPDLSQALGPSSRVARVDRSSRSVNRNISTPFGWLTLAEKRKMDAIRRAPSPNQLFWILTAIRRVSGDHAAWSLAMWQKVVDKFDPTVTGSSGKVNWTGFRLDNRLRRVVEHLEAQLAQDHLATGQARTEVQALT

SEQ ID NO: 61425 - protein, 468 aa, Magnetococcus sp. MC-1
MSDTFDLVVIGGGPGGYVAAIRAAQLGLKTACIDKRPTLGGTCLNVGCIPSKALLQSSHQLETAQHAMAAHGVEIKGVKANLTTMMQRKQEVVQGLTQGIAFLFKKNKVTHLMGSGTIVDSSHVQVTAADGSVQTLTTENILIASGSEVATLPGLEIDEKHIISSTGALALDKVPKKMVVIGAGVIGLELGSVWRRLGAEVTVVEFLDGILPGMDGEIRKTAQRTLSKQGMHFKLGTKVTAASVLKNGVKLTMEPVKGGEAEERQADVVLVAVGRRPYTQGLGLENIGVTLDERGFIPVDHDRQTTCAGVFAIGDVIGGAMLAHKAEEEGSAVAEALAGQVAHVNYDAIPAVVYTHPEIASVGQSEESLTAAGIPYKVGKFPFMANSRARAIGDAEGFVKILAHATSDAILGAHIIGPAAGDLIAEIVLAMECDISAEDIARTCHAHPGLGEAVKEAALAVDKRAIHA

SEQ ID NO: 61426 - protein, 531 aa, Polaromonas sp. JS666
MTPLESRIDIRSDAYHQALAHGRTQVETLRTRLSGVATGGRDAHIQRHRARGKLLVRERIDFIVDDGSAFLELSPLAAWDQYGNEVPGAGIVTGVGMVAGRPCMFIANDATVKGGSFFHETVKKHIRAQEIAERLRLPCLYLVDCGGAFLPEQDRVFPDKDHFGNSFHRQCRMSQAGLPQLSAVFGGCTAGGAYIPALSDEVVMVRGNARIHLGGPSIVKIAINEVVDGETLGGAEMHSRVSGVSDHLAEDERQALAMLRQIVASLPPEPSMVPPLPPSPPRHNPVELNGIVPADPKQPYDAREIIARLLDGSAFHEFKPLWGETLVTGFGAIHGQPVAILANNGALLAESALKGAHFIELANQRGVPLLFLQNIPGFMVGTEAERGGIAKHSAKMVYAMACARVPKLTLVVGGSYGAGNYGMCGRGFEPEFLFAWPSAKVATMSADIASNVMVELARSNLRGPADEARLLDTERKVREQYARQSDPYYATSRLWDDGLIEPAASRDVLGLALTLAARRELPKTATPVYRM

SEQ ID NO: 61427 - protein, 1429 aa, Magnetococcus sp. MC-1
MPHRSPIQSRPQPPLQSDALRANLAQTAVAAVEIPPHQQPLLQVVEPHAGIYQPLEQLLKELNHPFRNWRLLLPEWRAFVLKNLYHYLQHPLASTTLPLLGAPFFQALDDASQSREHVAALGAMCAYIEKLAQAVTPQNNALLQPCIEDLLGALQQRPDAQFCLLAQTHHPLKRAIKRLLEIPETPITQLNWQGAAQVMQRHLRLTYAFWLQQEDPSPFTTPLHGALFTALSHPALYQQQKQLERLAERHPPHGATALAFVQGLLELPDAHDMVRLYGEAGNRLSQSLKQSGDAHTERANVARCLQFLFRILENEGLTLLHEKTLREVNQGLVRLLSIAHDHDQTEAFFIRTFESLNHNVLHYPRTALQCIEALGSKVIQLANPRLVELFLEQAVGFGFQHSCVAGVDAQWKTIANPAHLHNIRVWLALIGQQPKWCSTLLSALIINIKLTGTLIRDTDLFQKDISKLLNSEVEPVYNLVKQFARLLPVYYNDIGAEGALRDVSTQLDEIHHRQDPLIHFLRKQCHVESTNLIVPLTAAVIRYWQSGEPAHVAPYLSEPVRMSLLQQAPLLEGVQRVMAALFDQLALQQPEALLNLPLTTLSPIVQAVDGVEASEKQRVLLLIELYQLVEQKYNPGFAGVLPLLQRMAQLGVAEATPLLQALEQGTAPTLPLLLEAMEGLKRLILDPQQHAAQEEIFQKRHIAVGIPSVYGRYSEPKFDALALIFRLERQATALLDGLTANVPEAFVTRATITQVIEDLSLFQRALRLDGIKSRKLRNDLLVVRYFVETNPFTYHQFLDLFRSLSQVVKGIIYTHYTSHHRDNMARIIPTLPAAAMQSKYAALLQAGDTTGNLERVNESFMRDLIAETFSLQALDNYLGRVLKMLHRQLSMLDAQRAQQLLTYDPTKLFCPIHHPNMAILHPIHLGNKGYNLARLVVNGAPVPAGTILTTEFFRCHRLIHDHPPAWQDFMARLRAEMAALEQQTGLGFADPQRPLLVSVRSGALISMPGMMQTIHNVGINETIVAGLSQQSGNAFFAWDTYRRFIQSWCMAHDVERGVFSDIMRSFKQQYGVKKKGQFSAEQMRQLAFAYRDAARGLAITLPEEPWQQLLAAIELVLASWHGEKAHHYRAIMDLSDAWGTAVVIQKMIYGNLLQSMITEETDGAACPRVLSGTGVLFTAHPYRKLTQVMLWGDYTPGNQGEDIVGGLVSTWPISMEQCYSDHRDPQQALEHRFPLIYQGLLELAKTLIYTRDWNHQEIEFTFDGPTVEHLHILQTRNMITRESLHSVVSGFKLHGSLKEHLIGQGIGVHGGALCGRAAFNLEQIETLRQTYPSDPLILIRYDTVSDDIKEISQSQGLLTARGGQTSHAAIVAASLQKTCVVGCESMRVWELQGYCKLDGVTVKLGDAIAIDGHNGHVLRGWHEIERTLY

SEQ ID NO: 61428 - protein, 157 aa, Pasteurella multocida subsp. multocida str. Pm70
MKVLEGAVAAPNAKIAVVIARFNSFINESLLEGALDALKRLGQVKEENITLVRVPGAYELPLVARRLAESKKYDGIVALGTVIRGGTAHFEYVAGEASSGLGQVAMNADIPVAFGVLTTENIEQAIERAGTKAGNKGAEAALVALEMVNLLAQIDAA

SEQ ID NO: 61429 - protein, 166 aa, Brassica napus
MGSCLSAESMSPTPGSPCSPGFGVKKRKNSKKRLGSRNSSFNHRRDDDDPLSTVPGRMFLNGSSEVACIFTQQGKKGPNQDAMVVWENFGSRTDTIFCGVFDGHGPYGHMVAKSVRDSLPLKLNAYWEPKVPIEGALKTTTTANSADNINNSEDAEEENMKETHSS

SEQ ID NO: 61430 - protein, 355 aa, Ustilago maydis 521
MSAPTTMKAVVIQGPEQVAVLERPIPKPGKGEVVVKVNLAALCGSDLHIYRGHQAVPRYDFVLGHEFVGEIHEAGEGIKNWKRGDKVVSPFTISCGDCFFCNRNQTGRCTQSRVFGSVPLDGAQAEYVLVPLADTTLYPIPDDVPEEIMLLTADIFPTGYFVANNAYTMLNEAERKDVTAVVIGCGPVGLCAITAACSFFKTVYAVDSVPERLAEAKKHGAIPLHLTDDDPVKTVKEATGGRGADVALEVVGAGPALDLAVSIVRNFGVISSCGIHTHTVTLQGPDLYNKNLRFQFGRCPVRAVFDPAVKLLSKHHDLFASFIQHTRPIEDAPEYYKLFNDRKVLKTVFKMNHAQ

SEQ ID NO: 61431 - protein, 449 aa, Bordetella parapertussis 12822
MGPQLVSWKNKRNLSPEILPMSQAPAHSLPSYLDAEHLGPWGIYLQQVDRVTPYLGPLARWVETLKRPKRALIVDVPIEMDNGSIAHFEGYRVQHNTSRGPGKGGVRFHQDVTLSEVMALAAWMSIKNAAVNLPYGGAKGGVRVDPRTLSHSELERMTRRYTSEIGVIIGPSKDIPAPDVNTNAQTMAWMMDTYSMNEGATATGVVTGKPIALGGSLGRVEATGRGVFVVGCEAARDLNLDVSKARIVVQGFGNVGGTAARLFHEAGAKVIAVQDHTGTIHNDGGLDVHKLLAHVGNQGGVAGFTGAQQLADDDFWGLETDFLIPAALEGQINENNAARVRAKVVVEGANGPTTPEADDILRENGVYVVPDVLANAGGVTVSYFEWVQDFSSFFWSEEEINQRLERLMREAYSAVSQVAKEHKVTLRTAAFIVACTRILQARQVRGLYP

SEQ ID NO: 61432 - protein, 535 aa, Polaromonas sp. JS666
MTILTSRVSTSDDEFRLNREAYEAVIADLQKRRQLALAGGPPKAREKHLARNKILPRHRVEVLLDPGSPFLEVGMLAGEGMYDGVPPGASIITGIGLVQGRPCMIIANDATVKGGTYYGMTCKKHVRAQQIAWAHRLPCITLVDSGGAFLPEMAHIFPDVGQFGSIFNNQVRMSAEGIQQIAVVMGPCTAGGAYIPALCDEAVIVKEQGYMYLGGPELTFAATGETVDAEALGGAKMHCSVSGVTDHIAEDDRHALAITREIVRDLGEQPKPRWTRQPSVPPRFDPREIYGIISRDTKIPTDTREILARFVDDSRFQEFKPMYGDTLLTGFARIHGHEVGILANQGVLFPDSAMKAAHFIDLCCQRDIPLLFMADVTGFMVGRAAEQAGIAKAGAKMITAMASANVPKYTIIMGASYGAGYLAMCGRPFNPTAMFAWPTGRAAIMGPDQAATVMALVRKQINKTEGKEWTPEEEEAFKAPVRKIYEDFQPATNFSSNLWVDGIIDPVETRDAMGLLLDLASRTAAKPTPFGIFRF

SEQ ID NO: 61433 - protein, 96 aa, Panax ginseng
ATYYKVKLLTPEGEKEFECPDDVYILDNAEEIGIDLPYSCRAGSCSSCAGKVVSGKVDNSDNSFLNDDNMDAGYVLTCHAYANSDVVIETHKEEEV

SEQ ID NO: 61434 - protein, 364 aa, Chlamydophila pneumoniae CWL029
MSHTECGIVGLPNVGKSGLFNALTGAQVASCNYPFCTIDPNVGIVPVIDERLEALAKISNSQKIIYADMKFVDIAGLVKGASDGAGLGNRFLSHIRETHAIAHVVRCFDDPDVTHVSGKVNPVEDIEVINLELIFSDFSSAKNIHSKLEKLAKGKREVGALLPLFDTIIAHLEKGLPLRTLELTPEQIVALKPYPFLTMKPMFYIANVDESSLPDMDNDYVAAVREVAAKENSKVVPICVRIEEEIVSLPIEERLEFLMSLGLEKSGLHRLVRAAYDTLGLISYFTTGPQESRAWTVVRGSSAWEAAGEIHTDIQKGFIRAEVITFEDMIECQGRAAARELGKLHIEGRDYIVQDGDTMLFLHN

SEQ ID NO: 61435 - protein, 596 aa, Zea mays
MDQYEVLEQIGKGAFGSALLVRHKAEKKKYVLKKIRLARQTDRTRRSAHQEMQLIATVRNPFIVEYKDSWVEKGCYVCIVIGYCEGGDMAEAIKRANGNHFSEEKLCKWLVQLLMALDYLHANHILHRDVKCSNIFIARDQSIRLGDFGLAKILTSDDLASSVVGTPSYMCPELLADIPYGTKSDIWSLGCCIYEMTALRPAFKAFDMQALISKITKSIVSPLPTRYSGSFRGLIKSMLRKSPEHRPSAAELLKHVHLQPYVLQVQLKSSPSRNMSPIYQALTDKVKKMTFPSDITDSARRVARRNSLGNERTVTFCKPSPEQNSISSTRSIKEYTTTQSVKELSVGSSQIDDEVTSKAIRTKTTGILRTPKSTPAKTLTTRNRLELDPPKTSYSRTDHSELTSRTPLNKSAVTARRASLPLPTYRAPNGRAASVLNQLDSPDVSVNAPRIDRIAEFPLASSEDPLAPMNKNLSSAPGHDVSCSTPPFINRSITKDKYTVQVLHRGDGDNASDSSGRNATAASSGGSNDSRQQRFDTSSYQQRAEALEGLLEFSAQLLQQERYEELGILLKPFGPEKASPRETAIWLTKSFKETAS

SEQ ID NO: 61436 - protein, 99 aa, Aphanothece sacrum
ATYKVTLINEEEGINAILEVADDQTILDAGEEAGLDLPSSCRAGSCSTCAGKLVSGAAPNQDDQAFLDDDQLAAGWVMTCVAYPTGDCTIMTHQESEVL

SEQ ID NO: 61437 - protein, 181 aa, Salix bakko
MGLSFTKLLGRLFSKKEMRILMVGLDAAGKTTILYKLKLGEIVTTIPTIGFNVETVEYKNISFTVWDVGGQDKIRPLWRHYFQNTQGLIFVVDSNDRDRVGEARDELHRMLNEDELRDAVLLVFANKQDLPNAMNAAEITDKLGLHSLRQRHWYIQSTCATSGEGLYEGLDWLSNNISSKA

SEQ ID NO: 61438 - protein, 312 aa, Triticum aestivum
LIILTASRCLGREVREKLFDDVSALFHDLDNGMQPISVIFPYLPIPAHRRRDQARTRLAEIFATIIKSRKASGQSEEDMLQCFIDSKYKNGRQTTESEVTGLLIAALFAGQHTSSITSTWTGAYLLKFQQYFAEAVEEQKEVMKRHGDKIDHDILAEMDVLYRCIKEALRLHPPLIMLLRQSHSDFSVTTREGKEFDIPKGHIVATSPAFANRLPHIFKNPDSYDPDRFAAGREEDKVAGAFSYISFGGGRHGCLGEPFAYLQIKAIWTHLLRNFEFELVSPFPENDWNAMVVGIKGEVMVSYKRRKLVVDN

SEQ ID NO: 61439 - protein, 373 aa, Zea mays
MARRSTPLLRRLLAPSPSLPTPLADAVSRRTVTYMPRPGDGAPRGVTLIPGDGIGPLVTGAVRQVMEAMHAPVYFETYEVHGDMPTVPAEVIESIRRNKVCLKGGLATPVGGGVSSLNVQLRKELDLYAALVNCFNLPGLPTRHDNVDIVVIRENSEGEYSGLEHEVVPGVVESLKVITKFCSERIAKYAFEYAYLNNRKKVTAVHKANIMKLADGLFLESCREVAKKYPGIKYNEIIVDNCCMQLVAKPEQFDVMVTPNLYGNLVANVAAGIAGGTGVMPGGNVGQDHAIFEQGASAGNVGNEKIVEKKRANPVALLLSSAMMLRHLQFPSFADRLETAVKRVIAEGKYRTKDLGGTSTTQEVIDAVIAKLG

SEQ ID NO: 61440 - protein, 420 aa, Thermoanaerobacter tengcongensis MB4
MITKVKNLFKGEHRPKLMALDFIKYIGPGLLVTVGFIDPGNWASNVAAGSSYGYKLLWMVTLSTIMLIILQHNAAHLGIVTGYCMSEAATKFLKPFTSRLVLISAVFAAILTAMAEILGAAIALQMLFKIPIKIGSLITVVFVSWMLYTNSYKKLEKWIISFVSLIGISFIFELSLIDVKWAEVASSWVKPEFPAGSMPIIMSVLGAVVMPHNLFLHSEIIQSRQWNLEDEKVIVKQLNYEYFDTIFSMIIGWGINSAMIIVAASAFFTNNVTVMELNQAQQMLKPLLGNASAVVFALALLFAGISSSITAGMAGGSIFAGIYGEPYDIHDAHTKVGVGITYIFAVLIIFFVKSPFQGLVYSQMFLSVQLPITIFLLIYLTSSKKIMGKFANTLLYKVLLWTIGIIVTVLNAMLLMSFVG

SEQ ID NO: 61441 - protein, 80 aa, Arabidopsis thaliana
  misc_feature (66)..(66): Xaa can be any naturally occurring amino acid
MSDKGRPLPKFGEWDVNDPASAEGFTVIFNKARDEKKTGGKPGSPGKSSEGHVKSGGGDPSKPQPXKKWLCCMQAPAVDS

SEQ ID NO: 61442 - protein, 181 aa, Vigna unguiculata
MGLSFTKLFSRLFAKKEMRILMVGLDAAGKTTILYKLKLGEIVTTIPTIGFNVETVEYKNISFTVWDVGGQDKIRPLWRHYFQNTQGLIFVVDSNDRDRVVEARDELHRMLNEDELRDAVLLVFANKQDLPNAMNAAEITDKLGLHSLRQRHWYIQSTCATSGEGLYEGLEWLSNNIASKA

SEQ ID NO: 61443 - protein, 316 aa, Fusobacterium nucleatum subsp. vincentii ATCC 49256
MINFNNVKIFSGNSNVELAKKIAEKAGLQLGKAEILRFKDGEVYIEIEETVRGRDVFVVQSTSEPVNENLMELLIFVDALKRASAKTINVIIPYYGYARQDRKSKPREPITSKLVANLLTTAGVNRVIAMDLHADQIQGFFDIPVDHMQALPLMAKYFKEKGFLGDDVVVVSPDVGGVKRARKLAEKLDCKIAIIDKRRPKPNVAEVMNLIGEVEGKIAIFIDDMIDTAGTITNGADAIAQRGAKEVYACCSHAVFSDPAIERLEKSALKEVIVTDSIALPERKKIDKIKILSVDSVFAAAMDRIINNKSVSELFE

SEQ ID NO: 61444 - protein, 495 aa, Petroselinum crispum
MTSDKWSIEKRAPLRNDSVLKEENVPEIGCLSIVVLGASGDLAKKKTFPALFNLYRQGFLQSHEVYIFGYARTKISDEELRDRIRGYLVPSKNTVEGHEEDLTNFLQLIKYVCGSYDTEEGYQLLDKEISEHEIYRNCTEGSSRRLFYLALPPSVYPPVCKMIRKCCMNKSDLGGWTRIVVEKPFGRDLESAEQLSNQIGELFEEPQIYRIDHYLGKELVQNLLVLRFANRFFMPLWNRDNIDNIQIVFREDFGTDGRGGYFDQYGIIRDIIQNHLLQVLCLVAMEKPVSLKPEHIRDEKVKVLQSVVPIKDEEVVLGQYDGYLEDPTVPDGSYTPTFATMVLRIHNERWEGVPFILKAGKALNSRKAEIRVQFKDVPGDIFKSKKQGRNEFVIRLQPSEAMYMKLTVKQPGLKMSTVQSEMDLSYGQRYQDVTIPEAYERLILDTIRGDQQHFVRRDELKAAWEIFTPLLHRIDKGEFKSLPYKPGSRGPEESG

SEQ ID NO: 61445 - protein, 252 aa, Rhizobium leguminosarum bv. viciae 3841
MVIANDDELVKLKEIGRICANAIQVMAAAMEPGMTTLELDRIGRKVLEDSGARSAPEFCYQFPGATCISINEEIAHGIPGPRVIRAGDLINIDVSAEKDGFFADTGASFTMPPVKPKIERLCRDGKRALWIGLNQVKSGEPLATIGTAVGAFAQKNRYTLVANLASHGVGRSLHEEPAELSTWPDPSEKRMMTEGLVFTVEPFLSLGATWAEGGDDAWTLYADPKAPTVQYEHTVVATRNGPVVLTLPDERA

SEQ ID NO: 61446 - protein, 399 aa, Thermoanaerobacter tengcongensis MB4
MPYEFRMPNVVSNGIEGFVVNWFKDEGQPVQAGELLLEVQFEKAAIELQAPVSGILTKILCPQGHVVKVGQLLCLIEEKSTEVAGGSGSAVPPVHAPEETPHFHGETERTTQSTPVDSQVHSSNTGDVRATPAARKLARELGIPLEAVPGTGPGGRITEEDVKNFAQRSEKTNLTARRVPLTPTQRLVGSRMLQSLRETAQYTLGREVDISALIKVRMELKQKGSPANITDLIHKAVVQAILENPVMQAVIDGDDMVVPAEVHLGFAVARGDELLVPVIKNAHRLNLNEMAVERRRLTDAVLQGIIKPEELQGGTFTVTNLGTYGVDFFTPVLYPKQSAILGIGRIVERPVLENGNIRSAQFMTLSLTVDHQVINGAPAARFLNRLAELLSQPEVLLEL

SEQ ID NO: 61447 - protein, 176 aa, Triticum aestivum
  misc_feature (31)..(31): Xaa can be any naturally occurring amino acid
  misc_feature (117)..(117): Xaa can be any naturally occurring amino acid
MGATVMASSATSVAPFQGLKSTAGLPVSRRXSNGASLGSVSNGGRIRCMQVWSIDGIKKWETLSYLSPLSTEALLKQVDYLIRSKWVPCLEFSKVGYIFRDHNASPGYYDGRYWTMXKLPMFGCTDATQVINEVEEVKKEYPDAYVRIIGFDNMRQVQCVSFIAFKPPSCEESGQA

SEQ ID NO: 61448 - protein, 287 aa, Pseudephebe minuscula
VDHGDVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKETMKKASEGELKGMTRKWNDIWIAANHSRHHGLLGGCACVHRFEWRQPLM

SEQ ID NO: 61449 - protein, 534 aa, Petroselinum crispum
MKSAVCDIVHKMSDKWCLEERAPVVEDSAGDPIVKDTQPPPPVSEDGCLSIVVLGASGDLAKKKTFPALFNLYRQGFLQSHEVYIFGYARTKISDDDLRDRIRGYLTPNKNTAEGHTEDVSKFLQLIKYVCGSYDAAEGFQCLDKEISEHEISRNSIEGSSRRLFYLALPPSVYPPVCKMIKTYCMNKSDLGGWTRIVVEKPFGRDLESAEHLSNQIGELFEEPQIYRIDHYLGKELVQNLLVLRFANRFFLPSWNRDNISSVQIVFREDFGTEGRGGYFDQYGIIRDIIQNHLLQVLCLVAMEKPISLKPEHIRDEKVKVLQSVAPLNDEEVVLGQYDGYLDDPTVPAGSNTPTFATMVLRIHNERWEGVPFVLKAGKALESRKAEIRIQFKEVPGDIFKCQKQGRNEFVIRLQPSEAMYMKLTVKKPGLEMSTAQSELDLSYGQRYQDVTIPEAYERLILDTIRGDQQHFVRRDELKAAWEIFTPLLHRIDKSELKSVSYKPGSRGPEEADELLKKVGYVQTHGYTWIPPTL

SEQ ID NO: 61450 - protein, 484 aa, Gnetum gnemon
MKKKNTFLVSVSTKSETSIGQITQIIGPVLDVSFPPGNLPNIYNSLIVKGQKDDRAFSVTCEVQQLLGNNTVRAVAMSATDGLTRGMKVINTGASLSVPVGKATLGRIFNVLGEPVDNLGPVDTDTTFPIHRPAPAFTQLDTNLSIFETGIKVVDLLAPYRRGGKIGLFGGAGVGKTVLIMELINNIAKAHGGVSVFGGVGERTREGNDLYMEMKESGVINERNIAESKVALVYGQMNEPPGARMRVGLTALAMAEYFRDVNEQDVLLFIDNIFRFVQAGSEVSALLGRMPSAVGYQPTLSTEMGSLQERITSTKKGSITSIQAVYVPADDLTDPAPATTFAHLDATTVLSRGLAAKGIYPAVDPLDSTSTMLQPEIVGEQHYEIAQGVKQTLQRYKELQDIIAILGLDELSEEDRLTVARARKIERFLSQPFFVAEVFTGSPGKYVSLIETIRGFQMILSGDLDGLPEQSFYLVGNIDEVISS

SEQ ID NO: 61451 - protein, 248 aa, Brassica napus
MSQQEQPKRPQEPVKYGDVFEVSGELADRPIAPEDARMMQAKETSVLGHTQKGGIAATMQSAATANRRAGFVEPGVATYLDPDRGVSVEQTDVAGARVTKETIGVQDVGQYVEPRPVATAATGVSVQSKITIGQALEATVHTAGKKPVDQSDAAAIQAAEVRASSNNVIAPGGVAASAQSAADYNAPIEFDENKIKLADVLAGAAGKLQEDKAVTKQDAEGVVSAELRNNPNLSTYPGGVADSVTAAR

SEQ ID NO: 61452 - protein, 498 aa, Bordetella parapertussis 12822
MTLHDSAYWRAQAAALAPEGRAYIDGAYCDAADGATFAAHSPIDGRKLADIAACGAADVDRAVAAARRAFEAGVWSGLAPRERKHRLLRLAALITEHQEELALLETLDMGKPIRDALAFDLPETARCYAWYGEAIDKRYDEIAPTGADALATITREPLGVVAAVVPWNYPLMMAAWKVAPALAVGNSVILKPAEQASLSALRLAALAEQAGIPPGVFSVVPGLGAQAGQALGLHPDVDCIAFTGSTATGKRFMTYSGQSNLKRVWLECGGKSPHIVFADCPDLDRAAQVAALAIFSNQGEVCIAGSRLYVQHGIYDAFMEKVAAFAATLRPGNPLDPDSALGAMVDERQTQAVMARIAAGAQEGARLRLGGRQVLTDSGGYYIEPTIFDCPGQDNSLVREEIFGPVLAAQGFADEDEAVALANDSIYGLGAGLWTADLGRAHRLSRRLRAGLVWVNCYADGDITVPFGGVKQSGFGRDKSLHAMDKYSDLKTTWISLR

SEQ ID NO: 61453 - protein, 239 aa, Yarrowia lipolytica CLIB122
MSRVSELSHNYNQIKTSVSALSPTTRLVCVSKYKPASDIQAVYDLGQRHFGENYVQELMEKVANLPQEIQWHFIGSLQSNKCAQLAKNIPNLWVETVDGEKKAKKLNDAREQSEYKDKAPVHVFVQVNTSGESQKSGLDPEDVSKVVDYIIKECPQLKLAGLMTIGSIEQSKASEENKDFATLVQIRDSIEQAFDITGLELSMGMSSDFEEAIKQGSTNVRIGSTIFGGRMTKEEAKTA

SEQ ID NO: 61454 - protein, 497 aa, Pseudomonas syringae pv. phaseolicola 1448A
MSSIQHLIHGEFISEDGRTADVFNPSTGQVVHTVALATRDTVQKAIDSAKAAFPAWRNTPPAKRAQVMFRFKQLLEQNEARIAQLISEEHGKTLEDAAGELKRGIENVEYACAAPEILKGEYSRNVGPNIDAWSDFQPLGIVAGITPFNFPAMVPLWMYPLAIACGNCFILKPSERDPSSTLLIAELLHEAGLPKGVLNVVHGDKVAVDALIEAPEVKALSFVGSTPIAEYIYKEGAARGKRVQALGGAKNHAVLMPDADLDNAVSALMGAAYGSCGERCMAISVAVCVGDQIADALVAKLVPQIQSLKIGAGTTCGLDMGPLVTGQHRDKVGGYIEDGVQSGATLVVDGRDLQVAGHEQGFFMGGCLFDRVTPQMRIYKEEIFGPVLCIVRVDSLEQAMQLINDHEYGNGTCIFTRDGEAARLFCDEIEVGMVGVNVPLPVPVAYHSFGGWKRSLFGDLHAYGPDGVRFYTRRKAITQRWPQRASHEASQFAFPSL

SEQ ID NO: 61455 - protein, 464 aa, Lactobacillus plantarum WCFS1
MKSAKTKDHAKMKAAEEKAIHSTGADSKSLDEVNGSVRVPKDASFWRTLIAYTGPGALVAVGYMDPGNWITSIAGGSQYKYALLSVILLSSLIAMLLQAMAARLGIVTGKDLAQLTRERTSKGMGIFLWIITELAIMATDVAEIIGSGIALKLLFGFPLIVGILITTADVLILLLLMKLGFRKIEAIVATLVAVILFVFLYEVIISQPNIPEMLKGYVPTSRIVSNRSMLFLALGIVGATVMPHNLYLGSSISQTRQVDRSDEKEVAKAVKFTTIDSNIQLSVAFVVNSLLLILGAALFFGTKGDLGRFVDLYNALGDSKVVGSIASPLLSMLFAIALLSSGQSSTITGTLSGQIIMEGFIRLKMPLWAQRLLTRLISVTPVLAFAIYYHGNEAKIEDLLTMSQVFLSIALPFAMIPLVMFTSNRALMGNFTNRVWVKWTAWIVTVILIILNIYLILQTVGLVK

SEQ ID NO: 61456 - protein, 160 aa, Triticum aestivum
  misc_feature (95)..(95): Xaa can be any naturally occurring amino acid
NKFVQKSLPVPVRNSRDIVDPRGRELPTEPKSSPAPVLPFPPPMYLPVTPAPPPPSPAIQEVEAIRTVVAESEKVLEKLQKKEATMREELTKRVXELHDKEFKLPYQNPAPRPDERAGCAKCYRSNGQDPLKGGRGGQRGAEGARIEWERGESKASHGEP

SEQ ID NO: 61457 - protein, 483 aa, Pseudomonas syringae pv. syringae B728a
MTVRRTKIVATLGPASNSPEVIEQLILSGLDVARLNFSHGTPDEHKARARLIREIAARHGRFVALLGDLQGPKIRIAKFTDKRIELKVGDKFTFSTAHPLTSGNQQIVGIDYPDLVKDCGVGDELLLDDGRVVMRVDTQTADELHCTVLIGGPLSDHKGINRRGGGLTAPALTEKDKQDIKLAAEMDLDYLAVSFPRDAADMEYARQLRDESGGTAWLVAKIERAEAVANDEVLDELIRASDAVMVARGDLGVEIGDAELVGVQKRIILHARRHNKAVIVATQMMESMISSPMPTRAEVSDVANAVLDYTDAVMLSAESAAGSYPIEAVQAMARICIGAEKHPTGKTSSHRIGHSFTRCDESIALAAMYTANHFPGVKAIIALTESGYTPLIMSRIRSSVPIYAFSPHRGTQARAAMFRGVYTVPFDPAALPPGQVSQAAVDELLKRGLVEQGDWVILTKGDSYHTIGGTNGMKILHVGDPLV

SEQ ID NO: 61458 - protein, 445 aa, Arabidopsis thaliana
MATRANVPEQVRGAPLVDGLKIQNKNGAVKSRRALGDIGNLVSVPGVQGGKAQPPINRPITRSFRAQLLANAQLERKPINGDNKVPALGPKRQPLAARNPEAQRAVQKKNLVVKQQTKPVEVIETKKEVTKKEVAMSPKNKKVTYSSVLSARSKAACGIVNKPKIIDIDESDKDNHLAAVEYVDDMYSFYKEVEKESQPRMYMHIQTEMNEKMRAILIDWLLEVHIKFELNLETLYLTVNIIDRFLSVKAVPKRELQLVGISALLIASKYEEIWPPQVNDLVYVTDNAYSSRQILVMEKAILGNLEWYLTVPTQYVFLVRFIKASMSDPEMENMVHFLAELGMMHYDTLTFCPSMQAASAVYTARCSLNKSPAWTDTLQFHTGYTESEIMDCSKLLAFLHSRCGESRLRAVYKKYSKAENGGVAMVSPAKSLLSAAADWKKPVSS

SEQ ID NO: 61459 - protein, 447 aa, Kluyveromyces lactis NRRL Y-1140
MQSLNSQLGGLPNSEQFFGKGAVQQQGPVGMNGMLFSPSMNSTRMMPQQSQQPHVLHGLENNGGLQNSYLLKQKMDVVNSAFGQQNNLQQQQQPGKMPLPNNGQVPMMMQNSISGGNSNNNTIPQQMQFPMPVQQQAMGNVNGLDTTPLPNASHTPISSPAHLLIREVWQNNVNFEFAIIRKMIEQYKVISISTEFVGTIARPIGNFRSKTDYHYQTMRSNVDLLTPIQIGLSLSDLQGNKPDNFPSTWQFNFHFDVTKETVNSESLELLKKSGVILERHQQNGVDFDEFAQLMMDSGLLLNDEVTWISYHAAYDYGFLINRLMNTNMPNNKEDFEWWVQKYIPTSYDLNLINKLVHEVTQQHPHPPPLHLLQSQQQQQQNQQQQYTLELLADELGIPIFPLFSSAAGQSLLALLAYTQLGKLSLYKLRNGTDFSYYKNLIYGITQE

SEQ ID NO: 61460 - protein, 172 aa, Prochlorococcus marinus str. AS9601
MKFFRFLRYFLCITFSFLVLSSPVFAGANVAVKGEGDEVPSYVRSNITGFDFHGEDLHLSSIAGAVARDADFSDVDLHGTTLTLSDLKGSNLNGIDLTDTLSDRVNFQKTDLRNAVLINMIASGSSFAGAQIEGADFSYAILDSEDQRNLCEIADGINPTTGVSTRESLECS

SEQ ID NO: 61461 - protein, 370 aa, Saccharum officinarum
MDGAPVAEFRPTVTHGGRFLQYNIFGNLFEITHKYQPPIMPIGRGAYGIVCSVMNFETREMVAIKKIANAFDNHMDAKRTLREIKLLRHLDHENIIGIRDVIPPPIPQAFNDVYIGTELMDTDLHHIIRSNQELSEEHCQYFLYQILRGLKYIHSANVIHRDLKPSNLLLNANCDLKICDFGLARPSSESDMMTEYVVTRWYRAPELLLNSTDYSAAIDVWSVGCIFMELINRQPLFPGRDHMHQMRLITEVIGTPTDDELGFIRNEDARKYMRHLPQFPRRPFASLFPKVQSVAALDLIERMLTFNPLQRITVEEALEHPYLERLHDIADEPICTEPFSFDFEQQALTEDQMKQLIFNEAIEMNPNFRY

SEQ ID NO: 61462 - protein, 510 aa, Burkholderia sp. 383
MSDASSSSSRSAAPSAAASAPKIGVIPATLMVAGNMMGSGVFMLPANLAATGGIAIFGWLITVVGAVSLALVFAKLAAIDPAAGGPYAYARKSFGPYMGYQTNLIYWLANVLGNVGLAVAGLGYLTHFFPVLKDPLVFALAQIFVIWLFTYANILGPNVVGRVQSVTTIFALVPILGMAVFGWFWFSKDVYFAGWNVSGASSFSAIGATLNFTLWAFIGVESASVSAGVVENPSRNVPIATVGGVVLAAVCYVLSSTVIMGMIPNKALLASSAPFADAARLALGNTAANAVAICAALGCLGSLAGWTLLVGQTAKAAADDGLFAGVFARVNSKNVPSAGLAIVALIMSVQVLATMSPSASEQFGKIASIAVIMTLLPYIYSCIAIKVLGYGKMPSHQFTFYTIVGLVGAVYALWAMVGSDGQQTRWSLIFVVATIVFYELSINRQREIEETHIHPGGRSPRWVRYLALGVTIAALAATFWISVGRHQADTLHARSPAVAASVQATQQTGE

SEQ ID NO: 61463 - protein, 578 aa, Solanum tuberosum
MGNTCVGPSISKNGIFQSVSAAMWRSRSPDDTASTTNGESARIETPISVKEPDSPLPVQEPPEQMTMPKSEKKEEEKEQPKKPKKPAEMKRVSSAGLRTDSVLQKKTGNLKEFFSIGKKLGQGQFGTTFKCVEKATGKEYACKSIAKRKLLTDDDVEDVRREVQIMHHLAGHPHVISIKGAYEDAVAVHVVMEFCAGGELFDRIIQRGHYTERKAAELTRTIVGVVEACHSLGVMHRDLKPENFLFVDQKEDSLLKAIDFGLSIFFKPGDRFTDVVGSPYYVAPEVLRKRYGPEADVWSAGVILYILLSGVPPFWAENEQGIFEQVLHGDLDFKSDPWPSISEDAKDLMRRMLVRDPRRRLTAHEVLCHPWVQVDGVAPDKPLDSAVLSRMKQFSAMNKLKKMALRVIAESLSEEEIAGLKEMFKMIDTDNSGQITFEELKEGLKRFGSNLKETEIYDLMQAADVDNSGTIDYGEFIAATLHMNKIERQDHLFAAFCYFDKDGSGYITADELQQACEEFGIGDVRMEEMIREADQDNDGRIDYNEFVAMMQKGNPVLGGGKKGLEHSFSIGFREAVKL

SEQ ID NO: 61464 - protein, 115 aa, Cryptomeria japonica
AGPAQGWSTLSQSKPIGSLPLMNTGTLMKQWKMGLKAKRSVKAAYKVKLVTPDGETEIECPDDQYILDAAEDAGIDLPYSCRSGSCSSCAAKVIEGEIEMEDQSFLDDDQIGSGF

SEQ ID NO: 61465 - protein, 158 aa, Streptococcus thermophilus LMG 18311
MRRMLTAKLQNRSGVLNRFTGVLSRRQVNIESISVGATENPDVSRITIIIDVNSHNEVEQIIKQLNRQIDVIRIRDITDVPHLEREVILVKVSAPTSKRAEILAIIQPFRASVVDVAPSSITIQMTGDAEKSEALLRVIRPYGIKNIARTGATGFTRD

SEQ ID NO: 61466 - protein, 115 aa, Cryptomeria japonica
AGPAQGWSTLSQSKPIGSLPLMNTGALMKQWKMGLKAKRSVKAAYKVKLVTPDGETEIECPDDQYILDAAEDAGIDLPYSCRSGSCSSCAAKVIEGEIEMEDQSFLDDDQIGSGF

SEQ ID NO: 61467 - protein, 466 aa, Thermoanaerobacter tengcongensis MB4
MPLNRSKKKTPMPTQKPEVRRRNFNEVALGYSEEEAVSEAQRCLQCKKPGCVEGCPVQVQIPQFIKRIAERDFEGAIKIIKETNSLPAICGRVCPQETQCEKNCVLGKVGEPVAIGRLERFAADWERAKGIRPPVIPKKLGKKVAIIGSGPAGLTCAGDLAKLGYDVTIFEALHKPGGVLVYGIPEFRLPKIIVEQEVKFIQQLGVEIKTNMVMGKVLTIDDLFEMGYEAVFISTGAGLPKFMGIPGENYLGVYSANEFLTRINLMKAYSFPNTDTPIKVGKKVAVIGGGNVAMDAARSALRMGADEVHIVYRRSEEEMPARKEEFENAKEEGIIFDFLTNPVRIIGNENGWVKGIECIRMELGEPDASGRRRPVPITGSEFIMDVDTIVIAIGTGPNPLLTKTTEGLELTKHGYIAVDEEGRTSREGVWAGGDIVTGSATVILAMGAGKKAARSIHEYLQNKKWR

SEQ ID NO: 61468 - protein, 459 aa, Burkholderia sp. 383
MQDNSLRQSLKQRHITMIALGGVIGAGLFVGSGAIIATAGPAAILSYLIGGVIVTLVMFMLGEMASRNPDSGSFSTYASSYLGEWAGFAVGWLYWFKSMMTITVEAILLGAILHDFLPWLPVWGGALFMLVTLIASNAYSVRSFGEAEYWLSFAKVTTIIIFMALGASILLGFQPRIPAPGLINLTDHGGFMPNGISPVLAGVMVVIFSLGGSEIAAVAAGESENPSKNVIRAIKSVIVRVMVFYVGSVSILILCMPWTDKANLKSPYVSLFSMAGFTSAAVAMKLVLFVSFMSVMNSFLFSNSRMLFSLSQRGHAPAMFGRTNAKGVPMNALVLCLAICVSILGIHFVSGGDLFLMLAKSSGAFVMIVWIFIIVAHFAMRRQEKHAPRDPQAFRAWFYPVSNWIALLALVAVLGSQAFNPDSRFQFWFTVLTALAIVAAYFVRRKPVQLGDTAGAKVR

SEQ ID NO: 61469 - protein, 352 aa, Thermoanaerobacter tengcongensis MB4
MKGFAMLSIGKVGWIEKEKPTPGPFDAIVRPLAVAPCTSDVHTVFEGAIGERHNMILGHEAVGEVVEVGSEVKDFKPGDRVVVPAITPDWRTSEVQRGYHQHSGGMLAGWKFSNIKDGVFGEFFHVNDADMNLAHLPKEIPLEAAVMIPDMMTTGFHGAELADIELGATVAVLGIGPVGLMAVAGAKLRGAGRIIAVGSRPVCVDAAKYYGATDIVNYKDGPIDSQIMDLTEGKGVDAAIIAGGNVDIMATAVKIVKPGGTIANVNYFGEGDVLPVPRLEWGCGMAHKTIKGGLCPGGRLRMERLIDLVVYKRVDPSKLVTHVFRGFDNIEKAFMLMKDKPKDLIKPVVILA

SEQ ID NO: 61470 - protein, 456 aa, Azospirillum brasilense
QDFAEIYARFSDERANEQANRCSQCGVPFCQVHCPVSNNIPDWLKLTSEGRLEEAYEVSQATNNFPEICGRICPQDRLCEGNCVIEQSTHGAVTIGSVEKYINDTAWDQGWVKPRTPSRELGLSVGVIGAGPAGLAAAEELRAKGYEVHVYDRYDRMGGLLVYGIPGFKLEKSVVERRVKLLADAGVIYHPNFEVGRDASLPELRRKHVAVLVATGVYKARDIKAPGSGLGNIVAALDYLTTSNKVSLGDTVEAYENGSLNAAGKHVVVLGGGDTAMDCVRTAIRQGATSVKCLYRRDRKNMPGSQREVAHAEEEGVEFIWQAAPEGFTGDTVVTGVRAVRIHLGVADATGRQTPQVIEGSEFTVQADLVIKALGFEPEDLPNAFDEPELKVTRWGTLLVDHRTKMTNMDGVFAAGDIVRGASLVVWAIRDGRDAAEGIHAYAKAKAEAPVAVAAE

SEQ ID NO: 61471 - protein, 352 aa, Bacillus sp. ULM1
MYKGLLKQYASYLPVNEKTPDVSLMEGNTPLIPLLNISKQLGVQLYGKYEGANPTGSFKDRGMVMAVAKAKEEGSEAIICASTGNTSASAAAYAARLGMKCIIVIPEGKIAHGKLAQAVAYGAEIISIEGNFDDALKAVRNIAAEEPITLVNSVNPYRIEGQKTAAFEICDQLQNAPDVLAIPVGNAGNITAYWKGFCEYEKEKGYKKPRIHGFEAEGAAAIVKGHVIEEPETIATAIRIGNPASWSYAVEAAEQSHGEIDMVSDEEILHAYRLLAKTEGVFAEPGSNASLAGVIKHVESGKIKKGETVVAVLTGNGLKDPDIAISSNQLDIASVSNDIEQIKDHIKGVIMS

SEQ ID NO: 61472 - protein, 547 aa, Mesorhizobium loti MAFF303099
MDKSAFQKQLAALRDHRSAAPASMRQAFAADPQRFQAFTATDGDLLLDWSKCAVDATTMDLLEKLAAAADLEGRRAAMFAGKKINITEDRAVLHTALRNLSGTGVTVDGQDVKADVLSVLDAMGAFADAIRSGKALGATGKKITDIVNIGIGGSDLGPAMATLALAPYHDGPRAHYVSNIDGAHIHDTLKGLSAETTLFIVASKTFTTVETMTNAQTARDWVQKALGKQAVGKHFAAVSTALDLVAKFGIEADRVFGFWDWVGGRYSVWGAIGLPVMIAVGPRNFRAFLDGAHEMDQHFRTAPLAGNLPALLGLVGWWHRVICGYPARAVIPYDQRLSRLPAYLQQLDMESNGKGVTLDGTPVATPTGPLVWGEPGTNGQHAFFQLLHQGTDFIPVEFLAAAVGHEPELKHQHDLLLANCLAQSEALMKGRTLDEARAQMLAKGMKPADVDKIAPHRVFSGNRPSLTILYRKLDPRTFGRLIALYEHRVFVEGTLFNINSFDQWGVELGKELATGLLPVVEGKESAANRDASTRGLVERIHQLRGSE

SEQ ID NO: 61473 - protein, 214 aa, Prototheca wickerhamii
VDSKLQKLVKGIQNDGLRSILEDVYARNAEQDEFLQAVRGMVVSIAPVFEKHPEYLTAFKLLTEPERAIIFRVPWVDDAGQWQMNRGMRVQFSSAIGPYKGGLRFHPSVTLSIIKFLGFEQIFKNALTTLPMGGGKGGSDFDPKGRSEAEIMRFCQSFMTELYRHIGSDVDVPAGDIGVGGREIGYMYGQYKRITRDRGGVLTGKGMGWGGSEI

SEQ ID NO: 61474 - protein, 192 aa, Triticum aestivum
  misc_feature (140)..(140): Xaa can be any naturally occurring amino acid
  misc_feature (155)..(155): Xaa can be any naturally occurring amino acid
  misc_feature (175)..(175): Xaa can be any naturally occurring amino acid
  misc_feature (182)..(182): Xaa can be any naturally occurring amino acid
MSAYCGKYKDELIKNAAYIGTPGKGILAADESTGTIGKRFASINDQHVLLEGTLLKPNMVTPGSDAKKVAPEVIAEYTVRTLQRTVPAAVPAIVFLSGGQSEEEATLNLNAMNKLQTKKPWNLSFSFGRALQQSTLKAWXSGKTENEEKAKDGVXLVRCKANSEATLGTYKGDAXLGEGASXESLHVKDYKY

SEQ ID NO: 61475 - protein, 429 aa, Serratia marcescens
MKLYNLKDHNEQVSFAQAIKQGLGKQQGLFFPLDLPEFELTEIDHLLEQDFVTRSSRILSAFIGEEVPETALKKRVQAAFEFPAPVAKVTDDVSCLELFHGPTLAFKDFGGRFMAQMLAEVAGEQPVTILTATSGDTGAAVAHAFYGLKNVRVVILYPQGKISPLQEKLFCTLGGNIHTVAIDGDFDACQALVKQAFDDQELKDALHLNSANSINISRLLAQICYYFEAVAQLPQEARNQLVISVPSGNFGDLTAGLLAKSLGLPVKRFIAATNANDTVPRFLTSGQWQPHATVATLSNAMDVSQPNNWPRVEELFRRKVWQLKELGHAAVSDETTKDTMRELAELGYISEPHAAIAYRALRDQLQEGEFGLFLGTAHPAKFKESVEAILGQELPLPKALALRAELPLLSHTLPASFGELRKFLMGLPA

SEQ ID NO: 61476 - protein, 533 aa, Desulfitobacterium hafniense DCB-2
MVIITSWKRFKEYLYYDQELELLLDISRMNFSAEFLTELAEPMRDAYHQLQLLEKGALANPDEGRMVGHYWLRNPDLAPTEEIAQDIKETLKEILDFAEQIHSGRLQGEKGNPFRNILLVGVGGSILGPRFVADALASSRDKMKAFFIDNGDPDGIDRVLSRIGEELPATLCLIISKSGGTIETRNGMLEVRRAYEEAGLSFPDHAVAITQRGSQLDKLSQKEGWLRAFPMWDWVGGRTSLLSAVGLLSLALQGIDVAGLLQGAKDCDGRTRRPDTLANPGALLALMWYYSTQGQGGKQMVVLPYKDRLELFTKYLQQLIMESLGKEKNLQGETVHQGITVYGNKGSSDQHSYLQQLLEGPDNFFVTFIEVLKDRQGSSAYMEENSTSGEYLQAFLLGTREALTQKGRESLTITVKEVNAYTIGVLIALFERAVSIYALLVGINAYHQPAVEMGKKAAGQAIQLKNNIVECLKKHPDKRFSVHEIALAIGEEAHQEMVFKLLLHLTTNPEHGVNMAAGHPLPESRFFVSGPIL

SEQ ID NO: 61477 - protein, 208 aa, Prototheca wickerhamii
MSALLPGTHLVSRPTKGWTPVRPARNVRPAGMGVSRAPMRPTICQSSTVAADTGTKLERFSPLDRVSVLSEALPYLQRFRGKTVVIKYGGAAMKDPTLKAGVVADLVLLATVGIRPVLVHGGGPEINIWLTKLGIEPNFKNGLRVTDEATMDVVEMVLGGRVNKSLVTLIQQSGGRAVGLCGKDSDIILARQMVEKDIGFVGEVSGVR

SEQ ID NO: 61478 - protein, 510 aa, Pseudomonas syringae pv. phaseolicola 1448A
MTATPKPLVLIILDGFGHSESHEGNAILAAKMPVMDRLYETMPNGLISGSGMDVGLPDGQMGNSEVGHMNLGAGRVVYQDFTRVTKAIRDGEFFENPTICAAVDKAVGAGKAVHIMGLLSDGGVHSHQGHLVAMAELAVKRGAEKIYLHAFLDGRDTPPRSAKKSLELMDATFARLGKGRTATIIGRYFAMDRDNRWDRVSTAYNLIVDSTAEFHADSGVAGLEAAYARDENDEFVKATRIGEPARVEDGDAVVFMNFRADRARELTRVFVEDDFKDFERARQPKVNYVMLTQYAASIPAPSAFAAGSLKNVLGEYLADNGKTQLRIAETEKYAHVTFFFSGGREEPFPGEERILIPSPKVATYDLQPEMSAPEVTDKIVDAIEHQRYDVIIVNYANGDMVGHSGIMEAAIKAVECLDVCVGRITAALEKVGGEALITADHGNVEQMTDDSTGQAHTAHTSEPVPFVYVGKRPLKVREGGVLADVAPTMLHLLGMEKPQEMTGHSILVAK

SEQ ID NO: 61479 - protein, 398 aa, Desulfitobacterium hafniense DCB-2
MRKKECIAMLLAGGQGSRLGCLTRNIPKPAVSFAGKYRIIDFSLSNCSNSNIDTVGVLTQYKPFALNTYINMGSAWDLNCLNGGIHILPPFVGEAQGSWYKGTANAIYQNMDFINFYNPEYILILSGDHIYQMDYYEMLSCHKQKHAEVTLSAIAVPWEEASRFGVMVTDAGGRIIRFEEKPPRPESNLASMGVYIFNWDVLKEALLEDERDPQSDHDFGKNVLPRLLQQGRRLYSYLFHGYWRDVGTIESYYNANMEVLQEERVDKFFELKQRVFSNEEILAPQHLGERAKIHNSLIGNGCTILGEVRDSVIASGVYVGEGSLIEQSILLPNSEIYEDVRLHKTILGENAIVRAHCRIGDKREGNPPQEGITVIGDHLHIPEGTVISEGENVRKDTA

SEQ ID NO: 61480 - protein, 522 aa, Deinococcus radiodurans
IYAEAGGVKTVDVDEAEQRAFSLSDDDLTELARQCVTIEKHYGRPMDIEWGKDGRDVQIYILQARPETVQSRAGRTLERFELTGKGDVLVEGRAVGSRIGAGVVRVVKSLDQMDSVQDGDILVADMTDPDWEPVMKRASAIVTNRGGRTCHAAIIARELGIPAVVGTGNATRELHNGDEVTVSCAEGDTGYVYAGRLDFHVNRVELDAMPEVGMKIMMNVASPDRAFSFAALPNEGVGLARVEFIISNVIGIHPRALLDYPDVPADVKAQIEEKTAGYASPRDFFREKLAEGVASIAAAFAPKPVIVRLSDFKSNEYHHLIGGPAYEPTEENPMIGFRGASRYRSADFAEAFALECQAMKQVRDDMGLTNVQLMIPFVRTVAEGQRILEILAANGLTQRENDLKVIMMCEVPSNALLADQFLDLFDGFSIGSNDLTQLTLALDRDSGLVADMFDEQNEAVLALMGMAIKAAKAKGKYVGICGQGPSDHPALAQWLMDQGIDSVSLNPDSVLSTWLHLAGEQA

SEQ ID NO: 61481 - protein, 354 aa, Azoarcus sp. BH72
MSDELLNLRNQIDRLDEEILARLAERARCAQRVGEIKHGNIYRPEREAQVLRRLADLNGGPLPDVAVQKIFREIMSACLGLEQPLKVAYLGPAGTFSESASRKHFGAAPNVLPTPSIDEVFRAVESGNADYGVVPVENSTEGAVGGTLDLLLANPLKVCGEVKLRIHQNLLSRAEGIGGAKRLYSHAQSLAQCHEWLNRNLAHLPRIPVASNAEAARLAAEDPESCAIAGEAAAELYGLNKLATNIEDDPNNTTRFLVIASHDAGPSGNDKTSLVCSAQNRPGAMHALLEPLARHGVDMSKLESRPARSGLWEYVFYVDIQGHQTDAAVAAALRELNERAAFVKVLGSYPVAAI

SEQ ID NO: 61482 - protein, 502 aa, Thermus thermophilus HB27
MEALWVTAAFALGLLASRLALPPLVGYLVAGFLLAGTGIRGTAFLHQIAEIGVLLLLFSVGLKLRLKDLLDPRVLLSGGLHLGLFATLAFLYTKNLPLAIALGFSSTVLVAKVLEDKKELTSYHGRIALGILVFQDLVAVGLLTLYGGEGVSPWAALVLLFPLLRQGVAWLLEKSGHEELLVLFGLGMALGSGELFQHVGLSPELGALLTGALLSGHAKSAELTKGLWSLKEAFLVAFFLDIGLREGLQGLDLGLAAGLTLLSLLKAPLFFLVLLLVGYRARTAFVAGMYLGNHSEFALIVGVALERAGLFTDLSALALAVALSMALSAPLARYSHTLYKRLEPFLLRLERPGSHPDAEPERLEGTVLVVGMGRTGDAVYRVLEAQGESPVGLDADPAKVERHREKGRPGPLRRRRGPGALGKAGPQGAQGRGPRPAGPGGQDPRRPLAQGAGLPGACGRHQLLPRGGPRAGPGRGPPHLPSVPRSGGKAWGAGPGEPRYNG

SEQ ID NO: 61483 - protein, 368 aa, Desulfitobacterium hafniense DCB-2
MQAALVLENGKIFRGESFGAGGEIQGEVVFNTGMTGYQEVLTDPSYKGQMVCMTYPLIGNYGINSLDNQSPQIQVQGFIVKEAARNPHHWQLEKNISRALAQAGVVGIKGIDTRALTRIIREHGVLRGMITTELGELDQKALELKNWEIPQDAVAQVSTRETYKLPPLGKTDSRKPFHVVVMDFGIKSSILRAMQEEGYALTVVPYSASAQEIIALKPDGVFLSNGPGDPKDVAVGIKTIGGFVNKLPVFGICLGHQLLTLALGGDTYKLKYGHRGGNQPVQDLRTKKVHITSQNHGYAVAEGSLADTLLEVTHLNLNDQTVEGVRHKELPVFSVQYHPEAGPGPNDSLYLFKEFSTLMTEWRIHHAT

SEQ ID NO: 61484 - protein, 180 aa, Vitis vinifera
  misc_feature (61)..(61): Xaa can be any naturally occurring amino acid
  misc_feature (77)..(77): Xaa can be any naturally occurring amino acid
  misc_feature (140)..(140): Xaa can be any naturally occurring amino acid
MSTPAATPATYTSIPISGADVISRSFHNLSAAVSSRRPWPDFVAADVFHRPDSLTVAGERXRKNASYFRINYGILIXGCAMISLVGTPISLMVWVLTLGMWLIFYFFREDPLFVGGRQVSDRLVLLCLVLASVMAVWFTXVLENLVVGVGIGLLVCCVHGVFRNPLEDDEAGLRESALTH

SEQ ID NO: 61485 - protein, 371 aa, Cryptococcus neoformans var. neoformans B-3501A
MPDLVVTTQELRPSSPVYGHARTIIKNNFVAMAGEYVGTTLFMLCCLGGTHVALLPEKSVTGDLSQPLNTSSLFYISLSIGLSLTVNVWIFFRVSGGLFNPAVSLGMVLAGCLPPMKGALLTVAQVLGGITGAAIINVLLPGELNAGTTLGGGASIAQGLFIEAILTALLMLTVFFTAAEKNEATFLSPLAIGMALFIAEMVGVPYSGGALNPVRSLGPAVVTHNFPGYHWIYWVGPALGSVLATCFYSLLKYLEYESVPGPGEAPHVPPFWRLPARGYLSTLSHPFAKRASTGTYSHEDDPEKGLRSGKDSQANTDNPTRVNRPGSGDAEIQSPVEDTTMANARLDRIEMLLTQLMQVRTSEGTQKSPAV

SEQ ID NO: 61486 - protein, 379 aa, Campylobacter jejuni
MEISYYEILEITQNADKETIKKAYRKMALKYHPDRNQGDKEAEDKFKLVNEAYEVLTNDEKRAIYDRYGKDALKGGGFGSSSSGFAGFEDLGDIFSSFFGEGFGSSRRRKSSNDEKIPSDFIVNLKLSFKEAVFGCKKNIDFTYKCSCKTCNGTGAKDGKLQTCPKCQGRGQVGVSQGFITFAQTCPDCQGIGEKASEKCSDCKGLGYNETKDSVELNIPEGVDTGMKLRVNAKGNILKNGTRGDMYVKIIAAEDDTFIRDDDDIYIEFPVFFTQAILGESIKVPTIRGEATLNLPKGAKDGQRFVLEKEGVKDVHSSRIGNQIVQISIKFPTFLNDEQKELLEKLSEVLVSKMVCIKTKKDFLKKSLIGLSLNFPKAF

SEQ ID NO: 61487 - protein, 515 aa, Chlamydophila pneumoniae CWL029
MTKTEEKPFGKLRSFLWPIHTHELKKVLPMFLMFFCITFNYTVLRDTKDTLIVGAPGSGAEAIPFIKFWLVVPCAIIFMLIYAKLSNILSKQALFYAVGTPFLIFFALFPTVIYPLRDVLHPTEFADRLQAILPPGLLGLVAILRNWTFAAFYVLAELWGSVMLSLMFWGFANEITKIHEAKRFYALFGIGANISLLASGRAIVWASKLRASVSEGVDPWGISLRLLMAMTIVSGLVLMASYWWINKNVLTDPRFYNPEEMQKGKKGAKPKMNMKDSFLYLARSPYILLLALLVIAYGICINLIEVTWKSQLKLQYPNMNDYSEFMGNFSFWTGVVSVLIMLFVGGNVIRKFGWLTGALVTPVMVLLTGIVFFALVIFRNQASGLVAMFGTTPLMLAVVVGAIQNILSKSTKYALFDSTKEMAYIPLDQEQKVKGKAAIDVVAARFGKSGGALIQQGLLVICGSIGAMTPYLAVILLFIIAIWLVSATKLNKLFLAQSALKEQEVAQEDSAPASS

SEQ ID NO: 61488 - protein, 332 aa, Brucella suis 1330
MKTGRTDRPRILIVSTGGTIASRYDPQTDSLLSVSTGNELLSSLGALAPAVDVVLDEFCNLGSNRIDLDTSFRLAHHIDERLRDRTVDGCVVTHGTDTLEESAFLAQLTISSRKPVVFTGAQRSADEPDADGPRNLADAISVAASPEARDLGTLVVFAGKVLSSIDATKIHTSKLEAYDAPGYGPLGVVDHGAVFITRKPLGYPMIAAHSIETRVDLITLAMGADGRLIEAAINSGTHGFILETFGRGNATPAVVDAVARATERGIVTIITSRCPDGRVLPVYGDGGGSDLEKAGAIFAGRLNGPKARILLCLSLPTIPVEELGRLFEQFGR

SEQ ID NO: 61489 - protein, 307 aa, Solanum virginianum
MGSKHSKETTSTSHRVPFVDLQEATNNFDDNFLIGEGGFGKVYRGVWRDGTKVALKRYNPKSGQGIAQFRTEIKMLSQLRHPYLVSLIGYCDENNEMTLIYEYMENGNLRKHLYGSDLPTLSWEQRLEICIGAAKGLHYLHTTAVIHCDVKCTNILLAENFVAKVADFGLSKKGTVLDETHTTTMMKGTFGYLDPEYYRTLRLTEKSDVYSFGVVLLDVLCARPAVASSSSKGIINLAEWAMKWKKKGQLERIIDPNLVGKIIPDSLRKFGETAEKCLAESGVDRTSMNTVLWNLEYALHLQEPVIQ

SEQ ID NO: 61490 - protein, 96 aa, Phytolacca americana
ATYKVTLVTPSGTQTIDCPDDTYVLDAAEEAGLDLPYSCRAGSCSSCTGKVTAGTVDQEDQSFLDDDQIEAGFVLTCVAFPKGDVTIETHKEEDIA

SEQ ID NO: 61491 - protein, 199 aa, Solanum tuberosum
IQQNAQGLARYAIICQENGLVPIVEPEILTDGNHDIKKCAAATETVLAAVYKARNDQHVLLEGTLLKPNMVTPGSDSPKVAAEVIAEYTVTALRRTVPPAVPGIVFLSGGQSEEEATVNLNAMNKLEVLKPWTLSFSFGRALQQSTLKTWCGKKENVGTAQEAFLTRCKANSDATLGKYTGGSGSGAASESLFVKGYKY

SEQ ID NO: 61492 - protein, 112 aa, Triticum aestivum
MATATRLLPTLLRTLTGTRHAGAARGLATEKAVGAAAVVGSHTAKWMQDTSKKSPMELINEVPPIKVEGRIAACEGDKNPALGHPIEYICLDLDAPAVCKYCGLRYVQDHHH

SEQ ID NO: 61493 - protein, 298 aa, Arabidopsis thaliana
MVSERRVHPDCINASNPYHECVEYCFKKIAEAKARFEKQNTGLAKVHEQTREPLDDKRIEEDSSEEEEEEEDNQEPQVDVTQLTGRQKKLFELRLKMNEARKSNQTDVGSEKKKMEAPTETKGISKQKWLEGRKKKIGKLLDANGLDMTQAYMLDTQEAAESKYKKWEKEPTPAGWDVFNQKTLYNAYKKRTKNIQVDLEEYNRMRAADPEFYREASSLQYGKAPKTSQDKIDKMAKELLDREQKRQEFSRRRKFREEKDIDSINDRNEHFNKKIERAFGKYTLEIKNNLERGTALPD

SEQ ID NO: 61494 - protein, 233 aa, Triticum aestivum
MAPSQEVTAATKEPSTNGNGTNGTNGTAAAAPKTKTPALNERILSSITRRSVAAHPWHDLEIGPDAPTIFNCVIEIPKGSKIKYELDKKTGLIKVDRVLYSSVVYPHNYGFIPRTLCDDSDPIDVLVIMQEPVVPGCFLRAKAIGLMPMIDQGEADDKIIAVCADDPEYRHFNDIKELPPHRLAEIRRFFEDYKKNENKEVAVNDFLPSEDAYEAIQHSMDLYATYIVEGLRR

SEQ ID NO: 61495 - protein, 130 aa, Glycine max
MSVKVNCVGGDTHNVFVYGSLLADEVVHTLLKRVPPTAPAILHDYHRFKIKGRVYPAILPVQNNKVYGRVLLGISGVELDILDEFEDVEYTRTDVEVSLKEWKQVHMNDFVKMTDGFRQELELPGSKPRV

SEQ ID NO: 61496 - protein, 245 aa, Triticum aestivum
  misc_feature (157)..(157): Xaa can be any naturally occurring amino acid
  misc_feature (210)..(210): Xaa can be any naturally occurring amino acid
  misc_feature (215)..(215): Xaa can be any naturally occurring amino acid
  misc_feature (223)..(223): Xaa can be any naturally occurring amino acid
MADKIQDSHTTPVGPAYRTHQQKPSATVSVDVNLDNVHVLPQTPQLIALLSMIRSKETERADFIFYSNRIIRLLVEEGLNHLPVIEHTVTTPIGRTYNGLMFQGKICGVSIMRAGEAMEQGLRDCCRSVRIGKILIQRDEETAQPKLFYDKLPEDIXADRWVLLLDPMFATGGSETMAVQVPRGRGVPEEHILFLNLIASPEGVKNFSAXFPRLXVVTAFIDXGLDEKNYIVPGLGDFGDRFYTI

SEQ ID NO: 61497 - protein, 248 aa, Picea sitchensis
MGRKFVVGGNWKMNGDKNQINEIVNNLKKGPLDPNVEVVIGVPAIYLAYVKSILPDTISASAQNCWKSAKGAFTGEISPAMIKDVGCEWVILGHSERRAIFGEKDDLVAEKVAHALESGLKVIACIGETLEEREAGKTEEVVFRQTKALIPAIGSNWDKVVLAYEPVWAIGTGKTASPQQAQEVHAALRNWLATNVSAEVAAAVRIQYGGSVTSANAKELAAAADIDGFLVGGASLKPEFVDIVNAKQ

SEQ ID NO: 61498 - protein, 132 aa, Brassica napus
MTTSFRSPAGAATVFSSDQKILNALRSSRSVFLGRNVRGGVHSLPPSSSSSSSIQAVSTPEAAAKATTKRSKVEIIKEKSNFIRYPLNEELLTEAPNVNESAVQLIKFHGSYQQYNREERGGRSYSFMLRTK

SEQ ID NO: 61499 - protein, 435 aa, Oryza sativa Japonica Group
MERDTSSSDVSASHVGRARQRRRPTEATADGNRTNGPALLVNDQNKYKSMLIRTYSTVWMIGGFVLIVYMGHLYIWAMVVVIQIFMAKELFNLLRKSSEEKQLPGFRLLNWHFFFTAMLFTYGRFLSRQLVNTVTSDHLLYKVVSGLIKYQMFICYFLYIAGFVWFILTLKKKTYKYQFKQYAWTHMILLTVFAQSSFTVANIFEGMFWFLLPASLIVINDIAAYLFGFFLGRTPLIKLSPKKTWEGFIGASVTTIISAFVLANVMGRFQWLTCPRKVRYHFLWNVIDLSTGWLRCDPGPMFKPEHYSLGEWVPKGFPWKEVVLLPVQWHALALGLFASIIAPFGGFFASGFKRAFKIKDFGDSIPGHGGITDRMDCQMVMAVFAYIYHQSFISPQNYSVELILEQILRNLTFEEQKFLYQQLGEIYRERQLMQS

SEQ ID NO: 61500 - protein, 424 aa, Mesorhizobium loti MAFF303099
MNKHQTDNANAAAFPVDTIRTMFPALQRAGDFIFMDNAAGAQIPQSVLDAVTNHLVSHNVQRGGRYGRSVTVDQSVADARTSVALLINAYSPAEICFGMNATSFIRLVSLGIGQMLSERDEIVITDMDHDANIATWLALETAGAKFKWWRMREDGNLHVDDLRPLVSDRTRLVACTVTAHSIGSIVDVASVAEIAHAAGAEVFLDCVHYGPHGLIDVQAWDCDYLVCSGYKNFSPHMGFLWGRFDTLKRLPTFREDFIPDEPPYKVEAGTFIYENVSGMDAAVQYLELIGRNLAPSNNRSRRENIVAGMGAIRDYELLLAREMLAVLKGCGATIYGVADEARLNERVPTFCFNIGRLSPQRIVEEMADMQIGIRDGHMYAPRLMKRLNLSMDSGAIRASLVHYNTVEEVHKFGEALRAIIARLS

SEQ ID NO: 61501 - protein, 501 aa, Shigella flexneri 2a str. 301
METKDLIVIGGGINGAGIAADAAGRGLSVLMLEAQDLACATSSASSKLIHGGLRYLEHYEFRLVSEALAEREVLLKMAPHIAFPMRFRLPHRPHLRPAWMIRIGLFMYDHLGKRTSLPGSTGLRFGANSVLKPEIKRGFEYSDCWVDDARLVLANAQMVVRKGGEVLTRTRATSARRENGLWIVEAEDIDTGKKYSWQARGLVNATGPWVKQFFDEGMHLPSPYGIRLIKGSHIVVPRVHTQKQAYILQNEDKRIVFVIPWMDEFSIIGTTDVEYKGDPKAVKIEESEINYLLKVYNAHFKKQLSRDDIVWTYSGVRPLCDDESDSPQAITRDYTLDIHDENGKAPLLSVFGGKLTTYRKLAEHALEKLTPYYQGIGPAWTKESVLPGGAIEGDRDDYAARLRRRYPFLTESLARHYTRTYGSNSELLLGNAGTVSDLGEDFGHEFYEAELKYLVDHEWVRRTDDALWRRTKQGMWLNADQQSRVSQWLVEYTQQKLSLAS

SEQ ID NO: 61502 - protein, 440 aa, Azoarcus sp. BH72
MKVTVVGTGYVGLVSGACLADVGNDVLCLDVDPDKIRILEEGGIPIHEPGLLDVVRRNVAAGRLSFTTDVERAARHGVIQFIAVGTPPDEDGSADLQYVLAAARNIGRHMDGYRVIVDKSTVPVGTGDKVRAAVAEELVVRGSTLAYSVVSNPEFLKEGAAVEDFMRPDRIIVGADDERAVELMRQLYGPFQRNHEKLLVMDVRSAELTKYAANAMLATRISFMNELANLAETLGADIELVRQGIGSDPRIGWHFLYAGCGYGGSCFPKDVKALVRTGAEHGHDLLLLNAVEAVNDAQKLRLVDKVVSRFGENLAGRRFAVWGLAFKPNTDDMREAPSRVVLGELLGRGASVCVYDPVAMDEARRIFGVDARLSYAERPMDALEAADALVIVTEWKEFRSPDFERIRALLKQPVIFDGRNMYDPAVLRSEGIEYFGMGRR

SEQ ID NO: 61503 - protein, 296 aa, Azoarcus sp. BH72
MEFKTLEDYVGKTPLVRMKRITAGHNNVILAKLEGNNPAGSVKDRPALSMVVRAEARGDIKPGDTLIEATSGNTGIALAMAAAMRGYRMILVMPENQSVERRQTMRAFGAELVLTPKEGGMEMARDVAEKMRDEGKGIILDQFANPDNPLAHYEGTGPELWEQTAGRITHFVSSMGTTGTIMGTSRFLKEMNPAIRIVGCQPEEGSQIPGIRKWPEAYLPAIYHRESVDSLEYVSQADAEEMTRRLAREEGLFAGISSGGAMHVALRIAAQVENAVIVSVICDRGDRYLSTGVFPA

SEQ ID NO: 61504 - protein, 472 aa, Blastopirellula marina DSM 3645
MATEVKLPELGDGIDSGDILSVYVSEGDVVTKNQNILELETDKATVEIPTNVAGKVTKVHVKTGDAVPIGGALISVEASEGAAKEESKPAPAPKKEAEAPKAEAKKAEPAPKAEAPKAEPPKPAPAAAKPAPTPEPAVTYAAPVARAATSSADLIYQEEDDVPAGPAIRRFAREVGVDLRRVRGTGNNGRVTRDDVLATVRELSQGGAPTLTAVAPAKADKPTTTPAVTPPGEQGEDAYGPVRIEKMAKIRKTIANQMVMSWTTAPRVTNFDDADVTALEALRQQSKDDYASAGVKLTSMSFLVKAVALALRNNPAINALIDMENNQVVYKEYVNVGIAVDSERGLVVPNIRNADRLAIPEIARDVQKLAADVRGGTFSMDQIRGGTFTISNLGAIGGTYSTPIINVPEVAILLVGRSRKLPVVVNDQIVPRMMMPLSLSYDHRLVDGATAARFLNEIKSYLEAPSRLLLAP

SEQ ID NO: 61505 - protein, 311 aa, Archaeoglobus fulgidus DSM 4304
MLDMPIDPVYYQLAEYFDSLPKFDQFSSAREYREAINRIYEERNRQLSQHERVERVEDRTIKGRNGDIRVRVYQQKPDSPVLVYYHGGGFVICSIESHDALCRRIARLSNSTVVSVDYRLAPEHKFPAAVYDCYDATKWVAENAEELRIDPSKIFVGGDSAGGNLAAAVSIMARDSGEDFIKHQILIYPVVNFVAPTPSLLEFGEGLWILDQKIMSWFSEQYFSREEDKFNPLASVIFADLENLPPALIITAEYDPLRDEGEVFGQMLRRAGVEASIVRYRGVLHGFINYYPVLKAARDAINQIAALLVFD

SEQ ID NO: 61506 - protein, 329 aa, Brucella suis 1330
MSLISIGPLGGTIAMVEGGSGGGVVPTLTADALIAAVPQIRNYAQIKAQSLFQLPSPSLKFRHGLEVIGWAENEVKSGADGIVLTQGTDTLEEMAFLLDLLWEHPQPLVLTGAMRSPRAPGADGPANLVAAVLTAASRLSRERGVLVAMNDTIHAARWITKSHALSVQTFVSSDSGPLGYVYEETPVYINTLSRLPKIDRTQFNADVKIGFYESLLDGDAQMLRSMFESGRYDGIVVACFGAGHVSGDEADIIERYASRIPVVVASRTYGGRTATKTYGFHGSEIDLQTKGAMLAGWLSPRKARLLLWALLAAGKNLEETRANFLLYNP

SEQ ID NO: 61507 - protein, 448 aa, Blastopirellula marina DSM 3645
MEVTLIEQEPKLGGTCLLRGCIPSKALLHVAKVIDETYDLHDEWGVSFGSPQIDLDKLRARKNKVIDAMSGGLKQLAKRRNVTVIQARGTFLDSGTLELTGDSPSIPEGGKLTFDHCVIATGSVAAVPPAFQVDSDRVMDSTGALELKEVPETMLVIGGGYIGLEMGSVYAQLGTQVSVVELTDGLLPGADRNLVKPLQKRIESLFEGRLHLNTKVGSIGIRGDKVEVAFEGPAKFGTEQYDRVLVSIGRWPNTKGIGLENTKVVVNKRGFIEVDGQLKTGDPKLLAIGDVTGDPMLAHKATHEGRTAIEALLGHPVEFKPAAIPAVIFTDPEIAWAGLMEEAAKKEGREVEVVMYPWAASGRAQSLGRSDGMTKWIVDPTTKIVLGCGIVGPGAGELIGEAVLAIEMRAEVGDIASAIHPHPTLSETVMNAAEVFFGTATEIYKPKR

SEQ ID NO: 61508 - protein, 159 aa, Archaeoglobus fulgidus DSM 4304
MKHTIAVLVENKPGVLARVAGLFRRRGFNIESLTVGTTERDDLSRMTIVVEGDDKVVEQVIKQLNKLIETIKVSEITESSVERELCLIRVHAPPEKRGEIVELTNIFRARIVDVSRDSFIIEVTGDEDKVSAFIDLMRQYGIKELARTGKVAMVRGNKK

SEQ ID NO: 61509 - protein, 436 aa, Alkaliphilus metalliredigens QYMF
MTGNLLKKYQVALNELDLVKYTGRVSQVIGLTIEAIGPAVKIGEVCKIFPLKGANPILAEAVGFREKKVLLMPLGEMEGIGPGSKVEATGSTLSINVGEALLGRILDGLGNPIDGKGPIEAHTAYPAMGSPVNPLLRKTIKEPLSLGVKAIDGLLSCGNGQRIGIFAGSGVGKSTLLGMIARNTRADINVIALIGERGREVKEFIEKDLKEEGLKRSVVIVATSDQPALIRMKGALLATSVAEYFRDHNKNVMLLMDSLTRFSMAQREVGLAIGEPPVTKGYTPSVFAILPKLLERSGTSDKGAITGLYTVLVDGDDMNEPIADAVRGILDGHIVLSRKIANRNHYPAIDVLASVSRVMDSIVGKEHIKLANELKEILSTYNDAEDLINIGAYVKGSNPKIDRAIEKIDAVNEFLIQTTDEKITFQESVDIMKKIL

SEQ ID NO: 61510 - protein, 469 aa, Zea mays
MAARAADENRRPGVGRPAPCVRDMGSRRALTDIKNLVGVAPNPCAVAKKPVLQYSPAPRSFLCHGSWVQEEQKGRKEDSVAKQPADDKVRTRASCSCALAFLGGFDLIWVLLWLLRKFVASLASKGQPECQPTGADPEPGVDQRKEPIGDGIIDIDVELDEPVDDSDCDVDMGDETENKDIMNQDESLMDIDSADSGNPLAATEYVEELYKFYRENEAKSCVRPDYMSSQQDINSKMRAILIDWLIEVHYKFELMDETLFLMVNIIDRFLEKEVVPRKKLQLVGVTAMLLACKYEEVSVPVVEDLVLISDRAYTKGQILEMEKLILNTLQFNMSVPTPYVFMKRFLKAADADKQLELASFFMLELCLVEYQMLNYRPSHLAAAAVYTAQCAINRCQHWTKVCESHSRYTSDQLLECSRMMVDFHQKAGTSKLTGVHRKYSTYKFGCVAKILPAQFLLESGGTPPPSGAN

SEQ ID NO: 61511 - protein, 479 aa, Chlamydophila pneumoniae CWL029
MQTNIGLIGLAVMGKNLVLNMIDHGFSVSVYNRTPEKTRDFLKEYPNHRELVGFESLEDFVNSLERPRKIMLMIQAGKPVDQSIHALLPFLEPGDVIIDGGNSYFKDSERRCKELQEKGILFLGVGISGGEEGARHGPSIMPGGNPEAWPLVAPIFQSIAAKVQGRPCCSWVGTGGAGHYVKAVHNGIEYGDIQLICEAYGILRDFLKLSATAVATILKEWNTLELESYLIRIASEVLALKDPEGIPVIDTILDVVGQKGTGKWTAIDALNSGVPLSLIIGAVLARFLSSWKEIREQAARNYPGTPLIFEMPHDPSVFIQDVFHALYASKIISYAQGFMLLGEASKEYNWGLDLGEIALMWRGGCIIQSAFLDVIHKGFAANPENTSLIFQEYFRGALRHAEMGWRRTVVTAIGAGLPIPCLAAAITFYDGYRTASSSMSLAQGLRDYFGAHTYERNDRPRGEFYHTDWVHTKTTERVK

SEQ ID NO: 61512 - protein, 479 aa, Coccidioides immitis RS
MASRRLASSLNGALRSRAALQAVRPAKRGFATPVSTAATTQSTTLSNGLTIATEYSPWAQTSTVGVWIDAGSRAETDKTNGTAHFLEHLAFKGTNRRTQHQLELEIENMGGHLNAYTSRENTVYYAKSFNADVPKAVDILSDILQNSKLEPAAIERERDVILREQEEVDKQLEEVVFDHLHATAFQNQPLGRTILGPKENIQSIQRQDLVDYIKTNYTADRMVLVGAGGIPHEQLVKLAEQHFGSIPSQPPTSAASAIAAEQKRLPDFIGSDVRIRDDTVPTAHIALAVEGVSWKDDDYFPALVTQAIVGNWDRAMGNSPYLGSKLSTFISHNNLANSFMSFSTSYSDTGLWGIYLVSENKTALDDLVHFTLREWSRLSFSVTPAEVERAKAQLKASILLSLDGTTAIAEDIGRQIVTTGRRMSPQDIERAIDKVTEKDVMDFAQRKLWDQDVAVSAYGSVEGMLDYQRIRNDMSRNAA

SEQ ID NO: 61513 - protein, 670 aa, Zea mays
MGKSSKKSSVKAAPAAVSVPEGKSAKKGKRNAEDEIEKAVSAKKQKTVPEKAVPVKKQPPPKKVESSSSEEDSSDSEVEVKVQPKKVIQPKKGTQPAKQESSDDSSSESSSDDEPSKKPVAGSKKPPASSSSSDDSSDSDDSSSDEEPAKKPTKPTVLSKKPVTAVSNGSKQVKPDSSSSDSSSDEDEKPAASLKKPPPVPSVQKKTQESDSSDSDSDEDESDDIPAKAQVVAKKKEESGSSSDSDSESESDDEDSNAKTVQPAKAAAIKKKEDSSESSETDSQSDSEDSEPEKPTVRAKRPLATNKKNEQSSEKSDDSSDESSDESDEEPPQKKTKNSAPSGAAKAATNVSKKKSSSDEDDESSEESSDDEDTEQVETKETSVVTTQKPAHNEPKTPAKSQSQATGSKTIFVGNLAYSIEREQVKEFFEEAGEVVDVRLATFDDGSFKGFGHVEFATVEAAQKALEFVGHDLMGRPLRIDMATERGAYTPSSGKDNGSFKKFAPRSGNTVFIKGFDTSGGEDRIRTALEEHFGSCGDITRISIPKDYDTGVSKGMAYMDFKDPDSLNKAYELNGTDLGGYSLYVDEAKPRPDNSGGFSGDTSGGRGGRSGGFSGGRGGRSDRGRGGTRGRGFGGRGGRGDRGRGGRGTPFRQTAGTASTGKKTTFGDDD

SEQ ID NO: 61514 - protein, 531 aa, Zea mays
MQDWRVREFEGKFTDEFAHSSSNEHKGGVEASGVISSKKLKHAVANEKIQGVIPGTNSSGSLKCNSENIQHANGVLSQNISCAGDCKNGSIAFPLREENTITETRCPADNWNSCQFALSNGSSILNNHSAPQDSLTYGDNDLNYIEWPGIDNFEDVDTLFRSSDSTYGQQQLENADGLSWIPSSDAVYSTDVALQQGFDSPYSDYGILDDLSAFQCAEDKSLPLVDDPSSALCDNQFNDTYLFPEQKNVNAYGEQIYQEDLMELLPTDQICSGHENIDMVGNQYPSENAIQGTEDKKFSIASTSQLSSQNLLNQRHHLDSSSPSNITSESYPGKFGPSSCSSAQRNSKVQKKTVNIQPRQPANDNVMNTSRASYPCENYETERRGLGKRTLGDPQVTMGSSMVVDGSFVSSMSSDNSVEESSFQQLQDAVSQLDVQTKLCIRDGLYRLARSAQHRQVFPNTMNSSGGSEDGKELENAETSCKFMDPRSIETQTNPIDRSIALLLFRESSGGHVPVAVAADDASSLKSPPGI

SEQ ID NO: 61515 - protein, 168 aa, Coxiella burnetii RSA 493
MQEAGIGTTTDGIQEKLVAVRRTAKVVKGGRVFGFSALVVAGDGDGKVGFGLGKAREVPSAIQKATENARRNMISVPLYGATLHHAIKATHASSTVLMLPASEGTGVIAGNAMRAIFEVMGVQNVLAKCIGSSNPINVVRATFKGLKQMETPESVAAKRGKAIEEIVE

SEQ ID NO: 61516 - protein, 797 aa, Glycine max
VDHYLQNIAWGGRHAVLVTKQGEVFSWGEESGGRLGHGVDSDVLHPKLIEALSNTNIELVACGEYHSCAVTLSGDLYTWGNGTYNYGLLGHGNQVSHWVPKRVNGPLEGIHVSYISCGPWHTAVVTSAGQLFTFGDGTFGALGHGDRKSVSLPREVESLKGLRTVRAACGVWHTAAVVEVMVGNSSSSNCSSVDLFTWGDGDKGRLGHVDKEAKLVPTCVVTLAEHNVCQVACGHSLTVALTTSGRVYTMGSPVYGQLGNPQADGKLPILVEGKLSESFVEEIACGAYHVAVLTSRTEVYTWGKGANGRLGHGDTDDRNTPTLVEALKDKDVKSIACGTTFTAAICLHKWVSGVDQSMCSGCRMPFNFKRKRHNCYNCGLVFCHSCSSKKSLKASMAPNPNKPYRVCDNCFNKIRKTTETDSSSQSSMSRRGSVNQGSLEFNGKDDKLDSRSHNQLARFSSMESLKQVDSRSSKKNKKLEFNSSRVSPAPNGGSQWGAMNISKSFNPGFGSSKKFFSASVPGSRIVSRATSPISRRPSPPRSTTPTPTLGGLSSPKMVVDDAKRINDNLSQEVVKLRSQVENLTRKAQLQEVELERTTKQLKEAIAIASEETAKCKAAKEVIKSLTAQLKDMAERLPVGASRNVRSPPSLASFGLNPGSNDLTNASFDRLNIQATSPESDSTGSTNQILSNGSSTITNRSAGHIKHSQSDAISRNGNKTKDNETEWVEQDEPGVYITLTSLPGGVIDLKRVRFSRKRFSEKQAEQWWAENRARVYEQYNVRMIDKSTIGVGSEDMAH

SEQ ID NO: 61517 - protein, 448 aa, Burkholderia sp. 383
MADVVPALVDEVRAFRQAHPEIRYVDLICLDLPGHFYGKRYPIDALEKVAAGSLLKLPQNCILLGTQGGLYKIGDYCFNDGDPDAVRRLIPGTLKPVTWEKQPLGQMLITTDGTDAPVEFEPREVLARVLKRLARRGIRPVVAFELEFYLFAAQLEDGMPKYPRDRLSDDRDDQPNMHIERLSRFSDVLHEMVDVACVQGIDATVITAELGPGQFEINFGHCDDGLRAADWSAMFCRSTRGVALQHGYRASFMGKPYLHAPGSGMHVHVSLYDDAGRNLLAADGQRPLRHAVAGCLALLPHCMPVFAPNHNAFRRYGSMVNAASRASWGFEDRDACIRIPESDARNLRIEHRLASADANPYLVLAAILSGMEHGLDAKLEPIAPLNEDRGSGIDFPKEMLSAVAEMQDHAAVREGLGSEFVMVYCENKRQEELDFRNEIGAREYRWFL

SEQ ID NO: 61518 - protein, 560 aa, Glycine max
QTLQRGRRNLWHLTASRVSVLLSSAAVCTASIHQFLKNYEDLGVFILTGEAFCGIEAVEFRQKLKVVCENYFIAFHRQNVHALKMVLEKETWLKLPPETVHMISFAGLIGDGAPLISLSSGKSTNVSAVHSIKSVNMVHTGARKNGFSHWIKSGNPFQQKLPTSNEGRGYSQPNGSVCGEFDGSSTNNFHDDKTPRKNDINQMNGANSVSEDENEDLLADFIDEDSQLPSRSSKPHHSRALSSHVNDEENTTQTGSSLCLLKSMDKYARLMQKLEVVNVEFFKGVCQLFGFFFYFIYETFGQQNASSTGKGTSSSLNYRLRTALSRVNQDCEEWIKSQSSSPTSLSSPFVHAELTPTHPPNTNYGHSSGTSLGLKVDAVPDLTEHVHRTTVRLLLHINGYVERVANCKWEVKELGMEHNGYVDLMLGEFKHYKTRLAHGGIRKEVQDLLLDYGLEIVAETLVEGLSRVKRCSDEGRALMSLDLQVLINGLHHFVSLNVKPKLQMVETFIKAYYLPETEYVHWARAHPEYSKSQVVGLVNLVATMKGWKRKTRLDILEKIE

SEQ ID NO: 61519 - protein, 538 aa, Oryza sativa Japonica Group
MATVSPARREPTPQAVRASPMPSAAAALVRRGGGGSGGTVLGKYELGRVLGQGSFAKVYQARHLETDECVAIKVLDKEKAVKGGMVHLVKREINVLRRVRHPNIVQLFEVMASKTKIYFVMEYVRGGELFSRVSKGRLREDTARRYFQQLVSAVDFCHARGVFHRDLKPENLLVDENGDLKVSDFGLAAGPDQFDPDGLLHTFCGTPAYVAPEVLRRRGYDGAKADIWSCGVILFALMAGYLPFHDHNIMVLYRKIYNGEFRCPRWFSKDFTRLITRLLDANPKTRITVPEIIESDWFKKGYKPVKFYIEDDKLYNLSDDVLNLEPADPVPPPLGLAPPVPPPPQGDDPDGSGSESDSSVVSCPATLSTGESQRVRGSLPRPASLNAFDIISFSKGFNLSGLFEERGNEIRFVSGEPMSDIVKKLEEIAKVKSFTVRRKDWRVSIEGTREGVKGPLTIGAEIFELTPSLVVVEVKRKAGDNEEYEDFCNMELKPGMQHLVHQMLPAPNGTPVSEKVERSSSLQAPLTLKLIGTEGSMS

SEQ ID NO: 61520 - protein, 810 aa, Thermoproteus tenax
MGLILWLEEITKKDHALVGGKGANLGEVSRLVRVPPGFVVTTEAFRAFLETTGLKSKISEVLKSVRGGSPEDYEKASETIREMIYREPMPREIADEIVRAYLKLSEKVGVKDVSVAVRSSATAEDIQEASFAGQQDTYLNVRGSENVIEHVKRVWASLYTARAIYYREQMGISHDNVSIAVVVQKLVNARSAGVMFTLDPTNGDTSKVVIEAAWGLGEGVVRGIVTPDEYVVDKNTLKIVERRISQKRLAVVRDERGLTKEVELPPEKSGAPALTDEEVIEYAKMALELERHYGHPLDIEFSVDSDVPFPQNLYVVQVRPETVWSRRAQPAEAKEAKAEGRVVVKGIAASPGVAVGRAKICLTLEDAKRKLQKGDILVTKMTDPDWVPYMRLASAIVTDEGGRTSHAAIVSRELGIPAVVGTGNATQVLRDGELYTVDGSKGVVLEGAAVQPQAKVAEAAQAAIAVPKEIILHIYRSIPTGTKVYMNLGEPDKIDEYKDLPFEGIGLMRIEFVITSWIGEHPLYLMSIGREDKFVDKMAEGVARVASAIYPRPVVVRFSDFKTNEYRSLQGGEKFEPEERNPMLGWRGVSRYVSLQYEKAFRLELRAIKKVREEMGLTNVWVMAPFVRTTWEAERFNRLLEEEGLVRDRDFKVWAMAEVPSVAFLVEEFAPYFDGFSIGSNDLTQLTLGVDRDNDFLVRINPKYFDEREMPVLKAIYELIQRAHRVGKTVSICGQGPSVYPQLVEFLVRAGIDSISVNPDAVLNTRILVASVEMKLLRERLDAIYRALYKVGDDEEFREIIKKVFGGLKY

SEQ ID NO: 61521 - protein, 915 aa, Thermoproteus tenax
MPKKYVFDFDEADYRNKRLFGGKGASLVQMAQLGLRVPPGFIITTEACKDFFGPKREEIAELEAQLARQPPPDVRDALITKLFSIIDSLDLPQGLWEEVVEHMKRLEDRTGRRFGDPKNPLLVSVRSGAAVSMPGMMDTVLNLGLNDETVKGLAEQTNNEWFAYDAYRRFINMFGRIVLNIDDKLFSKAWDDIKRKYGVKEDPQMPIEGLKEAVEIFKKIVAESRGAFPQDPWEQLKLAIKAVFRSWDSPRAIFYRIAEKITSDIADCTAVNVVTMVFGNMGWDSGTGVVFSRDVATGENRLYGEFLPVAQGEDVVAGIRTPMDIDEFKKRFPHLYEELYNGVKLLEKVNKDVQDVEFTVERGRLYFLQCRNAKMTPMARVKTAVDMAKEGIITKDEALMKVSPEHVLQLLYPRIDPKANARPIAKGLPASPGAVSGQLVFNPDDAVKWARDGKKVVLARVETKPDDVHGFYAAVGILTTRGGMTSHAAVVARAIGKPAVVGAEDAVVDEQNKVLRAGGLILKEGDWVTIDGNTGLVYPGVVPTLEPELIPELEELLRWADEVRRLGVRANADLPEDAAIARKFGAEGIGLLRIERMFRKPERLDLLRRIILAENREERIKHLEQLYRMLKEDFKAIFEIMDGLPVVVRLIDPPLHEFLPKPEEVLQQICEGRMSGKDVSSLERLYNRLKALQEANPMLGHRGVRVGVSYPEVYYYLTKAIAEAASELKKEGRNPVVEIMIPQVSDVREIKYVKEKGIMPALRDVEESSGVKLDIKIGTMIETVRAALTVEKIAREVDFISFGTNDLTQAVFSFSRDDAENKFIPQYLDLKILDADPFETLDPEGVAKLVEQASRSAKEANPAIEVGVCGEHGGEPKSISLFSRMKIDYVSASPFRVPLARLAAAQAAIASSKRE

SEQ ID NO: 61522 - protein, 76 aa, Arabidopsis thaliana
MSAKDLVDSVFTLGGWSNFLCSEKKLQQPVDVALVFIGRELLSSDVSSNQNSDPVLVNTLKSLNSEDPYVLQVATH

SEQ ID NO: 61523 - protein, 461 aa, Rhizobium leguminosarum bv. viciae 3841
MNVMQPIPAETANAADPQAEISARLERLPITREVFWARNIVGAATFFDGYTVIAIAYAMPVLVREWGLTPSQTGMILSMGYLGQLIGAILFGWLAEKVGRLKVLLFTILLFVSMDVACLFAAGAGMMMAFRFVQGIGTGGEVPVASAYINELIGSKGRGKFFLLYEVMFLLGLVGAGLIGYFMVPVYGWKAMFVVGLVPAIIMVPLRWFLKESPRWLAANGRYGEANAIVTRMEESARAAGKELPEPKLIQAPVHRKSDWRELFQGVYLKRTLSIWAMWFTAYTVANGTITWLPTLYRQVFNLPLQTSIFYGFLTSVGGVIAAVICALLIDKVGRKRWYTGALLLAPVPLLALAWLGATSPIQVLVLAGLAYAIVQTVTFSLYLYSAEIYPTRLRALGTGTGSAWLRLGSSAGPILVGTVMSSMGIQYVFASFAAILIVGAIITMLFAIETKDRVLEELSP

SEQ ID NO: 61524 - protein, 174 aa, Pseudomonas syringae pv. phaseolicola 1448A
MKYRLGESRVQTDPQSWVAPNAVLIGNVRLEAGASVWFNVVLRGDNELIHIGENSNVQDGTVMHTDMGSPLSIGKSVTIGHNAMLHGCSVDDYSLIGINAVILNGAKIGKYCIIGANSLIGENKVIPDGSLVMGSPGKVVRELTDVQKKMLEASAAHYVHNAQRYARDLVVQEE

SEQ ID NO: 61525 - protein, 282 aa, Triticum aestivum
MADGGEMDEEAMMRAFFPTSFGKAPTRPSAASHSSTLRKPQNPSSNPSTSAAAEEDDVGGAVVGPPRPPKELAPIQEDDEEGGGLIGPPRPPQRPSAHAAVEDEDGSMVGPPRPPPSKEGDEDDEDEGDDHDEDDDDDDMDDDGDDFGRIPLSNEIVLRGHTKVVSALAVDPTGSRVLSGSYDYTIRMYDFQGMNSKLQSFRQLEPCEGHQVRSLSWSPTSDRFLCVTGSAQAKIYDRDGLSLGEFVKGDMYIRDLKNTKGHISGLTGGEWNPRDVMIHLPM

SEQ ID NO: 61526 - protein, 465 aa, Medicago sativa
MASSSLLSSVPSHSASLSILDTNIKGKLKLGTNGLRFNNEGINNFSNLRSSGRICMAVATNVSRFEGIPMAPPDPILGVSEAFKADTSDVKLNLGVGAYRTEELQPYVLNVVKKAENLMLERGENKEYLPIEGLAAFNKATAELLLGADNPAIKQQRVATVQGLSGTGSLRLGAALIERYFPGAKVLISNPTWGNHRNIFNDARVPWSEYRYYDPKTVGLDFEGMIEDIKSAPEGTFVLLHGCAHNPTGIDPTPEQWEKIADVIQQKNHFPFFDVAYQGFASGSLDEDAASVRLFVSRGMEVLVAQSYSKNLGLYAERVGAINVISSSPESATRVKSQLKRLARPMYSNPPVHGARIVANIVGTPALFDEWKAEMEMMAGRIKTVRQALYDSISSKDKSGKDWSFILKQIGMFSFTGLNKSQSDNMTNKWHIYMTKDGRISLAGLSLAKCEYLADAIIDSYHNVS

SEQ ID NO: 61527 - protein, 170 aa, Zea mays
MAAPSSLASSHLSRLAAAAPAPQHHHQNHQLRLGCSRRRAQRLVAMAGSGKFFVGGNWKCNGTKESISKLVSDLNAATLESDVDVVVAPPFIYIDQVKSSLTGRIEVSAQNTWIGKGGAFTGEISAEQLVDIGCQWVILGHSERRHVIGEDDEFIGKKAAYALEPNLKVM

SEQ ID NO: 61528 - protein, 198 aa, Gossypium herbaceum
IAPEVLLKKGYGMECDWWSLGAIMYEMLVGYPPFYSDDPVTTCRKIVHWRNHLKFPEEARLTPEAKDLICKLLCDVDHRLGTQGADQIKAHPWFKDTRWDKLYEMEAAFKPHVEGEFDTQNFMKFDEVDCPRTGSGPLKKTFLAPKDLNFVGYTYKNFEAVKGLRHSFADVKEFGPVRQASTDSFHSDSGVDYSNSDK

SEQ ID NO: 61529 - protein, 653 aa, Desulfitobacterium hafniense DCB-2
MNLLTAESLTKSYGIKPLFQDISLGIEEGQKIGIIGVNGTGKSTLLKILAGLEQPDQGQITTNNELQLEYLPQEPDFDPEATVLQQVFKGNSPLMKLLRDYETALERLNQDPNSESYQNTLLQLGQKMDSHNAWQIESEAKAVLTKLGITQFDIPVGTLSGGQRKRVALAGALIQPSNVLILDEPTNHIDNEMVDWLENYLHKLKGALLMVTHDRYFLDRVANRIFELDRGKLYAYPGNYSRFLELKAERDEQEEATERKRQNILRNELAWIRRGAKARTTKQKARIDRFEQLQADQPEEKTGKVEVSAGAARLGKKVIQCSHLRKSYPGSGTVIDDFSIILAKYDRIGIIGPNGSGKSTLLNILAGRMPADAGEIEWGPTVKLGYFAQEYREFEPQTKVIDVIKAVAEVIPTSDGGVLTASQMLERFLFTPAQQWTPVEKLSGGEKRRLYLLQVLMSSPNVLLLDEPTNDLDIQTLSILEDYLEDFPGVVITVSHDRFFLDRVVDQILAFEGQGRIHFAIGNYTDYREQLARRIAEEQSSREALSKTQKLNGQNSRLGEAEAAGHQAKPKERPVKMSYKEQREYEQIEDRIAGLEGQLEQVDQDMAEEGSNYGKLNELMKAKEDLEKQLEESLERWTYLSELAEEIAGRKAP

SEQ ID NO: 61530 - protein, 456 aa, Archaeoglobus fulgidus DSM 4304
MYRVKTFKYYSTYKICMIEEVFELTQNGRAKKWHAFYGGKIEILPKVPIRTLDDFSIWYTPGVAEVCNEIAEDEEKAYDYTNKWNLIAIITDGSRTLGLGNIGPKAAMPVMEGKALLFKFLGAVDAFPIALAEQDADRFIEIVKAISPTFGGVNLEDISSPKCFYILERLQKELDIPVWHDDQQGTATATLAALINALKIVGKDISEVKISIIGVGAANFATIRLLKAAGADPKKMFVVDSKGILHPDRADLKEKKGYKWQVAIETNGERRTGGMEEAIRGTDVLIAASKPGPDVIKKEWIAEMNDDAIVFPLANPTPEIWPWEAKDAGARIVGTGRSDFPNQVNNSLVFPGVFRGALTVRARKITDEMCLAAANALAEFAERNGLSEDYIIPRMTEKEVFPEVATAVGVKAVELGLARLELREEEIYEIAELMISATQRKIKKLYELGFIKEPPS

SEQ ID NO: 61531 - protein, 198 aa, Gossypium barbadense
IAPEVLLKKGYGMECDWWSLGAIMYEMLVGYPPFYSDDPVTTCRKIVHWRNHLKFPEEARLTPEAKDLICKLLCDVDHRLGTQGADQIKAHPWFKGTRWDKLYEMEAAFKPHIEGEFDTQNFMKFDEVDCPRTGSGPLKKTFLAPKDLNFVGYTYKNFEAVKGLRHSFSDVKEFGPVRQASTDSFHSDSGVDYSNSDK

SEQ ID NO: 61532 - protein, 462 aa, Cryptococcus neoformans var. neoformans B-3501A
MHPQNSSTPSTNSPSTFSLPKSSISRKKPPGLDISKSILRPTRTAPVLPANGSSPSNFVSEADRLRDDIANLQLSSRSTGSNHSPEALDSPRAFQSDSSVASGLAKKEKSRDGKERGDKEKRKKKHKDKDGEDLVKDEDLEILHDLGAGNGGTVTKVWNKKRKCVMARKLILVDAKPSIRKQILRELQIMNDCDSPYIVGYYGCFPVDVHVGIVMEFMDAGSLDYIYRHHGAIDIDIVGKVAQAVLEGLIYLYDKHRIIHRDIKPSNVLANTRGEIKICDFGVSGELINSIANTFVGTSTYMSPERIQGAPYTIKSDIWSLGISLIELAVGRFPFSDSPDSEELSPSVSDFDPDPTLPRSVRRPKIESNSRHNGVSQSGGPHAMSILDLLQHIVNEPAPRLASRRRRFPQEAVAFVEGCLIKDPDQRRSPKELLSSSWITSLKTTKEDLQTWARSMVGPREE

SEQ ID NO: 61533 - protein, 128 aa, Halobacterium salinarum
PTVEYLNYETLDDQGWDMDDDDLFEKAADAGLDGEDYGTMEVAEGEYILEAAEAQGYDWPFSCRAGACANCASIVKEGEIDMDMQQILSDEEVEEKDVRLTCIGSPAADEVKIVYNAKHLDYLQNRVI

SEQ ID NO: 61534 - protein, 393 aa, Mycobacterium smegmatis str. MC2 155
MKAVTWHGRRDVRVDNVPDPKIEQPTDAIIEVTSTNICGSDLHLYEVLGAFMNEGDILGHEPMGIVREVGSAVDGLSVGDRVVIPFQISCGHCFMCDQKLYTQCETTQVREQGMGAALFGYSELYGSVPGGQAQYLRVPQAQFTHIKVPDGPPDSRYVYLSDVLPTAWQSVAYAEIPKGGTVTVLGLGPIGDMAARIAHHLGYEVFAVDRIPERLRRAADRGIQAIDLGAIDEPLGDVIRSMTHGRGTDAVIDAVGMEAHGSPVAKIMQTAAAALPDAVAKPMMENAGVDRLDALYSAIDTVRRGGTISLIGVYGGTADPIPMLTLFDKQIQLRMGQANVKRWVDDIMPLLGDDDPLGVDDFATHILPIDEAPHAYEIFQKKQDGAVKIILKP

SEQ ID NO: 61535 - protein, 389 aa, Mycobacterium smegmatis str. MC2 155
MGEMNDRVALRAGVPPFYVMDVWQAAAERQRTHGDLVNLSAGQPSAGAPAPVRDAAAAALGRNQLGYTVALGIPELREQIAQTYHTRHDIDVGVDDVVLTTGSSGGFLLTFLACFDVGDRVAITSPGYPCYRNILSALGCEVVEIPCGPETRFQPTAAMLEALDPPVQGVIVASPANPTGTVIAPEELAAIARWCDASGARLVSDEIYHGLVYEGAPETTCAWETSRNAVVVNSFSKYFAMTGWRLGWLLVPEKLRRAVDCLTGNFTICPPALAQYAALAAFTPESLAEAEGLLTHYAENRHLLLNGLRGLGIDKLAPTDGAFYVYADVSKYTDNSLQFCEKLLNDTGVAIAPGIDFDTVRGNSYVRLSFAGPTHDIEEALRRIGPWLG

SEQ ID NO: 61536 - protein, 231 aa, Glycine max
MAATASASAASLSLRSSPFKLNPPKLNSVTLRFPHLNRRYNSAFRVVAASVSVSNPNVQTGPDDLVASILSKVVQTDGGVLLKEEEHKEVAEVAQELQKYCVSEPVKCPLIFGEWDVAYCSRPTSPGGGYRSAIGRLFFNTKQMVQVVEAPDIVRNKVSLSVLSFLDVEVSLQGKLKALDGEWIQVIFEAPELKVGSWQVQYGGQSEVKLRITYVDEKISGKNNSFWGVPL

SEQ ID NO: 61537 - protein, 98 aa, Bacillus sp. SG-1
EMNRVLKPGGMAVCLETSQPTMFGYRQAYYFYFQFLMPLFGKVFAKSYNEYSWLQESAKDFPGMKELADMFRDAGFEKVTFKPYVGGAAAMHMGFKKN

SEQ ID NO: 61538 - protein, 178 aa, Glycine max
MEKMNKAFEKVKIMVGMDVEDEEQQAAALDNSNSFAFMDDFNRNCTLSTTQRLYGFAICFASGLTCTLLSMLVFFKPIKFAIAFTLGNLLSLGSTAFLIGPKRQVTMMLDPARIYATAIYIASMIIALFCALYVHNKLLTLLAIILEFGALVWYSLSYIPFARAMVSKIMVSCFDTEF

SEQ ID NO: 61539 - protein, 305 aa, Mycobacterium smegmatis str. MC2 155
MTKWTTARIPDQTGRVAIVTGANTGLGLETAKALAAKGAHVVLAVRNLDKGKAAVDWIARSAPTADLELQQLDLGSLASVRAAADDLKGKFDRIDLLVNNAGVMWPPRQTTADGFELQFGTNHLGHFALTGLLLDRMLTVPGSRVVTVSSQGHRILAAIHFDDLQWERRYNRVAAYGQSKLANLLFTYELQRRLTGHQTTALAAHPGASNTELARHLPGALERLVTPLAQDAALGALPTLRAATDPGALGGQYFGPDGIGETRGYPKVVASSAQSHDADLQRRLWAVSEELTGVTFPVGEALQQA

SEQ ID NO: 61540 - protein, 261 aa, Mycobacterium smegmatis str. MC2 155
MARKPLIAGNWKMNLNHFEAIALVQKIAFALPDKYFDKVDVTVIPPFTDLRSVQTLVDGDKLRLTYGAQDLSQHDSGAYTGEISGAFLAKLGCTFVIVGHSERRTYHGETDELVAAKAKAAHKHGLTPIVCIGEQLEVREAGNHVEFNVNSLRGSLAGLTPEQIGQTVIAYEPVWAIGTGRVAGAADAQEVCKAIRGELANLSSSEIAAGVRVLYGGSVNAKNVGEIVSQGDVDGALVGGASLDGEQFATLSAIAAGGPLP

SEQ ID NO: 61541 - protein, 131 aa, Oryza sativa
YDTFKRSMMTWNRYRYSHLNSGSEDDSVSSFQLFLCGFAAGTFSKAACHPLDVVKKRFQIEGLKRHPRYGARIESSTYKGMYHALKEIVAKEGFGGLYKGLFPSLVKSAPAGAVTFVAYEYISDWLESILM

SEQ ID NO: 61542 - protein, 386 aa, Enterobacter sakazakii
MSQTPLTPESKLPALGTTIFTRMSALAQQHQAINLSQGFPDFDGPRYLQERLAHHVAAGANQYAPMTGVQALREAIADKTEALYGHRPDANSDITVTAGATEALYAAITALVRPGDEVICFDPSYDSYAPAVALSGGVLKRIALTPPHFRVDWAQFAALLSERTRLVILNTPHNPSATVWRNADFAALWQAIAEREIYVLSDEVYEHICFAKEGHASVLAHPQLRERAIAVSSFGKTYHMTGWKVGYCVAPAALSAEVRKVHQYLTFSVNTPAQLALADMLRAEPAHYLDLPDFYRARRDRFIQALGDSRFKILPCEGTYFLLADYSAISTLDDVSFCEWLTTEAGVAAIPLSVFCDAPFPHKLIRLCFAKQEATLLAAAERLARL

SEQ ID NO: 61543 - protein, 255 aa, Nostoc punctiforme PCC 73102
MDWKEVRGNWVIIPRNPIGIIHFLGGAFVATAPHITYRWLLEQLASKGYVVIATPFVNTLDHTAIAKSVLLNFDRTLERLHDSGALRKLYFPIYGLGHSMGCKLHLLIGSLFKVERAGNILISFNNYAAKEAIPLVEQFNSTLKIEFTPSPLETNKLVQERYNIRRNLLIKFSNDTIDQSAALTKILQERFDDMVTAQTLPGTHTTPLGQDIKWQTGTSFTPFDALGQWFKQEAYRDLNQLKSSILLWMNPLAPP

SEQ ID NO: 61544 - protein, 468 aa, Arabidopsis thaliana
MVRGLMKFPGISTKLLNISVNSLCKFRNLERAETLLIDGIRLGVLPDVITYNTLIKGYTRFIGIDEAYAVTRRMREAGIEPDVTTYNSLISGAAKNLVLNRVLQLFDEMLHSGLSPDMWSYNTLMSCYFKLGRHGEAFKILHEDIHLAGLVPGIDTYNILLDALCKSGHTDNAIELFKHLKSRVKPELMTYNILINGLCKSRRVGSVDWMMRELKKSGYTPNAVTYTTMLKMYFKTKRIEKGLQLFLKMKKEGYTFDGFANCAVVSALIKTGRAEEAYECMHELVRSGTRSQDIVSYNTLLNLYFKDGNLDAVDDLLEEIEMKGLKPDDYTHTIIVNGLLNIGNTGGAEKHLACIGEMGMQPSVVTCNCLIDGLCKAGHVDRAMRLFASMEVRDEFTYTSVVHNLCKDGRLVCASKLLLSCYNKGMKIPSSARRAVLSGIRETVSYQAARKTHIKIKAAIECNTLMYP

SEQ ID NO: 61545 - protein, 100 aa, Vitis vinifera
MCLISQAEGSEVSAELDFLNQQNLILSMENKALKQRLESLAQEQLIKYLEQEVLEREIGRLRSFHRRSSSRDLDAQFANLSLKHKDNSSGTDAVTGPLRI

SEQ ID NO: 61546 - protein, 476 aa, Enterobacter sakazakii
MDTFIHPTNLCFFTQPLSPGKLSKPPHWRRIPRLAAHPVYPWCSPDRLSHWNLSLFTDCQEVVMKALTYHGPHNVKVENVPDPIIEAQDDIILRVTATAICGSDLHLYRGKIPQVHHGDIFGHEFMGEVVETGSAVKDIRKGDRVVIPFVIACGDCFFCKLQQYSACENTNKGTGAALNKKQIPAPAALFGYSHLYGGIPGGQAEYVRVPKGNVGPFKVPPVLSDDKALFLSDILPTAWQAVKNGQVQKGSQVAIYGAGPVGLLSAACARLLGAEQIFMVDHNDYRLAFAKERYGVIPINFDENDDPAAFIIENTPGNRGVDAVIDAVGFEAKGSLTETVLSNLKIEGSSGKALRQCIAAVRRGGVVSVPGVYAGFIHGFLFGDAFDKGISFKMGQTHVHAFLPELLPLIEQGLLTPEEIVTHYLPLEDAARGYKIFEKREEECRKVILVPGAATPEAAREKVTALMNAPLQPLQP

SEQ ID NO: 61547 - protein, 576 aa, Rhizobium leguminosarum bv. viciae 3841
MRSGDSRCGAPKGFALTNFESLGVSKPIVATLFQLGIETPTPIQEHSIPLLLEGRDLIGLAQTGTGKTAAFGLPLIEKLLADERRPDNRTTRTLILAPTRELVNQIAESLKKFIRKSSLRINVVVGGVSINKQQLQLEKGTDILVATPGRLLDLINRRAITLTAVRYLVLDEADQMLDLGFVHDLRKIAKMVPKKRQTMLFSATMPKAIADLAGEYLVDPVKVEVTPPGKAADKVEQYVHFVGGKNDKTELLRKSLTENPDGRAMVFLRTKHGAEKLMKHLENIGYSVASIHGNKSQGQRERALKAFRDGSIKTLIATDVAARGIDIPAVSHVYNYDLPEVPDAYVHRIGRTARAGRDGIAIAFCAPDEAKLLRDIERLMGIDITVASGEAPANIGGGPRRANGNGNNRNRNGGQGREGQGRGEGRGDQNRSEHRGSRQERRPRREGEGSEVRAGGEERRPRPERPTSRNEDFRGQRRGEATPDLGPDNDLASTSDFRASAKPQRPAHHGAHANGEPSGHHRGNSRHAHGRPARKHGEDRGPQQAQAGEPRRDGNGGNRRGGSGSRNGGGQRRERA

SEQ ID NO: 61548 - protein, 404 aa, Shigella flexneri 2a str. 301
MGQSSQPHELGGGLKSRHVTMLSIAGVIGASLFVGSSVAIAEADPAVLLAYLFAGLLVVMIMRMLAEMAVATPDTGSFSTYADKAIGRWAGYTIGWLYWWFWVLVIPLEANIAAMILHSWVPGIPIWLFSLVITLALTGSNLLSVKNYGEFEFWLALCKVIAILAFIFLGAVAISGFYPYAEVSGISRLWDSGGFMPNGFGAVLSAMLITMFSFMGAEIVTIAAAESDMPEKHIVRATNSVIWRISIFYLCSIFVVVALIPWNMPGLKAVGSYRSVLELLNIPHAKLIMDCVILLSVTSCLNSALYTASRMLYSLSRRGDAPAVMGKINRSKTPYVAVLLSTGAAFLTVVVNYYAPAKVFKFLIDSSGAIALLVYLVIAVSQLRMRKILRAEGSEIRLRMWLDP

SEQ ID NO: 61549 - protein, 194 aa, Gossypium barbadense
IAPEVLLKKGYGMECDWWSLGAIMYEMLVGYPPFYSDDPVTTCRKIVHWRNHLKFPEEARLTTEAKDLICKLLCDVDHRLGTQGADQIKAHPWFKDTRWDKLYEMEAAFKPHVEGEFDTQNFMTFDEVDCPRTGSGPLKKTFLAPKDLNFVGYTYKNFEAVKGLPDVKEFGPVRQASTDSFHSDSGVDYSNSDK

SEQ ID NO: 61550 - protein, 595 aa, Zea mays
MVSEASKKKAAQKKAAAAAKRGGKASVASSSSSSAAAAADKVANGVVALKLSDRTCTGVLASHPLSRDIHIESLSLTFHGHDLIVDSDLELNYGRRYGLLGLNGCGKSTLLTAIGCRELPIPEHMDIYHLSHEIEASDMSALQAIDSCDEERVKLEKEAEILAAQDDGRGEALERVYERLDAMDAGTAEKRAAEILFGLGFDKQMQAKKTKDFSGGWRMRIALARALFMNPTILLLDEPTNHLDLEACVWLEETLKKFDRILVVISHSQDFLNGVCTNIIHMQNKKLKLYTGNYDQYVQTRSDLEENQMKQYKWEQEQIASMKEYIARFGHGSAKLARQAQSKEKTLAKMERGGLTEKVVRDRVLVFRFTDVGKLPPPVLQFVEVKFGYTPDNLIYKSLDFGVDLDSRIALVGPNGAGKSTLLKLMTGDLAPLDGMVRRHNHLRIAQYHQHLADKLDLDMPALAYMMKEYPGTEEEKMRAAVGRFGLSGKAQVMPMRNLSDGQRSRVIFAWLAYRQPQLLLLDEPTNHLDIETIDSLAEALNEWDGGLVLVSHDFRLINQVAQEIWVCENQAVTRWEGDIMDFKAHLKSKAGLSD

SEQ ID NO: 61551 - protein, 624 aa, Zea mays
QLGTGPPLEPCSGKGTCAQTAAAVDTRAATPRSKPPLLPPPPLTMGSAAASPQPSGNLTQDELKRVAAHRAVEFVESGMTLGLGTGSTAAHALDRLGDLLRAGALPGVAGVPTSLKTEAHAARVGIPLLPLDAASGASIRLSIDGADEVDPDLNLVKGRGGSLLREKMIEGAGDRFVVIVDESKLVPRLGCTGAVPVEVIPFGAPHTLGLIRKVFDGVPGFHARLRTVPAANGEDSDAPFLTDNGNYIVEMFFEDGIRGDLLDISDRLLRITGVIEHGMFLGMATTVIVANKDGTVTVINKKKMNQAVSSTSTRGRGKSERVWTYFEDEALLKALFELSLDPKWKSEGSFKNGYLSVLKATLAEKIPGCGLTAVPHIESRVRHFRTKYGAIEVMLANSGFSWDENRKMVQCEKQQYEDHCKRHPDAKGLYGISFPHLDTLAAIYGKDITTGEGAEGLGDAISNLEKEITLEESHDQEVEEDSMSRETPRWASDRNLLDSTSSTSKRRKRDKGNEVRKSSDPFLDMLGEFLDDLKNASNHFGKMTEIMEREAKLQEEAAHKDPMQALQQKSITELTRLGFTSTELVKAASVFVNVPNQMTMLFALPETLRRGFILNMLANEAQKN

SEQ ID NO: 61552 - protein, 198 aa, Gossypioides kirkii
IAPEVLLKKGYGVECDWWSLGAIMYEMLVGYPPFYSDDPVTTCREIVHWRNHLRFPEEARLTPEAKDLICKLLCDVDHRLGTHGADQIKAHPWFKDTRWDKLYEMEAAFKPHVEGEFDTQNFMKFDEVDGPRTGSGPLKKTFLAPKDLNFVGYTYKNFEAVKGLRHSFADVKELGPVRQASTDSFHSDSGVDYSNSDK

SEQ ID NO: 61553 - protein, 147 aa, Triticum aestivum
MAAAALRVQLEALLENMFATGMVDEQFRQLQSLQEGGSASGFVAEVATLFIDDADRIIADIGSLLDQPVVDFDKVDAHVHQLKGSSSSVGAQKVKLACMHFRQFYEAKSKEGCLMALALVRSEFCDVRNKFQTMMQLEQQIEACSPK

SEQ ID NO: 61554 - protein, 148 aa, Bacillus sp. SG-1
MEKTFLMVKPDGVQRGLIAEFVSRFEKKGFQLAGAKLMSISKELAEEHYGEHKERPFFGELVDFITSGPVFAMVWQGENVIATARQMMGATNPKDAAPGTIRGDFGITVGKNVIHGSDSAESAEREIGLFFKDEELVEYSKLMNEWIY

SEQ ID NO: 61555 - protein, 460 aa, Desulfococcus oleovorans Hxd3
MAQSFEKKILCIGAGYVGGPTMAVIADKCPRYKVTVVDIDAGKIAAWNSDTLPVYEPGLLDVVQRARGKNLFFSTDVPAAIAEADIIFVSVNTPTKATGVGAGMAADLRYWENTARQIRQCADTPKIVVEKSTVPVKTAEAMAQILSMENGGNLFEVLSNPEFLAEGTAVADLENPDRVVIGSRQTPEGVAARDVLVEVYANWVPREKILTSNIWSSEMAKLAANAFLAQRVSSINTIANICESSGANVQEVSRAVGMDRRIGPKFLNAGVGFGGSCFKKDILSLAYLCREAGADAEADYWESVVRINEHQKERFVRRMLDAMFHSMADKRIALFGFAFKPDTGDIRDAPAITIAGRLLDEGAVLAISDPRALDGARSVFGDADGRVEYVEDPYEAAKKSHAIAVLTEWQAYRDLDYTAIYAAMEKPAFFFDGRNVADHAALFDMGFNVYPVGMPAMTHF

SEQ ID NO: 61556 - protein, 316 aa, Leptospira interrogans serovar Lai str. 56601
METKLQKIGEVGTLLFPAWVLIGSILSFFFPQWFTWFTGPAITYGLGFTMLGMGITLLPRDFRNIFKTPIPVFIGVALQYTVMPVSGWGIGVLLDLPIPLATGLVVVSCCPGGVASNVITYLAKGDLALSVSMTASSTILSVFMTPLLTLFLIGKGIDVSTSGLFLDTFQVVILPIVLGVLLNVYFPEVSKKIQAVSPLVAVFLITMIVSSILGAGKEKILQSAGILIFAVLSLHISGFFFGYVISWLFIRKQKISRTISIEVGMQNSGLGVVLSRNNFPDPLVAIPAAISSLVHSLIGSLLAVFWRKLEKETTIR

SEQ ID NO: 61557 - protein, 186 aa, Brassica napus
  misc_feature (103)..(103): Xaa can be any naturally occurring amino acid
  misc_feature (110)..(110): Xaa can be any naturally occurring amino acid
  misc_feature (131)..(131): Xaa can be any naturally occurring amino acid
MAYSMLSSAAVVTSPAQATMVAPFTGLKSSSAFPVTRKANNDITSIVSNGGRVSCMKVWPPVGKKKFETLSYLPDLTEVELGKEVDYLLRNKWIPLCWNFELXEHGFVYXREHGKHPPDTTDGRYWTMWEXLPCSGCTDSAQVLKEVQECKTEYPNAFIRIIGFDNNRQVQCISFIAYKPPSFTGA

SEQ ID NO: 61558 - protein, 383 aa, Leptospira interrogans serovar Lai str. 56601
MQSIIDWKEIQDLYPVNQEMIWLNNCGTTPCNVHTVQAIGEYLEGYSKKGVLTEVRKYASVKHSIRKIVAGLINCDVEELCIIHNTNEGMNFLSLGFQLKSGDEILLLENEYPSNIYPWEHWKEKGVVIGFIPMASTPDQFLENLKSSISSKTKIVALSAVHWCTGMPFPLEEIGVFLDSKGIEFVLDGAQGIGLIPVDVRKMKLKYIAFPAWKWLLGPLGLGMLYIQQDCIDTLSFPFKGTGSVINDEVYLPYRAELKSGADRYEISTGNFIDWVYFQSTLEMLQKIGFHSVMERIYELADYLSEGMKGIGFQIELDHFPDNRTGIVVGYKEGIPMDELVSYLKKNEVMCALRLGKVRFSPHIYNKKDQLDRVVELLGSFSS

SEQ ID NO: 61559 - protein, 364 aa, Chlamydophila pneumoniae CWL029
MTTEVRIPNIAESISEVTVASLLVTEGALIQENQGLLEIESDKVNQLIYAPVSGRIFWEVSEGDVVPVGGVVGKIEPAGEGEELGDSQSKETIEAEIICFPQSGVRQSPPENKTFIPLRDQMDQGSQGLSAGDRGETRERMTSIRKTISRRLLSALHESAMLTTFNEVYMTPLFHLRKEKQEEFLSRYGVKLGFMSFFVKAVLEALKAYPRVNAYIDGEEIVYRHYYDISIAVGIDRGLVVPVIRDCDKLSNGEIEQKLADLALRAREGLLAIAELEGGGFTITNGGVYGSLLSTPIINPPQVGILGMHKIEKRPVVLDNEIVIADMMYVALSYDHRLIDGKEAVGFLVKVKEGLENPASLLDL

SEQ ID NO: 61560 - protein, 249 aa, Pseudomonas aeruginosa PAO1
METRRLFDQGSAAYASARPRYPDALYRHLAGLCGQRRRAWDCATGTGQAALGLAQYFGEVLASDTSTQQIEHAVVHPGIRYSVQDAEATDYPDAAFDLVCVAQAWHWFDHSRFNRELLRVLRPGGVFAAWGYGWFSIDAQIDAAIDEEYLRPIGPYWAQQNRLLWNAYRDVELPLGELPAPAFVIEQQWSLARLFDYMATWSASRLCREAQGNAFVRQALQRVAALWGEPTSTRRVRMPLALRIARKDA

SEQ ID NO: 61561 - protein, 484 aa, Pseudomonas putida KT2440
MSIRRTKIVATLGPASNSPEVIEQLILAGLDVARLNFSHGTPDEHKARARLIRDIAAKNGRHVALLGDLQGPKIRIAKFANKRIELKIGDKFTFSTAHPLTEGNQDIVGIDYPDLVKDCGVGDELLLDDGRVVMRVETATADALHCVVIIGGPLSDHKGINRKGGGLTAPALTEKDKADIKLAAEMDLDYLAVSFPRDASDMEYARKLRDEAGGSAWLVAKIERAEAVADDETLDKLIAASDAVMVARGDLGVEIGDAELIAIQKKIIQHARRNNKAVIVATQMMESMIQNPMPTRAEVSDVANAVLDNTDAVMLSAESAAGSYPIEAVQAMARICLGAEKHPTSQKSSHRLHTTFQRCDESIALAAMYTANHFPGVKAIIALTESGYTPLIMSRLRSHVPIFALSPHRATQARASMFRGVYPIAFDPAALPADKVSQAAVDELLKRGLVEQGDWVILTKGDSYHTIGGTNGMKILHVGDPLVG

SEQ ID NO: 61562 - protein, 99 aa, Nostoc punctiforme PCC 73102
MPTYKVTLINEAEGLNTTLDVEDDTYILDAAEEAGIDLPYSCRAGACSTCAGKLVSGTVDQGDQSFLDDDQIEAGYVLTCVAYPTSNVTIETHKEEELY

SEQ ID NO: 61563 - protein, 265 aa, Chromobacterium violaceum ATCC 12472
MQLSAMFVHPVKSCRGIAFDRAYAGKLGLLHDREWLLVSPDGQQITARAHPKLVTIRVELLPGGALLHHSGKAPIFAMATAYTRPHPAQVWKDGFQAWHGDERVDAWFADILGCDCRLLWLGAQSNRPFKGGPETMSFADGYPFLLASQASLDDLNRQLAAPVTLRHFRPNLVVSGAYPWEEDEWQVIRIGDVEFDVVKPCVRCVLTTVDPELGEKRADGEPLQTLIRTRMLDAGVCFGMNLRARNEGVLELGAPVEVLEQRYSF

SEQ ID NO: 61564 - protein, 312 aa, Synechocystis sp. PCC 6803
MKIASNITELIGRTPLVRLNRIPLLEGCGAKIVVKLEGMNPAASVKDRIGINMINRAEQEGLIEPGKTLLIEPTSGNTGIALAMVAAAKGYQLILTMPETMSQERRAMLKAYGAKLELTPGSEGMGGCIRRAQELAESLPNAYMLQQFDNPANPQIHQQTTALEIWQDTDGAIDFLVAGVGTGGTITGVASVLKEKKPSFQAIAVEPQNSPVLSGGKPGPHKIQGIGAGFIPEVLDVNLIDEVIAVTDEEAIAYGRRLAREEGILSGISTGAALAAAIKVAKRPANKDKLIVMIQPSFGERYLSTPLFQDLE

SEQ ID NO: 61565 - protein, 304 aa, Chromobacterium violaceum ATCC 12472
MNLQALIEDIRQQVLPFYDQGRVADYIPALASVPPHQFGIAIHTLDGREHACGDADTPFSIQSISKAFMLALTLQADGEQLWRHVGKEPSGNPFNSLVQLEYEHGIPRNPFINAGALVVTDRAIGHFGDAHARLLAWLREETGNAGLMADQAIAASERAHGDRNAALAHFMKSYGNLGHPVETVLDQYFHNCSIAMSCRELARAGLFLANHGLSPQTGTQYLSRSQAKQVNAVMLTCGTYDAAGEFAYRVGLPVKSGVGGGLLAVIPGKMAIAAWSPQLDARGNSVLGLEALDRFTTRTGLSIF

SEQ ID NO: 61566 - protein, 258 aa, Nostoc punctiforme PCC 73102
MKTELIVILSQREIEKMRQAGRLAAKLLQHLEPFVKPGVSTLELNDEAERWTQAHGAKSAPLGYKGYPKSICTSVNEVICHGIPNAKQILKDGDIINIDVTPIVEGYHGDTSKTFFVGTPSPKTRKLVEVTEECLRLGIAEVKPGGRIGDIGAAIQEYAEGQGFSVVRDFVGHGISNIFHTAPDVPHYGTRGKGKRLRPGMVFTIEPMINEGTYEVEVLSDKWTAVTRDRKLSAQCEHTLAVTEDGVEILTLPEGENY

SEQ ID NO: 61567 - protein, 393 aa, Photobacterium profundum SS9
MFKQLTQAQLDPILSLSIAYRADDRADKMDLGIGVYKNSQGETPIMQAVQQAQQQVLATQTTKSYVGLAGSEVFNQSMMDLLLSGTSAHSRAAAVQTPGASGALRMLADLMHLAQPDTTVWLTNPSYVNHKPVMEAAGLTVKYYPYFDHATKQVNSDAMLAELAKAGPKDVVLLHGCCHNPTGADISFSDWQAITALANKNGFLPFVDIAYLGFGDGLEQDGAGLKYMADNVEEMIVAASCSKNFGLYRERTGAAIVISDSLPEAQKAKGRILQLARASYTMPPDHGAALVATILTDDALTATWKQELDQMHKRLLSLRSGLTKAVRAQGSDAFNFIEQHKGMFSVTGLSPEQIERLRAEYGIYAVGDGRINIAGLQEQQLDYLANALITVTK

SEQ ID NO: 61568 - protein, 552 aa, Arabidopsis thaliana
MVIGLSTMLEKTEALFASDHASVVSMNLFVALLCACIVLGHLLEETRWMNESITALIIGSCTGIVILLISGGKSSRILVFSEDLFFIYLLPPIIFNAGFQVKKKQFFRNFMTIMLFGAIGTLISFVIISFGAKHLFEKMNIGDLTIADYLAIGAIFSATDSVCTLQVLNQDETPLLYSLVFGEGVVNDATSVVLFNAIQRFDLTNINSAIALEFAGNFFYLFILSTALGVAAGLLSAFVIKKLYIGRHSTDREVALMMLLAYLSYMLAELFHLSSILTVFFCGIVMSHYTWHNVTDKSKVTTKHTFAAMSFLAEIFIFLYVGMDALDIEKWDVVRNSPGQSIGVSSILLGLILLGRAAFVFPLSFLSNLTKSSPDEKIDLKKQVTIWWAGLMRGAVSMALAYNQFTTSGHTKVLGNAIMITSTITVVLFSTVVFGLLTKPLVKHLQPSSKQSSTTALQITLRSSFHDPILHEPLLSTQGQSEYDPEQHVSFRMFWKSPSRAIHHYWRKFDNAVMRRIFGGRGVSPVVPGSPIENSVPQWSEEVENKEQNGEP

SEQ ID NO: 61569 - protein, 347 aa, Bacillus cereus ATCC 10987
MKAVVVNKNSKANIEIIEKELRPLHSGEALVDVEYCGVCHTDLHVANHDFGNTDGRILGHEGIGIVTKIADDVTSLKVGDRVSIAWMFQSCGRCEYCITGRETFCREVKNAGYSVDGGMAEQCIVTADYAVKVPEGLDPAQASSITCAGVTTYKAIKVSDIKPGQPIVIYGCGGLGNLAIQYAKNVFGAKVIAVDINDDKLALAKEVGADMTINPISQGPADKIVQEEFGGAYAAVVTAVSKVAFNSAVDAVRACGKVVAVGLPVETMDLNIPRLVLDGIEVVGSLVGTRKDLEEAFMFGAEGKVVPVVQTCSLDKVQHVFEEMEQGRIQGRMVIDFKHNNCDCNSL

SEQ ID NO: 61570 - protein, 500 aa, Physcomitrella patens subsp. patens
MKVGGRSADHGDERVLQLVAEVREAYMTMRTKPAEWRVQQLKGLLRMVIESESEIVEALYADLGKPAHESYMSEISLVKSSCKLAIKELKKWMAPQRLCIMHVMFGALMVSGSMITFPSSASIVAEPLGVTLVISAWNFPFLLSVDPLIGAISAGCAVVLKPSEVVYATPALLAKLIPLYMDNSVIRVVEGGVAETTLLLEQKWDKIFYTGNPKVGRIVMAAASKHLTPVTLELGGKCPVYFDRSANLKVCLRRIAQGKWGNNNGQACISPDYILVDESIASELVDNLKEIIETFYGKNPISSTNLSRIVNTKHYLRLISFLEDPQICSKIVHGGERDEKKLYIAPTLVCDALMDSFLMSEEIFGPILPIIKVQGEQEAIDIINARPKPLAAYVFTTNKAVEERMVKNVSSGGMVVNDTVMHFVNPGLPFGGVGESGMGSYHGKFSFDAFSHKKAVLYRTSLGDFPARYPPFTTKKQNFLRCVLDGDYIGAILSLTGLKK

SEQ ID NO: 61571 - protein, 416 aa, Populus trichocarpa
MTKKAVLIGCNYPGTKAELKGCVNDVKRMCRCLVDRYGFYEDNITILIDTDDSYTLPTGKNVRKALNDLVLSSEPGDFLFVHYSGHGTRLPAETGEEDDTGYDECIVPCDMNLITDDDFRDLVDQVPEGCRITIVSDSCHSGGLIDETKEQIGESTKRQDEEEKDSGIRFKSFLKQTVKDAFESRGVHIPSGLHRNRHGKEEDFDDRAVEGEYGERGYVRSRSLPLSTLIEILKQKTGKDDIDVGKLRPTLFNVFGEDASPKVKKFMKIIMDKVQHGDGESGGGGFFGMVGNLAQEFLKQQLEHDEGYAQPALETEVGSKQEVYAGATKHALPDGGILISGCQSDQTSADASPGGNPAEAYGAFSNAIQIILAETAGEISNQELVLRARKMLKKQGFIQRPGLYCSDHHVEVPFVC

SEQ ID NO: 61572 - protein, 548 aa, Zea mays
MGLSNRSDIMTRSFLYALAYNGLTNAKRMIRGFERQDCSRAVLALIAFVTVVALRHLISSWRQHGRLPPGPTSLPVIGHLHLLRPPVHRTLQELASRIGPLMHIRLGSTNCVVASSPEVASELIRGHEGSISARPFTAVARKFSYDSAGFVFEPYNTHWRFMKRLCMSELLGPRTVEQLRPVRRAVTVSLVSDLLASSARGETVDITRHLIRLTNTSIIRMVASTVSGSVTDEAHELAKAVIEVVGAFNVDDYIAVVRGWDFQGLGRKAADVHRRFDALLEDILRHKEEARAARRLDDGHGKQATHSKDLLDILMDKAEDPAAEVKLTRENIKAFVIDVVTSGSDTSAAMAEWMLAELMNHPETLRKVVEEIDAVVGGGRIASEADLPQLPYLMAVYKETLRLHPAGPIAHRQSTEEMVVHGFTVPPQSTVLIHVWAIGRDPAYWEEPLLFRPERFMPGGAAESLEPRGKHFQYIPFGSGRRGCPGMGLAMQSVPAVVAALVQCFHWSTVDGGMDKIDMSESDGLVCARKKPLLLRPTSRLTPFPPVV

SEQ ID NO: 61573 - protein, 117 aa, Zea mays
MAETDTAAATPPPAPAMATLSPPPKSGIPPRYDLDARWDACLDLSIRRVAYSSLAGALAGLLLFRSPTTRWASVTLGAGVGIGAAYTECSYLFSGGPPNWSPKVSTIPSAHSEGEDK

SEQ ID NO: 61574 - protein, 477 aa, Rhizobium leguminosarum bv. viciae 3841
MTIYQNLIAGEWVGSNATKNINPSDTNEVVGLYADGSADDTRNAIAAAKAAFPAWSRSGIWERHVILKKTGDEIMARKDELGALLAREEGKTLPEATGEVIRASQIFEFFAGEALRLAGEVIPSVRPNIGVEITREALGVIGIITPWNFPIAIPAWKIAPALCYGNTIVFKPAELVPACSWAIVDILNRAGLPKGVLNLVMGKGSVVGQAMLESPDVHGITFTGSTGTGRRVAAASIEHNRKFQLEMGGKNPMVVLDDADLNVAVEAAANSGFFSTGQRCTASSRLIVTEGIHDKFVAALTDKLKTLVVDNALKAGTHIGPVVDERQLKTDTDYIEIGKSEGAKLAFGGEVISRDTPGFYLQPTLFTEATNQMRISREEIFGPVVSVIRAKDYDEALAIANDTPFGLSAGIATTSLKHATHFKRNSEAGMVMVNLPTAGVDFHVPFGGRKGSSYGPREQGKYAAEFYTTVKTAYTLA

SEQ ID NO: 61575 - protein, 305 aa, Bordetella parapertussis 12822
MGHGVIIRENVLQECRIFHPVRFVNTREGFMAQVPVLKLNDGNAMPQLGLGVWQVPNDQAAASVKAALAAGYRSIDTAAIYGNEAGVGEGLRAAGVARKDLFVTTKLWNDRHGYDEAQRAMDESLRKLGLAYVDLFLIHWPVAGSDKFVDAWRAMVAMKEDGRARSIGVSNFTIANLRRLVDETGVVPAVNQVELHPGFAQRELRAFHAEQGIATESWSPLGQGAVMHDATLAGIAARHGKSAAQVTLRWHLQNGLIVIPKSVTPARIQANIDVFDFELSADEMADIDALPEGPRLGPDPATFTG

SEQ ID NO: 61576 - protein, 955 aa, Pseudomonas syringae pv. phaseolicola 1448A
MLELTLEQISMARSAVDKTAALKLIADHLVADGLVAEGYLTGLMSREQQGSTFLGQGIAIPHGTPETRDLVVTTGVRLMQFPEGVDWGDGQMVYLAIGIAAKSDEHLRLLQLLTRALGEEDLGQALREARTPEDLLKLLQGAPQELALDAQMISLGVSADDFEELVWRGARLLRKADCVSNGFAAVLQQVEALSLGDGLWWLHSEQTVKRPGLAFVTPDKPIRYLGQPLTGLFCLASLGEAHQALLERLCLLLIEGRGHELGHATNSRVVLEALGGEVPAEWPTQRVQLANAHGLHARPAKILAQLAKEFDGEIRMRVLESGESAVSAKSLSKLLSLGARRGQTLEFIAEPTIANDALPALIAAVEQGLGEEVEPLPVASEAQAAPAPAAVAKPLNAPAAGSVLQAVPASPGIAIGPAHVQVLQIFDYPQQGESVAAERERLHKAIGEVRSDIENLIQRSKSKAIREIFITHQEMLEDPELTNEVEARLNNDESAAAAWATVIETAAVQQEQLQDALLAERAADLRDVGRRVLAQICGVETVAAPDEPYILVMDEVGPSDVARLDPAQVAGILTARGGATAHSAIVARALGIPALVGAGDEVLLLKPGTVLLLDSQRGRLTVAPDEATLQRAAQDRDAREERLKAAAAARMEPAVMRDGHAVEVFANIGDSTGTPAAVEQGAEGVGLLRTELLFMAHSQAPDEATQEAEYRRVLTDLGGRPLVVRTLDVGGDKPLPYWPIAKEENPFLGVRGIRLTLQRPDVMESQLRALLRAADSGPLRIMFPMIGTLEEWRQAREMTERLREEIPVSDLQLGIMIEVPSAALIAPVLAKEVDFFSIGTNDLTQYTMAIDRGHPTLSAQADGLHPSVLQLIDMTVRAAHANGKWVGVCGELAADPLAVPILVGLGVDELSVSARSIGEVKACVRELTLSSAQQLAQNALTAGSAAEVRALVEAV

SEQ ID NO: 61577 - protein, 240 aa, Glycine max
MKTPISGFYRNPVKFRMPTAENLVPIRLDIEIEGQRYKDAFTWNPSDPDSEVVVFAKRTVKDLKLPPAFVTQIAQSIQSQLSEFRSYEGQDMYAGEKIVPIKLDLRVNHTLVKDQFLWDLNNFESDPEEFARIFCKDTGIEDPEVGPAIAFAIREQLYEIAIQSVVSARESRMSKKGRRGAEYTPVSKGGAAAVDLVKLFGPKSSVVRKRKEWDVYEPIVDLLSNEEVDALEAKEERNFR

SEQ ID NO: 61578 - protein, 74 aa, Salmonella typhi
MFENITAAPADPILGLADLFRADDRPGKINLGIGVYKDETGKTPVLTSVKKAEQYLLENETTKNYLGIDGIPEF

SEQ ID NO: 61579 - protein, 424 aa, Pseudomonas aeruginosa PAO1
MLDLVAAFIALTTLLTYVNYRFIRLPPTIGVMATALVFSLIVQGLSELGYPILEVEMQEIIRRIDFSEVLMTWFLPALLFAGALHVDLSDLRSYKWPIGLLATAGVLIATFVIGGLAYYTFPLFGWQVDFIYCLLFGALISPTDPIAVLGILKSAGAPKPLATTIVGESLFNDGTAVVVFAIILGILQLGEAPTVSATAILFVQEAIGGVVFGAVLGYGVFVMMRGIDQYQVEVMLTLALVIGGAALAARLHVSAPIAMVVAGLIIGNHGRHYAMSDETRRYVDKFWELIDEILNALLFALIGLELLLLPFSWLHVAAAFALGGAVLVSRLLTVGPAILVLRRFRGANRQVPAGTIRILVWGGLRGGVSVALALSLPLGPERDLILSLTYIVVLVSILLQGLSIGPLVRRIYAGQPLEKSEGAH

SEQ ID NO: 61580 - protein, 460 aa, Desulfitobacterium hafniense DCB-2
MLTVEKIGGTSMSQFEDVLKNIIGEPDSQRFSFGRVFVVSAYAGVTNKLLEDKKTKAPGIYRHFVNGEDCEEALNVLLQDLLKVNERFVNIGLDYEAAKEFLGSRIQQTKSYLHSMHEIIASGYVDRENIFSAARELLASLGEAHSAFNSVNIMQNRGIPARLVDLTGLRDSSQLTIDERIAKAFRGVDPFKEIVIVTGYTKGKEGIMRQFERGYSEITFSRIATHLHADEAIIHKEFHLSSADPKIVGVEKAIPVGRTNYDVADQLADIGMEAIHPNASKPLEMAGINLRLKNTFEPDHPGTLISKDYIGPEAKIEIIAGSDKVVVVEIHDSLMVGEAGYDKQIMEMFMNYSVSYIMKATNANSISLVIWEHDLNEELMAELKGAYQTVTILPAAIVCVIGSNIAVPNILARATSSLAKNHINVNCVSQSLRQVNMQFVIDRDKYTSAIYHLNEDLCVG

SEQ ID NO: 61581 - protein, 350 aa, Nicotiana tabacum
MSEGEKVLPTASADEKSGASENKKSSESSSTEAPSGEARTTSTAAAGAGLQNPFDFSAMSGLLNDPSIKELAEQIAKDPAFNQMAEQLQKTFQGAAVEESVPNFDSQQYYSTMQQVMQNPQFMTMAERLGNALMQDPSMSGMLESLSNPAQKEQIEERMARIKEDPSLKPILEEIESGGPAAMMRYWNDQETLKKIGEAMGFAAGGEGATSSAIPGTDETEEANEDESVVHQCASVGDAEGLKAALTAGADKDEEDSEGRTALHFACGYGEVKCAQILLEAGAKVDALDKNKNTALHYAAGYGRKECVALLLENGAAVTLQNLDGKTPIDVAKLNNQQEVLKLLEKDVFL

SEQ ID NO: 61582 - protein, 524 aa, Ustilago maydis 521
MSDTVQAGVAAAATAPELSSLVDTLSNTTLSSQPKPAQGDTTSSTLSRRGAHGADNFDLPEGLKRMLANMYDPITNPDGIINAGIADNSLCRTELLEFFLAKDQLKLLPADMTYADRFTCSSQLLEAIAALFNQRRPDWPETNASPLPLTKVEPSHIAIGSGATGILDELFWNLCDEGDGVLLSAPYYNAFDNDLTNRAKARIVEVSVPLPEEAQRLQESLEYSSFAPSTVTAYEEAYQKAIADGINVRVLLLCNPHNPTGTIYPRETVVELAKFAAKYQLHFVSDEIYARSTFTTTDVAQPSTFHSILSIDTLKECRLDPSFVHVVTSASKDFAINGFRLGVLVSQHNPALQRAMACIGLLSQSASPAAALWIALLRDTAFLEWYFAENRRRLSLAYQHTVEFLHHHAIPYTRSNAGFFLMINLGTFCGIHKHMSDKQAREKEAIFVDRLIENRLLISPGTMYHHPIPGWFRFTFSQQPDTLKLTFTRLERAMRVQHSFEHNRPVLDWHSRANKAPNSTPPNP

SEQ ID NO: 61583 - protein, 496 aa, Nicotiana tabacum
MVLSKTASESDVSIHSTFASRYVRTSLPRFKMPENSIPKEAAYQIINDELMLDGNPRLNLASFVTTWMEPECNKLMMDSINKNYVDMGEYPVTTELQNRCVNMIAHLFNAPLGDGETAVGVGTVGSSEAIMLAGLAFKRKWQNKMKAQGKPCDKPNIVTGANVQVCWEKFARYFEVELKEVKLSDGYYVMDPEKAVEMVDENTICVAAILGSTLNGEFEDVKRLNDLLIEKNKETGWDTPIHVDAASGGFIAPFLYPELEWDFRLPLVKSINVSGHKYGLVYAGIGWAIWRNKEDLPDELIFHINYLGADQPTFTLNFSKGSSQVIAQYYQLIRLGFEGYKNVMENCQENARVLREGLEKSGRFNIISKEIGVPLVAFSLKDNSQHNEFEISETLRRFGWIIPAYTMPPNAQHVTVLRVVIREDFSRTLAERLVIDIEKVLHELDTLPARVNAKLAVAEANGSGVHKKTDREVQLEITAAWKKFVADKKKKTNGVC

SEQ ID NO: 61584 - protein, 391 aa, Lactobacillus plantarum WCFS1
MKFEESKILQQLPKQFFANLVKKVNAKAAAGADVINLGQGNPDQPTPEFVVKAMQTATANPADHKYSLFRGLPRFKQAAADFYEREYGVKLDPETEIAVLGGSKIGLVELPFALLNPGDTMILPDPGYPDYLSGITLAQVKLALLRLTAANHFLPDYQQVDPQVAAAAKLLYLNYPNNPTGAVATSQFFQDTVDFANEHQIGIVHDFAYGAIGFDGQRPVSFLQTPGAKDVGIEMYTLSKSFNMAGWRVGFAAGNADMIEALNLIQDHLFVSVFPAIQDAAIAALNSDQQTVHELVRLYERRRNQFFTTARKIGWEPYPSGGSFYAWMPVPEGYTSEAFADLLLDKAAVAVAPGNGFGAGGEGYVRVGLLIDEPRFTEACQRIAKLHLFDR

SEQ ID NO: 61585 - protein, 385 aa, Streptococcus pyogenes MGAS10394
MKITVVGIGYVGLSIGLLLAKEHDVTFFDIDNKKIDLINKRQSPLKEAAINKLLCKAKNINATSSEELAYKDATFIILSLPTNLKFNKLDTSIIEISVSNILKINKKATIVIKSTVPIGFTEYLRNQFHYNDIIFSPEFLREGSTIHDQLYPSRTIVGNESRNSQLFLDILTDISVEKDSPSLLVGSSEAEAIKLFSNAYLAQKIAFFNELDTFAEMQNLDSKKIIEAMGYDQRIGNSHNNPSFGFGGYCLPKDIKQLEYHFKEIPAPIITSISESNLLRKIHIAKTILNSSAKTIGIYRINSKKDSDNCRESSTIDVAKLLKSSGKDVIIFEPLINQKKFLGCPLINDFNEFIKYSDIIVANRIDDALRKCNSKVFTRDIFQYD

SEQ ID NO: 61586 - protein, 402 aa, Xanthomonas campestris pv. vesicatoria str. 85-10
MAPKSDKSTAATGGKKKPTKTSVRASDSKPANTPAEKAAIKTAAPVLADVRAKIDEIDRNIQALIAERANFAHQVGKAKGKLAAAVDYYRPEREAQVLRMVVDRNEGPLSDEVLVHVYREIMSACLAQQEPLKIGYLGPEGTFSQQAVLKHFGRSAVGLPMATIEEVFQEVEAGNADFGVVPVENSGQGTIQVTLDMFLTSNLKICGEVELRVHQYLLSRNGRLEDIERIYAHSQSFAQTAGWLRSHLPKVEKIAVSSNAEGARRARNAEDAAAIGGESAAHVYGLKKVIMKSIEDDDDNTTRFLVIGRQIFPSSGHDRTSVLVFIHDKPGALFDVLSPFARHGISMNRIESRPSHQAKWEYGFFIDLIGHVEDDAMKQALAELKAHSAQIKVLGSYPVAIP

SEQ ID NO: 61587 - protein, 172 aa, Chromobacterium violaceum ATCC 12472
MAKHEMEDRGDGLVEKMISVNRVTKVVKGGRIMAFSALTVVGDGDGGIGMGKGRSKEVPVAVQKAMEQARHNMMKIKLYNGTVKHTVEGRHGATRVLIQPAKDGTGVKAGGPMRAIFDAMGIHNVSAKIHGSTNPYNVVRATLDGLSKINTPAQIAAKRGLSIEDILGVGHE

SEQ ID NO: 61588 - protein, 299 aa, Saccharomyces cerevisiae YJM789
MSTFSASDFNSERYSSSRPSYPSDFYKMIDEYHDGERKLLVDVGCGPGTATLQMAQELKPFEQIIGSDLSATMIKTAEVIKEGSPDTYKNVSFKISSSDDFKFLGADSVDKQKIDMITAVECAHWFDFEKFQRSAYANLRKDGTIAIWGYADPIFPDYPEFDDLMIEVPYGKQGLGPYWEQPGRSRLRNMLKDSHLDPELFHDIQVSYFCAEDVRDKVKLHQHTKKPLLIRKQVTLMEFADYVRTWSAYHQWKQDPKNKDKEDVADWFIKESLRRRPELSTNTKIEVVWNTFYKLGKRV

SEQ ID NO: 61589 - protein, 345 aa, Zea mays
MKRKENSAHSAPPLNRPRGKRKALAELPKSNGLNMNHDSAPRPSKPRTRSAARAEAEAEAAMKRRKAGDAARWPMDTRQPDAEAAVAPYVGDIDRYLRSLEVEPLRRPSHSYFQDIQKNICPKMRAILVDWLVEVAEEFKLHAETLHLAVSYVDRFLTMNVVARNKLQLLGVTALLVAAKYEEIESSKMKVVKMETDLLKSLSFQIGGPTVTTFLRQFIASCRGGNSASRGKLEFVCSYLAELSLLDYDCISYLPSVVAAACLFVARFIIHPKTRPWNLSLEQSTGYRVFDLQKSIYVIHELQLTIRCPNQVAIREKYKDPKFGCVSTMVSPREIPTSFLEGCHK

SEQ ID NO: 61590 - protein, 83 aa, Paracoccidioides brasiliensis
LMVGLDAAGKTTILYKLKLGEIVTTIPTIGFNVETVEYKNIQFTVWDVGGQDKIRPLWRHYFQNTQGIIFVVDSNDRDRVVEA

SEQ ID NO: 61591 - protein, 601 aa, Fusobacterium nucleatum subsp. vincentii ATCC 49256
MNEELTKKCEEIRKKLIEVVSKNGGHLGSNLGVVELTVCLDEVFDFKEDIVLFDVGHQAYVYKILTDRAEKFDTIRTRKGLSPFLDPNESKYDHFVSGHAGTALPAAVGFAIANPDKKVIAVVGDASLSNGHSLEALNYIGYKKLENILVIVNDNEMSIGENVGFISKFLKRVITSGKYLNFREDVKSFINRVKADRVKKTLERLERSIKGYVTPFYALESLGFRFFNVCEGNNIEKLLPMLKKIKDLKGPIVLLVKTEKGKGYCFAEENKEKFHGIAPFDIKTGNTHKSSVSYSEVFGNKILELGKEDKDIYTLSAAMIKGTGLHKFLEEFPERCIDTGIAEGFAVTLAGGLAKSRKKPYVCIYSTFIQRAVSQLIHDISLQNLPVRFIIDRSGIVGEDGKTHNGIYDLSFFLSIQNFTVLCPTTSKELEQALDISKNFNLGPLVIRIPRDSIFDIEDEKPLEIGRWKEIKKGSKNLFIATGTMLKIILEIYDELKNRGIDCTIVSAASVKPLDENYLLNYIKGYDNIFVLEENYVRNSFGTSILEFLNDNGIQKKIIHRIALKSAIIPHGKREELLKEEKLKGESLIERIEELIYGRKK

SEQ ID NO: 61592 - protein, 318 aa, Triticum aestivum
  misc_feature (169)..(169): Xaa can be any naturally occurring amino acid
  misc_feature (177)..(177): Xaa can be any naturally occurring amino acid
  misc_feature (194)..(194): Xaa can be any naturally occurring amino acid
  misc_feature (210)..(210): Xaa can be any naturally occurring amino acid
MEGKEEDVRLGANRYSERQPIGTAAQGGGADDKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMVMQCLGAICGAGVVKGFQTTLYMGNGXGGANSVAXPGYTKGDGLGAEIVGTXFVLVYTVFSATDAKRXARDSHVPILAPLPIGFAVFLVHLATIPITGTGINPARSLGAAIIYNKKQSWDDHWIFWVGPFTGAALAAIYHVVVIRAIPFKSPRLAYSIGHGTEWMESYRSSDHRLC

SEQ ID NO: 61593 - protein, 511 aa, Zea mays
MASNGCNGNGNGNGNGKAAPAGVVVPEIKFTKLFINGEFVDAASGKTFDTRDPRTGDVLAHVAEADKADVDLAVKSARDAFEHGKWPRMSGYERGRIMSKLADLVEQHTEELAALDGADAGKLLLLGKIIDIPAATQMLRYYAGAADKIHGDVLRVSGRYQGYTLKEPIGVVGVIIPWNFPTMMFFLKVSPALAAGCTVVVKPAEQTPLSALYYAHLAKMAGVPDGVINVVPGFGPTAGAALASHMDVDSVAFTGSTEVGRLIMESAARSNLKTVSLELGGKSPLIIFDDADVDMAVNLSRLAVFFNKGEVCVAGSRVYVQEGIYDEFVKKAVEAARSWKVGDPFDVTSNMGPQVDKDQFERVLKYIEHGKSEGATLLTGGKPAADKGYYIEPTIFVDVTEDMKIAQEEIFGPVMSLMKFKTVDEVIEKANCTRYGLAAGIVTKSLDVANRVSRSVRAGTVWVNCYFAFDPDAPFGGYKMSGFGRDQGLAAMDKYLQVKSVITALPDSPWY

SEQ ID NO: 61594 - protein, 119 aa, Brassica napus
  misc_feature (5)..(5): Xaa can be any naturally occurring amino acid
DNDDXDGEPTHTPHRRRLGFAESRLQDVEIGTPVYNSLEAKRMRESPLASAKQCEYTIGECIERLDSMEEVEPGSDLYMFALDLFLRKEYREIFMQLKKASLRISWLLRLQAGPPTHAA

SEQ ID NO: 61595 - protein, 347 aa, Pyrobaculum aerophilum str. IM2
MKFLLRCKPDTKKPPTGKKVAIIGAGPAGLGAAGILLCNGHEVHIYDALPEPGGLLMFGIPPFRIPRENVREGIRELVDAGAKFFTSTFVYCGEKPHEHEALLLAKDYVSLEELVGKYDAVIITTGTWKSRSLGVPGENLPGVYKALDYLFRIYAHQLGYLPKEKVYPTGRKVLVVGAGLTAVDAALEAREQGAEKIIVAYRRTINEAPAGRKTIETELIAKGIEFRELINPVAFLGRDRVERVRFVKMRLGPPDKSGRPAPEPIPGSEFEEEFVTVLIAAGEIATPPGKCLGMELNPDGTIKVNEKMMTTRRGVFAAGDVVTGPSLIGKALGSGMRAAQFVDEFLR

SEQ ID NO: 61596 - protein, 407 aa, Oryza sativa Japonica Group
MASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLTVRSYRYYDPATRGLDFQGLLEDLGSAPSGAIVLLHACAHNPTGVDPTLDQWEQIRQLMRSKALLPFFDSAYQGFASGSLDQDAQSVRMFVADGGELLMAQSYAKNMGLYGERVGALSIVCGSADVAVRVESQLKLVIRPMYSNPPIHGASIVATILKDSAMFNEWTVELKGMADRIISMRQQLFDALKTRETPGDWSHIIKQIGMFTFTGLNSDQVAFMRQEYHIYMTSDGRISMAGLSGRTIPHLADAIHAAVTKLK

SEQ ID NO: 61597 - protein, 456 aa, Saccharopolyspora erythraea
MTDTSADLVILGGGSGGYACAFRAAELGLSVVLIEKDKLGGTCLHRGCIPTKALLHAAEVADSARDGDQFGVKTSLEGIDIAGVNSYKDGVVSKLYKGVQGLFKAHKITVVEGAGTLVDAKTVRVDGTRYTGRNVVLATGSYSKSLPGLELGGRVIASEQALNLDFVPEKVVVLGGGVIGVEFASVWRSFGAEVTIVEALPHLVPNEDEFISKRLEREFRKRGIKFKTEVKFTGAQQSAEGVSVRLENGDQYDADLLLVAVGRGPNTAALGFEEAGVTMERGFVRTDDRLRTSVDGVYAVGDIVPGLQLAHRGFQQGIFVAEEIAGLNPQAIDESGIPRVTYSHPEVASVGLTEAAAKEQYGSVETFNYDLAGNGKSQILKTSGAVKLVRPTDGPVVGLHMVGDRVGELIGEAQLIYNWEALPEDVAPLVHAHPTQTEALGEAHLAQAGKPLHVHG

SEQ ID NO: 61598 - protein, 46 aa, Glycine max
DPSNTIFKPIPKPIQLESLLITNDICNYCNQINGVSGQSFNKLYYT

SEQ ID NO: 61599 - protein, 326 aa, Saccharopolyspora erythraea
MAFSVQMPALGESVTEGTITRWLKQEGDTVEVDEPLLEVSTDKVDTEIPSPAAGVLQRIVAQEDDTIEIGGELRVIGESGESGGGESAPAEQPQQAEPQQPEPQQAEAAQPEPEQQPAPAQQEAPAHELRCRQSGSAQGTEVPMPALGESVTEGTITRWLKQVGDTVEVDEPLLEVSTDKVDTEIPSPVAGTLLEISAGEDDTVEVGAKLAVVGEQGAAPSAPAAPPEEQTAPSAGRSHSRPLPQQSAPAEQRHRLSSRLRPSPLRSPCRSSPSRPPRAQPAQPSAPAEAPSGAAPYVTPLVRKLANEHGIDLSKIKGSGVGGGRI

SEQ ID NO: 61600 - protein, 374 aa, Wolbachia endosymbiont of Drosophila simulans
MIENKFGKFDIVVIRENEEDVYTGIEHRLTGDSYQCTKIITRSGSEKICRYAFEYAKKHNRKKVTCLTKDNIMKMTDGTFHAAFDRIAKEYQDIKAEHYIVDIGMARVATEPENFDVIVTENLYGDILSDIVAQTSGSVGLAGSSNIGNEYAMFEAVHGSAPDIAGKNIANPSGLLNAAVHMLIYIGQVGTAKLIYDAWLKTLEGGIHTADLYKEKRSKQKVGTKEFAEAVIDNLGKKPAELTIGSGSDSKINLDSKINKVQDNYEQDYKVKKLVGSDITLAWDKSSNVDQIVGLFESSNPQIIAIYSKGLAIWPGSSKSSSDQITCRFIANSEKKPITNSDVNDLLIKLEENTFDVVRMDKLYLYDGKEGFFS

SEQ ID NO: 61601 - protein, 566 aa, Escherichia coli
MEMLSGAEMVVRSLIDQGVKQVFGYPGGAVLDIYDALHTVGGIDHVLVRHEQAAVHMADGLARATGEVGVVLVTSGPGATNAITGIATAYMDSIPLVVLSGQVATSLIGYDAFQECDMVGISRPVVKHSFLVKQTEDIPQVLKKAFWLAASGRPGPVVVDLPKDILNPANKLPYVWPESVSMRSYNPTTTGHKGQIKRALQSVVAVKKPVVYVGGGAITAGCHQQLKETVEALNLPVVCSLMGLGAFPATHRQVLGMLGMHGTYEANMTMHNADVIFAVGVRFDDRTTNNLAKYCPNATVLHIDIDPTSISKTVTADIPIVGDARQVLEQMLELLSQESAHQPLDEIRDWWQQIEQWRARQCLKYDTHSEKIKPQAVIETLWRLTKGDAYVTSDVGQHQMFAALYYPFDKPRRWINSGGLGSMGFGLPAALGVKMALPEETVVCVTGDGSIQMNIQELSTALQYELPVLVVNLNNRYLGMVKQWQDMIYSGRHSQSYMQSLPDFVRRGAYGHVGIQISHPHGWKANLARRWNRCAIIAWCLLMLPSMAASTSTRCRFAGAEWMKCG

SEQ ID NO: 61602 - protein, 160 aa, Escherichia coli
MRRILSVLLENESGALSRVIGLFSQRGYNIESLTVAPTDDPTLSRMTIQTVGDEKVLEQIEKQLHKLVDVLRVSELGQGAHVEREIMLVKIQASGYGRDEVKRNTEIFRGQIIDVTPSLYTVQLAGTSGKLSAFLASIRDVAKIVEVARSGVVGLSRGVK

SEQ ID NO: 61603 - protein, 325 aa, Blastopirellula marina DSM 3645
MASDAKLKEDLPSLTDRIVATYKQIGTINHLGHCPLPNYEIIISALEDLKEIIYPGYRRREGLHMGNITYHVGDLIDGLHDKLTTQIARALQHDERLKHERGECDPDEKTDYEAKGQAMAIEFLNRLPKIRDQLSTDVQAAYDGDPACRSLDEVIFCYPGLEAVSVFRIAHELYTLGVPFIPRMMTEWAHKQTGIDIHPGATIGSYFFIDHGTGVVIGQTCEIGEHVKLYQGVTLGALSFDTDSDGNLVRGMKRHPTIEDHVVIYANATVLGGRTTVGHNSVIASSVWLTRSVEPHTTVLLEKPRLRLRSETPPEEISEEVNFQI

SEQ ID NO: 61604 - protein, 688 aa, Dechloromonas aromatica RCB
MSTALLLALGCAVLAVLYGWISSRQILALPAGNERMQEIAKAIQQGAEAYLSRQYKTIAMVGVILFLVIGLIPKLGWLTAFGFLIGAVLSGAAGFIGMNVSVRANVRTAEAARSGIAAALDVAFKGGAITGMLVVGLGLLGVAGYFAFLKSTAAPGADLHHIIEPLVGLAFGSSLISIFARLGGGIFTKGADVGADLVGKVEAGIPEDDPRNPAVIADNVGDNVGDCAGMAADLFETYAVTVVATMVLAALTIKSVPGLGENLVLYPLALGGVSIIASIVGCYFVKATEGGKIMAALYRGLIVAGVLALAAYYPITSWLIGAGATLPDGTTINTMTMFGCSVVGLVLTAALVWITEYYTGTDYAPVKHVASSCQTGHATNIIAGIGVSMKACAWPVLSVCAAIYAAFAMGGLFGIAIAATSMLSMAGIVVALDAYGPITDNAGGIAEMAELPKEVRNVTDPLDAVGNTTKAVTKGYAIGSAGLAALVLFADYTHGLEAASGKVFTFDLSNHLVIIGLFIGGLIPYLFGAMAMEAVGRSASAVVMEVRRQFKEIPGIMEGTAKPDYSRAVDMLTVAAIKEMMIPSILPVAVPIVVGLVLGPQALGGLLVGTIVTGLFVAISMTTGGGAWDNAKKYIEDGHFGGKGSEAHKAAVTGDTVGDPYKDTAGPAVNPLIKIINLVALLIVPLIA

SEQ ID NO: 61605 - protein, 309 aa, Streptomyces olivaceus
MTGDRLSAAARGIVDMLSAGFPAALGPDTDVAALRQSILQQPSGLPELASVTDRTVPGPEGAPDVPVRIYQPGARGAALPVVVFFHGGGFVLCGLDSHDGLCRELAASSGAVVVSVDYRLAPEHPAPAAVEDAYAALAWVAAHAEELGADPARLAVAGDSAGGNLAAAVCLLARERGGPVPAAQVLIYPALDPAQDSASMREFGEGHFLTADQMRWYWEQYLAGSEPTPLTAPATAHDLSGLPPALLVEAECDPLRDEGRAYAARLPEADVHSAPGVFHGFLDFTAELPQAVAAQRRVAEWLRERLGAS

SEQ ID NO: 61606 - protein, 258 aa, Burkholderia xenovorans LB400
MSKQRAKLVVGNWKMHGRLAENAVLLQAVAQGAGELPAQVRVGVCVPSPYLAQSQSLLEGSRVAWGVQDVSAFTHGAYTGEVAAPMAVDFGATLAIVGHSERRAYHRESAELVAVKTQRVLEAGLTPIVCVGETLEEREAGSTEQVVGMQLDEVLAKLSEQEAARIVVAYEPVWAIGTGKSASSEQAQAVHAFLRARLAAKGAAVADVPLLYGGSVKPENAEELFRQPDIDGGLIGGASLKAQDFLVICKAATTSVAG

SEQ ID NO: 61607 - protein, 319 aa, Petunia x hybrida
MENFPIISLDKVNGVERAATMEMIKDACENWGFFELVNHGIPREVMDTVEKMTKGHYKKCMEQRFKELVASKALEGVQAEVTDMDWESTFFLKHLPISNISEVPDLDEEYREVMRDFAKRLEKLAEELLDLLCENLGLEKGYLKNAFYGSKGPNFGTKVSNYPPCPKPDLIKGLRAHTDAGGIILLFQDDKVSGLQLLKDGQWIDVPPMRHSIVVNLGDQLEVITNGKYKSVMHRVIAQKDGARMSLASFYNPGSDAVIYPAPALVEKEAEENKQVYPKFVFDDYMKLYAGLKFQAKEPRFEAMKAMETDVKMDPIATV

SEQ ID NO: 61608 - protein, 194 aa, Shigella dysenteriae
ADERPGKINLGIGVYKDETGKTPVLTSVKKAEQYLLENETTKNYLGIDGIPEFGRCTQELLFGKGSALINDKRARTAQTPGGTGALRVAADFLAKNTSVKRMWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 61609 - protein, 320 aa, Petunia x hybrida
MENFPIINLEKLNGSERDATMEMIKDACENWGFFELVNHGIPHEVMDTVEKLTKGHYKKCMEQRFKELVASKGLEAVQAEVTDLDWESTFFLRHLPVSNISEVPDLDDEYREVMRDFAKRLEKLAEELLDLLCENLGLEKGYLKKAFYGSKGPNFGTKVSNYPPCPKPDLIKGLRAHTDAGGIILLFQDDKVSGLQLLKDGQWIDVPPMRHSIVVNLGDQLEVITNGKYKSVLHRVIAQTDGTRMSLASFYNPGSDAVIYPAPTLVEKEADQECKQVYPKFVFDDYMKLYAGLKFQAKEPRFEAMKAREADVKSDPIATA

SEQ ID NO: 61610 - protein, 474 aa, Bacillus cereus ATCC 10987
MKKHLYINGDWKSVNTYKPLYAPYSEETLAEIAQGTEEDVKEAVIAAKNAMKEMNRLSAYDRATILEKVAQKMDERREEFAEIIAKEAAKPIRAARGEVDRTVQTYKFAAEEAKRIYGETLPLDAAPGADGRIAYTIRKPIGVIGAITPFNFPLNLVAHKVGPAIAAGNTVVLKPADQTPLSSYALVELFEEAGLPKGALNIISGPGSTVGEAIVTNDDVASITFTGSPKVGLGIKAKAGLKRVTLELGSNAAVIIDEDVELTDELIERVKWGAFVNNGQVCISVQRVFVHEERMDEFLSKLQKAMETVVVGDPLLEETDVSALISKKDVERIDNWVQEAVKEGASVLYGGNKRDERIFKPTVLTNVPEHVSVQCQEVFGPLMTVNTFKEFDEAIEQVNHSRYGLQAGVFTNNLFKVMRAIDELEVGGVMINDIPTFRVDHMPYGGVKESGTGREGIKYAIEEMTEMKLVCIKK

SEQ ID NO: 61611 - protein, 795 aa, Candida glabrata CBS 138
MKALEFPLAEIPIPFKYQLAAKRNRPLGNSKRRHDVDGGADRKRMKICLDDMQDGVGRTPSSLEVLVRATNTPNETDINDKSLCSTEDGTCDNISMLSAPPTAVVSNTSSNPAVSTIPPTSVDTTGANANVAVSTPSTVSNPKVTTGLVTSGSANESNVNNSMAVDTAAESGIMLDDGALPLSPIASTPGSASPILKSMDLIEEYKDKERAETERLLATIKASLGAVNMNHLIYSLLSGMHRSELSDISTLLRDNLKRDFVTSLPLEITLKILNKLPFESISNCLQVSKSWNRLINGTPALWKHLLLSESFVSKDSFDKKYPVENNKLDPPFDNDSRYRQDFLMNCSILQNWYNPDFIPQRTTLKGHMTSVVTCLQFEDNYVITGADDKMIRIYDSITKKFLIELSGHDGGVWALKYAGNGILVSGSTDRSVRIWNIHLGKCTHVFKGHTSTVRCLDIVEHEGVKYIVTGSRDNTLHIWKLPQMSDSNIDEGMPNVYSNNGPLFFHSPEENPYFVGVLRGHIASVRTVSGHGRIVISGSYDNNLIVWDIIQMKCLYILMGHTDRIYSTIYDYKRNRCISASMDSTIKIWDLQNIWNNGECVNVTNATVPCTKITGPMMTLQGHTALVGLLKLSDKFLVSAAADGSLRGWDSSDYSRKFAYHHNNLSAITTFYMTDNILVSGSEGQFNIYNLRTGKLIHSNILNDADQIWSVNFKGNILVAAVEKDGQSFVEILDFSKKQVTFSSALHNENQVECVTDSSSSSLPSADLSTSLPDRPYSSGSTYSYSSNAIVSSSE

SEQ ID NO: 61612 - protein, 266 aa, Escherichia coli
VDKPMIQYIVDEIVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDREGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 61613 - protein, 173 aa, Haemophilus influenzae Rd KW20
MLKSRVKSLWLIIGKNMKVLEGSVAAPNAKVAVVIARFNSFINESLLEGAIDALKRIGQVKDENITIVRTPGAYELPLVARRLAESKKFDAIVALGTVIRGGTAHFEYVAGEASSGLGKVAMDAEIPVAFGVLTTENIEQAIERAGTKAGNKGAEAALTALEMVNLIQQIDAA

SEQ ID NO: 61614 - protein, 222 aa, Lactobacillus plantarum WCFS1
MTIKQAIVQQALTLIKPQMVVGFGGGSTVGELVKEAANHVNDITVVTPSPTTRQLATVLGYTVVDTAYCDRVDIAFDGCDQLDHHGNALKSGGGIHANEKIIASLADEYWLLTMQDRLVDQFDIKTPLVLEVLPAALSLVMRTVSDLGGQATIRTANNRDGFTLTDSGNLLIDCHFPTYAKLTDLNVELATLAGVVETSYFDHLVTNAWLGDATTNTVKALF

SEQ ID NO: 61615 - protein, 285 aa, Glycine max
MPTGLPAANSLVAPDEEGWVWGQIKAEARRDAESEPALASYLYSTILSHSSLERSLSFHLGNKLCSSTLLSTLLYDLFLNAFSSDPSLRSAAVADLRAARERDPACVSYSHCLLNYKGFLACQAHRVAHLLWRQSRRPLALALHSRIANVFAVDIHPAARIGKGILFDHATGVVEGRHRNREQCVDPAPCSLGGTGKVGGDRHPKIGDGVLIGAGATILGNIKIGEGAKVGAGSVVLIDVPPRTTAVGNPARLVGGKEKPSKHEDVPGESMDHTSFISEWSDYII

SEQ ID NO: 61616 - protein, 337 aa, Escherichia coli
MKVLLTGGLGYIGCHIAVELLQQGHDVVIFDNLSNSHLTVLERIKAITQKKVVFIRGDLRSLSDIRKTFESSQIEAVIHLAALKSVSESVRHPLEYYINNVVGSLNLIQAMSHANIKRLIFSSSATVYGQPEHLPITEQASVGKVTNPYGQTKLIIEKILADICLADPEWQITSLRYFNPIGAHPSGMIGEDPRGMPNNILPYITQVAIRRRPYFTILGDDYPTKDGTGVRDYIHVQDLALGHIAALMNAKNKSYQVYNLGTGKGYSVLDIINSFKEINNIDIPFIIEKRRPGDIAECWSSPELAKRELGWQAKFELKDMLRDSWNWQQKNPFGYGN

SEQ ID NO: 61617 - protein, 306 aa, Lactobacillus plantarum WCFS1
MSTKIIMDTDPGIDDAAAITFALNHPDLDLQLITTVAGNVTVDKTTLNALKLTRFFNSDVPVAGGAAQPLIKPFEDAVRIHGVSGMPGYDFPTDLAEPLPETAVEALRDYIMAAEQPITLVPTGAYTNIALLFKTYPEVMPHIKEIVAMGGALGKGNMTSAAEFNVFTDPHAAEIMYQSGVPITMVGLDVTMKALLTRKSIEQLPTLGKTGEMLHALFGHYNDRNQTGVAMHDVNTLFYLLHPEAFTTEKMWIDVQTEGPANGETVGDIRGAYHDGKTNATVCVDIDAAAFNKWFLETVAAIDQSK

SEQ ID NO: 61618 - protein, 122 aa, Arabidopsis thaliana
EMIKPGALAIASPIVVGLVFRILGYYTGQPLLGAKVVASMLMFATVCGILMALFLNTAGGAWDNAKKYIETGALGGKGSEAHKAAVTGDTVGDPFKDTAGPSIHVLIKMLATITLVMAPVFL

SEQ ID NO: 61619 - protein, 350 aa, Mesembryanthemum crystallinum
EDEACSYAMTITSGSVPPMVLKAVIELDVLEIIKRAGPGAQLSPAEIANQLPTKNPDAATMLDRMLRLLASYSILSYSLRTLSDGRVERLYGLAPVCQFLTKNQDGVTLGALSLMNQDKILMESWYHLKDAVLDGGIPFNKAYGMSAFEYHGTDPRFNKVFNSGMSNHSTITMKKILDDYQGFEGLSTLVDVGGRHWGYPNMIISKHTTIKGINFDLPHVIEDAPAYPGVEHVEGDMFVSVPKGDAIFMKWICHDWSDEHCLSFLKNCYAALPNHGKVIVCEYILPVAPETSHAARTVFHVDAIMLAHNPGGKERTEQEFQALAKGSGFEGFKVACSAYDTKVMEFLKQN

SEQ ID NO: 61620 - protein, 466 aa, Escherichia coli
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLLMDPKRMIEACDENTIGVVPTFGVTYTGNYEFPQPLHDALDKFRADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLLGIAQQNSFKHT

SEQ ID NO: 61621 - protein, 466 aa, Escherichia coli
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDLKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61622 - protein, 203 aa, Zea mays
MEEQGERHIQLQLLLLPAPAGHHQVLRDVPAAVPASAVEPPQLDLDLTMSIGPRRHPAAQTPAPSPPPPRARSPPTNENRRASAMMMSTVLAPVPASARQHQKHQQYAGADVRAVKQQAADQARMASAERAYAERVRELARRELELAEREFARARAIWERAREEVERVERMKQIAARRLVGSAASSAAVLEITCHACMQRFHP

SEQ ID NO: 61623 - protein, 374 aa, Populus trichocarpa
MAALRSLLKKNSSSIPTCNELVMIRRLFSSEAAAASPSFAQRLRDLPKDLPGTKIKTQVSQLIGKTPIVYLSKVTEGCGAYIAAKQEMFQPTSSIKDRPALAMIEDAEKKNLIAPGKTTLIEPTSGNMGISMAFMAAMKGYKMILTMPSYTSLERRVTMRAFGAELILTDPAKGMGGTVKKAYELLESTPGAFMLQQFSNPANTQIHFETTGPEIWEDSLGKVDIFVMGIGSGGTVSGVGKYLKSQNPNVKIYGVEPAESNVLNGGKPGPHDITGNGVGFKPDILDMDVMEKVLEVSSEDAVNMARRLALEEGLMVGISSGANTVAALRLARMPENKGKLIVTIHASFGERYLSSVLFQDLRKEAENMQPVPVD

SEQ ID NO: 61624 - protein, 123 aa, Chromobacterium violaceum ATCC 12472
MAITKEDILEAVAGLTVMELNDLVKAFEEKFGVSAAAVAVAGPAGAGAAAAEEKTEFDVVLSAAGDNKVGVIKVVRAITGLGLKEAKDLVDGAPKNVKEGVAKAEAEDIVKQLTEAGAKAEIK

SEQ ID NO: 61625 - protein, 436 aa, Bacillus cereus ATCC 10987
MRDYLIKPLVGQPYPMISHGKGVYLYDQNGNKYFDGSSGAITAGIGHGVKEIADVIKKQAEEIAFVYRSQFTSEPAEKLAKKLSDLSVGDLNWSFFVNSGTEANETAMKIAIQHFQERGIQGKHKILSRWMSYHGITMGALSMSGHPLRRQRFVSILEDYPTIPAPYCFRCPVQKVYPTCQLACATELERSIERIGAEHIAAFIAEPIIGAAGGAVVPPKEYYKVIKDICSHYDILFIADEVMTGLGRTGAWFAMEHWGVEPDIMTLGKGLGAGYTPMAATVVSDRVMEPILRGSRSVMSGHTLSANPLSAATALAVIEYMEKHNLPEKTAEKGEYLIKGLQKVQQQSTIIADVRGKGLLIGVELQPFTKASELISVAAKNGLLLYQAVSGQAGKEDSALLVAPPMTTTYSELDELLSIFAKSVEEMMQKGGHSIA

SEQ ID NO: 61626 - protein, 416 aa, Gracilaria gracilis
MAFVAPVSSVFSTSSKSAVCSGRSSFAQFSGLKKVNNTARLQTAEQGSAFGGVSDANDAFFNAVNTMGAPARTSNAPSMKVRVAINGFGRIGRNFIRCWAGRTDSNMDVVCINDTSGVKTASHLLKYDSILGTFDSDVVAGEDSITVDGKTIKVVSNRNPLELPWKEMEIDIVVEATGVFVDAVGAGKHIQAGAKKVLITAPGKGEGVGTFVVGVNDHLYSHDKFDIVSNASCTTNCMAPFMKVLDDEFGVVRGMMTTTHSYTGDQRLLDAGHRDLRRARSAALNIVPTTTGAAKAVALVVPTLAGKLNGIALRVPTPNVSVCDVVMQVSKKTFKEEVNGALLKAANGSMKGIIKYSDEPLVSCDYRGTDESTIIDSSLTMVMGDDMLKVVAWYDNEWGYSQRVVDLGEVMASQWK

SEQ ID NO: 61627 - protein, 296 aa, Clostridium difficile 630
MKLGFIGLGIMGKPMAKNLLKDGCNLLVYDINKSAVDELISCGAKYASVLEMGQECDIVFTILPNGTIVQDILFGMDGLAKTLKEGSIVVDMSSVTPTESILCANKLKDMGLEFIDSPVSGGEPKAIDGTLAFMAGGKEEIYKKVEPFFNIMGSSSILIGDNGSGSVTKLTNQVIVNLTIAAVSEAFVLAAKAGADPEKVYKAIRGGLAGSTILDAKIPMIMNRDFKPGGKISINLKDIKNVMQTAHNLDVPLPMTSQLLEIMQTLKVHGHLEDDHSGIAQYFEKLAGVEIKKHDN

SEQ ID NO: 61628 - protein, 91 aa, Glycine max
KMHKKETTICEEISTRGTEMHDKEIKMSYQRPSPCTDERAQCAECYTSTVHKPLKCAETVKRFETCVFTSIRGGVTTGDVHYTQSLGVWGE

SEQ ID NO: 61629 - protein, 496 aa, Populus trichocarpa
MNTIRQYQLPLQKYTAMMELEERNERLFYKLLIDNVEELLPVVYTPTVGEACQKYGSIFKRPQGLYISLKEKGKVLDVLKNWPQKSIQVIVVTDGERILGLGDLGCQGMGIPVGKLSLYTALGGVRPSACLPVTIDVGTNNEQLLKDEFYIGLRQKRATGQEYSELLHEFMTAVKQNYGEKVLIQFEDFANHNAFDLLAKYGTTHLVFNDDIQGTAAVVLAGLISALKLLGGSLADHTFLFLGAGEAGTGIAELIALEMSRRSKTPLEETRKKIWLTDSKGLIVSSRKESLQHFKKPWAHEHEPVKGLLEVVKAIKPTVLIGTSGVGKTFTKEVIEAMASFNEKPLILALSNPTSQSECTAEEAYTWTKGKAIFASGSPFDPVEYEGKVFVPGQSNNAYIFPGLGLGLVISGAIRVHDDMLLAAAEALAGQIKEEYLAKGLIYPPLSNIRKISVQIAANVAAKAYELGLATRLPRPENLVKHAESCMYSPAYRYYR

SEQ ID NO: 61630 - protein, 337 aa, Cochliobolus heterostrophus
MVVKVGINGFGRIGRIVFRNAIEHNDVDIVAVNDPFIEPHYAAYMLKYDSTHGQFKGDIKVDGNNLTVNGKTIRFHMEKDPANIPWSETGAYYVVESTGVFTTTEKAKAHLKGGAKKVVISAPSPDAPMFVMGVNHETYKPDIEALSNASCTTNCLAPLAKVIHDKYTIIEGLMTTIHSYTATQKVVDGPSAKDWRGGRTAAQNIIPSSTGAAKAVGKVIPELNGKLTGMAMRVPTANVSVVDLTVRIEKGASYDEIKQAVKEASEGSLNGILGYTEDDIVSTDLNGDNRSSIFDAKAGISLNKNFVKLVSWYDNEWGYSRRVLDLLVYIAKIDGNA

SEQ ID NO: 61631 - protein, 137 aa, Arabidopsis thaliana
  misc_feature (50)..(50): Xaa can be any naturally occurring amino acid
SRADHTRPENPKEEENHQVEVRASFMSSSTVGVTSRVKATMVVPLTGWKXSVFFRVTRRANTDFTSLTGNGGGVSCLKGWPPIGKKKFGTLSYLPDLRDVEWVKEVDYLFRTKGIPGVEFKWEHGFWYREHGTTPGS

SEQ ID NO: 61632 - protein, 429 aa, Fusobacterium nucleatum subsp. vincentii ATCC 49256
MEKLKLAKHLIKFIDESPSNYFACINTKNILNEKGFTELFETEEWKLKKGGKYFVTINDSGVIAFIIGSEKISKSGYKIAASHTDSPGFLIKPSPEINRKGFNILNTEVYGGPILSTWFDRPLSFSGRVFVEGDNAFKPKKYFINYDKDLFIIPSLCIHQNRGVNDGMAINAQKDTLPLVTITDDKEKFSLKKLLAKQLKVKEDKILSYDLNLYSREKGCLLGANEEFISVGRLDNLAALHAELMSLVDNKDKKNTCVVVGYDNEEIGSNSIQGADSPTLKNILERISNAMKLSFEEHQQALSNSFVISNDAAHSIHPNYLEKSDPTNEPKINGGPVIKMAANKSYITDGYSKSVIEKIAKDSKIPIQTFVNRSDVRGGSTIGPIQQSQIRILGIDIGSPLLSMHSVRELGGVDDHYNLYRLISEFFKI

SEQ ID NO: 61633 - protein, 164 aa, Zea mays
RPAGIIARSSLGLATPVLLTATASRSSCSASLALLLCCCTCESATAHREMSTVSRASLDQKLALAKRCSREATLAGAKAAAVATIASAIPTLASVRMLPWAKANINPTGQALIVSTVAGMAYFIAADKKILSLARRHSFEQAPDHLKNTSFQGTGRPHPAFFRP

SEQ ID NO: 61634 - protein, 521 aa, Mycobacterium avium subsp. paratuberculosis K-10
MTNSGEGPMQRAGSPERQGVSTSRSERLREVLRYDLPASLVVFLVALPLSLGIAIASDAPVLAGLIAAIVGGIVGGWLGGSPLQVSGPAAGLTVVVADVVAEFGWGVTCFITVVAGVLQVLLGFSRIARAALAISPVVVHAMLAGIGITIALQQVHVLLGGSSKSSAWSNVTGLPAQILGAHRPGLVLGLLVIAILVAWRWVPARLAIVPGPLVAIVVVTIISMVLPFKVSRIELDGSVLDAVRLPSLPHGNWGAVAIAVITVTLITSVQSLLTAVSIDRMHTGPRTDFNRELIGQGAANIASGALGGLPIAGVIVRSSANVNAGAKTRASTIMHGFWVLVFAVPFAGLVEKIPTAALAGLLIVIGIELLKPAHIETALRNGDLAIYLVTVTSVIFLNLLHGVLIGLLLAVVVTGWRVVRARIEAEPVGDGWHVVIEGACTFLALPRLTGVLASIPERTSVTVHLLTNYLDHAAHQAIGDWQRRHCATGGTVEVRDTAEPAARRRNSHLSLVEQVSSPGGA

SEQ ID NO: 61635 - protein, 185 aa, Shigella flexneri 2a
RPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPL

SEQ ID NO: 61636 - protein, 120 aa, Glycine max
  misc_feature (35)..(35): Xaa can be any naturally occurring amino acid
  misc_feature (56)..(56): Xaa can be any naturally occurring amino acid
  misc_feature (87)..(87): Xaa can be any naturally occurring amino acid
  misc_feature (108)..(108): Xaa can be any naturally occurring amino acid
GAKTSPFLRNTFGRAKEDPLVEDEDPGTNAQETFXNLAPFQDLGIFSSTNPSCINXTEIRAVQAIMGMLSSAVKACHCAAGKFLGRXIINHDKEPFLLLCFPQIHRRXCNIMSLPAQDVQ

SEQ ID NO: 61637 - protein, 457 aa, Zea mays
  misc_feature (136)..(136): Xaa can be any naturally occurring amino acid
  misc_feature (246)..(246): Xaa can be any naturally occurring amino acid
MPRTVAVVGAGAAGLVAARQLLREGLDVAVFEKSGRAGGTWAYDPRADADPLSRDPGSPSAVHGSLYASLRTNLTRDLMGFSDFPMAGWVFAGDARAFPGHQEVLAFLDAFAEECGVAARVRLRSEVLRVAGAPLXAAGAPLGQRERWAVSWRREDGEVAEEVFDAVVVCNGHCTVPRVPGIRGIDNWSGKQIHSHNYRTPEPFRDQNVVVVGFSTSGIDIASEISRLAKEVHVADRYSRDRLGKXALYQNVWIHASDPREQVDCIQDDGKVRFAEGSVVDADVILYCTGYRYHFPFLDLDGLTVDDNRVGPLYKHVFPPKYAPNLSFVGLPVKTIVFQELEQEAKWVAAVLSGRATLPSEEDMMASVRSHYQLMEEAGRPKRHTHALAAQWAEHMNWLADQVGEPPVEPWKCEVFDKVLASILALDEAYRDRWEQEEDGGSSGHQEGIRIRASSIM

SEQ ID NO: 61638 - protein, 287 aa, Mesorhizobium loti MAFF303099
MPEKTNRISFQGEPGANSDTACRNVYPSMEPLPCPTFEDAFNAVETGKADLAMIPIENTIAGRVADIHHLLPESRMHIVGEYFLPIHFQLMVLPGVKRDEIKTVHSHIHALGQCRKYIRKNGWKAVVAGDTAGAAKMISEVKDRTMAALSPALAATLYGLDIIEENVEDTDSNVTRFVVLTKSKQWAERPSPDVKMMTTFIFRVRNVPAALYKAMGGFATNGINMTKLESYQLGAFTATLFYADIEGHPDDPLVKLALDELRFFSREVRILGVYPASESREQWKVAD

SEQ ID NO: 61639 - protein, 468 aa, Escherichia coli
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEESALKGPSIMPGGQKEAYELVAPILTKIAAVAEDGEPCVTYIGADGAGHYVKMVHNGIEYGDMQLIAEAYSLLKGGLNLTNEELAQTFTEWNNGELSSYLIDITKDIFTKKDEDGNYLVDVILDEAANKGTGKWTSQSALDLGEPLSLITESVFARYISSLKDQRVAASKVLSGPQGQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRSAVLPANLIQAQRDYFGAHTYKRIDKEGVFHTEWLD

SEQ ID NO: 61640 - protein, 388 aa, Escherichia coli
MKITISGTGYVGLSNGILIAQNHEVVALDIVQAKVDMLNKKQSPIVDKEIEEYLATKDLNFRATTDKYDAYKNADYVIIATPTDYDPKTNYFNTSSVEAVIRDVTEINPNAVMIIKSTIPVGFTESIKERFGIENVIFSPEFLREGKALYDNLHPSRIVIGEQSDRAERFAALLQEGAIKQDIPILFTDSTEAEAIKLFANTYLAMRVAYFNELDSYAESLGLNSRQIIEGVCLDPRIGNHYNNPSFGYGGYCLPKDTKQLLANYQSVPNNLISAIVDANRTRKDFIADSILARKPKVVGVYRLIMKSGSDNIRASSIQGIMKRIKAKCVPVIVYEPAMKEDDFFRSRVVRDLDAFVQEADVIISNRMSADLADVADKVYTRDLFGND

SEQ ID NO: 61641 - protein, 176 aa, Triticum aestivum
  misc_feature (164)..(164): Xaa can be any naturally occurring amino acid
MEHKEAGCQQPEGPILCVNNCGFFGSAATMNMCSKCHKEMVMKEEQAKLAASSFDSIVNGGDGGKAPVVAAVAASAEVAVAQVDVKALVVQPAADVAGTSEAVAVSPKRKEGPNRCSTCRKRVGLTGFNCRCGNMYCSLHRYSDKHDCQFDYRTAARDAIAKGXTPVVKAEKLDKI

SEQ ID NO: 61642 - protein, 604 aa, Mesorhizobium loti MAFF303099
MSEGNSGPKSPENGKAAAYRVLARKYRPSNFSELVGQEPMVRTLTNAFATGRIAQAWMLTGVRGVGKTTTARILARALNYKTATVDQPSVDLAVLGEHCQAIMEGRHVDVIEMDAASHTGIDDIRDIIERVRYAPVSARYKVYIIDEVHMLSTQAFNGLLKTLEEPPPHVKFIFATTEIRKVPITVLSRCQRFDLRRIDAGALVAHLSSIAAKEGISVDDDALAMIARAAEGSARDSLSILDQAIAHGAGAVSAEAVRAMLGLADRARIVDLFEHVMKGDVAAALAEFRTQYDTGADPAAVLTDLAEFNHLVTRLRFVPTAMDDASLSQDERQRGADFARALSVRVLSRTWQMLLKGIPEVQSSNRPVSAAEMVLIRLAHAADLPTLDEALRSLDGAATVQNGASRPNGAPGGPGNGGGAGAVAQTRMPSGSSGAQTMRLVEAAPALAAFVAPPAPVSEPQQVPVRSLADIVALADAQRDIAFKVLVKRCIRPVRFEPGRIDVSLTDDAPKLLLNDLTTKLRAWTGRNWLVSLSKEEGGQTLAEMESTKRENAFLDAKSDPTVAAILARFPGAKIIDVRIPDAPEVDATEAEVPVEPPADDDET

SEQ ID NO: 61643 - protein, 531 aa, Archaeoglobus fulgidus DSM 4304
MREKIGFWEAVSIGIGGMIGGGIFAVLGLSVQLAKGSAPIAFLIAGIVALFTAYSYAKLSLRFPSEGGTIEFLIKAYGTGLLAGGLNILLLVSYVVMIALYSYAFGSYAANALGTPILKSFLIAFVVIFFTVLNSLGAVVSGRAEDLLVAFKLAVLVIVAAAGLAFVNPERLMPSNWADAVSIIAGGMIIFLAYEGFELIANAGGDVEHPKVLEKAFYVSVVVVIAVYVLIAIITVGTLPYEKIMEARDYALAIAAEPALGQLGFWFVTFAALASTSSAINATLYGTARASYMVAKFGELPEFVGKKLWRQAYEGLVVIPILSIILSITTNLETIATAGSGGFLLIFAAVNLAAVKLRRKVKVNPLISSAGAIMALAAFTILALRMAEENLYALAVMLSLIAASFLFEWTYRWYTGREIGRYVDRKLIEREKNLRNWEEWIPAVVDELRRRYSDSEVYLVGSLARGEAEKAGDVDLLVLTDAVENGEKEGITRDIKKKLELGPQHCLDLHFEKKSLRDEALKRAVSYRRLK

SEQ ID NO: 61644 - protein, 118 aa, Brassica napus
MASATGVSSSEMAVDHATGPGAVDKPRFDALTPNEMSGGRPQFRKVPVPQHRFAPLKRCWMEIYTPVYEHMKIDIRMNLKARRVELKTRQDTPDVSNLQKCADFVHAFMLGFDIADAV

SEQ ID NO: 61645 - protein, 443 aa, Lactobacillus plantarum WCFS1
MAEQYDVVVIGGGPAGNAMASGLKAQGKTVLIVEADLWGGTCPNRGCDPKKILLSAVEARQAAQHLQGQGLIGAPKIDWPALMAHKRGYTDGINDGTLNGLTGQDIATLHGQAHFQSDNQLAVGDRVVSATDYVIATGQRPAILPITGHEYFKTSTDFLDLDQMPKRVTFVGGGYVGFELATIANAAGADVHVIHHNDRPLKAFDADLVKDLMAAMTADGITFDLNTDVQAITKTATGLQLTADNFELTTDLVISSAGRIPNADQLGLANVGVTFDRHGIQVNDHLQTANPHIYAIGDVSDTPVPKLTPVAGFEARYLVGELTHPGAAIKYPVVPTQVFAAPKLAQVGISAAVATEHPDEYRVNTLDMTKWFTYYRFGAQQAQAKVVVAKASGQVVGATLLSDVADEMINYFTLLIEKHVTLPDLQRLVLAYPTPASDLQYLY

SEQ ID NO: 61646 - protein, 609 aa, Lactobacillus plantarum WCFS1
MAFSATTRQQNIERLQNETLDLLVIGGGITGAGVAIQSTAMNMKTGLIDMQDFAEGTSSRSTKLVHGGIRYLKTFDVGVVADTVKERAVVQGIAPHIPKPDPMLLPIYDETGATFDLFSVKVAMDLYDKLAEVKDPKFTNYTLSREEVLQREPQLNPKHLVGGGVYLDFRNNDARLVIENIKKAHENGGIMASHVKATGLLHDDDGRINGITAEDLLTGASFEIHARIVINTTGPWSDTIRKMDHTEKYQSQMRPTKGVHLVVDAEKLPVPQPTYFDSGDQDGRMIFVVPRENKTYFGTTDTDYHGDLKHPTVTQEDVDYLLEIVNRRFPTAKITLDDIEASWAGLRPLIAANGSSDYNGGNSGKISDKSFKEVIKVVDQFESQEASREDVESVLNDLETSLAEDKLSPSAVSRGSSLTSSPDGLLTLAGGKITDYRKMAAGAMALIAKILADKYDAHFNEINSKNLPVSGGDIDPHNVDATIAFYAKQGTDNGLTNDEALRIANMYGSNAARVFSLIGKVEPTHGLSLAETISLRYALDEEMTLTPVDYLLRRTNHLLFMRDTLDGLKDGVIATMADYLGWDAATVKAQTELLNQTIAESDLTALKQG

SEQ ID NO: 61647 - protein, 466 aa, Escherichia coli
MDQKLLTDFRSELLDSRFGAKAISTIAESKRFPLHEMRDDVAFQIINDELYLDGNARQNLATFCQTWDDENVHKLMDLSINKNWIDKEEYPQSAAIDLRCVNMVADLWHAPAPKNGQAVVTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61648 - protein, 466 aa, Escherichia coli
MDQKLLTDFRSEPLDSRFGAKAISTIAESKRFPLHEMRDDVAFQIINDELYLDGNARQNLATFCQTWDDENVHKLMDLSINKNWIDKEEYPQSAAIDLRSVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQAAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61649 - protein, 135 aa, Burkholderia vietnamiensis G4
MSYSNKVLDHYENPRNVGSFAKDDDAVGTGMVGAPACGDVMKLQIRVGADGVIEDAKFKTYGCGSAIASSSLVTEWVKGKTLDEALSIKNTQIAEELALPPVKIHCSILAEDAIKAAVADYKKRHDTKEGDQAAA

SEQ ID NO: 61650 - protein, 317 aa, Bacillus sp. SG-1
MKNGIISLGEALIDFIPLDQENISYQKSPGGAPANVSVGLARLGAKSTFLGKVGKDVLGEFLKDTLENYGVRTNQMFLTPDTRTGVVFVTNAEDGERSFDFYIDPSADRFLEAAEIDEADFTSHKILHFGSISMISSPAKEATHHAVKLAKENGMLVSYDPNLRLGLWDTEENARETIVTMLGKADFLKISEEELEFITGEKELDAGVEEMRKYNIPLMIITMGAEGCYVYTKDGHKHVPAMKVRAVDTTGAGDAFVSGMLYRLNELEGDIASLTVDQAGEMASFAAVSGALAASTKGAMTALPTLQEVKSHLKGDE

SEQ ID NO: 61651 - protein, 407 aa, Burkholderia vietnamiensis G4
MTQQTLHLPIYMDYSATTPVDPRVVDKMVPYLRERFGNPASRSHAYGWDAEHAVEEAREQVAALVNADPREIIWTSGATESDNLAIKGAAHFYKGKGKHIITVKTEHKAVLDTCRELEREGFEVTYLDVKEDGLLDLDVFKAALRPDTILVSVMHVNNEIGVIQDIATIGEICREKGIVFHVDAAQSTGKVEIDLAKLKVDLMSFSAHKTYGPKGIGALYVRRKPRVRIEAQMHGGGHERGMRSGTLATHQIVGMGEAFRIAREEMATENERIRMLRDKLLRGLSQIEETYVNGDMEHRVPHNLNISFNFVEGESLIMAIKDVAVSSGSACTSASLEPSYVLRALGRNDELAHSSIRFTVGRFTTEEEVDFVIDLLNSKIAKLRELSPLWEMHQEGIDLSTIEWAAH

SEQ ID NO: 61652 - protein, 466 aa, Escherichia coli
MDQKLLTDFRSELLDSRFGAKAISTIAESKRFPLHEMRDDVAFQIINDELYLDGNARQNLATLCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKEGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61653 - protein, 640 aa, Alteromonadales bacterium TW-7
MIQISEIELLRGGTALLKNASATLFPEHKVGLVGANGCGKSTLFGLLKSELQLDAGNCSIPKDWSIASVKQETPALEISAIDYVLQGHPEYYALRIALREAEQNNDGDTQAKVHIQLENMKGYSIESQAGELLHGLGFANNQIENPVSAFSGGWRMRLNLAQALIRNADLLLLDEPTNHLDLDAVYWLERFLRAYTGTLVLISHDREFLDAVVDQIWHIDKQLINVYKGNYSQFERQKAERLLQQQAMFEKQQEQIAHLEQFITRFKAKASKAKQAQSRVKALERMEKLAPAHADSPFNFEFAEPLALPNPLMTLDKAQAGYGNVTILNSIKLNLVPGSRIALLGRNGAGKSTLIKLLAGDLKPQAGDVFQHQGLNIGYFAQHQLESLDLKASAITHLQRLNPKASEQSLRDFLGGFAFIGDKALEPVAPFSGGEKARLVLAMLVYQKPNLLLLDEPTNHLDLEMRHALVMALQGFEGAMVTVSHDRHMLKNTADEFYLVDSGEVTQFGYELDDYYQWLLNANKAATKSEQADEPKANSGVNRKEQKRLEAEFRKAIQPLKKQIEKLEKQLDKYAAELSEVEVALGDNELYNDDNKARLKELIAKQATLTPKLNDIEEELLMALEEMEEKEQAFADELAQ

SEQ ID NO: 61654 - protein, 327 aa, Glycine max
MAPFAFATLPSSHICRLPKPTNLKFRVRCSTAASSPSSVSTRSKAAGFDLKTYWANLMVQINQKLDEAIPVQFPPQIYEAMRYSVLAKGAKRAPPVMCISACELFGGSRLAAFPTACALEMVHAASLIHDDLPCMDDSPSRRGQPSNHTIYGVDMAILAGDALFPLGFRHILSQTPSDLVPESHLLRVIAEIARSVGSTGMAAGQFLDLEGGPNAVGFIQEKKFGEMGESSAVCGGFLAGAEDDEIERLRRYGRAVGVLYAVVDDIIEEEIEKVYGVEKAIEKAEELRAKAKEELDGFEKHGERVFPLYSFVDYAFDRSFSVDDASG

SEQ ID NO: 61655 - protein, 337 aa, Phanerochaete chrysosporium
MPVKAGINGFGRIGRIVLRNALLHGDIDVVAVNDPFIDLEYMVYMFKYDSVHGRFKGSVEAKDGKLYVEGKPIHVFAEKDPANIPWGSVGAEYIVESTGVFTTTEKASAHLKGVCKKVIISAPSADAPMFVCGVNLDAYDSKYKVISNASCTTNCLAPLAKVIHDKFGIVQGLMTSVHATTATQKTVDGPSNKDWLGGRSVGNNIIPSSTGAAKAVGKVIPSLNGKLNGLAFRVPTVDVSVVDLVVRLEKPASYDEIKQAIKEASETTHKGILGYTEEKVVSTDFTGNDNSSIFDRDAGIALNKTFVKLISWYDNEWGYSRRCCDLLGYAAKVDGAL

SEQ ID NO: 61656 - protein, 495 aa, Pichia jadinii
SYDSFGDRVTIIVFGASGDLARKKTFPALFGLFREKQLPSTVQIIGYARSHLSDKDFKDYISSHFKGGDDKTKEDFLNLCSYISDPYDTDEGYKKLEARCQEYESKHNVKVPERLFYLALPPSVFHTVCEQVKKNVYPKNEKSRIIIEKPFGRDLETYRELQKQISPLFTEDEVYRIDHYLGKEMVKNLLVLRFGNELFSGIWNNKHITSVQISFKEAFGTEGRGGYFDNIGIIRDVMQNHLLQVLTLLTMERPVSFDPEAVRDEKVKVLKAFDKIDVNDVLLGQYGKSEDGTKPGYLDDSTVKPNSKAVTYAAFRVNIHNERWDGVPIVLRAGKALDEGKAEIRIQFKPVAKGMFKEIQRNELVIRIQPNEAIYLKINSKIPGISTETSLTDLDLTYSTRYSKDFWIPEAYEALIRDCYLGNHSNFVRDDELEVSWKLFTPLLEAVEKEENVKLESYPYGSKGPKELRKYLIDHGYVFNDPGTYQWPLTNTDVK

SEQ ID NO: 61657 - protein, 199 aa, Aegiceras corniculatum
KTLLGCFSRVDAEVAGVGMGNPVAPDAVGSTAVVAIVCPKHIIVANCGDSRAVLCRGKHAMPLSEDHKPNREDERERIEAAGGMVINWIGYRVSGFLAMSRSIGDRHLDPYVIPDPEITFVSRTKEDECLILASDGLWDVVKNDEACEIARKRILLWHKRNGNTILERGDGVDPAAQMQRIIFRSLLSRRSSDTSRDCG

SEQ ID NO: 61658 - protein, 139 aa, Aegiceras corniculatum
LSLKLSSSSLGLLNFCFDPLMEDVVKTGDHLTSVATFVKGGIQQACDDACSICLEEFIESDPSTVTGCKHEFHLQCILEWCQRSSQCPMCWQSINLKDPSSQELVDAIQREKSVRVRPSRNTTIFHHPTLGDFELQHQP

SEQ ID NO: 61659 - protein, 181 aa, Picea sitchensis
MEVGSADFPNARVAMGSPLAKSLYGIDGVARIFFGSDFITVTKSEEVSWDILKPEIFAAIMDFYSSGQPLFLDSKSGAPTDTAINEDDDETVAMIKELLETRIRPAVQDDGGDIEYCGFDPETGVVKLKMQGACSGCPSSSLTLKSGIENMLMHYVPEVKGVEQELDPEEDETAELANNME

SEQ ID NO: 61660 - protein, 445 aa, Alteromonadales bacterium TW-7
MNLSKNNKKVAVIERQETVGGGCVHWGTIPSKALRHSVSRYIEYKANPLFNIGERPSRLTFPDILRHASSVISKQSNLRSSFYDRNRIHMFQGDASFVDKHTVEVKRLDGSTERITAKTIVIATGSRPYRPPEVDFSHSRIYESDTILGLEHDPQRVLIYGAGVIGCEYASIFKGLGAKVDLVNTRDRLLAFMDAEISDALSYHFWNSGIVIRHNEEFDRVETRDDCVVMHLKSGKRVKADCILFANGRTGNTDTLNLEAIGLKADGRGQIKVNETYQTEVENVYAVGDVIGYPSLASAAFDQGRIAADAIACGNCDDKLIIDIPAGIYTIPEMSSVGKTEQELTAAKVPYEVGRAQFKHLARAQIAGTEVGSLKILFHTETKEVLGVHCFGERASEIVHIGQAIMEQKNGGNNIDYFVNTTFNYPTMAEAYRVAALNGLNRLFK

SEQ ID NO: 61661 - protein, 466 aa, Streptococcus pneumoniae R6
MDAKLRYKAKKIKIVFFDIDDTLRNSKTGFIPTTIPTVFKQLREKGILTGIASGRGIFGVVPEIRDLKPDFFVTLNGAYIEDKKGQVIYQHQIEKSYVEEYISWAKQEGIEYGLVGSHDAKLSTRTDMMSEAINPIYPDLDVDPDFHEKEDIYQMWTFEDKGDDLHLPDSLSDKLRMVRWHQHSSDIVPISGSKATGVEKVVEHLGLKPEKVMVFGDGLNDLELFDYAGISVAMGISHDKIKEKADYITKTLEEDGIFDALEVFGMVEKELHFPQVDIETVEGPLATIKTNHGDLRIKLFPEHAPKTVANFVSLSKDGYYDGVIFHRIIKDFMIQGGDPTGTGMGGESIYGESFEDEFSEELYNIRGALSMANAGPNTNGSQFFIVQNQHLPYSKKEITRGGWPEPIAEIYANQGGTPHLDRRHTVFGQLADEASYAVLDVIAAVETGAMDKPVEDVVIETIEIED

SEQ ID NO: 61662 - protein, 590 aa, Physcomitrella patens subsp. patens
MELEGDAQDGVGGYASNHRIGDGSGAGQQSGAAGSVAGEHPYGEHPSRTLFVRNINSNVEDTELKQLFEQYGAIRTLYTACKHRGFVMISYYDIRAARSAMRALQNKPLRRRKLDIHFSIPKDNPSDKDVNQGTLVVFNLDASVSNDDLRQIFGAYGEVKEIRETPHKRHHKFIEFYDVRSAEAALRALNRSDIAGKRIKLEPSRPGGARRSLLQQLNQESGDEDVRSRQQALSPLNTSPPMRAVLSGGSGLLYPSSNGNGSASGQQFSLWGGSGSSFSHISGSPPPVLWANPSSMGQAFNAIGQTQAQSHAYSSGMLASLSRHHVGSAPSGEPSLLERRHSYMGGESLVESGALMRSSSGTGLGGNAAHAMNIGGGSSQHGVMNMSSSVGGNCGMEHASSPNMGMMSPQNRARFLQNGGVLGTSSIEGLTDRGRSRRGESGSAQADNKKQYQLDLERIMRGEDLRTTLMIKNIPNKYTSKMLLAAIDEQHRGTYDFIYLPIDFKNKCNVGYAFINMTSPARIVPFYKAFNGKKWEKFNSEKVASLAYARIQGKAALVAHFQNSSLMNEDKRCRPILFHSDGPHIGDQVE

SEQ ID NO: 61663 - protein, 587 aa, Aspergillus oryzae
MKSSLFCILSSIVAANATSVPSFLARDSVSASLSSSASLSTSSSGACTGNTASTRDQWCNYDINTDYTTTIPETGVTREYWFDLEHVTVAPDGRSRFALAINGSIPGPTIEADWGDTVVVHVNNKLPSSVKNGTSIHFHGIRQYYTNPSDGVVSITQCPTASNSTITYKWRATQYGSTWYHSHIGLQAWEGVFGGIKINGPASANYDVDKGFIILNDWDINTVDQLFDSAQNDGPPELDSALINGMNVFGEDGYANQTGTRWNTSFTEGESYRFRLVNGACDTHFKFMIDNHTMTVIANDLVPIEPYNTSVLDIAMGQRYDIIVHADQASIAKNFWLRAIPQEACSENQNPTNIKGIVYYGSSPSTPTTTTGYSYTDACDDEDMSNLVPIVNPYTITSNPLYNESEPVSLGKNSQSLYRWKLNSTSMHVSWDDPTLLEIYRNHTSFSNTSGVVQLPRADEWAFVIIETTLSVPHPIHLHGHDFVVLSQGSGTYSAGDITTNNPPRRDTAMLPANGHLVIGFVTDNPGAWLMHCHIGWHTEEGFAIQFVERYSEIQDLIDYDSLHSNCQNWETYQSGKNFAIEDDSGV

SEQ ID NO: 61664 - protein, 530 aa, Lotus japonicus
MVEIEGSPGTSMHGVTGREQTFISSVSSPMVPTDTTAKFDLPVDSQHKAKVFKLFSLANPHMTTFHLSWISFFTCFVSTFAAAPLVPIIRDNLNLTKSDIGNAGVASVSGSIFSRLTMGVICDLLGPRYGCAFLIMLSAPTVFCMSFVNDAAGYIVVRFMIGFSLATFVSCQYWMSTMFNSKIIGLVNGTAAGWGNMGGGATQLIMPIVYELIRRAGSTGFTAWRIAFFIPGFMHVFMGILVLTLGQDLPDGNLSALQKKGDVAKDKFSKVLWYAITNYRTWIFALLYGYSMGVELTTDNVIAEYFYDRFNLKLHTVGIIAASFGMANLVARPFGGYVSDVAARLFGMRGRLWTLWILQTLGGVFCIWLGRANSLPIAVLAMILFSVGAQAACGATFGIIPFISKRSLGIISGLTGAGGNFGSGLTQLVFFSTSRFSTGAGLSWMGVMIVGCTLPVTLVHFPQWGSMFLPPSKDINKSSEEHYYTAEWDEEERKKGLHSQSLKFAENSRSERGKRVSSAPTPPNTTPTHV

SEQ ID NO: 61665 - protein, 73 aa, Physcomitrella patens subsp. patens
GAKAGFKAACIAFVASSIPTLTAVRMFPKVKASLNYTGQALIVSAASIASYFIVSDQTIHECSRKSSYAALEK

SEQ ID NO: 61666 - protein, 353 aa, Oculimacula yallundae
MGCGMSSEEKEGKQRNEEIENQLKRDKMLQRNEIKMLLLGAGESGKSTILKQMKLIHEGGYSRDERESFKEIIFSNTVQSMRVILEAMEQLELPLDDQRTEYHVQTIFMQPAQIEGDNLPPEVGNAISALWRDIGVQECFKRSREYQLNDSAEYYFNNIDRISLPDYMPDDQDVLRSRVKTTGITETAFIIGDLTYRMFDVGGQRSERKKWIHCFENVTTILFLVAISEYDQLLFEDETVNRMQEALTLFDSICNSRWFIKTSIILFLNKIDRFKEKLPISPMKNYFPDYEGGDDYSLACDYILNRFVSLNQHETKQIYTHFTCATDTTQIRFVMAAVNDIIIQENLRLCGLI

SEQ ID NO: 61667 - protein, 236 aa, Coccidioides immitis RS
MLLSRRACYKCGNIGHYAEVCSSSERLCYNCKQPGHESNGCPRPRTTETKQCYHCQGLGHVQADCPTLRLNGGATSGRCYNCNLPGHLARNCHNAGMQGAPRNVGGARGGFNAPFRGGYGGYPRAATCYKCGGPNHFARDCQAQAMKCYACGKLGHISRDCTAPNGGPLSSAGKVCYKCSQAGHISRDCPTNNTANTTTETNTQPTAETTAPAPPATETTTEAPQAPAAATTPAVA

SEQ ID NO: 61668 - protein, 138 aa, Arabidopsis thaliana
MTIAPALQTTFVSSTNFLKHSSSWGSPSPNNVILPKNKRSSSSVVVAAVGDVSSDGTIYLIGGAIAVALVGTAFPILFKRKGPVNHSHLFTLCPECDGAGFVRKGGVTLRANAARKDLPQIVCANCNGLGKLNQIDKS

SEQ ID NO: 61669 - protein, 353 aa, Oculimacula yallundae
MCFGGRDDGEAKRSREIDALIHRDEKVMQKVVKLLLLGAGESGKSTILKQMRLIYTKDGFTKNEKEEWRVIIFNNILDGLRMTLDAMEEFGIPFEFKNTDVHLPVILADKDLRPYEPIPVEYLRAFKDMWKDQGIQKAIKRGNEFALHDNLSYFFQDLDRLFNKEFVPTDQDVLRARLRTTGITETVFDLGSLQYRMFDVGGQRSERKKWIHCFENVNALMFLVAISGYDQCLAEDKDGNQMQEALMLWESIANSHWFKNSALILFLNKMDLFKEKIAISPITKFGFSDFQGDPRDPQQASKYFMDKFVALNRSPVREVYSHFTNATDTDLLKVTMASVQDMIIQKNLQKLIL

SEQ ID NO: 61670 - protein, 308 aa, Wolbachia endosymbiont of Drosophila simulans
MKIIIGNASKELGESVVNRLDVQPSSAWISKFTDGEVNVEVANDLYNQEVYIIQSLSPPVNDNLMELLLIIDAVNRLGAKRIVVIIPYYGYSRQDRIIKNNNMQSALSAKLVANLIQTAGASSVAVIDLHSSQIEGFFDVPITNLNCFEAFVDSIHTENLAIVAPDVGAIGRARAFAKTLEEKYKIGLSDKIIVVDKYREKAGTSQVMNIIGEVANKNCVIVDDIVDSGGTLCNAALALKSYGAKSVTSCITHGVLSGSAVEKISSSSLDKLVITDTILHKLEKTGKIEVVSVVNILTHFIQGGRNAS

SEQ ID NO: 61671 - protein, 93 aa, Zea mays
  misc_feature (75)..(75): Xaa can be any naturally occurring amino acid
MAAAGGGAGGKVSFKIILTSDPKLPFKVFSVPEAAPFTAVLKYAAEEFKVPPQTSAIITNDGIGINPQQSAGNVXELRLIPRDRVGAVVKSSG

SEQ ID NO: 61672 - protein, 399 aa, Glycine max
MASASASLLKSSLVLDKSEWVKGQTLRQPSAASVVRCNPTTPSGLTIRAGSYADELVKTAKTVASPGRGILAMDESNATCGKRLASIGLENTEANRQAYRTLLVTVPGLGQYISGAILFEETLYQSTTDGRKIVDVLLEQNIVPGIKVDKGLVPLAGSNDESWCQGLDGLASRSAAYYQQGARFAKWRTVVSIPNGPSALAVKEAAWGLARYAAIAQDNGLVPIVEPEILLDGEHGIDRTFEVAKKVWAEVFFYLAENNVLFEGILLKPSMVTPGAESKDKASPQTVADYTLKLLHRRIPPAVPGIMFLSGGQSEVEATLNLNAMNQSPNPWHVSFSYARALQNTALKTWGGRPENVKAAQDALLFRAKSNSLAQLGKYTGEGESEEAKKELFVKGYSY

SEQ ID NO: 61673 - protein, 355 aa, Colletotrichum lagenarium
MSRANAPNPSGSRKISFNVSEQYDIQDVVGEGAYGVVCSAIHKPSGQKVAIKKITPFDHSMFCLRTLREMKLLRYFNHENIISILDIQKPRSYETFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPKTSDLALDLLEKLLAFNPVKRITVEDALKHPYLEPYHDPDDEPTAPPIPEEFFDFDKHKDNLSKEQLKQLIYQEIMR

SEQ ID NO: 61674 - protein, 449 aa, Pyrobaculum aerophilum str. IM2
MLADLLKKGELTVAVYGLGYVGMALSAAWALAGAKVIGVDIDQAKVDKLNSGTVEYLEKDVVEVLTAAVKNGKFTATTDGVVASIRSHVKIVAVPVYLKKSATAIDVDFSALASAVKSIGAGLKKGDLVIIESSVPPGTTEEVVKPILEGASGLVAEEDFYLAYSPERIMVGHALKDIVENYPKIIAGVGPKSAEIAAGLYKHIARKGVIILESPREAEFEKLLEGVYRDVNIALANEMARLANALGISFKRAREAANSQPYSHVHKPGSGVGGNCIPVYPYFLMWTAAKYGIELPLTRLARLINERQPEEIAFSALRAMLKHGINPATAKITILGLAFRGDVDDVRESPTYYIITTLLKAGIKPTQIVVHDPYVKRDQLLAKWGVTLTQDLESAVKDAEILIVSTDHSVYKIEASKLLKLMKHPVIVDARGVLIPDAEIYSIDSGKWP

SEQ ID NO: 61675 - protein, 466 aa, Escherichia coli
MDKKQVTDLRSELLDSRFGAKSISTIAESKRFPLHEMRDDVAFQIINDELYLDGNARQNLATFCQTWDDDNVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVAMRIMCRRGFEMDFAELLLEDYKASLKYLSDHPKLQGIAQQNSFKHT

SEQ ID NO: 61676 - protein, 382 aa, Pseudomonas putida GB-1
MIRSKLPNVGTTIFTTMSQLAVQTGALNLSQGFPDFNGPQALLDAVGRHVAAGHNQYSPMTGLPALRQQVAAKVERLYGARVDADQEVTITPGATEAIFCAIQAVVHAGDEVIVFDPCYDSYEPSVELAGGRCVHVQLSDGNFRIDWQKFSDALSPRTRMVILNSPHNPSGALITREDLDQLAKLVADRDIYLVSDEVYEHLVYDGVRHASVLAHEQLYQRAFVVSSFGKTYHVTGWKTGYVIAPPALSAELRKVHQYVNFCGVTPLQCALADFMAEHPEHIDELPAFYQAKRDLFCGLLEGSRFSFARTAGTYFQLVDYSQIRPDLNDVDMSLWLTREHGVATIPVSVFYQQPIPEQRLVRLCFAKREETLRQAAERLCAI

SEQ ID NO: 61677 - protein, 429 aa, Pseudomonas fluorescens PfO-1
MREELNQGLIDFLKASPTPFHATASLVQRLEAAGYVRLDERETWHTEANGRYYVTRNDSSIVAIKMGRNSPLHDGIRLVGAHTDSPCLRVKPQPELQRQGFWQLGVEVYGGALLAPWFDRDLSLAGRVTFRRDGKVESQLIDFKAPIAIIPNLAIHLNREANQGWAINAQTELPPILAQFAGDERVDFRAVLTDQLAREHGLNADVVLDYELSFYDTQSAAVIGLHGDFIAGARLDNLLSCYAGLQALLNADTEETCVLVCNDHEEVGSCSACGADGPMLEQTLRRLLPEGDEFVRTIQKSLLVSADNAHGVHPNYAEKHDANHGPKLNAGPVIKVNSNQRYATNSETAGFFRHLCMAEEVPVQSFVVRSDMGCGSTIGPITASNLGVRTVDIGLPTFAMHSIRELCGSHDLAHLVKVLSAFYASRELP

SEQ ID NO: 61678 - protein, 310 aa, Erwinia carotovora subsp. atroseptica SCRI1043
MTTTNIAVIGECMIELSQKGTDLNRGFGGDTLNTAVYIARQVNADKLGVHYVTALGTDSFSTEMVAAWQKEGVKTDLIQRLDNKLPGLYFIETDDSGERTFYYWRNDAAARYWLDSPEAEKIGQGLAQFDYLYLSGISLAILNAESRQRLLALLRACRANGGKVIFDNNYRPRLWQSKEETQQSYTDILSCTDIAFLTLDDEDMLWGTKPLEAVLERTHGLGVNEVVIKRGADSCIVSERGQALVDVPAIKLSKEKVVDTTAAGDSFSAGYLAVRLNGGSTQEAAQRGHLTASTVIQYRGAIIPLEAMPA

SEQ ID NO: 61679 - protein, 144 aa, Brucella suis 1330
MNPDIKEASGACHCGTVRFRVKLSDGLHSARRCTCSYCRMRGAVAVSADLDGLEILEGEDALTLYTFNTGTAKHFFCSKCGIYTFHQRRSNPRQFGVNAACLEGVSPFDFKVIPVNDGINHPSDNPDQTGSCIIGYLYYKSEIT

SEQ ID NO: 61680 - protein, 217 aa, Triticum aestivum
VYTIATDGSPFRPELLTPWMVATLIDFYVNVIAISAWVIYKEANWISSAVWVVLLVCFGSAATCAYIVKKLFEVTSAGSSQDPLDLLFIRQGNLSQRKCSYIVIGRVIFSILGIFMVAVVTYTVITDGLPFRKELLTPWMAATLIDFYINIFAISVWVTHKESSWISTTIWIVLLICFGSITTCGYIVLQLFKVSYQDPIYHVLLNSHSKYGISTSL

SEQ ID NO: 61681 - protein, 466 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKGGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61682 - protein, 480 aa, Glycine max
MVKICCIGAGYVGGPTMAVIALKCPSIEVAVVDISKSRIAAWNSDQLPIYEPGLDGVVKQCRGKNLFFSTDVEKHVFEADIVFVSVNTPTKTQGLGAGKAADLTYWESAARMIADVSKSDKIVVEKSTVPVKTAEAIEKILTHNSKGIRFQILSNPEFLAEGTAIKDLFNPDRVLIGGRETPEGQKAIQALKDVYAQWVPEERILTTNLWSAELSKLAANAFLAQRISSVNAMSALCEATGANVQQVSYSVGTDSRIGPKFLNASVGFGGSCFQKDILNLVYICECNGLPEVAEYWKQVIKINDYQKSRFVNRVVASMFNTVSNKKIAILGFAFKKDTGDTRETPAIDVCQGLLGDKANLSIYDPQVTEDQIQRDLSMNKFDWDHPIHLQPTSPTTVKKVSVVWDAYEATKDAHGLCILTEWDEFKTLDYQRIFDNMQKPAFVFDGRNIVDADKLREIGFIVYSIGKPLDPWLKDMPALA

SEQ ID NO: 61683 - protein, 590 aa, Burkholderia vietnamiensis G4
MSLIEVKVPDIGDFSGVDVIEVNIKPGDVIEKEQTLLTLESDKASMEVPSDIAGTVKEIKVKAGDKVSQGTVIALVEASTGAAAPAPAKAPEAPKPAAAAPAPAAAAPAPAPQVGSYGGSADIECDMLVLGAGPGGYSAAFRAADLGMKTVLVERYSTLGGVCLNVGCIPSKALLHTALVVEEAAALASHGITFGKPEVDLDKLRDFKGGVVKKLTTGLAGMAKARKVEVVTGIGAFVDPFHMEVQGDNGKKVVKFKQAIIAAGSQAVKLPFMPEDPRVVDSTGALELRQLPKRMLVIGGGIIGLEMATVYSTLGAEIDVVEMMDGLMMGADRDLVKVWEKFNAKRFGNVMLKTKTVGAQAKEDGIYVKFEGEKAPAEAQRYDLVLVAVGRSPNGKKIGADKAGVAVTERGFIDVDKQMRTNVPHIFAIGDIVGQPMLAHKAVHEGHVAAEAAHGEKAYFDALQIPSVAYTDPEVAWAGKTEDQCKAEGIKYGKAVFPWAASGRAIANGRDEGFTKLIFDEATHRVIGGGIVGLNAGDLISEVCLAVEMGADAEDIGKTIHPHPTLGESVGMAAELYEGVCTDLPPQRKK

SEQ ID NO: 61684 - protein, 546 aa, Burkholderia vietnamiensis G4
MSQAIEVKVPDIGDYKDVPVIEVLVKVGDTVEPEQSLVTLESDKATMDVPSPAAGTVKEVKVKVGDAVSEGTLIILLEGGAAAQANGAAAAAAAPAPAAAPAAAAPAAAPAASGGTLEVKVPDIGDYKDVPVIEIGVKIGDTVEKEQSLVTLESDKATMDVPSPAAGVVKDIKVKVGDAVSEGTLIVLLEAAGAAAPAVAPASAPAPAAAAPAPAAAPAPAPAASAPAAAAPAAAPSGEYRASHASPSVRKFARELGVDVARVSGSGPKGRITKDDITGFVKGVMSGQRAAPGAAAAPAGGGELNLLPWPKVDFAKFGPFEAKPLSRIKKISGANLHRNWVMIPHVTNNDEADITELEALRVQLNKEHEKAGVKFTMLAFVIKAVVAALKKFPTFNASLDGDNLVFKQYYHIGFAADTPNGLVVPVIRDADKKGLVDIAKEMAELSKAARDGKLKPDQMQGGCFSISSLGGIGGTHFTPIINAPEVAILGLSRGQMKPVWDGKQFVPRLTLPLSLSYDHRVIDGAEAARFNAYLGALLADFRRIIL

SEQ ID NO: 61685 - protein, 175 aa, Triticum aestivum
  misc_feature (56)..(56): Xaa can be any naturally occurring amino acid
MARHIQADHEPADDSGGAAGAALVLWDCGSALYDSYELTAFKRQLDAAVLAGRSLXMPHLPAASPAVQPAGRRKRARRLPALLRRLFSKVLRLASARGARHDRYRAYEGYGHGGYSGTGSPWSGALTSIPEESGGSPEAGSSPVVPGPSALRRAQSERFIGSKTATPMVQFDVVL

SEQ ID NO: 61686 - protein, 448 aa, Chromobacterium violaceum ATCC 12472
MSNQAWLERSFAAVWHPCTQMKRHERLPIVPIASADGVWLTDFDGKRYLDGVSSWWVNLFGHGHPRIKQAVRKQLDSLEHVMLAGFTHRPVVELSERLAALSGLGHAFYGSDGASATEIALKMSFHYWKNVGRPQKTRFVSLENSYHGETVGALAVTDVPLFSSTYAELLKPGLRAPSPDARQAVPGERAADVALRAARSLENLLAKHGGEIAAVIVEPLVQGAAGMAMHDPIYLTELRRLCDQYQVHLIADEIAVGFGRTGSFFAYQQAGITPDFLCLSKGITGGFLPLSCVLTRDEIYQAFYHDDVARGFLHSHSYTGNALACAAALAVLDIFDDEDVLEANRVKAEGFTRQMRPLAERPEIRHFRQRGMIWAFDVDTARSDFALAYFSAMLNRGCLLRPIGKSVYFMPPYTLKSEEMDWLASASVDALDEVLAGESVGGDPTALP

SEQ ID NO: 61687 - protein, 547 aa, Lentisphaera araneosa HTCC2155
MILDKHPFITQRPGPVVLCILDGVGYSDHTEGDAYKAAHTPNLDWLHTNCQNRPLNAHGTHVGLPSDADMGNSEVGHNAIGGGRIVAQGAKLVNTALSTGALFEGEIWRKLSGNVREKSSTLHFIGLFSDGGVHSHLDHLKAMVEQARKEGIKSIRFHILLDGRDVSETSALDYVLPFEDYLTSLNAEGVSAKIASGGGRMTITMDRYGAEWDMVERGWNTHVHGEGRQFASAEEAIKTFREEDGFIDQYLPAFVVAENGQPVGRICSGDSVIFYNFRGDRSIEISQAFEDDEFPNFDRGDRPDVEYSGMMEYDGDDHIPKQYLVAPPAIDQPMCEFLSANGVGQLAISETQKYGHVTFFFNGNRSGKFDDKVEDFIEIPSDVGGYDLRPWMKAVEITDYLVPAICENRQPFVRVNYANGDMVGHTGNFNAARMAVEVVDVQVGRLMAAVKKANGVLLVTSDHGNCDEMFEFDKKGEVKRGENGKAKAKTSHTLNKVPFIVYDPASRNEFSLSEVQDAGLSHIAGTVFNLLGFQAPDVFNRTLLEKK

SEQ ID NO: 61688 - protein, 218 aa, Triticum aestivum
  misc_feature (201)..(201): Xaa can be any naturally occurring amino acid
  misc_feature (204)..(204): Xaa can be any naturally occurring amino acid
  misc_feature (212)..(212): Xaa can be any naturally occurring amino acid
MAQREERREGGRGEGRGRGGRGFGRGRDAKGGKRGPVEEEWTPVTKLGRLVNQGLVEKIEEIYRFSLPIKESQIIDRLLKDKLKEEIMKVQPVQKMTTAGQRTRFKAVVLVGDSEGHLGLGVKVSKEVQGAVKGAIIDAKLNMIPIRRGYWGNKIGNPHTVPTKVTGKCGSVRVRLVPGPRGSGIVAAPAPKKVLQMAGIXDVXTSSRGCTXTRENFP

SEQ ID NO: 61689 - protein, 399 aa, Clostridium difficile 630
MLHMISNKMQTLVANSSVIRAMFEEGKKLSDIYGEENVFDFSIGNPSVEPPETIKAVINDILNEESPNLVHGYMNNSGYEDVRDAIAEHINKKDGLNLTRENLIMTCGAAGGLNIILKTLLNPGDEVIAFAPYFGEYKNYTENYDGKLIEVPTNIETFEPDLDALKNAITPKTRALIINTPNNPTGVIYSEELLKNLGELLDSKQKEFNTSIYLISDEPYREIIYDGAKVPCVLKYYRNSFIGYSYSKSLSLPGERIGYIVANGQMDDFDDVMSSLNVANRILGFVNAPSLFQRVIARSLDAEVDVNIYKKNFDLLYNSLIDMGYSCVKPNGTFYLFPKAPIEDDKKFCNDAKQFNLLLVPGSSFGCPGHFRVSYCVSYDKVKSSLPAFEKLAKLYNLK

SEQ ID NO: 61690 - protein, 395 aa, Streptococcus pneumoniae R6
MKLSNRVLEMEESVTLAAGARAKALKAEGRDILSLTLGEPDFTTPKNIQDAAIASIRDGRASFYTVTSGLPELKAVVNSYFERFYGYSVASNQVTVAAGAKYSLYTFFMAVVNPGDEVIIPTPYWVSYGDQVKMAEGVPVFVSAKEDNHFKVTVEQLEAARTDKTKVLVLNSPSNPTGMIYTREELLAIGNWAVENDILILADDIYGRLVYNGHEFTPISSLSEAIRKQTVVINGVSKTYAMTGWRIGYAVGEADIIAAMSKIAGQTTSNPSAVAQYAAVEALSGEQDTVESMRQAFEERLNTIYPLLAEVPGFEVVKPQGAFYLFPNVKKAMEMKGYTDVTDFTTAILEEAEVALVTGAGFGAPENVRLSYATDLDTLKEAVERLKAFMGSEND

SEQ ID NO: 61691 - protein, 358 aa, Alteromonadales bacterium TW-7
MSKTNYSVAVLAGDGIGPEVMAAAEQVLDAVSNKFGFTLNREHHAIGGAAIDEFGEALPPKTLSACENADAILFGSVGGPKWENLPPNEQPERASLLPLRKHFGLFCNLRPAQLLPALSAASPLRADISEKGFDILCVRELTGGIYFGEKGRGGEGEEEFAFDTQNYSRKEIERIARFAFEAAKLRSNHVTSVDKANVLASSVLWREVVTEVSKDYPEVSLDYIYVDNAAMQLVKQPSQFDVLLCDNLFGDILSDECAMITGSMGLLPSASLNQSGFGLYEPAGGSAPDIAGKGVANPIAQILSAALMLRYSLGQDEAARTIEKAVAEAVEAGVGTPDIYPQGGYSTSDVAAAIVSRI

SEQ ID NO: 61692 - protein, 504 aa, Aspergillus oryzae
MTRTQIHKVAVIGAGISGVVSAGHLLAAGFDVTVFERNKVAGGVWYVSCGIFGMAQKLTEDRLYDERQPIEPQYPATKPSETDQPAKDRHQKERFCSPCYESLRNNVPTPLIRVKLNAWPEGTPDFVSHDVIKEYIQDTSRKARVDDVTIYGARVKDLRKRGDKWEVFWSTVGENDQSDMVVELEEISVFDAIIVASGHYHAPRIPDIPGLSEAKTHWASRIMHSKGFRKSQGFENKNVLLIGGGVSSADIAKEIGPVAKTVYQSTRNGDFDLPASLLPDNGVRIGEVSHFEIDRSQDTVSDDEPLPLTIHLKSGQKLCGIDRVIICTGYHITLPFLRDYHSDHTPAELADEKILVTDGTQVHNLHKDIFYIPDPTLAFIGVPYYTATFTLFEFQAIVATQVFAGIAQIPPADVMRLEYLAKIKEVGSGKKFHSLKDKEEFYVRDILQWVNEDRATYGLGPLEGHSTQWLEAKEEHRKRIEGLWQSTGRRDSGVGELPVLAVCS

SEQ ID NO: 61693 - protein, 390 aa, Burkholderia xenovorans LB400
MNAPHDTPTSPTFPSRLPNVGTTIFTVMSALAAEKGAVNLGQGFPDFNCDPRIVDAVANAMREGHNQYPPMAGAAPLRQAISDKIANLYGRRYDATTEITVTAGATQALLTAILCSVHPGDEVVVVEPTYDSYLPSIELAGGKPVFVTLEAPDYAIPFDRLAAAITPKTRLLLINTPHNPTGTVWREQDMRKLEEIVRGTNVLILSDEVYEHMVYDGAPHESVARYPELAQRSFVVSSFGKTYHVTGWKVGYVAAPAALTVEFRKVHQFNVFTVNTPMQIGLADYMKDPAPYLDLPAFYQKKRDFFRAGLANSRFRLLPCTGTYFQCVDYSAISDLPEAEFAQWLTGEIGVAAIPVSAFYHEAHESGVVRFCFAKQESTLATALERLARL

SEQ ID NO: 61694 - protein, 600 aa, Lentisphaera araneosa HTCC2155
MFDILLKHSGNLKNDVLAGLTAVLTLIPEAVAFTFVAGIDPMMGLYGSFFIGFITAVFGGRPAMISGAAGSMAVVTTAFIIMFGIEYLLAAVVLTGILQVLFGAFKMGKFIRLLPHPVMLGFVNGLAIVIGMAQFGQFKENTRVVYDKQNDMFTYAGDWMALTSPAMLTMMGMIVLTMLIVHFLPKFTKAIPAPLAAIVVCTLLATFTPLKDHSKRVSDVVFGQRTSMTEKEIITDNFDAKKETVLHREYVNAAEATVVTGTTPEQVQQRWEQNQTKLIAEGKKVEADALDGSLKGRLPSFHLPNIGWDMSNPENRDKAVKVFILALILASVGLIETLMTMSLIDEITETRGQGNRESVAQGSGNIVSGLFGGMCGCAMIGQSVICLNSGGRGRASGIATAIFMLIFILFAPQLIEMIPVASLIGVMFMVVIATFEWSSLRLFGKIPKSEILIIIIVSAVTVFLDLAVAVGIGIIISALIYAWNSAKEIKIKVAAQSDDEKTYSVSGNIFFGSITSFKELFDPSNDPKDVYIDFADSKVCDHSGIEAVHGLSERYKAAGKVLHLRHLSPECAKLLKKAGDIVEVNILEDPKYHVADDALA

SEQ ID NO: 61695 - protein, 921 aa, Daucus carota
SLSSAISPSSYAAIAAAYSARTPIFNKKKTAAVLSPLSLFHQSPSLSKTGIFLHRGRKESSSKFYIAASVTTAVPSLDDSVEKVHLPRGAMWSIHKFGGTCVGSSERIRNVAEIVVEDDSERKLVVVSAMSKVTDMMYDLIYKAQSRDDSYESALDAVMEKHKLTAFDLLDEDDLARFLTRLQHDVITLKAMLRAIYIAGHATESFSDFVVGHGELWSAQLLSFVIRKNGGDCNWMDTRDVLVVNPAGSNQVDPDYLESEKRLEKWFSSNQCQTIVATGFIASTPQNIPTTLKRDGSDFSAAIMGALLRAGQVTIWTDVNGVYSADPRKVSEAVVLKTLSYQEAWEMSYFGANVLHPRTINPVMRYDIPIVIRNIFNLSAPGTMICRESVGETEDGLKLESHVKGFATIDNLALINVEGTGMAGVPGTATAIFGAVKDVGANVIMISQASSEHSICFAVPESEVKAVAKALEARFRQALDAGRLSQVANNPNCSILATVGQKMASTPGVSATLFNALAKANINVRAIAQGCTEYNITVVLSREDCVRALKAVHSRFYLSRTTIAVGIVGPGLIGATLLDQLRDQAAILKENSKIDLRVMGITGSRTMLLSETGIDLSRWREVQKEKGQTAGLEKFVQHVRGNHFIPSTVIVDCTADSEVASHYHDWLCRGIHVITPNKKANSGPLDQYLKLRALQRRSYTHYFYEATVVAGLPIITTLQGLLETGDKILRIEGIFSGTLSYIFNNFKSTTPFSEVVSEAKAAGYTEPDPRDDLAGTDVARKVIILARGSGLKLELSDIPVQSLVPEPLRGIASAEEFLLQLPQFDSDMTRKREDAENAGEVLRYVGVVDAVNQKGVVELKRYKKEHPFAQLSGSDNINAFTTERYNKQPPIIRGPGAGAEVTAGGVFSDILRLASYLGAPS

SEQ ID NO: 61696 - protein, 290 aa, Physcomitrella patens subsp. patens
MQEAEEPVPNIDEHDVGNQLAVVDYIEDIYSFYRKTEVQSCVPADYMSRQSDINEKMRAILIDWLIEVHLKFKLMPETLFLTTNLIDRYLCVQSVSRKNLQLVGVTAMLLAAKYEEIWAPEVNDFVHISDNAYTREEVLNMEKNMLNTLKFNLTVPTPYVFIVRLLKAAACDKQEKSSPTQLEMVAWFLVELCLTEYPMIKYAPSQLAAAAVYTAQVTLARQPRWGPALQRHSGYSEAHIKECACMMATLHSKANEGNLTVVHKKYSLAKLLAVAKLPHAASLCSPQTSS

SEQ ID NO: 61697 - protein, 392 aa, Oryza sativa Japonica Group
MARSPAARKPSAAQTVAVTLALALASAGLLFLLFHLSPSSPTPHPHPHRRLRLRGARASPSPRGQIPFDPVIAGLERRRDDREWERLAAAGLHAPGFEAAPVPEDYIDGGGGFGADPDEDYINDAARFNLTRRVEALFPKIDVDPADGAVTPAELTAWNLASARREVMHRTARELDLHDRDHDGRIAFSEYERPSWAWRFDDHNSSNDGVGWWKEEHFNASDMDVFSLVYFVQLLTSSRYYEPKANKLVVQRRSQVGDSTGYSLESRERDKDNDGKLNFQEFYNGLFYSIRHFDEEASTDDSNASDAPARKSFTHLDLDNDGLLSADELKPIIGNLHPPEHFYAKQQADYVITQADTNKDGQLSLQEMIENPYVFYSALFTEDDYGFHDELR

SEQ ID NO: 61698 - protein, 302 aa, Oryza sativa Indica Group
MDRYQRVEKPRNETPISENEIRITAQGRMRNYISYGMSLLEENGHDEIVIKAMGRAINKTVMVVELIKRRIGGLHQITSTESIDITDTWEPLEEGLLPLETTRHVSMIAITLSKKALDTLSPGYQPPIPAEEVRPAFDYEHEAQPFDDKFLHGNLESFPANRGRGRGGGRRGRGRAMSNGPPAYDYGEEWEEEGDYYNYRGRGRGRFRGRGRGRGRGGYYGGGRRGGYGYDYGYGGRGDYYEDQGEYFEEPEDYPPPGRGFAISLLMAPLILGRLHRTWQGKKGRRTGTIPWSRPWAWSILR

SEQ ID NO: 61699 - protein, 104 aa, Zea mays
DVGPDAPKPFKEALAPPKPVIWTAPMGVFDFEKFPPAPEAIPKKLVELPPPRGVIPIMGGGDFVLPVEKAGLPPKMSPISPGGGGSLELLEGKTFPGVLALEDP

SEQ ID NO: 61700 - protein, 200 aa, Ehrlichia chaffeensis str. Arkansas
MKLKTIMSKCEFMIGATHIKSLPDFSIPEIAIAGRSNVGKSSLINAITNNKKNAKTSSKPGCTKQINFYLINKDFMVLVDLPGYGYSKADKTTINNYLCLMEYYLLNSRNLLKVILLIDAKVGFKEIDLDFINWLELHQIHYQLVLTKIDKIKKEMLDVNVNYIKNLNLDFIMYPIISTSSQCKQGIEELIYEIAQCIKK

SEQ ID NO: 61701 - protein, 558 aa, Glycine max
DLPLLLVGYGFGASFVALFAQLGGGIYTKAADVGADLVGKVEQGIPEDDPRNPAVIADLVGDNVGDCAARGADLFESIAAEIISAMILGGTMAQRCKIADPSGFILFPLVVHSFDLIVSSAGIFSIRGTRETGVIVPVEDPMTILQKGYSFTIVLAVLAFGLSTRWLLYTEQAPSAWFNFALCGLIGIITAYIFVWIAKYYTDYKHEPVRILALSSSTGHGTNIIAGVSLGLESTALPVLVISVSIISAFWLGHTCGLVDETGNPTGGLFGTAVATMGMLSTAAYILTMDMFGPIADNAGGIVEMSQQPESVREITDVLDAVGNTTKATTKGFAIGSAALASFLLFSAYMDEVSSFAHEPFKQVDIAIPEVFVGGLLGSMLIFVFSAWACSAVGRTAQEVVNEVRRQFIERPGIMDYKEKPDYGRCVAIVASASLREMIKPGALAIISPILVGIVFRILGYYTGQPLLGAKVVAALLMFATVTGILMALFLNTAGGAWDNAKKYIETGALGGKGSEAHKAAITGDTVGDPFKDTAGPSIHVLIKMLATITLVMAPVFL

SEQ ID NO: 61702 - protein, 136 aa, Mycobacterium tuberculosis H37Rv
MTRPKLELSDDEWRQKLTPQEFHVLRRAGTERPFTGEYTDTTTAGIYQCRACGAELFRSTEKFESHCGWPSFFDPKSSDAVTLRPDHSLGMTRTEVLCANCDSHLGHVFAGEGYPTPTDKRYCINSISLRLVPGSV

SEQ ID NO: 61703 - protein, 292 aa, Triticum aestivum
MEGKEEDVRLGANRYSERQPIGTAAQGGGADEKDYKEPPPAPLFEAEELTSWSFYRAGIAEFLATFLFLYISVLTVMGVVGNPSGSKCGTVGIQGIAWSFGGMIFVLVYCTAGISGGHINPAVTFGLFLARKLSLTRAVFYMAMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 61704 - protein, 263 aa, Wolbachia endosymbiont of Drosophila simulans
MLDETTKNLLIVEVNKLLPENSENKLISAMRYILLAPAKHIRSFLVVASSRVFNAEAKKVISVAAAIEFVHAYSLIHDDLPCMDNSDTRRSQLSCHKKFDEATAVLAGDALLTLAFEVLSSLNEKRCEIIKVLSQAIGIRGMVGGQALDIDTDFNKIKEIHLMKTAKLFAASCEIGAIIGGATDEQRRALYNFGINLGLIFQAKDDIEDYEQDKTNNLMSVLGKSEVEDYIDGLFKQGLDNLSALSGDTNYLYDLLNQVKKDG

SEQ ID NO: 61705 - protein, 432 aa, Saccharomyces cerevisiae
MCEHQLTQEDLEFDKKHIWHPYTSITTPLKVYPVTKAEGSYLYLDNGTKVVDGMASWWCVQQGYNNHRLNAAAISQINKMSHVMFGGITHKAGIDFCKKLLALLPDTLECALLADSGSISVDIAMKMALRYHHSLGNTTKKRFLTIKKGYHGDAFGAVSVCDPVNSRHNTYNGFLAENIFCKAPEVRFDCREKDVEKLVEELDVKPFAEIIDKHHSEISGVVMESIVQGAGGLRMYHPYFLKRVRALCNDFNILLILDEVAVGLGRTGMLFGFEHAGIVPDIVCLGKTLTAGYLTLSATVTTREIGDQISSGPEGCFMHGQTYMANPLACAVASENLSILMEGKWKSQVRQIEVQLKKELVPLLEHPIVADVRILGAIGVVEVTKRVNVEVLQEQFIKAGAWIRPFGNIIYILPPYIITSEELTVLTEAIRS

SEQ ID NO: 61706 - protein, 232 aa, Zea mays
MSEAAVRVIGLWPSPFVIRVLIALKLKGVEFEFVEEVVGRKSELLLTSNPVHKKIPVLLHHGKPISESLIIVQYIDEVWSSGAPAFLPVDAHARAVQRFWAQYVDDKLPWAIRILKGTDDGGMEQAAGQLSAALQLLEEAFAQLSQGKRYFGGDSVGYLDIALVSHVGWVKAVEKIAGVTLLDKAKVPNLVAWADRLCAHPAVVDAIPDADKFVEFSVTYGSFSKPINAPAK

SEQ ID NO: 61707 - protein, 506 aa, Brucella suis 1330
MVMSTIVKPQPLTGLEVREFSMLIDGKWVGSDSGKSIERVAPGHGVTVSRYPAGNKADVERAVSAARKAFDDGRWSSTTASQRSLVLLKAADLIEARAEELAYLDAIEAGKPISQVRGEISGSVDIWRYAAALARDLHGESYNTLGDGTLGVVLREAIGVVSIITPWNFPFLIVGQKLPFALAAGCTAVVKPSELTSGSTLLLGEILAEAGVPDGVVNIVTGTGADVGQHMSTHPHVDMVSFTGSTGVGKLTMANAAQTLKKVSLELGGKNPQILFPDADMDAFIDAAVFGAWFNAGECCNAGSRLIVHRSVVDAIVGRVADLSKKVIVGDPLDASTQVGAIITPQHLTKVGAYVDQARKAGAAIAHGGEVLDLGLGQYMGPTILAGVKADMAVAREEVFGPVLSVLSFDTVEEAISIANAVDYGLSAGVWSRDFDTCMTIGRKVRAGTVWMNTFMDGTPELPFGGYRQSGLGRELGRHAVEDYTETKTLNMHIGARTGWWMPQAK

SEQ ID NO: 61708 - protein, 466 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFPRLGREGYTKVQNASYQVAAYLADEIAKLGPYEFICTGRPDEGIPAVCFKLKDGEDPGYTLYGLSERLRLRGWQVPAFTLGGEATDIVVMRIMCRRGFEMDFAELLLEDYKASLKYLSDHPKLQGIAQQNSFKHT

SEQ ID NO: 61709 - protein, 141 aa, Pseudomonas putida GB-1
MAVQRTFSIIKPDAVAKNVIGKITTRFEEAGLKIVASKIKQLSKAEAEGFYAEHSARGFFGDLVAFMTSGPVVVQVLEGENAIALNRELMGATNPKEAAAGTIRADFAESIDANAVHGSDSEAAAAREIAYFFAATEVTTR

SEQ ID NO: 61710 - protein, 252 aa, Streptococcus pyogenes MGAS10394
MSRKPIIAGNWKMNKNPQEARAFVEAVASKLPSTDLVDVAVAAPAVDLVTTIEAAKDSVLKVAAQNCYFENTGAFTGETSPKVLAEMGADYVVIGHSERRDYFHETDEDINKKAKAIFANGLTPIVCCGESLETYEAGKAVEFVGAQVSAALAGLSAEQVASLVLAYEPIWAIGTGKSATQDDAQNMCKAVRDVVAADFGQEVADKVRVQYGGSVKPENVKDYMACPDVDGALVGGASLEAGSFLALLDFLN

SEQ ID NO: 61711 - protein, 466 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNHEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61712 - protein, 174 aa, Triticum aestivum
  misc_feature (166)..(166): Xaa can be any naturally occurring amino acid
  misc_feature (169)..(169): Xaa can be any naturally occurring amino acid
MAPSQEVAAAATKEPSTNANGTNGTNGTAAAAAPKTKTPALNERILSSITRRSVAAHPWHDLEIGPDAPTIFNCVIEIPKGSKVKYELDKKTGLIKVDRVLYSSVVYPHNYGFIPRTLCDDSDPIDVLVIMQEPVVPGCFLRAKAIGLMPMIDQGRRPTTRSSLLXDNXSTQRT

SEQ ID NO: 61713 - protein, 466 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDEGIPAVCFKLKDGEDPGYTLYDLTERLRLRGWQVPAFTLGGEATDIVVMRIMCRRGFEMDFAELLLEDYKASLKYLSDHPKLQGIAQQNSFKHT

SEQ ID NO: 61714 - protein, 210 aa, Chromobacterium violaceum ATCC 12472
MNANTDILSLRVHAALDALRRGLPVIVADDADRENEADLILAADTLTVPEMARMIRDGSGIVCLCLTPERAERLQLPPMAAENGSRYGTAFTVAIEAAQGVTTGVSAADRTTTIRAAIHPDAKPGDLVRPGHVYPIVARAGGVRERRGHTEASVELARLAGFSPAGVLCELMNPDGTMMRGQQVQDYAERHDLPQLSVAELAEWLQREPA

SEQ ID NO: 61715 - protein, 376 aa, Mycobacterium sp. JLS
MPAGLWQTVIPVGLNLGIVGLPNVGKSTLFNALTRNNVLAANYPFATIEPNEGVVALPDPRLEALAKIFHSEKIVPAPVTFVDIAGIVKGASEGAGLGNKFLANIRECDAICQVVRVFADDDVVHVDGKVDPKSDIEVIETELILADMQTLERAVPRLEKEARTHKDRKPVLDAALAAQEVLNSGKTLFAAGTDVSLLRELNLMTTKPFLYVFNADESVLTDEARKVELRELVAPADCVFLDAKIEAELQELDDESAAELLESIGQTERGLDALARAGFHTLRLQTYLTAGPKEARAWTIHQGDTAPKAAGVIHSDFEKGFIKAEIVSFDDLAEAGSMAAAKAAGKVRMEGKDYVMADGDVVEFRHGQPSTSKAKA

SEQ ID NO: 61716 - protein, 361 aa, Triticum aestivum
  misc_feature (300)..(300): Xaa can be any naturally occurring amino acid
  misc_feature (317)..(317): Xaa can be any naturally occurring amino acid
MEKKPRAAGDGQGGGEASGSVGGGLVDILPEALLVEVVGRVGLEAACSAAASCRALRGAAGAALSSVASLDLSAFTPTNAIANRILAGNGRLRSLAVNCSLLNDSAVAAIAKESLRELSLLKCSSFSPYLFVVIGERCTNLRSITLEMANLNGSEHFVICRKSIAHMFKGCDYLENLSLKFPLLAPGSVDFDSLVPIMPSTIKVLLLMPVANWQAKKLFPISASLKTPFSDSLESLSLVLDIITDELVTFITRSLSYLLELCLEDNPGSEADLDNDLTNIGLQALGLCQNLTHLSLTRRXQGCSSTFRRVNDFGLLXLAEGCKPLQTIRLGGFPKVRDAAFAALPLPCKGLRKSGPSTASC

SEQ ID NO: 61717 - protein, 466 aa, Escherichia coli
MDKKQVTDLRSELLDSRFGAKSISTIAESKRFPLHEMRDDVAFQIINDELYLDGNARQNLATFCQTWDDENVHKLMDLSINKNWIDKEEYPQSAAIDLRCVNMVADLWHAPAPKNGQAVGTNTIGSSEACMLGGMAMKWRWRKRMEAAGKPTDKPNLVCGPVQICWHKFARYWDVELREIPMRPGQLFMDPKRMIEACDENTIGVVPTFGVTYTGNYEFPQPLHDALDKFQADTGIDIDMHIDAASGGFLAPFVAPDIVWDFRLPRVKSISASGHKFGLAPLGCGWVIWRDEEALPQELVFNVDYLGGQIGTFAINFSRPAGQVIAQYYEFLRLGREGYTKVQNASYQVAAYLADEIAKLGPYEFICTGRPDGGIPAVCFKLKDGEDPGYTLYDLSERLRLRGWQVPAFTLGGEATDIVVMRIMCRRGFEMDFAELLLEDYKASLKYLSDHPKLQGIAQQNSFKHT

SEQ ID NO: 61718 - protein, 131 aa, Glycine max
  misc_feature (102)..(102): Xaa can be any naturally occurring amino acid
  misc_feature (125)..(125): Xaa can be any naturally occurring amino acid
MAPLMISSPAATTGNRALAYVGAPFTDLKYMAGLRTRNTNTDITSIASNGGRVQCMQAWPPIGKKKFETLSYLPDLDDAQLTKEVAYLLRNGWIPCLAFELXTGSLYREHITSPGYYDRRYWTCXKLSMFG

SEQ ID NO: 61719 - protein, 267 aa, Shigella flexneri 2a str. 2457T
MAIPAFGLGTFRLKDDVVISSVKTALELGYRAIDTAQIYDNEAAVGQAIAESGVPRHELYITTKIWIENLSKDKLIPSLKESLQKLRTDYVDLTLIHWPSPNDEVSVEEFMQALLEAKKQGLTREIGISNFTIPLMEKVIAAVGAENIATNQIELSPYLQNRKVVAWAKQHGIHITSYMTLAYGKALKDEVIARIAAKHNAIPAQVILAWAMGEGYSVIPSSTKRKNLESNLKAQNLQLDAEDKKAIAALDCNDRLVSPEGLAPEWD

SEQ ID NO: 61720 - protein, 353 aa, Coprinellus congregatus
MGCVQSTGVDDEAKARNDEIENQLKRDRVMAKNEIKMLLLGAGESGKSTVLKQMKLIHHGGYSDQEKDSYKEIIFSNTVQSMRAILDALPALDLALQPANDARRATILAVPGQIEAEVLPRDIADAIRQLWADPGLKEAVRRSREFQLNDSAVYYFNSIDRMSAPGYLPTDQDILRSRVKTTGITETTFKVGELTYKLFDVGGQRSERKKWIHCFENVTALVFLVSLSEYDQMLYEDESVNRMQEALTLFDSICNSRWFVKTSIILFLNKIDLFAEKLPARRSTYFPDFTGGDNYDAACDYLLHRFVSLNQSAATKQIYAHYTCATDTQQIKFVLSAIQDILLQLHLRECGLL

SEQ ID NO: 61721 - protein, 447 aa, Erwinia carotovora subsp. atroseptica SCRI1043
MATRSTIMDTNSFRAEHADALSADIRTLTDKRSKILGESYRLFYRKPVHLVRGEGQYLWDADGKKYLDVYNNVASIGHCHPAVIEAVHQQMTMLNTHTRYLHERILDYSEQLLATTPTAINRAMYMCTGSEANDLAIRVARAWSGGTGVIVTREAYHGTSDLTSGVSPALGSGQPLAATTRLVPPPDAYRVNTPDLRVWFANEIQKQIDDMAAHGIKFAAFLADSIFSSDGVHPNPRGFLRPVVDVVHRNGGIFIADEVQPGFARTGDAFWGFARHDVVPDIITTGKPMGNGIPVSGLLAKSDVLAAFSDQIPYFNTFGGNPVAMAAAQAVLKVIHDEQLQEHSRVVGAQLLAELTTLQDKYARVGNVRGAGLFIGFELVSDRESKTPDKTLALNLTEALRDRGVLTSVAGPYGNVLKLRPPLAFQTQDIDWLVGALDDCLGALTHD

SEQ ID NO: 61722 - protein, 180 aa, Oryza sativa Indica Group
MRGNAHFVVPASKFTLAAGAGESLTTYTFGTHTAKHTFCRVCGITSFYTPRSNPDGVAVTAACVDPGTWRTSSTGTPTGGTGRSGSPGATSPTSPSPRRRRRRRRVRPSCSGGDGRWARAGKDLLSIFFEHKLVEAFLAPLWFSPLCFTTKWRSNASFPVYHSVELVVIGRKEVFFISLN

SEQ ID NO: 61723 - protein, 592 aa, Erwinia carotovora subsp. atroseptica SCRI1043
MKIKNTTSGKWLLSLSVTALLVSGTVQAASAPAVEAKNGMVVSSQYLASQIGVDIMKMGGNAIDAAVAVGYAQAVVNPCCGNIGGGGFMTLHLADGKDTFINFRETAPAAASANMYLNADGSVKKDASLYGYLAAGVPGTVLGLDTALQKYGKLTREQVMTPAIKLAREGFELTRADTDILDTTIKRFKADPEAARIFLRPDGSPLQPGDKLVQTDLANTLAAIAAKGPDAFYKGTIPQAVEKAAKQGGGILTAADFADYRITETAPVTCNYRGYQFVSSPPPSSGGITMCEILNIVEGYDITSTGFNSAATVHVLTEAMRHAYMDRNTYLGDPAFVSNPVERLLSKDYAAEIRKQIEPENATPSKNVQPGIGPHERPETTHYSIVDNQGNAVSTTYTVNGRFGSVVIAPGTGFFLNNEMDDFTVKVGEKNLYGLVQGERNSIAPGKRPLSSMSPSLVTKDGKVFMVLGSPGGSRIITITLQTALNIIDHGMAPQEAVDAPRIHHQWLPDEVYYEQRGLSADTLNLLKQRGYKMVEQTPWGAAELILVGLPGAAGVTPADSGNDSAVSGKVREGYLYGANDIRRPAGAAIGY

SEQ ID NO: 61724 - protein, 332 aa, Triticum aestivum
  misc_feature (163)..(163): Xaa can be any naturally occurring amino acid
  misc_feature (270)..(270): Xaa can be any naturally occurring amino acid
EPHGHVSWSEFQYVVDDYGDIFFQVPDDGNILEDDDANNPVTVLIGTDGAIIGETSAVTSDFSDHVVVEDSMDMHDNDSKVDTEITDILIEWGMPVTMRSIHPIYFAKCLTKAVHDNHGEKIDNPSNGVSIVGYLRPAFIEEESYLRSLFGAECSADGYSSNXREEYNREPQPASGTNGLIDGDKSKSDINDTESSIDSTIYKLEMMSIELFSVYGKQFMIDPQDFQDAEPDLLSNHASDIIKRVKENSDQCTMALRSLCSRKKGLTVEXASLIGVDSLGIDVRAFSGLEARTVRFSFNAQALFERSAEKKIKRMLFPRYRKTVKVSAEDEC

SEQ ID NO: 61725 - protein, 623 aa, Streptococcus pneumoniae R6
MSDFIVEKLSKSVGDKTVFRDISFIIHDLDRIGLIGVNGTGKTTLLDVLSGVSGFDGDVSPFSAKNDYQIGYLTQDPDFDDRKTVLDTVLSSELKEIQLIREYELIMLDYSEDKQARLERVMAEMDSLQAWEIESQVKTVLSKLGIQDLSTPIGELSGGLRRRVQLAQVLLGNHDLLLLDEPTNHLDIAIIEWLTLFLKNSKKTVLFITHDRYFLDALSTRIFELDRAGLTEYQGNYQDYVRLKAEQDERDAALLHKKEQLYKQELAWMRRQPQARATKQQARINRFHDLKKKVSGSSAETDLTMNFETSRIGKKVIEFQAVSFAYENKPILQDFNLLVQAKDRIGIVGDNGVGKSTLLNLIAGSLEPTKGQVVIGETVRIAYFSQQIEGLDESKRVINYLQEVAEEVKTSGGSTTSIAELLEQFLFPRSTHGTLIEKLSGGEKKRLYLLKLLLEKPNVLLLDEPTNDLDIATLTVLENFLQGFAGPVLTVSHDRYFLDKVATKILAFEDGKIRPFFGHYTDYLDEKAFETDMANQVQKVEKEKVVKVREDKKRMTYQEKQEWASIEGDIETLEKRIAAIEEEMQANGSDFGKLATLQKELDEKNEALLEKYERYEYLSEFDS

SEQ ID NO: 61726 - protein, 283 aa, Brassica napus
CIIFLLSSPFCIHKFLLSFHSFSFSLFRQFVLCCLIFCLLSLSPQDLWRKVKNLYGEGVTSSIAAKFAFFPPTPPSYEVVADESCGGRLYIPEIPRRDDVDILKLRTRCGNEIVAVYVKHSKANGTILYSHGNAADVGQMFELFVELSNRLRVNLMGYDYSGYGQSTGQASESNTYADIEASYKCLKEKYGVKDDQLILYGQSVGSGPTVDLASRTPNLRGVVLQCPILSGMRVWYPVKCTYGLDIYKNIDKIGSVACPVLVIHGTADEVVDYSHGRRLWELS

SEQ ID NO: 61727 - protein, 244 aa, uncultured bacterium
MKHIDFYMIDAFTDTTFGGNAAAVCPLTEWLPDEILLKMSQQHNQSETAFFVTTDSGFELRWFTTQGEINLCGHATLAAAHVIFEHLDYPDTTIHFETRFVGPLTVTRSGEWLTLDFPAWNTESVIPPPLLLETLGITEYKEVRVARDYMVVMENQQQIAAVRPDIHAMLPLGKMVCITAPGDGEYDFVSRFFCPGEAVAEDPVTGSAHSMLIPYWAEKLNKTQMLARQVSERGGDLRCKLVGD

SEQ ID NO: 61728 - protein, 192 aa, Shigella boydii
ADERPGKINLGIGVYKDETGKTPVLTSVKKAEQYLLENETTKNYLGIDGIPEFGRCTQELLFGKGSALINDKRARMAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 61729 - protein, 194 aa, Ostreococcus tauri
MSRASLALGDARALRPRPASSASRRRARTPTRAFFNGKGADKTARDAIDLSKRKISSETDDKGAAVTVSFLGANDSRVDVTCGSNQYILDAGLEAGIEIPFTCRGGICGACVARCAKGTIDQSDIADLEFTLSEEELKSGMVLLCMARPVGDVEIETQSDWGYSLGVCEWRGATGEILGRDPTPLMGDTDRIGL

SEQ ID NO: 61730 - protein, 150 aa, Pyrobaculum aerophilum str. IM2
MVRLAIVVAEFNYDITQLMLQKAVEHAKFLGAEITYIVKTPGVYDIPMILKELVAKEEVDAVATLGAVIQGATKHDELVATQAARKILDIAVESGKPITLGIIGHGANRIQALERVEEYARRAVEAAVKMARRKKALREAKYNGSTVYID

SEQ ID NO: 61731 - protein, 433 aa, Mycoplasma genitalium
MFMSDKLLTIDLSHVYGFDKEIIFKKYQKKVDQIHQDFLAHKLADGHMTGWYDQPDQNHQFLLKTINQIDKKFKSLKVTDIVYVGIGGSFTGIKTVLDFLKPKQRTGLKIHFVPDLSAFQAASVIKEIKNKSWALITTSKSGRTLEPALNFRIFRNLLNKRYGNKHYQRVVVITDEKKGLLTKMASNHGYQKLVIDSNIGGRFSTLSPAGLLLAKLFGHDPKAILKGTLQAKKDLQTTSLENNSAYLYAVVRHWLYTTKKFKIEVCIAYHSLYEYLLLQHRQLFGESEGKNDKSLFPTFSIFTVDLHSMGQLYQEGEKVFFETVIDVKNPLVNINLPPSDFDNDDELDFLLDKSLNEISDVAIDSVIKAHYQANVSIIKLTLKEQSAFMFGYFYFWLSVATVMSGSLLGHNVFNQPGVEVYKKLMFEKLRSGH

SEQ ID NO: 61732 - protein, 280 aa, Helicobacter hepaticus ATCC 51449
MKILLDSLPFIRIFRGQIIVIKYGGAAQINPQLKEKFALDIVIMYMLGLKPVIIHGGGKRINEMLDIMGIESEFYNGYRITSAECMRVVEMVLSGEINKELTAFLNFHGAKAVGMSGKDAHLLQAKAKDNGALGYTGEITAVNPSFLLNVINDGFVPIIAPIATGEGAGHLGYNINADIAACHIAKALSAKKIIFLSDIAGVLDSNKEPISSLTPSDIKQLQKQGVINGGMIPKLEACVDCVQNGVEKAHIIDGRIEHSLLLELFTTQGIGTEIYNGQDK

SEQ ID NO: 61733 - protein, 194 aa, Shigella boydii
ADERPGKINLGIGVYKDETGKTPVLTSVKKAEQYLLENETTKNYLGIDGIPEFGRCTQELLFGKGSTLINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQ

SEQ ID NO: 61734 - protein, 423 aa, Oryza sativa Indica Group
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLQLLSFFILELSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKHLQQAC

SEQ ID NO: 61735 - protein, 429 aa, Wolbachia endosymbiont of Drosophila simulans
MRPVILCGGSGSRLWPLSKPKQFQKIFSQNTMFHNTLLRLKSDYMPPIIATNIQYESLVMEELHALQEYKVIFEPVKIGTAAAILIAALLCNENETMLILPSDHFIGDLNSFYASTQKASKLASETNSIVTFGVKPHEFNSEYGYINAVYDQKEKCHIVKDFTEKPERKLSNDHYWNSGIFVFKAKRYIDEIKKSAPNLYNLCFKYFTPQERFLYLKQRDFAGIEGISIDYLVMEKAKNVAMIEANFDWLDVGTWNSVLELSEKFSKEPVSFQHVIREKEPVSTTKSNKNLLGGACKQPNKSLISFIHKVKKVKVIRKEVKPWGFCSIILMSENFLIKYLFINPLSCTSKQFHHYRDEYHIVLSGVGYVSLEDKEYAIAKDHMIEIPREVSHRIENRSISSPLEIVEFQIGEHLSDNDIVRLDDVYGRF

SEQ ID NO: 61736 - protein, 315 aa, Vibrio cholerae O1 biovar eltor str. N16961
MGKLIKGKWHDVWYDTKQHDGEFIREDAGFRDWVKATPDAQFAAESGRYHLYVSLACPWAHRTLIFRALKGLQTHIDVTIVCPDMLSHGWQFGIPEPLYGYTQLHQLYTHAKADYTGRVTVPVLWDKKLHTIVSNESSEIIRMFNSAFNELTGNQTDYYPQALRTVIDEWNEFIYPNINNGVYRCGFATTQKAYEEAFEALFAALDKVDQHLTTHRYLAGNQITEADWRLFTTLVRFDAVYVGHFKCNRQRITDYPHLSGYLRELYQVPGIQETVDFYHIKRHYYFSHTTINPTQVVPVGPQVDLLSPHQRERIG

SEQ ID NO: 61737 - protein, 117 aa, Flaveria trinervia
DESWCQGLDGLASRSAAYYQQGARFAKWRTVVSIPNGPSALAVKEAAWGLARYAAISQDNGLVPIVEPEILLDGEHGIDRTFEVAKKVWAEVFFYLAENNVMFEGILLKPSMVTPGA

SEQ ID NO: 61738 - protein, 240 aa, Glycine max
MGKVSIPVPQNGFSIRNFSTSKRSCFTPSPSTLRISCSGVAELDGSHENKGGLFNFNGIKGVACGILAACTVTSAAFPVTAATQRLPPLSTEPHRCERAFIGNTIGQANGVYDKPLDLRQCDFTDEKTNLKGKSLSAALMSDAKFDGADMTEVVMSKAYAVGASFKGVDFSNAVLDRVNFEKADLEGAVFKNTVLSGSTFDDAKLDNAVFEDTIIGYIDLQKLCTNKTIGDEWRVELGCR

SEQ ID NO: 61739 - protein, 221 aa, Corynebacterium glutamicum
MQARIDATLNEHNRPEGSVRLLPVTKFHPVEDIKILQELGVTAVGENREQEARAKALELPDMDFHMIGQIQSKKANSIARWAAAVHSVDSEKIAEALGRGVALALERGDRTGDELPCFIQLSLDGDPSRGGTPLSQVTQLADCISDTTHLRFEGLMCVPPLGWDPEKAFSQARDVLSGLEEHFDRSLEFSAGMSGDLIAAIKHGSTIVRVGTEILGNRPLA

SEQ ID NO: 61740 - protein, 507 aa, Wolbachia endosymbiont of Drosophila simulans
QDFKILENLKTKALEAEKGGGSDRITKQHEKGKLTARERLSILLDESSFAEYDKFVKHHANDFGMQNANFLGDGVVIGHGTIYGRKVFVYSQDFTVFGGSLGASHAKKICKIMDMAINARVPIIGLNDSGGARIQEGVNSLAGYGEIFQRNVNASGVIPQISLIMGPCAGGAVYSPALTDFTFMVKNSSYMFITGPDVVKKVTYEDVSFEDLGGAKIHTSKTGVADFAFNNDVEMLLKMREFFTFLPANNQESPKSAPICNDVDDIDESLNTLIPTNPNTPYDMYELIEKVCDERNFFELKPDFARNIITGFGRIGGNTVGIVANQPMHLAGCLDIDSSRKAARFVRFCDAFNIPIITLIDVPGFLPGTNQEYNNIIQHGAKLLYAYAEATVPKISLITRKAYGGAYIVMNSKHLKGDINYAWPTAEIAVMGPESAVEIIFRHEKDQQTLIKEYKEKFANPFFAASHGYIDDIIVPSKTRYHFCKALELLKNKKVERIWKKHDNLPL

SEQ ID NO: 61741 - protein, 309 aa, Oryza sativa
  misc_feature (144)..(144): Xaa can be any naturally occurring amino acid
  misc_feature (177)..(177): Xaa can be any naturally occurring amino acid
  misc_feature (188)..(188): Xaa can be any naturally occurring amino acid
  misc_feature (209)..(209): Xaa can be any naturally occurring amino acid
MEADSGKLFVGGISWETDEDRLREYFSRFGEVTEAVIMRDRNTGRARGFGFVVFTDAGVAERVTMDKHMIDGRMVEAKKAVPRDDQSITSKNNGSSIGSPGPGRTRKIFVGGLASNVTEGEFRRYFEQFGVITDVVVMYDPNTXQRPRGFGLITYDLEDGGAQGLHQNFHELNGKMXVESKRAGPKEXQSPGTGARSPAGGQNYALSRXHRFLNGSNQGFNPTLMEGFGWGGDGKGWLASRPPGWVSFIFGPGFVEGAINLSTGGKYAQFAPPQFVFLAFTPTRGAGKKGGISSPKGGGLATTEKGRPP

SEQ ID NO: 61742 - protein, 261 aa, Pseudomonas putida GB-1
MFERLREDIQSVFHRDPAARNAFEVLTCYPGMHAIWLHRLGNALWKRDFKWLARLVSNFGRWLTGIEIHPGATIGRRFFIDHGMGIVIGETAEIGDDVTLYQGVTLGGTSWNKGKRHPTLENGVVVGAGAKVLGPFTVGAGAKIGSNAVVTKAVPAGATAVGIPGRIIVKSEDTEVEAKRKAMAEKIGFDAYGVSGDMPDPVARAIGQMLDHLQAVDERLEGMCGALTKMGSDYCAKELPALPEDDFTEAALVAKRDTQSH

SEQ ID NO: 61743 - protein, 221 aa, Oryza sativa
MMGSNSAGGGAMVPGGMGAAAGGGGGGGDGRHDDEAVLTEFLSSLMDYTPTIPDELVEHYLGRSGFHCPDLRLTRLVAVATQKFISDIASDSLQHCKARVAAPIKDNKSKQPKDRRLVLTMDDLSKALQEHGVNLKHPEYFADSPSAGMAPGGKRRVDSTELKVKPGTLVGSRQMNDHGWHPLPNPYYSLANEWNPVRPLFPPFFTTREGLVPLDFPFWPL

SEQ ID NO: 61744 - protein, 591 aa, Oryza sativa Indica Group
MAALRDVLLSIAQTPHRLRRRALVTWTPAQETSEVRDRSGARMKRRLEWYDLVGLGVGGMLGAGVFVTTGRVARDTAGPAVFASYVIAGVSALLSSFCYAEFSVRVPAAGGAFSYLRVTFGELVGFFGGANILMEYVLSNAAVARSFTDYLASTCGITEPDAWRIQVDGIAKGYNALDFPAVALILVLTLCLCYSTKESAMLNMVITVFHLLFFVFIILAGLWNGSARNLVSPHGLAPYGVRGVLDGAAIVYFSYIGYDSASTMAEEIRDPARALPVGIAGSVLVVSALYCLMSLALCAMLPYTEIAESAPFSAVFREKAGWEWAGSVVGAGASLGIVASLLVAMLGQARYLCVIARARLVPAWLAKVHPSTGTPMNATIFLDRANGSIKYTNNFTEVKVLTTVSDHENCNAGLCTASIALFTELQVVFEMISIGTLLVFYLVANALIYHRYAKLGANRSLHVLLFLLLLTLSSLGFSLSRRIHGQCRWGMALFGATSVTITAMFHCAVRRDMPEPPSEWMVPLMPWPAAASVFLNVFLMTTLKVMSFQRFGLWSFVIIVFYVCYGVHSTYSAEENEAVNAMIHHANMDIS

SEQ ID NO: 61745 - protein, 111 aa, Vitis vinifera
MASSSSSSSSASNFQNPNKKKTLGLIANALKRKDSFIQFFAMSGIFLLSLRSLGQKYRLNDLQEDTASLKEEQKGLHDRMNHIKRSLLHEASLDSTGLFASRLRLLFGDDQ

SEQ ID NO: 61746 - protein, 508 aa, Brassica napus
  misc_feature (338)..(338): Xaa can be any naturally occurring amino acid
  misc_feature (344)..(344): Xaa can be any naturally occurring amino acid
MAMANLARRKAYFLTRNVTSSHTDALKFSFSLSRGFASSGSDENDVVVIGGGPGGYVAAIKAAQLGLKTTCIEKRGALGGTCLNVGCIPSKALLHSSHMYHEAKHAFAHHGIKLASVEVDLPAMLAQKDNAVKNLTRGIEGLFKKNKVTYVKGYGKFLSPNEVSVETIDGGNTVVKGKHIIVATGSDVKSLPGITIDEKKIVSSTGALSLSEVPKKLMVIGAGYIGLEMGSVWGRLGSEVTVVEFAADIVPSMDGEIRKQFQRSLEKQKMKFMLKTKVVSVDASGDGVKLTVEPSEGGDQTTLEADVVLVSAGRTPFTSGLDLEKIGVETDKGGRILXVNERFXPNVSGGYAIGDVIPGPMLAHKAEEDGVACVEFIAGKHGHVDYDKVPGVVYTHPEVASVGKTEEQLKKDGVSYRVGKFPFMANSRAKAIDNAEGLVKILADKETDKILGVHIMSPNAGELIHEAVLAINYDASSEDIARVCHAHPTMSEALKEAAMATYDKPIHI

SEQ ID NO: 61747 - protein, 276 aa, Melanelia hepatizon
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEIISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDQIKATMKKASEGELKGIMSYSEDALVSTDLNGDNHSCIFDAT

SEQ ID NO: 61748 - protein, 275 aa, Nephromopsis pallescens
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPDLNGKLTGMSMRVPTSNVSVVDLTCRVEKSVTYDEIKATMKKASEGELKGIMSYSEDALVSTDLNGDNHSCIFDA

SEQ ID NO: 61749 - protein, 328 aa, Arabidopsis thaliana
MVSKKDKQIHSDHNPQDASPVEWAEIRHKLLAFQENIQSGSDIDARSDDPQMCGLYVSDIYEYLRELEVKPKLRPLHDYIEKIQEDITPSKRGVLVDWLVEVAEEFELVSETLYLTVSYIDRFLSLKMVNEHWLQLVGVSAMFIASKYEEKRRPKVEDFCYITANTYTKQDVLKMEEDILLALEFELGRPTTNTFLRRFIRVAQEDFKVPNLQLEPLCCYLSELSMLDYSCVKFVPSLLAASAVFLARFIILPNQHPWSQMLEECTKYKAADLQVCVEIMLDLYLSRSEGASKAVREKYKQHKFQYVAAIPVYQELPVTFWEDVVTIG

SEQ ID NO: 61750 - protein, 187 aa, Zea mays
  misc_feature (51)..(51): Xaa can be any naturally occurring amino acid
  misc_feature (57)..(57): Xaa can be any naturally occurring amino acid
  misc_feature (83)..(83): Xaa can be any naturally occurring amino acid
  misc_feature (97)..(97): Xaa can be any naturally occurring amino acid
  misc_feature (143)..(143): Xaa can be any naturally occurring amino acid
MDMPVASHIHYHPSWQATIRSSPSNREAAMATRRSRATRLEADLTGKNVYXRADLNXPLDDAQDITGDTRIRSSVPTIRLLLXKGAKVILARHLGRXNGVPPRTDLKPLDPRLCDLLGVRFQMLDDCLGQEQVNCADALPQRXSSVPIESTWLPEDENNQSVCAPKLSSVADLDATEAIGTMHRAHT

SEQ ID NO: 61751 - protein, 278 aa, Nephromopsis laureri
VEHGAVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVSTDLNGDNHSCIFDATAG

SEQ ID NO: 61752 - protein, 636 aa, Clostridium difficile 630
MKKIYGEKIKAVVFDWAGTTVDYGCFAPLNVFIEIFKRRGIDVTMEEARKPMGKLKIDHIREMCEMDRIKNIWSDKFGKVPTEDDVNELYAEFEPMLFETLEEYTTPIPHVVETIEKLRKNGLKIGSTTGYTREMMNIVEPNAAKKGYSPDFLVTPSEVSQGRPYPWMCYKNAEALGVSPMSSMVKVGDTISDVKEGVNAGMWSVAVIKGSSELGLTQEEVENMDKEELKAKMSIVSKKFKEAGAHFVIETMAELEDILIKIENETIKSDFVPENDYILLTPGPLSTTKSVRASMLKDWCTWDVEYNNLVQDVRRRLVSLATQNTDKYTSVLMQGSGTFSVEAIIGSTISKDGKLLVIANGAYGKRMKDICNYLNIQFVDCTFKDIEAVDLNVVENLLKENKDITHISMVHCETTTGRLNPIQEVGKLAKEYNKIYIVDAMSSFGGIEIDVEDFNIDFLVSSSNKCIQGVPGFGFIIANKEELSKCKGIAKSLSLDVYAQWDTMEKNNGKWRFTSPTHVVRAFYQALLELEEEGSVEKRYARYKENQFTIASRLKSLGFDTLVNDNAQSPVITTFLYPKNAKFEFMEFYTYLKDNGFVIYPGKLTDIDTFRIGSIGEVYPTDMERLADVIEKFINR

SEQ ID NO: 61753 - protein, 186 aa, Shigella boydii
INLGIGVYKDETGKTPVLTSVKKAEQYLLENETTKNYLGIDGIPEFGRCTQELLFGKGSALINDKRARTAQTPGGTGALRVAADFLVKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 61754 - protein, 328 aa, Rhizobium sp. NGR234
MMDTPRILVTGGAGYIGSHTAKLLRLEGLEPVTYDNLTTGNRSSVRWGPFIEGDILDSAHLIEVIEHYAPDAVIHFAASAYVGESVADPAKYYHNNVCGTLSLLDACRRTGLGKVIFSSSCATYGVPAALPIDEATRQEPINPYGRTKLIAERMLSDYAAAFGLSYVALRYFNACGADPEGDLGEWHDPETHLIPRALMAAAGRIGKLEVFGDDYDTADGTCVRDYIHVADLAQAHVLAYRLLAEGGANLALNLGSGRGFSVREVLSAVGAVTGRDVPVAIRPRRAGDPPVLYADARLAREVLGFSPLYSDLETIVRTAAPFFGLEAR

SEQ ID NO: 61755 - protein, 283 aa, Triticum aestivum
METPRYSWDTIEYSSYASNASGAHPYGRPAGGRPGRWATFSFAMASGTDEKAKMESLTSPAAFVEGGVQDACDDACSICLEAFCESDPSALTGCKHEFHLQCILEWCQRSSQCPMCWQPVSMKDPTSQELLEAVRWERNIRTNQTQNTTIFHHPALGDFEVQHLPVVGNDAELEERILQHLAAAAEMGRSHQHGRREGQRNRSGSRGRPQFLGFSGHPNTPAGSVSSSSTQGDGADDLRILVPRVGDLHHMLIPLKSRAPKSGGLTYHANKMLWFTWKYSPVS

SEQ ID NO: 61756 - protein, 714 aa, Vibrio cholerae O1 biovar eltor str. N16961
MSRTIMLIPISAGVGLTSVSMGLLRAMERKGVSVSFYKPIAQPRTGDDQPDLTSTVMSRNSDIKIGQPMSMSAAETLIGSEKMDVLLETVVERYNQINKDAEVTLIEGLVPTRKHPFANQVNAEIANTLGAEIVFVATPGTDNPTQLKERIEVACSNFGGTKNKSISGVIINKLNAPVDEAGRTRPDLSEIFDDADHAKQANLEVMQIFNTSPIRVLGCVPWSIDLIATRAIDMAKHLKAEIINQGDINTRRIKSITFCARSIPNMIEHFKPGSLLVTSADRPDVIVAAALAAMNGVEIGAVLLTGGYDIPRELVSLCKPAFDTGLPIFKAQGNTWQTSLNLQSFSLEVPADDKERIEFISEHVASHIDGPWVDSLTEGAQASRRLSPPAFRYQLTELARSANKRIVLPEGDEPRTVKAAAICAERGIAQCVLLGNPEEIKRVAAQQGVELGSGIEIIDPKVAQEKYVARLVELRKSKGMTEVVAREQLEDTVVLGTMMLERNEVDGLVSGAVHTTANTIRPPLQIIKTAPNASLVSSIFFMLLPDQVLVYGDCAINPDPNAEQLAEIAIQSADSAAAFGIEPRVAMISYSTGTSGQGADVDKVREATRIAKEKRPDLVIDGPLQYDAAIMENVAASKAPNSPVAGKATVFVFPDLNTGNTTYKAVQRSADLVSIGPMLQGMRKPVNDLSRGALVDDIVYTIALTAIQAGQEQK

SEQ ID NO: 61757 - protein, 538 aa, Lentisphaera araneosa HTCC2155
MIAVSNLSIRFGKRTLFEEVSVKFSPGCRYGLIGANGVGKSTFMKILAGELDSSTGQVSIDSGCRMSFLRQDHYKYDDFKVLDTVFTGNDELWQLHQKRDNLYDQSDNGTISDEDADYLYGDLEAEYGEKGGYTMEGDASKLLSGLGIPAEEHHRKMNEISGGLKLRVLLAQALFGDPDILLLDEPTNHLDMDTIEWLENFLKRHEGTVIVISHDRHFLNSVCTNIADLDYQAMRLFTGNYDDFMIANQIQLDRQQRENDKKEKRADELKTFISRFGANASKAKQATARQKELDRLQIEKFKPSSRVAPYIRFEAKTKIGAKVIHAEKLCKSYDKPLFTDFNIHMNNDEKIAIIGTNGVGKTTLLRTLLGKEQADSGNLEIGQTIELSYFPQDSQEVLDENMKAIDWLGKFAPEEGITETELRSAMGRMLFKGEDSLKPINVLSGGERARLIVASMLLEGGNFIVLDEPTNHLDLEAIESLNYALTLISDPVIFVSHDREFVNSLATRIIELHGDGTYTDYPGNFEEYEAWKNSQKKK

SEQ ID NO: 61758 - protein, 310 aa, Triticum aestivum
  misc_feature (206)..(206): Xaa can be any naturally occurring amino acid
MEKYEKLEKVGEGTYGKVYKAQDKATGQVVALKKTRLEMDDEGIPPTALREISLLRLLSSSLYVVRLLAVEQATKGGGAGGGGKPVLYLVFEFLDTDLKKFVDAYRRGPAPKPLPTQVVKSFLYQLCKGIAHCHGHGVLHRDLKPQNLLVDKEKMILKIADLGLSRAFTVPMKSYTHEIVTLWYRAPEVLLWSNTLLQPGLIFWSXGCIFAEMVRKQALFPGDSELQQLLHIFKLLGTPTEEDWPGVTALRDWHEFPQWKAQRLTRAVPTLEPEGIDLLSKMLQFDPANRISAKAALEHPYFNSLDKSQF

SEQ ID NO: 61759 - protein, 197 aa, Streptococcus pneumoniae R6
MTMELNTHNAEILLSAANKSHYPQDELPEIALAGRSNVGKSSFINTMLNRKNLARTSGKPGKTQLLNFFNIDDKMRFVDVPGYGYARVSKKEREKWGCMIEEYLTTRENLRAVVSLVDLRHDPSADDVQMYEFLKYYEIPVIIVATKADKIPRGKWNKHESAIKKKLNFDPSDDFILFSSVSKAGMDEAWDAILEKL

SEQ ID NO: 61760 - protein, 119 aa, Coccidioides immitis RS
MSAQNSAGIQTLLDAEREAQKIVQSAREYRTKRIKDAKAEAQKEIEEYRRQKEQEFKRFEAEHSSGNKKAEEEANKDADVKLKDIQEAGKAKGERVVDDLIHAVLDVKPEVPEKLAANA

SEQ ID NO: 61761 - protein, 265 aa, Burkholderia xenovorans LB400
MSSLNTNLNGKVAVVTGAASGIGKQIALTLSAAGAAVAIADLNQDGANAVAEEIRKGGGKAIGVAMDVTNEDAVNQGIDKVAAELGSVDILISNAGIQIVNPIENYSFSDWKKMQAIHVDGAFLTTKAALKHMYKDDRGGIVIYMGSVHSHEASPLKSAYVTAKHALLGLSRVLAKEGAKHNVRSHVVCPGFVRTPLVDKQIPEQAKELGISEEDVVKRVMLGGTVDGVFTTVEDVAQTVLFLSTFPTAALTGQSFIVSHGWYMQ

SEQ ID NO: 61762 - protein, 341 aa, Myxococcus xanthus DK 1622
MDKTPGGTPFPTQLLYERIGGYWLTQVIGTAARLGIADLLSKGPRSSDALADELGISADGLYRLLRGGISAGVFQEVGERTFALTPMGEGLRSDIPGSLRDVAIAQSDRAHWLPWGQLIEAVRTGKSTVREALGTDIWEHFAKHPEEATHFARAMGNLSALVAHELTQQVDFSPFAHVADIGGSQGALLARVLRANPSCRGILFDLPHVLEGAKAPMEAQGLHGRVELVGGSFFEPGLPSAEAYLLKHILHDWDEESATAILRNIHAAAPAGARLFVMELVMPDNQTPSPVPLMDLNMMVLADGRERTANEFQTLLTRTSWELVGIRPTQAGTCIIEAVKR

SEQ ID NO: 61763 - protein, 258 aa, Geobacillus stearothermophilus
MGKTVVIKCGGSVLDELSPAFFASVNAMRKQGMEVVIVHGGGPEIGQMLKTLRVPSEFVNGLRKTTKDVLAVVEMVLSGKVNKQLASMLRQHGLPAVGVSGVDGGLLEAEPIDLAKLGYVGRVKTVRSQLLRTLLAAGYIPVISPLGIDQNGQTYNINADTAAGAVAAAIGASQLAFVTNVPGILRDGALVAEATAEMIERLIEDGVITGGMIPKVQAALSALSDALPEVMIVSGKTTFYQNGTWHGTTIRKEVGVYL

SEQ ID NO: 61764 - protein, 472 aa, Acidobacteria bacterium Ellin345
MNIAMIGSGYVGLVAAACLAEIGHNVICVDNDARKIEALSAGSEVIHEEFLPELLARHRGRRLKFTTSLHHAVRPSEIVFIAVGTPPCESGEADVSFIENVCRDIAAEINGHGPKTLVVKSTVPAGTSDWIRSVLVRNGVPASNFELASNPEFLREGSAVTDFLYPDRIVIGSSSATGTELLRRAYLPLTSGSYHGCVSRVPQPDDSCSPAKLIVTKPATAEMIKHASNAFLAMKVSFINAVANVCEAVGADVEELVQGMGSDRRIGTRFLKAGIGYGGSCFPKDVSALRAVAEDRGCDFQLLDEVMRINENQRKAFLHRVRDALGNLKGKRLAVLGLAFKGGTDDVRESPAIALVQSLLHEGCTIQAYDPAAMERAREEFAPNGKITFASSAYETARNADALLVLTDWEEFLTLDFARIRSLLRQPILFDGRNLYNPDRMQDLGYFYFSVGRREIAPLQAKAAEASSEDAA

SEQ ID NO: 61765 - protein, 339 aa, Pyrobaculum aerophilum str. IM2
MKYLTPGPVQLPKFVIEAMARQPPFHRSDDFKKLFKSVLDKLQSLYPAKSIVMPGTGTLAVDTMVYNYVNPGDRVLALVYGEFGKRAVETARIRGAEVVEIERDTPPEPDEIEDALRKIGGVKAILLIHNETSTGIAYKKLKRLVDIAKAYGALLLVDSVSGFPAEPLPPEIDVVATASHKALLAPPGASILYITSQPKATTGVPPSMDLRKFLKMLDHLETPYTPPISVLFALEVSLDHILGFGSKYTEIHQERVNYLYSLVKLRAIPPEGLRSVTVTAFLCEKPKEVMAKLREAGYVIAGGMYKYREKSIRIGVMGDVSLEDLKTVAEVINNVAGRV

SEQ ID NO: 61766 - protein, 558 aa, Listeria monocytogenes str. 4b F2365
MVQLFSAFDRETIERNLQEEKFDLVIVGGGITGAGIALDATSRGMSVALVEMGDFASGTSSRSTKLVHGGLRYLQQFEIKEVADLGKERAIVYENGPHVTTPEWMMLPFHKGGNMGKTTASFGIRLYDYLAGVKKNERRKILSAKETLAKNPFVKKDGLKGSGYYVEYRTDDARLTIEVMKKAVELGANAINYTKAEHFLYDDNKQVVGVTVTDRLSGKAYDIKGHRVINAAGPWVDKVRKLDYATNNKHLRLTKGIHLVIDKQKFPMEQAVYFDTPDGRMVFAIPRDKKVYVGTTDTVYDEAVINPKALESDHNYVIKAINYMFPDVHITEKDIESSWAGVRPLIYEEGKDPSEISRKDEVWFSESGLITMAGGKLTGYRKMAEKLLDDISKTLAKETGKKYKTVQTKHLPISGGDIGGSEQLEAFLSKKAKEGNNRFGWTLEEGREMAKRFGSNIDQLFTYAQEHKEQNETTLPNSLYAELRYSIQHEAVTTPIDFLLRRTGYLLFDMPYLLEWKDAVVDEMAKQFHWSDDVKQTYIEELNIQINDAREPADWHDR

SEQ ID NO: 61767 - protein, 900 aa, Caulobacter crescentus CB15
MNSKMPVETLTKAQWVYAFGGGGADGDASMKNLLGGKGANLAEMSSLGLPVPPGFTITTEACVHYYANGKQYPAELAEQVQAGLAKIEEITGKQFGDVTNPLLVSVRSGARASMPGMMDTVLNLGLNDETVEGLAKLSGDRRFAYDSYRRFIQMYSNVVLNLEHHMFEEILDDHKDRLDVNVDTGLTADDWAAVIKDYKAAVREQLGKPFPQDAQEQLWGAVGAVFASWMNDRAKFYRRMHDIPESWGTAVNIQSMVFGNMGETSATGVAFTRNPSNGDNRLYGEFLINAQGEDVVAGIRTPQSLTKAAREEMGDTAPSMEEAMPEVFGQFKTVVETLERHYRDMQDIEFTVEQGKLYMLQTRNGKRTAKAALKIAVDMAAEGVISTSEAVGRVEPASLDQLLHPTIDPSAHRDVIAKGLPASPGAATGKIVFNSDAAEKAAANGESVILVREETSPEDIHGMHAARGIITARGGMTSHAAVVARGMGRPCVSGAGDVAIFEKEGLFRVRGRDFRAGEIITIDGSTGDILAGAPKMIEPELTGDFATLMGWADQVRRLKVRANAETPLDAKTARQFGAEGIGLCRTEHMFFDDTRIAAVREMILADDEKGRRAALAKIAPFQKADFVELFTIMEGLPVTIRLLDPPLHEFLPHTEEDVQAVAVATGLDAAKLMRRAKELHETNPMLGHRGCRLGVSYPEIYEMQVRAILEAACEVKKAGKQPPAPEIMHPLVAKGEEMKYLRDLTDRVAKAVLEEQGVALEYTVGTMIELPRAALRAGDLAANAEFFSFGTNDLTQTTFGISRDDAGKFLNAYIEKGIFEKDPFVSLDQDGVGDLIRIAAERGRAVRPNVKLGICGEHGGDPASIGFCEKVGLDYVSCSPYRVPIARLAAAQAAMANKVE

SEQ ID NO: 61768 - protein, 1301 aa, Oryza sativa Indica Group
MLLHILGSSTLAPARPSPLRQSGAGTGAATVRCASSSSNPSPSSSSSAAAAAGKQVAKVHSYGALDYERRAALRWSSLYRRIAVGHGGRPVGRTLGAWDEGERRLDKWELCRIARELRKFRRFNLALQVYDWMTERRDRFSLSSSDMAIQLDLIAKVRGVSHAEEYFEELPDPLKDKRTYGSLLNVYAQAMMKEKTESTFEQMRKKGFATDTLPFNVLMNFYVDAEEAEKVSILIDEMMERNVAFDVCTYNIWIKSCAAMQDADAMEQVFNQMIRDETVVANWTTYTTLASMHIKLGNSEKAEESLKEAEKRTTGREKKCFHYLMTLYSHLGKKEEVYRVWNWYKATFPTIHNLGYQEVLSALVRLGDIEGAELLYEEWASKSSSFDPKTMNILLAWYAREGFVTKAEQTLNRFVEKGGNPKPNTWEILGTAYLKDGQSSEALSCLEKATAVASPSKWRPRPTNVESLLANFKEKNDAESADRLMNVLRSRRPPPVKPPAAAAAVAGGGVAGTPGGKGRGLGASGEGIGSSGGRGDPQSRRCTRSASAKGSGDARSVEEGGPRVAGDDGGSGKSGVAAEGSGFEGLRNGRGGGVGTAAAEDCGLEKSNPDGIVGDADVHLESGSDARDGECVSEGLKKPCVNNSNGSSAADCAPKVKKGNDSGDGGADECNAAAKSSNLACPGNNGDETNRKGRKVVLPWRFQVGFKRSFSKAFCSDSESSGPSGTQFYRAQDSSTPCTPATRSSVRCYASAHSGVRVSAMRDFSVKGEKETSTPYKKSKTGMDGPSQGMPKNGVVLARENIMGSLQNFRLIYRDLLDEEEEKSTEAVIRPDLQAYRIFRERFITDCDEKKYIGNVPGIKVGDIFHLRVELCVVGLHRPHRVGVDHIKQEDGTCIAVSIVSYAQSSDIKNNLDVLVYSGAMTAIANQKIEGTNLALKKSMDTNTPVRVIHGFVTHLNGNCQRKKIPTYIYGGLYIVEKYWREKEGNDRYVYMFRLRRMAGQKHIDIQDILNSGQAESYGGIIIKDISRGLEKIPVSVVNSISDEYPMPYRYIAHLQYPRNYQPAPPAGCGCVGGCSDSKRCACAVKNGGEIPFNDKGRILEAKPLVYECGPSCKCPPTCHNRVGQHGLRFRLQVFKTKLMGWGVRTLDFIPSGSFVCEYIGEVLEDEEAQKRTTDEYLFAIGHNYYDEALWEGLSRSIPSLQKGPDKDEEASFAVDASKMGNFAKFINHSCTPNLYAQNVLYDHDDKSVPHIMFFACEDIPPRQELSYHYNYTIDQVHDANGNIKKKKCLCGSIECDGWLY

SEQ ID NO: 61769 - protein, 290 aa, Mycobacterium tuberculosis H37Rv
MTRPDNEPARLRSVAENLAAEAAAFVRGRRAEVFGISRAGDGDGAVRAKSSPTDPVTVVDTDTERLLRDRLAQLRPGDPILGEEGGGPADVTATPSDRVTWVLDPIDGTVNFVYGIPAYAVSIGAQVGGITVAGAVADVAARTVYSAATGLGAHLTDERGRHVLRCTGVDELSMALLGTGFGYSVRCREKQAELLAHVVPLVRDVRRIGSAALDLCMVAAGRLDAYYEHGVQVWDCAAGALIAAEAGARVLLSTPRAGGAGLVVVAAAPGIADELLAALQRFNGLEPIPD

SEQ ID NO: 61770 - protein, 264 aa, Streptococcus pyogenes MGAS10394
MENMFSLQGKIALITGASYGIGFEIAKAYAQAGATIVFNDIKQELVDKGLTAYRELGIEAHGYVCDVTDEAGIQQMVSQIEDEVGVIDILVNNAGIIRRTPMLEMAAEDFRQVIDIDLNAPFIVSKAVLPSMIAKGHGKIINICSMMSELGRETVSAYAAAKGGLKMLTKNIASEFGEANIQCNGIGPGYIATPQTAPLRERQADGSRHPFDQFIIAKTPAARWGATEDLAGPAVFLASDASNFVNGHILYVDGGILAYIGKQP

SEQ ID NO: 61771 - protein, 532 aa, Yersinia pestis KIM
MAYLLVFDYNRERKRTLKRCFEHSEEGNMETKDLIVIGGGINGAGIAADAAGRGLSVLLLEAQDLACATSSASSKLIHGGLRYLEHYEFRLVSEALAEREVLLKLAPHIAFPMRFRLPHQPHLRPAWMIRTGLFLYDHLGKRTSLPASKGLRFGPESVLKPELVRGFEYSDCWVDDARLVVLNAQEVVKHGGEVRTRTKVTRAWREQGLWMVEALDVNTGKTFTWRAKGLVNATGPWVKQFFDDGLKLKSPYGIRLIKGSHIVVPRVHNQPQAYILQNEDHRIVFVIPWLDDYSIIGTTDVEYHGDPKEVKIDDQEMTYLLKVYNDHFKKQLGRDDIVWTYSGVRPLCDDESDSPQAVTRDYTLDVADEAGQAPLLSVFGGKLTTYRKLAEHALEKLSAYYPNVGPAWTKTGALPGGDIGGSRDSYTVQLRHRYNWLPEGLARRYTRTYGSHSELILANATRLESLGEHFGHGLYEAELRYLVENEWVVELDDAIWRRTKLGMALSDEEKQRVAQWLADAHTEKQQALPLVS

SEQ ID NO: 61772 - protein, 346 aa, Streptococcus pyogenes MGAS10394
MNSNSILTRKGGHMSKLLLVGEPLIRVSPNQFQPLTNACDAQLFFGGSEVNIARTLGGFGLEVRLFTALPDNPVGHAFHQFLKQIGVDMTLTAWQGNRVGLYYLENGFGCRASQVYYDRCGSSFSALDKDSLDLAAIFEGIRHFHFSGISLALGKKTQDLIEILAREARKRQVCVSFDLNFRSSMIAAADAKRLFSHFAQYADIIFGMEPLLLDSDDFDMFDRNKADATMIRERLAGLYQRYQLQAIYHTERSNDAQGSNRFKAYAYDGQFYESCEVTTPVLQRVGSGDAFVAGLLYQLLEGNEKQRNLDFAVATASLKCTVAEDQLYHSVQQVEAVLANQRDVQR

SEQ ID NO: 61773 - protein, 144 aa, Triticum aestivum
  misc_feature (62)..(62): Xaa can be any naturally occurring amino acid
  misc_feature (67)..(67): Xaa can be any naturally occurring amino acid
  misc_feature (83)..(83): Xaa can be any naturally occurring amino acid
MAAAWEVLAVLLVAAQVASAAQVTAPAFLWAPKNYGFSSDDAKEVVHYQTISPKSLAKSVLXEGGWXNFMCSREDTQNNVDVXIVFIGLKLQSSDISKETIHFTDTLNSLPRFQGSLVPHIEKTKCITCETCNHPKTVEIHSFR

SEQ ID NO: 61774 - protein, 606 aa, Capsella rubella
MEEVTRSVLAEEILKRLDLENLCSVACVSTTLRSAVVSGVLPSLTSLDLSVFSPDEETLNHVLRGCIGLSSLTLNCLRLDANSVRGVLGPHLRELHLLRCSLLSSTVLTSIGTLCPNLRVLTLEMSDLDSPAVFQSNLTQMLNGCPYLESLQLNIRGILVDATAFQSVRFSLPETLKALRLQPLLESEAILLMNRFKVTGTCLSQADYSALLSLSPSFTLQSLSLVLDLISDRLIIAITGSLPQLVQLDLEDRPEKEPFPDSDLTYTGLQALGYCQQLTSLSLVRTCYNRKISFKRINDMGIFLLSEACKGLESVRLGGFQKVSDAGFASLLHSCRNLKKFEVRGAFLLSDLAFHDVTGSSCFLQEVRLSTCPLITSEAVKKLGLCGNLEVLDLGSCKSISDSCLNSVSVLRRLTSLNLAGADVTDSGMLALGKSDVPITQLSLRGCKRVSDRGISHLLINEGTISKTLSTLDLGHMPGMSDRAIHTITRYCKALTELSIRSCFYVTDSSIESLATRERQVEGGSKQLRKLNIHNCVSLTTGALRWLSKPSFAGLHWLGLGQTRIAGRKETVTATICGQRPWLTLCFDGCELGCYDGWEFHTPQRH

SEQ ID NO: 61775 - protein, 534 aa, Thermobifida fusca YX
MPGTLSRTSHDRDSPREDADVKEPVMPGAVPNPLRSVLDRRLPRIAGPCVLVLFGVTGDLSRKKLLPAIYDLANRGLLPPGFGLVGFARRDWADQDFTQVAYDAVRTHARTPFREDVWRQLSEGVRFVPGEAHDDAAFDALVRTVRELDESRGTGGNYAFYLSLPPKLFPTVLTQLKRSGLAESSGDSWRRVVIEKPFGHDLASAQELNALVDDVFPPHSVFRIDHYLGKETVQNLLALRFSNTLFEPIWNRSYIDHVQITMAEDIGVGGRAGYYDGIGAARDVIQNHLLQLLALVAMEEPLSFTADAIRAEKVKALSAVQLPDDLATGTARGQYTAGWQGGAWVPGYLEEEGIPPNSTTETYAAMRLGVNTRRWAGVPFYLRTGKRLGRRVTEVALVFHRTANQVFDHVATANQGANSLVIRIQPDEGVTLRFGSKVPGTAMEVRDVSMDFSYGASFTETSPEAYERLILDVLIGDPPLFPHQEEVELSWRILDPVEEFWAKNGRPEPYPAGSWGPPSGHELLARDNRTWRRP

SEQ ID NO: 61776 - protein, 275 aa, Nephromopsis leucostigma
  misc_feature (261)..(261): Xaa can be any naturally occurring amino acid
VEHGEVKVVAVNDPFIEPHYAAYMLKYDSQHGQFKGTIEVKGSDLVVNGQTVKFYTEKDPANIPWKDTGAYYIVESTGVFTTTEKAKAHLKGGAKKVVISAPSADAAMFVMGVNEKEYKSDIEVISNASCTTNCLAPLAKVMHDNFTIIEGLMTTIHSYTATQKTVDGPSSKDWRGGRTAAQNIIPSSTGAAKAVGKVIPSLNGKLTGMSMRVPTSNVSVVDLTCRLEKSVTYDEIKATMKKASEGELKGIMSYSEDALVXTDLNGDNHSCIFDA

SEQ ID NO: 61777 - protein, 429 aa, Nostoc punctiforme PCC 73102
MISKSLLPLEPASPAHICPFDQACSYLEAAAKELNLNQGLLEILSHPRKVVTVSIPVKLDDGEIQVLAGHRVQHSDVLGPYKGGIRYHPAVTLREVSALAMLMTWKCALLGIPYGGGKGGIPIDPKRYSVGELERISRRYISELLKDIGPSVDIPAPDMGTSAREMAWMMDTYSVNVGHAVPGVVTGKPLSIGGSLGREMATGRGTMIIVREALADRGKSLVGVRVAIQGFGNVGGAAAELLHQAGAKIIAVSTGAGGIFSEAGLDIPALKIYAAENRKSIVGFPQSVPISNADLLTLPCDVLIPAALENQITGENVNQVQAQIVAEAANGPVTLEANLALEARGVTVLPDILANAGGVVVSYLEWVQGLSYVFWDEERVNREMEHLMVQAYRKVIQQSNKRQISLRLAAYTLGVGRVAQALTDRGLYP

SEQ ID NO: 61778 - protein, 241 aa, Zea mays
MATTAGAGGAGKLKLLGAWPSPFVNRVRVALHLKGLEYENVEEDLTNKSDQLLASNPVHKKVPVLLHGDTPVSESLVIVEYLDDAFPGAGQALLPADPYERAVARFWAAYVDGKLHGMMVKAILGATEEERAAATADALAAMETLEGAFAECSGGKEFFAGDEPGYLDVVLGGFIGWLRAWDKVGGVKLLDGGRRTPRLAAWAERFAALDVARDVIPDPDHIAEFAKVLQARSAAAAAAGN

SEQ ID NO: 61779 - protein, 642 aa, Staphylococcus aureus subsp. aureus NCTC 8325
MILLQLNHISKSFDGEDIFTDVDFEVKTGERIGIVGRNGAGKSTLMKIIAGVENYDSGNVSKIKNLKLGYLTQQMTLNSNATVFEEMSKPFEHIKRMESLIKEETDWLSKHANDYDSDTYKTHMSRYESLSNQFEQLEGYQYESKIKTVLYGLNFSEEDFNKPINDFSGGQKTRLSLAQMLLNEPDLLLLDEPTNHLDLETTKWLEDYLRYFKGAIVIISHDRYFLDKIVTQIYDVALGDVKRYVGNYEEFIQQRDLYYQKRMQEYESQQAEIKRLETFVEKNITRASTSGMAKSRRKILEKMERIDKPMLDAKSANIQFGFDRNTGNDVMHVKNLEIGYQTAITKPMSIEVSKGDHIAIIGPNGIGKSTLIKTIANQQKALNGDITFGANLQIGYYDQKQAEFKSSKTILDYVWDQYPLMNEKDIRAVLGRFLFVQDDVKKIINDLSGGEKARLQLALLMLQRDNVLILDEPTNHLDIDSKEMLEQALQHFEGTILFVSHDRYFINQLANKVFDLTIDGGKMYLGDYQYYIEKVEEAEALKAHQEEQSVNVQAHKKSMEQSSYHNQKEQRREQRKLERQISECENEIETLETTILQIDEQLTQPEVYNNPQKANELAIQKQDSEQKLEHAMSKWEELQQKL

SEQ ID NO: 61780 - protein, 525 aa, Shigella flexneri 2a str. 301
MTENIHKHRILILDFGSQYTQLVARRVRELGVYCELWAWDVTEAQIRDFNPSGIILSGGPESTTEENSPRAPQYVFEAGVPIFGVCYGMQTMAMQLGGHVEASNEREFGYAQVEVVNDSALVRGIEDALTADGKPLLDVWMSHGDKVTAIPSDFVTVASTESCPFAIMANEEKRFYGVQFHPEVTHTRQGMRMLERFVRDICQCEALWTPAKIIDDAVARIREQVGDDKVILGLSGGVDSSVTAMLLHRAIGKNLTCVFVDNGLLRLNEAEQVLDMFGDHFGLNIVHVPAEDRFLSALAGENDPEAKRKIIGRVFVEVFDEEALKLEDVKWLAQGTIYPDVIESAASATGKAHVIKSHHNVGGLPKEMKMGLVEPLKELFKDEVRKIGLELGLPYDMLYRHPFPGPGLGVRVLGEVKKEYCDLLRRADAIFIEELRKADLYDKVSQAFTVFLPVRSVGVMGDGRKYDWVVSLRAVETIDFMTAHWAHLPYDFLGRVSNRIINEVNGISRVVYDISGKPPATIEWE

SEQ ID NO: 61781 - protein, 521 aa, Solanum tuberosum
MAASIGALKSSPSSNNCINERRNDSTRAVSSRNLSFSSSHLAGDKLMPVSSLRSQGVRFNVRRSPMIVSPKAVSDSQNSQTCLDPDASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPDWFQGTADAVRQYLWLFEEHTVLEYLILAGDHLYRMDYEKFIQAHRETDADITVAALPMDEKRATAFGLMKIDEEGRIIEFAEKPQGEQLQAMKVDTTILGLDDKRAKEMPFIASMGIYVISKDVMLNLLRDKFPGANDFGSEVIPGATSLGMRVQAYLYDGYWEDIGTIEAFYNANLGITKKPVPDFSFYDRSAPIYTQPRYLPPSKMLDADVTDSVIGEGCVIKNCKIHHSVVGLRSCISEGAIIEDSLLMGADYYETDADRKLLAAKGSVPIGIGKNCHIKRAIIDKNARIGDNVKIINKDNVQEAARETDGYFIKSGIVTVIKDALIPSGIII

SEQ ID NO: 61782 - protein, 491 aa, Mycobacterium avium subsp. paratuberculosis K-10
MADPSGFLKYTHRELPKRRPVPLRLRDWREVYEEFDHGTLREQATRCMDCGIPFCHNGCPLGNLIPEWNDLVRTGRWRDAIERLHATNNFPDFTGRLCPAPCEPACVLGINQDPVTIKQIELEIIDNAFDEGWVQPLPPDKLTGKKVAVVGSGPAGLAAAQQLTRAGHSVTVFERSDKIGGLLRYGIPEFKMEKRVLDRRLDQMRAEGTEFRAGVNVGVDITADQLRADFDAVVLAGGATAWRDLPIPGRELDGIHQAMEFLPWGNRQASGDLDEADMDADGQPPITAKGKKVIIIGGGDTGADCLGTVHRQGATEVHQFEIMPRPPDTRAPSTPWPTYPLMYRVSSAHEEGGERVFSVNTEEFVGENGRVTALKAHEVTMEDGKFVKVEGSEFELEADLVLLAMGFVGPEKEGLLTDLGVKFTERGNVARGADFDTSIPGVFVAGDMGRGQSLIVWAIAEGRAAAAAADRFLMGATALPAPVKPTAVPLQ

SEQ ID NO: 61783 - protein, 259 aa, Streptococcus pneumoniae R6
MKKEVCEMSRKPFIAGNWKMNKNPEEAKAFVEAVASKLPSSDLVEAGIAAPALDLTTVLAVAKGSNLKVAAQNCYFENAGAFTGETSPQVLKEIGTDYVVIGHSERRDYFHETDEDINKKAKAIFANGMLPIICCGESLETYEAGKAAEFVGAQVSAALAGLTAEQVAASVIAYEPIWAIGTGKSASQDDAQKMCKVVRDVVAADFGQEVADKVRVQYGGSVKPENVASYMACPDVDGALVGGASLEAESFLALLDFVK

SEQ ID NO: 61784 - protein, 228 aa, uncultured bacterium
MRGSLSAVCPLTEWLPDEILLKMSQQHNQSETAFFVTTDSGFELRWFTTQGEINLCGHATLAAAHVIFEHLDYPDTTIHFETRFVGPLTVTRSGEWLTLDFPAWNTESVIPPPLLLETLGITEYKEVRVARDYMVVMENQQQIAAVRPDIHAMLPLGKMVCITAPGDGEYDFVSRFFCPGEAVAEDPVTGSAHSMLIPYWAEKLNKTQMLARQVSERGGDLRCKLVGD

SEQ ID NO: 61785 - protein, 543 aa, Listeria monocytogenes str. 1/2a F6854
MKKVLLNSVKGYTWARFRKDLLAGIIVGIIALPLAMSFAIASGVSPEYGIYSSFVAGIIVSIFGGSKFQIAGPTGAFIPVLLGIVLTYGYQDLLVAGMMAGVLLCLMGIFKIGTLIKFIPRPVTIGFTAGIAVTIFMGQVGNFLGLTGMEKHESFVANMKEIWLHLDSWNFYSVLISCICMLVLFIFPKILPRIPAPLIGLVVTTAIAMLFFPDALPTIGSAYGNIPSTFPPFEFPDMTFANMSKLIGPAFVIAMLGGIESLLSAVVADGMTNTKHNSNRELIGQGIANIVTPMFGGIPATGAIARTATNINNGATSRVSGVIHGVFVLLTLLVLAPVAVNIPIAAMAPILMLVAWNMSERKTFQHIIKLKSGDTLVLVITFLLTIFASLTVAVEVGLLLAVVLFAKQMGSSMQIEEIEPEGAEIAPHLHEKISIFTIRGPLFFGAAQIFQQNIIKAIHVKPKYLILRMGKVPIIDATAEGYFHQIEKEFSKQGGQILITGLTDKAKESLKGSGLYDRIGEEHFFSHTEDAIHYAENALNKGD

SEQ ID NO: 61786 - protein, 470 aa, Solanum tuberosum
NKIKPGVAYSVITTENDTQTVFVDMPRLERRRANPKDVAAVILGGGEGTKLFPLTSRTATPAVPVGGCYRLIDIPMSNCINSAINKIFVLTQYNSAPLNRHIARTYFGNGVSFGDGFVEVLAATQTPGEAGKKWFQGTADAVRKFIWVFEDAKNKNIENIVVLSGDHLYRMDYMELVQNHIDRNADITLSCAPAEDSRASDFGLVKIDSRGRVVQFAEKPKGFDLKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGIIIILEKATIRDGTVI

SEQ ID NO: 61787 - protein, 519 aa, Triticum aestivum
  misc_feature (213)..(213): Xaa can be any naturally occurring amino acid
MAVAGAPPVLQLLPQQWQLILAILLVPLGFLLLRGRSGSGLKLPPGPMRLPFVGNLHQIGPLPHRSLAALARRHGPVMMLRLGMVPTVVLTSPEAAREALKTKDDDCSSRPLSAGPGLLSYGYKDVAFSPWSDYVREMRKLFIIELLSRRRVQSAYYARDAQIDKLIETLTVVGPNPVPLEAHIFATMDRIVGLFAFGESYAGEQFKGAVCAXLNATMDMLGSFSAQDFFPNAVGRLIDRITGVKAHRQRVFRQLDRFFEHIIEQCDGRKATGGGGSDLVQELLDIMKRPAASAAGTFTRDHVKAILMNTFIGSIDTTTVTITWAMAELIRKPRVLQRAQLEIRTAAGGGSRVHQADMPKMSYLRMVLSETLRLHPPATLLVPRETLRPIQVAGYDIPAKTQVIVNAWAISRDPSAWKDPEEFNPERFQDTDVDFNGSHFEFIPFGAGRRICPGLAMGVANAEYILANLLYCFNWALPNGVSREGVNMEEEGVLTYRKKTSLMLVPTPYHPAQEKEEEY

SEQ ID NO: 61788 - protein, 176 aa, Streptococcus pneumoniae R6
MKERKKMNLKDYIATIENYPKEGITFRDISPLMADGNAYSYAVREIVQYATDKKVDMIVGPEARGFIVGCPVAFELGIGFAPVRKPGKLPREVISADYEKEYGVDTLTMHADAIKPGQRVLIVDDLLATGGTVKATIEMIEKLGGVMAGCAFLVELDELNGREKIGDYDYKVLMHY

SEQ ID NO: 61789 - protein, 305 aa, Streptomyces griseus
MATQALGTALRLGVFDRIGTGELRAEALAGSLGTHPRATLRLLRALAGLQLLSEPEPGAFRTTAAGNVLRADAPGTMVAMARMFTDPVMLRGWDLLDESVRTGETTFDTVFGTDFFGHLREHPELSAAFNEAMSQGTRLTAETVPHHYDFGRFQRLVDIGGGDGTLLASILRAHQEPRGVLFDTAEGLAQAPRRLAREGLDGRVTLETGDFFASAPAGGDLYLLNSIIHDWDDAVRGHLRHIRDVIPDHGSLLIVEPVLPATVPADRPDNVYLSDLNMLVNVGGRERTADDFAALCTAGGFACGA

SEQ ID NO: 61790 - protein, 629 aa, Oceanicola granulosus HTCC2516
MQGFLIQATIYLGAAAIAVPLAARLGLGSVLGYLLAGVAIGFIPGIGSETEELQHFAEFGVVVMLFLIGLELEPRALWDMRDRLIGLGGLQITLTTGLIALGAAALGIAWPTALAVGMIFALSSTAIVLQTLSEKGLMQTPGGRSTFSVLLTQDIAVIPMLALLPLLVVGTGSATALHGEAAHGPEVHAMSLVEGLPGWGVTLVTLGAVAAIVLAGTYLTRPVFRYIQHARLREMYTVLALLMVVAIAVLMQSVGLSPALGTFLAGVVLANSEFRHELESDLEPFKGLLLGLFFITVGAGIDFELLLAHPLTLFGLTLGVIVIKGVVLYLLALLFKLRGRDRWLFTLGLAQAGEFGFVLISFSLQQAVLTQEAGAMLLMVVALSMMITPLLFILNERLSRRMVEAADAPADEIDETGPVIIAGIGRFGQVVNRLVRSAGYSTVVLDANLATVQTMRTFGFRAFFGDPTRPDLLHSAGFDDASVLVVALDDPAAATRLVRYARTARPDIHIVARARDRIHVYQLYQAGADDIVRETFDSSLRAGRYVLENLGLSEYEANEAEVYFYHHDRSAMRTLAQLYKPGVPVSQNPEYVAKARELERDLETALASNLDVEAMGLQRKGAAGGRAKE

SEQ ID NO: 61791 - protein, 546 aa, Oryza sativa Japonica Group
MSGFLAVVGKVGTFLLWLLFLVLQTATKIVGSLLAAGPPPADAQEAAAAAAARRRSPPASPHSGGGATDPYQPPQLWDPPPPSSPYSAGHAADEYSSSSSYRRRGASAPPAEDVVVSSSYSRPAAAVASAPQACTVSSAPPLRAVETRSPAPSRAAAAVGGKRPKLERKYSKIVDQYRSLDEVIEALAQAGLESSNLIIGIDFTKSNEWTGKRSFNGMSLHHIGDSPNPYEQAITIIGQTLSAFDEDNLIPCYGFGDASTHDQDVFAFYPDERPCNGFQEALARYREIVPHLRLSGPTSFSPIIEMATTIVEQSGGQYHVLVIIADGQVTRSVDTEFGQLSTQEQMTVDAIVQASEFPLSIILVGVGDGPWDMMKEFDDNIPARSFDNFQFVNFTSIMSKKISQSKKETEFALSALMEIPLQYKATLELGILGRRFAKSPERVPLPPPFASYNTISRAAPSRANSFRSMPSHPRDEAPVDSAITASVTSPPSVDARAAEPQLCPVCLSKPRDMAFGCGHQTCAECGPQVEHCPICRRPIDTRVKLY

SEQ ID NO: 61792 - protein, 428 aa, Vibrio cholerae O1 biovar eltor str. N16961
MMMDLAFDRCHIWHPYTSTLTPLTCYPVSRADGVMITLEDGRSLVDGMSSWWAAIHGYNHPKLNQAAHQQIEQMSHIMFGGLTHQPAIELCQKLLKLAPNNLQQVFLADSGSVAVEVSLKMALQYWHSKGQPRAKFLTLRHGYHGDTFAAMSVTDPDNSMHSLYKGFLPEHIFANSPEGGFFDAWDERDIADFRHKLTEHHHQIAAVILEPIVQGAGGMRIYHPEFLRQVRALCDEFGVLLILDEIATGFGRTGKLFACEHAGIQPDILCVGKALTGGYMTLSATLTTQQVADTVCAGEAGCFMHGPTFMGNPLACAVASASLSLIEQGDWQQQVANIEAFFAEQLPKLNDSPRVKQTRWLGAIGVVETHLPVNMEVIQALFVEHGVWIRPFGRLIYLMPPYISQPEHLQKLVDAMAAALNQPDCFKQ

SEQ ID NO: 61793 - protein, 190 aa, Shigella sonnei
RPGKINLGIGVYKDETGKTPVLTSVKKAEQYLLENETTKNYLGIDGIPEFGRCTQELLFGKGSSLINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAY

SEQ ID NO: 61794 - protein, 436 aa, Haemophilus somnus 2336
MSTQKSNKIGVVQLTILTMVNMMGSGIIMLPTKLAEIGTISIVSWLVTAVGSTALAYAFAQCGMFSKKSGGMGGYAEYSFGKAGNFMANYTYGVSLVIANTAIAISAVGYGSELLNVTLSPISIALCTIFTLWLATVLNFGGARITGNISSFTIWGVIIPVVGICLIGWFWFSGEMYVSAWNPHNVPTFEAIGVSISMTLWAFLGLESACANTDVVENPERNVPIAVLGGTLGAAVIYIVSTNVIAGIVPNLELANSTAPFGLAFAHMFEETTGKVVMGLMVMSCFGSLLGWQFTIAQVFKSSAEEGYFPAFFKKVTSKNAPIIGMVTITAIQSLLALMTISPSLNKQFNILVDLAVVTNVIPYLLSMAALMVLLKVEKVALNKAKITTFVAFIGSLYSLYALYAAGEQAMLYGSIVTFIGWTLYGFISYKFDIKK

SEQ ID NO: 61795 - protein, 314 aa, Glycine max
MEKYEKLEKVGEGTYGKVYKAREKASGSLVALKKTRLEMDEEGVPPTALREVSLLQLLSQSIYIVRLLSVEHVDKVPKSQKSSSNPLTKPILYLVFEYLDTDLKKFIDSHRKGPNPRPLPPPLIQSFLFQLCKGVAHCHSHGVLHRDLKPQNLLLDQHKGILKIADLGLGRAFTVPLKSYTHEIVTLWYRAPEVLLGSTHYSTGVDIWSVGCIFAEMVRRQALFPGDSEFQQLIHIFKMLGTPTEENWPGVTSLRDWHVYPRWEPQSLAKNVPSLGPDGVDLLSKMLKYNPSERISAKAALDHPYFDSLDKSQF

SEQ ID NO: 61796 - protein, 868 aa, Ostreococcus tauri
  misc_feature (702)..(708): Xaa can be any naturally occurring amino acid
MRGASSGATHHLGDFSNASFHDRPLSLEHNGGLKEYSVVYTDRAVNHMSSTFCETMKNIDGMMKRAYNASGVVIMPGSGTYGMEAVARQWCTGKKALVLRNGYFSYRWTDIFEQTGIPSETVVMRGRAVDDEAQPAFAPPPLAEVVEMIAKEKPAVVFAPHVETSTGIILPDEYIKGVADAVHAHGGLFVLDCIASGTIWVDMKETGVDAILSAPQKGWTGPACASVIMLGERGVHATRNSTSTSMVINMRKWLELMDSYLAGGFAYYTTMPTDALMLFERAAKATEAIGFNETKAAAWALGNECRKMMAAKGLKSVAAKGYEAPGVVVSYTDDAAMFAKFKAKGFQIAAGVPFMINEPAGNNTFRIGLFGLDKIMNKDNCINTLEPTLAEILRENESAAEKTAQFKTKRPRRPNATVVRHPSSEPCVRSRAPPRGRLDAPTSCAPPPRMHPRRRVTVRLPRNLRPDDPRRAMDAAHVAALETHGAMAARLDANVARVKRGKANMFLDGCPIVYAGAIEATEGKVKTGDWVCVTDHAKAPICVGFYNETSSYAVRALAMCWEEESVDGDVVIARRIREAYELRVSLGLVGNERTTCYRLLNSEGDRCSGLNADVYGDIVVASSTAAWAERRRDVILRSIADVVGENTKVVWRRDQKMYEQEGEPWNGESVSYYHAATGEEIAEGVPSEVHVVENGVKYDFTXXXXXXXALGGAASVTAVDSSESALAVAAQNAELNGVADKIEFVRADAFDFMQDALDSGAAGSYDVVILDPPKFAPNKTALAKALPKYVGLNKRAMALLSRGGILVTCSCSGAVTQDRLLPKVVNEAARASGRFVTTLSVTGAGKDQPIDPSYAFGEYLSVVTARIA

SEQ ID NO: 61797 - protein, 279 aa, Candida glabrata CBS 138
MGHSPTPRCIIVRHGQTEWSKSGQYTGLTDLPLTDYGVGQMLRTGESIFSNNRFINPDHITYIFTSPRTRAKQTIELVLKPLSEEQRSKIKVIVDNDLREWEYGDYEGLLTKEIVELRKSRGLDKARPWNIWRDGCENGETTEEVGLRLSRVIARIQNLHKKHQEQGIPSDIMVFAHGHALRYFAAIWLRLGEEKECITAFSKQKVKSYEEDESVVPYVEITKFRHLVDNPFFLLDAGGIGVLSYAHHSIDEPALDLAGAFISPPEEESQHAPVPNKNY

SEQ ID NO: 61798 - protein, 794 aa, Candida albicans SC5314
MVQLALFTNNNHNNNSNNNTTNTLNDDTQYDSTTMNTEDTPIIPDKTDKLNGSDSRSSSRNRTRSISFTRFLFNSNNNNNNNKDHTEQSRCPSNETSDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTNTSQNPQIETAPGRSDMSVALRHNDSVFSLNENGVLKPPKIHYSELSSSSEDNSEPSSPALPKTPMRDLVEKDELHLKPIEDERDLAIPASPFQRALRRVASAPLVHRLLNEKSPEDANNNNNNNTGNNLGGPFSTSTQTSPKKDEPFDINKHIGEVKITGRPRTYTQDRTYSNAATRIVDVQVGPNSFEKVRLLGKGDVGKVFLVREKSSNKLYAMKILNKKEMIERNKIKRALAEQEILATSNHPFIVTLYHSFQSKDHLYLCMEYCMGGEFFRALQTRDTKTICEADAKFYAAEVTAALEYLHLMGFIYRDLKPENILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQSISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNQSPMYNPDSSAYTSVAYTMTSNNENSFRQKSFLKR

SEQ ID NO: 61799 - protein, 287 aa, Synechococcus sp. WH 8102
MDLTIVGCGYVGLALAERLQPRRPQLKLTLTTTNSERLEQLDPLADRVEVCDATNPMQLLAALRQSSSAVFCLGPKGDRQVDANGYRHTFVDSFRCLTSLLPQLRELRQIVYTGSCSIYGDAEGDWVDEQTPPAPSRGHGDVLLESEHLLSGISDRRVCILRLGALYGPGRDLDRRLRGLAGLERPGNGATYSNWLHVADAAGALEAALNAEWAGLVNVVNDEPIQLRDLVGRSLQRQGLAPVRWLGQDEPGSGGRRIRNTRLKQLGYQLQHPRLDQSGVLATSQVP

SEQ ID NO: 61800 - protein, 187 aa, Betula pendula
NYGIIRDIMQNHLLQILALFAMETPVSLDAEDIRNEKVRVLRSMRPLQLANVVTGQYKSRTKGGVTYPAYTDDKTVPKDSLAPTFAAAALFIDNARWDGVSFLKKAGKALHTKRAEIRVQFRHVPGNVYNRNFGTDLDRATNELVIRVQPDEAIYLKINNKVPGLGMRLDRSNLNLHYAARYSKEIP

SEQ ID NO: 61801 - protein, 434 aa, Arabidopsis thaliana
MAREEQNIENRGSVHVVEGESNLRSVVCGPVRWLKMLASKLHWSYVFAVVSNCGINQGFGYSLGHVATDYYMKDVQKVQPSQYQALSAITRISWIIFKPLFGILTDVLPIFGFHRRPYFILAGVIGVVSLLFISLQSNLHLYLALFWMTISSAAMAIADVTIDACTTYNSNKHPSLASDMQSLCSLSYSIGELLGFFMSGILVHLVGSKGVFGLLTFTFALVSVVGVLFSEPRVHGFSFKQNFTNAMKAMWRTIKCSDVWQPSLYMFITRALGLDIKEGLFYWFTDSKDGPLFAQETVGFILSIGSIGSILGVLLYNLRLKDHPFRKLFLWTQLLFALSGMFDLILVLRLNLKFGLPDYLFIVVDGIVSKMIIRLTWMVIFVLNTKLCPHGIEGTFFALLMSIDNAGLMTSSWLGGKMLHVLKEIRTRSSSRLR

SEQ ID NO: 61802 - protein, 1148 aa, Oryza sativa Japonica Group
MDNPEAEPDDAVLFVGVSLVLGIASRHLLRGTRVPYTVALLVLGVALGSLEFGTKHGMGKLGAGIRIWANINPDLLLAVFLPALLFESSFSMEIHQIKKCMAQMVLLAGPGVLISTFFLGSALKLTFPYNWNWKTSLLLGGLLSATDPVAVVALLKELGASKKLSTIIEGESLMNDGTAIVVYQLFYRMVLGRTFDAGSIIKFLSEVSLGAVALGLAFGIASVLWLGFIFNDTIIEIALTLAVSYIAFFTAQDALEVSGVLTVMTLGMFYAAFAKTAFKGDSQQSLHHFWEMVAYIANTLIFILSGVVIADGVLENNVHFERHGASWGFLLLLYVFVQISRILVVVILYPLLRHFGYGLDLKEATILVWAGLRGAVALSLSLSVKRASDAVQTHLKPVDGTMFVFFTGGIVFLTLIFNGSTTQFLLHLLGMDRLAATKLRILNYTKYEMLNKALEAFGDLRDDEELGPPADWVTVKKYITCLNDLDDEPVHPHAVSDRNDRMHTMNLRDIRVRLLNGVQAAYWGMLEEGRITQTTANILMRSVDEAMDLVPTQELCDWKGLRSNVHFPNYYRFLQMSRLPRRLITYFTVERLESGCYICAAFLRAHRIARRQLHDFLGDSEVARIVIDESNAEGEEARKFLEDVRVTFPQVLRVLKTRQVTYSVLTHLSEYIQNLQKTGLLEEKEMAHLDDALQTDLKKFKRNPPLVKMPRVSDLLNTHPLVGALPAAMRDPLLSSTKETVKGHGTILYREGSRPTGIWLVSIGVVKWTSQRLSSRHSLDPILSHGSTLGLYEVLIGKPYICDMITDSVVHCFFIEAEKIEQLRQSDPSIEIFLWQESALVVARLLLPMMFEKMATHELRVLITERSTMNIYIKGEEIELEQNFIGILLEGFLKTKNQTLITPPGLLLPPNADLNLFGLESSAINRIDYCYTAPSYQVEARARILFVEIGRPEIEADLQRSASLISQTLELPRTQSKEHSGLLSWPESFRKSRGAQNGASLTEIRDHPASFSARALQLSMYGSMINDMKSGQGQGQRRQRHRHTKASSNKAHSSSYPRVPSRSSNTQRPLLSVQSEGANMTTARQAAAAGASLPPEPEEAGRRRRRQRKAIEEDEDNSSDESAGEEVIVRVDSPSMLTFRQPSSAADR

SEQ ID NO: 61803 - protein, 358 aa, Betula pendula
IGSEVIGGVGGTCVIRGCVPKKILVYGATFRGELEDARNYGWELNEKIDFNWKKLLHKKTEEIVRLNGIYKRLLTNSGVKMHEGEGKIVGPNEVEVTQLDGTKLSYTAKHILIATGSRAQRPPIPGQELGITSDEALSLEELPKRVVIVGGGYIAVEFASIWNGMGVTVDLCFRKELPLRGFDDEMRAVVARNLEARGVNLHPRTSLSEIIKTGDGIKVNTDHGEELIVDVVMFATGRAPNTKRLNLEAVGVELDKTGAVKVDEYSRTNIPSIWAVGDVTNRLNLTPVALMEGTCFAKTVFGGEPSKPDHRDVPCAVFSIPALSVVGLSEEQAIEQANGDILVFTSTFNPMKNTISGR

SEQ ID NO: 61804 - protein, 355 aa, Gibberella fujikuroi
MSRSNPPNAAGSRKISFNVSEQYDIQDVVGEGAYGVVCSAIHKPSGQKVAIKKITPFDHSMFCLRTLREMKLLRYFNHENIISILDIQKPRNYESFNEVYLIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFRTLFPQDLGSALDLLEKLLAFNPVKRITVEEALKHPYLEPYHDPEDEPTAPPIPEEFFDFDKHKDNLSKEQLKQLIYQEIMR

SEQ ID NO: 61805 - protein, 218 aa, Treponema pallidum subsp. pallidum str. Nichols
MERSFTLAPSLLSADFSALDRALVYLEAHGAQWVHLDVMDGHFVPNLTFGAPVLRCLRSKTHLPFDVHLMVSRPADLIEDFVQAGADFLTFHIEAEVHAHRLIHAIRGRGVKVGISLVPSTPVAALSEVLPFVDLVLVMTVNPGFSGQQMIAHCLSKVSALVQMRTERGYSYMISVDGGIDCRTLPQALDAGADVIVSGSAFFSGTLRSLLCKDSSGA

SEQ ID NO: 61806 - protein, 139 aa, Brassica napus
  misc_feature (122)..(122): Xaa can be any naturally occurring amino acid
YRCNPMSHHRIGNKYKIYPTYDFACPFVDSIEGITHALRSSEYHDRNAQYYKVLEDMGLRRVEIYEFSRLNLVYTLLSKRKLLWFVQQGLVGGWDDPRFPTVQGIVRRGLKIEALIQFILEXGASKNLNLMEWDKLWTI

SEQ ID NO: 61807 - protein, 261 aa, Thermobifida fusca YX
MATAKRKPLIAGNWKLNNNHLEAIALVQKMAFALNDADYDAADIAVLPPFTAIRSVQTLVEGDKLRITYGAQDISQHEKGAYTGEVSGPMLAKLNCTYALAGHSERREYHHEDDAVVNAKVKAAFASGITPILCLGEGLEVRKAGRHVEHTLAQLEGALKGVTEEQVRTLVVAYEPVWAIGTGEVATPEDAQEVCAALRKRIGELYSPEAAQQTRILYGGSVKSGNVAAIMAQADVDGALVGGASLDADEFVKLIRAAVQG

SEQ ID NO: 61808 - protein, 215 aa, Treponema pallidum subsp. pallidum str. Nichols
MNTQVWRVCVGVMLFCFVGRIGCAEEKMVREEGLAVADGIYAVMETNRGTIVLSLFFEKAPLTVCNFVGLAEGTLAVCKGRPFYQGLTFHRVIKDFMIQGGDPQGNGTGGPGYQFPDECDPALRHDSPGVLSMANAGPGTNGSQFFITHVATPWLDGKHTVFGKVVEGMEVVHAIIAGDTIRSLKIVRRGAAAKRFVCDQAQFDQLRKRVSAASK

SEQ ID NO: 61809 - protein, 395 aa, Thermobifida fusca YX
MRTIEDLDVAGKRVFVRADLNVPLDGDRITDDGRIRASLPTITALRERNARVIIGAHLGRPKGKVDPAYSLKPVAARLGELLGTEVRFASDTAGESAQAISRELADGEVALVENLRFEPGETSKDDAERGEFADRLAALAELYVGDGFGAVHRKHASVYDLPKRLPHAAGGLVLAEVNVLRKLTESPQRPYVVVLGGSKVSDKLGVIDNLLNTADRILIGGGMAYTFLAAQGYEVGASLLERDQIDTVKGYLRRAEERGVELVLPVDVVAAEKFAADAAHDVVDVREIPADRMGLDIGPASAELFASKLADAATVFWNGPMGVFEMEPYAKGTRSVAQALADSSAFTVVGGGDSAAAVRALGFDEKAFSHISTGGGASLEYLEGKTLPGIAALEE

SEQ ID NO: 61810 - protein, 335 aa, Thermobifida fusca YX
MTIRVGVNGFGRIGRNFWRAVQAAGGSDVEIVAVNDLTDKATLAHLLKYDTVLGTLPGEVEVGEDSITVGGTTMKALAQRDPAQLPWGDLGVDIVVESTGFFTKAEDAKKHLDAGAKKVIISAPAKGEDLTVVMGVNDDKYDPANHHILSNASCTTNCVAPMAKTLMENFGIVKGLMTTVHAYTNDQVILDYPHKDLRRARAAAQNIIPTTTGAAKATALVLPELKGKLDGLAMRVPVPDGSVTDLVVTLEREVTKEEVNAAFKAAAEGALKDILVYTEDPIVSSDIVGTPASCTFDASLTMAFGTQVKVVGWYDNEWGYSNRLVDLVKLVGSNL

SEQ ID NO: 61811 - protein, 402 aa, Pseudomonas putida GB-1
MAIPGSPRRFARIDRLPPYVFNITAELKMAARRRGEDIIDLSMGNPDGATPPHIVEKLVQVAQREDTHGYSTSRGIPRLRRAISNWYKERYEVDIDPESEAIVTIGSKEGLAHLMLATLDQGDTVLVPNPSYPIHIYGAVIAGAQVRSVPLVPGVDFFNELERAIRESIPKPKMMILGFPSNPTAQCVELDFFERVVALAKQYNVLVVHDLAYADIVYDGWKAPSIMQVPGAKDIAVEFFTLSKSYNMAGWRIGFMVGNPELVNALARIKSYHDYGTFTPLQVAAIAALEGDQQCVRDIAEQYRQRRNLLVKGLHELGWMVENPKASMYVWAKIPEQYAHLGSLEFSKKLLAEAKVCVSPGIGFGDYGDDHVRFALIENQDRIRQAIRGIRQMFRADGLTNK

SEQ ID NO: 61812 - protein, 250 aa, Bacillus caldolyticus
MKKKCIAMLLAGGQGSRLRSLTKNIAKPAVPFGGKYRIIDFTLSNCTNSGIDTVGVLTQYQPLLLHSYIGIGSAWDLDRRNGGVTVLPPYSASSGVKWYEGTANAIYQNMNYIEQYDPDYVLVLSGDHIYKMDYQQMLDYHIAKQADATISVIEVPWEEASRFGIMNTNENMEIVEFAEKPANPKSNLASMGIYIFNWPLLREYLQIDNADPHSSHDFGKDVIPRLLRENKRLVAYPFKGYWKDVGTVKS

SEQ ID NO: 61813 - protein, 348 aa, Staphylococcus aureus subsp. aureus NCTC 8325
MTYNIVALPGDGIGPEILNGSLSLLEIISNKYNFNYQIEHHEFGGASIDTFGEPLTEKTLNACKRADAILLGAIGGPKWTDPNNRPEQGLLKLRKSLNLFVNIRPTTVVKGASSLSPLKEERVEGTDLVIVRELTSGIYFGEPRHFNNHEALDSLTYTREEIERIVHVAFKLAASRRGKLTSVDKENVLASSKLWRKVVNEVSQLYPEVTVNHLFVDACSMHLITNPKQFDVIVCENLFGDILSDEASVIPGSLGLSPSASFSNDGPRLYEPIHGSAPDIAGKNVANPFGMILSLAMCLRESLNQPDAADELEQHIYSMIEHGQTTADLGGKLNTTDIFEILSQKLNH

SEQ ID NO: 61814 - protein, 473 aa, Triticum aestivum
MDVPLASKTFPSPSPSKREQCNIDGHKSSSKHADLNPHVDDSVLGIILGGGAGTRLYPLTKKRAKPAVPLGANYRLIDIPVSNCLNSNISKIYVRTQFNSASLNRHLSRAYGSNIGGYKNEGFVEVLAAQQSPDNPDWFQGTADAVRQYLWLFEEHNVMEYLILAGDHLYRMDYEKFIQAHRETDADITVAALPMDEERATAFGLMKIDEEGRIIEFAEKPKGEQLKAMMVDTTILGLDDARAKEMPYIASMGIYVISKHVMLQLLREQFPGANDFGSEVIPGATSTGMRVQAYLYDGYWEDIGTIEAFYNANLGITKKPIPDFSFYDRSAPIYTQPRHLPPSKVLDADVTDSVIGEGCVIKNCKIHHSVVGLRSCISEGAIIEDTLLMGADYYETEADKKLLAEKGGIPIGIGKNSHIKRAIIDKNARIGDNVMIINVDNVQEAARETDGYFIKSGIVTVIKDALLPSGTVI

SEQ ID NO: 61815 - protein, 326 aa, Trichodesmium erythraeum IMS101
MQTNQKLILPKIGCGTWAWGNRLLWGYDESMDNELQNVFSLCVSNGVTLFDTGDSYGTGRLNGRSEMLLGKFSQGYMGAYQDNICIATKLAAYPWRWRAKAMISACAASAQRLGKNVDLVQMHWSTANYFPWQEWGLLDGLADLYEQGKVKGVGLSNYGPKQLKKVYKRFSDRGVPIATLQVQYSLLSTYPVTELGVKEVCDELGIKLIAYSPLALGILTGKYSEKGSYPKGIRGILFKQILPGIRPLLLCLEAVAKSRNKTMSQVAINWCVSKGTIPIPGAKNQVQAQENIGALGWELDSGEVAELDKAAASTGKKMVQNIFQTQ

SEQ ID NO: 61816 - protein, 128 aa, uncultured bacterium
MPQLGLGVWKASNEEVISAIHKALEVGYRSIDTAAAYKNEEGVGKALRDSGLPREALFITTKLWNDDQKRPREALLESMEKLQLDYLDLYLMHWPVPAIDHYVEAWENMIDLQKQGLIKSIGVCNFQI

SEQ ID NO: 61817 - protein, 438 aa, Streptococcus pneumoniae R6
MLTYDLIVIGFGKAGKTLAGKLASAGKKVALVERSKAMYGGTCINIGCIPTKTLLVAAEKDLSFEEVIATKNTITGRLNGKNYTTVAGTGVDIFDAEAHFLSNKVIEIQAGDEKQELTAETIVINTGAVSNVLPIPGLATSKNVFDSTGIQSLDKLPEKLGVLGGGNIGLEFAGLYNKLGSKVTVLDTLDTFLPRAEPSIAALAKQYLEEDGIELLQNIHTTEIKNDGDQVLVVTEDETYRFDALLYATGRKPNVEPLQLENTDIELTERGAIKVDKHCQTNVPGVFAVGDVNGGLQFTYISLDDFRVVYSYLAGDGSYTLEDRLNVPNTMFITPALSQVGLTESQAADLKLPYAVKEIPVAAMPRGHVNGDLRGAFKAVVNTETKEILGASIFSEGSQEIINIITVAMDNKIPYTYFTKQIFTHPTLAENLNDLFAI

SEQ ID NO: 61818 - protein, 340 aa, Serratia marcescens
MNTVNASMTVIGAGSYGTALAITLARNGHSVVLWGHNPAQIQTLQHDRCNQAFLPDVPFPDTLLLEADLARALAASRDVLVVVPSHVFGDVLRQLKPHLRPDARIVWATKGLEAETGRLLQNVAREALGETIPLAVLSGPTFAKELAAGLPTAIALAATDAQFADDLQQGCMHCGKSFRVYSNPDFIGVQLGGAVKNVIAIGAGMSDGIGFGANARTALITRGLAEMSRLGSALGADPSTFMGMAGLGDLVLTCTDNQSRNRRFGIMLGQGKGVQEAQDSIGQVVEGYRNTKEVLALAQRQGVEMPITEQIYQVLYCHKDAREAALSLLGRARKDEKPSV

SEQ ID NO: 61819 - protein, 449 aa, Listeria monocytogenes str. 1/2a F6854
MEKHYDYIAIGGGSGGIASINRAAMHGAKCALIEPKFLGGTCVNVGCVPKKVMWYGAQIKEAMDLYADAYGYQVDASFNFQKLVENREAYIERIRGSYKNGLDNNKVEWIKGYAEFVDEKTLRINGELVTADHILIATGGEPALPSIPGAEFGITSDGFFALKELPKKVAVVGAGYIAVELAGVLQQLGSETHLFVRKHAPLRNFDPLLTDTLTEIIEQSDMTLHKHAIPQKVEKNPDGSLTLSLEDGRTETVDTLIWAIGRKPVIKDLQIENAGVELLESGHIAVDKFQNTNVAGIYAVGDVTGHYELTPVAIAAGRRLSERLFNNKKDAHLNYENIPTVVFSHPAIGTVGLTEPEAIEKYGKENIKVYTSSFTSMYTAITDHREPCRMKLICEGKTERVIGLHGIGYGVDEMIQGFAVAINMGATKADFDNTVAIHPTGSEEFVTMK

SEQ ID NO: 61820 - protein, 573 aa, Ostreococcus tauri
MRLPNGERFRSERDGMVFYLCFSIAWTIAIAMGAVAVKEVARTAWRLVKVASSLFAVMLPCFCVMASTNARRMRIGADAGEARKSSGAADPLGDAPRGRRRLCIVGAGASGLTATRHALRRGFDVTTFEKSDSVGGVWAYGHDACKVFNNVIQNVTKLTNVFADYPAKRAWPSYLGWRQTMDYLTGYAAAFSLNEHIELNAEIVRVERDEKSGEFEVTIAYRGESATMTHRIERFDYVWVASGQLTQAAMPEIRGLSTFTGDVMHSSEYKTPTLFAEKNVLVVGLGSASGSDIAQELSWVASSVSLSIRTERDVYSRGILGGVASMMNRVAWILPAWLGVLGYTYLDCYGWIHHLRKGVTDSGDLLSHFALNKIKRVDVIERVHGSTVYFTDGTCSVYDVIICATGYRRSFDFMAKNLQPNEKSGLFEDCILPSDPRVAYVLFVLPFGSHWQLAELQSMLLARVHDGTIPLPSRETMATLADSFNIVGTHEHLAEWWKHRYIFVLAPYIFPKLATLWRRPRLAMRILWSPWVAPFGEWASENDRDRTCYRDSWALANVTWSGHRLNRCMFFPW

SEQ ID NO: 61821 - protein, 478 aa, Ostreococcus tauri
MGLRKRPFKNTAARGRALGSTAREVYGEVLETGVLVASFELAGAQTFELIVDTGSSRTYLPCKGCASCGAHEAGRYYDYDASADFSRVECSACAGIGGKCGTSGVCRYDVHYLEGSGSEGYLVRDVVSLGGSVGNATVVFGCEERELGSIKQQSADGLFGFGRQAYALRAQLASASVIDDLFSMCVEGYEKLSGEHVGGLLTLGNFDFGADAPALVYTPMVSSAMYYQVTTTSWTLGNSVVEGSRGVLTIIDSGTSYTYVPGNMHARFLQLAEDAARESGLEKVAPPEDYPDLCFGNSGGLGWSTVSEYFPALKIEYHGSARLTLSPETYLYWHQKNASAFCVGILEHDDNRILLGQITMRNTFTEFDVARSQVGMASANCEMLREKYVEHASESPRLPPPPPPPSPSQSPLPPPSPPGSSDDNDSGVFVYLAMPVVGIIGVMGGSALMKKRDSNQWRRLEEDIGEHLDGEIELVDVP

SEQ ID NO: 61822 - protein, 713 aa, Zea mays
MSESESSNTAGFAAALELWQENQLRILVLISLATQCFLFVFAPLRQHRIPGPLRLSIWLAYLGSDAVAIYALATLFNSHRCDTGTGTGTARAGVELLWAPIMLVHLGGQDSIPAYNIEDNELWRRHVVTAVSQVAAAIYVFVKSWPKSMAATAAHLVVDQDTRNRINAFMAHKSEMAAYGRILGPALLLFFSGITKCVCKPWDLKRVSVNSLVDSSSSGSSEEKGDAGESEMMDSLQEYVGAAAQYFESVGHEEEEEDDDAACKADEVWKPYNLCVDLAPPYSGRLSCLKHLARSPADEAHRLVKSSLSATFHQLYTKESLKLHDMSHIVLTDNRALNRLKLVTSARGLRTVAAATLLGAIAAFYGEGDVDQDPTDVTITYALLWSAFVMECVLPTVIHHTFAWIERLFTGHRTWPDQVAQYSLMGYVARGRSHSWLMKAVACLGCGDLVDQLWTMKPRMGASSREITGLVHAHVAGAWMQGHIAGADSFRAFNDYRGQWTLGNCREIGVGVSSSMVVLMSSVSRPFDESVLVWHLATDFCFHLLQVQGDPSRANATARRCIEMSNYMAYLLFVKPEMLMPGARRKLFRDACRELVGLLEEDRPDAPRARGKRDLAHKVVQLLKRDGDDVLGSAGVGVVRRGLGVWVEMLCFSASRCKGYLHAKGLGTGGEYLSYVWLLLLYMGMETLAEKMQRTELYEGSTAAALSISGQNV

SEQ ID NO: 61823 - protein, 269 aa, Brassica napus
IKERIGAGSFGTVHRAEWHGSDVAVKILMEQDFHAERVNEFLREVAIMKRLRHPNIVLFMGAVTQPPNLSIVTEYLSRGSLYRLLHKSGAREQLDERRRLSMAYDVAKGMNYLHNRNPPIVHRDLKSPNLLVDKKYTVKVCDFGLSRLKASTFLSSKTAAGTPEWMAPEVLRDEQSNEKSDVYSFGVILWELATLQQPWGNLNPAQVVAAVGFKNKRLEIPRNLNPQVAAIIETCWTNEPWKRPSFATIMDLLRPLIKSAVPPPNRLDM

SEQ ID NO: 61824 - protein, 180 aa, Shigella sp. K-319
RPGKINLGIGVYKDETGKTPVLTSVKKAEQYLLENETTKNYLGIDGILEFGRCTQELLFGKGSALINDKRARTAQTPGGTGALRVAADFLAKNTSVKRVWVSNPSWPNHKSVFNSAGLEVREYAYYDAENHALDFDALINSLNEAQAGDVVLFHGCCHNPTGIDPTLEQWQTLAQLSVEK

SEQ ID NO: 61825 - protein, 468 aa, Mycobacterium tuberculosis H37Rv
MREYDIVVIGSGPGGQKAAIASAKLGKSVAIVERGRMLGGVCVNTGTIPSKTLREAVLYLTGMNQRELYGASYRVKDRITPADLLARTQHVIGKEVDVVRNQLMRNRVDLIVGHGRFIDPHTILVEDQARREKTTVTGDYIIIATGTRPARPSGVEFDEERVLDSDGILDLKSLPSSMVVVGAGVIGIEYASMFAALGTKVTVVEKRDNMLDFCDPEVVEALKFHLRDLAVTFRFGEEVTAVDVGSAGTVTTLASGKQIPAETVMYSAGRQGQTDHLDLHNAGLEVQGRGRIFVDDRFQTKVDHIYAVGDVIGFPALAATSMEQGRLAAYHAFGEPTDGITELQPIGIYSIPEVSYVGATEVELTKSSIPYEVGVARYRELARGQIAGDSYGMLKLLVSTEDLKLLGVHIFGTSATEMVHIGQAVMGCGGSVEYLVDAVFNYPTFSEAYKNAALDVMNKMRALNQFRR

SEQ ID NO: 61826 - protein, 560 aa, Bacillus cereus E33L
MEFSSKQRKDVLNGVNKQELDVIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLKKEPLVKQEGLKGGGYYVEYRTDDARLTIEVMKEAIEHGAKAVNYAKVDSFLYKDGKVCGVRVIDLLDGEVYEVYGKKIVNAAGPWVDTLREKDNSKKGKVLQLSKGVHLVIDQKRFPLGQAIYFDTPDKRMVFAIPRGGKTYVGTTDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSSTKHMPISGGHVDGSKGLPAFIAKKAGEGTKYGLTTAQAEEFAKFYGSNVDVLFDLAKKHKDEAKEYNMPLDVLIPLVYAMDYEMTAKPVDFFVRRRGAVFFNIHWVYEWKEAVINYMAAKLGWSKEEQMKYTAELEKALTDAVIPVDQQEHAAALA

SEQ ID NO: 61827 - protein, 428 aa, Gloeobacter violaceus PCC 7421
MRQVTAIILGGGRGTRLYPLTKRRAKPAVPIGGKYRLIDIPVSNCINSGIQHIYILTQFNSASLNRHVSQTYQFSRFSDGFCEILAAEQTDENPNWFQGTADAVRQYLWLLEPSGSTEYLILSGDHLYRMDYSKFVRRHRETNADVTIAVLPCDLERASDFGLIKTDADGRVVQFTEKPKGAELERMRVDTTTLGLTLEEAERRPFVASMGIYVFRHDVMLKLLRDDPSRTDFGKEILPACLDDYNVQAYLFDDYWEDIGTIEAFYKANLALTSQNAPPFSFYHPAPIYTRPRYLPPSKLIDCQIAESIITEGCIIKQARIFHSVLGLRSRIESGVRIEDSLLMGADFYETPIQREESLRRGLPPVGIGERCVLQKAIIDKNARIGNDVRILNKERPDSADHPERGFYIRHGIVIVPKDTVIPDGTVI

SEQ ID NO: 61828 - protein, 714 aa, Pseudomonas fluorescens PfO-1
MTQAIRYEKGQDGIVLLTIDMPGQSANTMNAVYREAMADSVARLLAEKDDIAGVIITSAKKTFFAGGDLNELIKVGKPEAKAFYDMVLTLKGQLRTLETLGKPVVAAINGAALGGGWEICLACHHRVALDDASVQLGLPEVTLGLLPGGGGVVRMVRMLGIEKALPYLLEGKKVRPQQALQAGLIDELAADRDELLAKARAWILANPAAVQRWDVKGYQIPGGTPSNPKVAQMLAIAPSILRTKTQGTLPAPEKILCAAVEGAQVDFDTAHLIETRYFTVLTTGQISKNLIGTFWFQLNEINAGGSRPQGFAPYVTKRVGVLGAGMMGAGIAYVSAVAGIDVVLKDINLAAAEKGKAHSAALLDKKVARGQMSAQQREAVLARIQPTESDADLAGCDLIIEAVFEDRQLKAKVSAAAQQVVGADAVIASNTSTLPITGLATAVPDQSKFIGLHFFSPVEKMPLVEIIKGAQTSDETLARGFDFVLQIKKTPIVVNDSRGFFTSRVFGTFTNEGIAMLGEGVSAPMIETEARKAGMPVGPLAISDEVSLSLMSHIRQQTAKDLQAEGKALIEHPAFAVIDLLLNEYKRPGKAAGGGFYEYPAGGQKHLWPELKTRFEKADGQISPKDVRDRLLFVQAIETVRCVEEGVLTSTADANVGSIFGIGFAAWTGGALQFINQYGVKDFVARAQYLAEQYGERFAPPALLLEKAAKGELF

SEQ ID NO: 61829 - protein, 300 aa, Symbiodinium sp. P083-2
RIGRQVARIAMKDPETDLKLINASYDADYLAYMMKYDTIHGKYDGTVEVDGDSLVIDGQTVALSHTRDPAEIPFKEHGAEYVCESTGVFLTTDKVQPHLKAGAKKVIFSAPAKDDSHTIVMGVNEDTYDPSMECVSCASCTTNGLAPAVRVLQEKFGIKRGLMTTCHAMTASQPTVDGTSKKDWRGGRAGPGNIIPSSTGAAKAVAKVLPAVKGKLTGMALRVPTIDVSVVDLTCELEKETTYEEICAEMKKRSEGDMKGYLGYTDEALVSTDFETNPISCTFDSKAGIMLDPTFVKEVC

SEQ ID NO: 61830 - protein, 150 aa, Brassica napus
MAEQTFIMIKPDGVQRGLIGEVISRFEKKGFYLKGLKLQNVEKSFAEQHYSDLSSKPFFAGLVEYIVSGPVVAMVWEGKSVVATGRKIIGATNPLASEPGTIRGDFAVDIGRNVIHGSDSVESARKEIALWFPEGIAEWRSSQHNWIYEA

SEQ ID NO: 61831 - protein, 443 aa, Azoarcus sp. EbN1
MTTIASVSDAAREQALAYVDGARRDAARIPDIPADTPLRPIRRVGVIGAGTMGGGIAMSFANVGIPVTVCDTDGAALERGLERVRRNYEFSVARGRLDAATMAARLALIRAAVDLQDLKDADLVIEAVFEDMALKQDIFRKLDAIVHPDAILATNTSGLDIDEIAVVTRRPQDVVGAHFFSPAHVQKLLEVVRGARTAPEVIATLMSLGRRMGKVSVLSRIYPGFIGNALFRQYVREAHFLVEEGALPHEVDSALGRFGYAMGVFAVHDMAGNDVGWQMRKAQMATRPRDRRWNDLILELCDMGRLGQKSGKGWYRYENGDRTPRRDPEIERYIVERSAHLGIERRPIGEDEIIKRCLYGMINEGAKLLEQGIALRASDIDIVFVTGYGFPAERGGPMYYADQVGLAGIFADVKQFHTRHGAWWTPSPLLERLAASGKKFAEL

SEQ ID NO: 61832 - protein, 491 aa, Listeria monocytogenes str. 1/2a F6854
MVFLSIKETALPKVQTKLFINGKWTDGDNKETKDIVNPANGDVIAKIAQAGPSETKKAIKAAKDAFPDWAKMELADRVKLLHKIADLMEEKADTLAKIMTLEQGKPLKESKGEVLTGVENFRFAAEEARRLYGETIPAPNNHAFIVKKQPIGVVAAITPWNFPGGMVTRKLAPALATGNTIVLKPSGDTPLSALAIFEIFEEAGLPKGVANIVMGSSKEIGETLTDSDDVRKLTFTGSTKVGQTLFKQSADTLKKISLELGGHAPFIVFDDANLDAAVNDLVAAKFRNNGQVCVSPNRIFVAKEIKEKFTKALVAKVEQLKVGNGLDNVNVGPLIREDAIDKIDKQLKNATDKGAKVLTGGGRLTGSDYDNGNFYKPTVLDNVTREMDIFYEETFGPVIPLITFETEDEAIEMANDSEFGLASYFYTKDLARVEKVGAALEYGMVGANEIAISNPETPFGGVKHSGFGRENGHYGMEEYIQVKFINLKYRD

SEQ ID NO: 61833 - protein, 315 aa, Mycobacterium avium subsp. paratuberculosis K-10
MARIAYLGPEGTFTEAALRQITAAGLVPGQGADGVRPTPVDGTPAALDAVRDGAADYACVPIENSIDGSVTPTLDSLAIGSPLQVFAETTLDVAFSIVVKPGLSAADVRTLAAIGVAAAQVRQWVAANLAGAQLRPAYSNADAAQQVAEGRADAAVTSPLAAARWGLDTLADGVVDEPNARTRFVLVGPPAPPPARTGADRTSVVLRIDNAPGALLAALAEFGIRGIDLTRIESRPTRTGLGIYRFFADCVGHIDDEPVAEALKALHRRCADVRYLGSWPTGTPAGALPPSTEEAVRWLAAVRDGKPEPPGESRR

SEQ ID NO: 61834 - protein, 136 aa, Glycine max
MSNSSAGTSSKPRAASSQPSETSSKRKRGVFQKELQHMMYGFGDDPNPLPESVALMEDIVVEYVTELVHKAQDIGSQRGKLSVEDFLYLIRKDSPKLNRCTELLSMNEELKQARKVFESDEEKLRKVFEVDDSVEG

SEQ ID NO: 61835 - protein, 498 aa, Aspergillus oryzae
MSPRPFTLNDPSLLHEASLLNGEWVAAQSNKRLSLTDPGSRHVFATCPTNGPEDVDKYVETSHAAFERYRHVNPRERAKFLLKWHELITKAREDIATIVVYETGKPMAEALGEVDYALGFAWWFAGEAERVRGSIALPSVSNRRTFVIKQPIGVSAALVPWNFPVAMIVRKVAAALAAGCTMIVKPSPETPLSVMALADLALRAGLAPGVLNVITTDNEYTPSVSERLCKHPLVRKVTFTGSTRVGSIIAKHCSEGLKKVTMELGGNCPFIVFDDGNLEQAVAALMILKWRTAGQACTHANRVYVQAGVYDKFAQMMLEATQKLKVGHGTDSGTTMGPLTTERGVEKLKKLVSDAISKGGKVLCGGKQPNGPQGYFFEPTIISGMTSEMLASQEEIFGPLLGLHRFETEEEAVKMANDTSMGLASYFFTKDIDRTWRLLESLAAGMIGMNTGNSSCAESPFGGIKESGYGKEAGKDVAIEEYLISKTGTLTVEGAPGP

SEQ ID NO: 61836 - protein, 214 aa, uncultured bacterium
MTIEIKVPDLPESVADATIATWHKKPGDLVARDEVLVDIETDKVVLEVPAPEAGVLGDILQLEGATVLSRQLIAILKAAPVAGEETKEKPVEVAADDAADGLSPSVRRLVAEHDIDVAKLTGTGKGGRVTKEDVDAFIKNLGKPAAPAAAVAAAPVAPIAPLAGRTEKRVPMTRLRKRIAERLLEAKNTTAMLTTFNEINMAPIMKLRKQYGEI

SEQ ID NO: 61837 - protein, 164 aa, Bifidobacterium longum DJO10A
MAETFNVVVEIPRGSKNKYEVDHETGRVFLDRTLFTAMGYPDDYGYIDGTLGEDGDPLDALVMIPNSVFPGCVVECRAVGLYHMVDEAGGDDKVLCVPADVRFDDIKDIDDVNEYHKAEIKHFFEQYKALEPGKEVLPGDYWTGADAAEKEIIAARERLANEGK

SEQ ID NO: 61838 - protein, 390 aa, Wolbachia endosymbiont of Drosophila simulans
MFLIKPSPTIAVTDKANKLKNEGKKICVLAAGEPDFDTPDHIKKAAIQAISEGKTKYTAVDGTRELKEAIINKLRKDNNLEYTLNQICVGTGAKQVLFNLFMATINSGDEVIIPAPYWVSYVDMVSLFGGLPVVVECKQNFKLTAELLKSRITKKTKWLILNSPNNPAGAVYTCDELKDIAQILLEYPHMNVVTDDIYEHIIYDEKFFTIAQVEPKLYDRVFVVNGVSKAYAMTGWRIGYIAGRSDVVKAISTLQSQSTSNPNSIAQAAAAAALNGDHSFLKERTRIFKSRRDFMVKELNSAPGLSASVPQGAFYLFVSCEGLLSKSTKSGKIINNDLDFTEYLLGDHLVAVVPGIAFGLENFIRISYATSQEQLEIGCDSITKACQELK

SEQ ID NO: 61839 - protein, 796 aa, Candida glabrata CBS 138
MARHGIEREDSVTSELARLERIFSHHRINHDTVLKDALQFSNERVTIINANPASKEFGFWFIVSCYFPVITACLGPVANTISIACAVDKWRVNYFYVEGGGDKVFTHIDDPRGVFAVNIISLVIGCCSNAVLFLHFARKLSYLKSQIINIVGWTLAGGMLMIDVIVLSTHNIDETYQEKTIGFWYAAITSGLYLCCTLTLSIHFVGHKLQKYPAQFNLLPNERSIMVFTVILSIWLIWGAGMFSRLLHISYGNALYFCTVSLLTIGLGDILPKSTAAKCMALVFSMTGVLILGIIVFMTRSILQTSAGPIFFFHRVEHRRVKAWEKLTRGDCTLTDKECFELMMSIRRTSKMKGHIYSLMITIIIFILFWILGATVFYFAEGWTYFNAVYFCFLCLLTIGYGDYAPETGAGRAFFVLWSIGAVPLMGAILSTAGDLLYASSESLDVKLGKWLKNSVKTVLIGPNLTKKQSYTSSSPLEEQAEVNEFNFGNDDGIGIIDSTFNNDEDSQSTVSDNIGDPINIRMASSNNNNNVDGLHTLAAAISRSSSYRRKGASSGSNRRRNNSIKDEVEKCNREDEVFEGTDLFGDIRTEREKITRLNQLVKVLKRLHEMSLNDKDKKLNYNDWSKIHHLALKNLNNDGIDPNPTYWLSEYSPLKFPLNQPHYAFMKIMGLMDRTLRNLAIDESMRGQSHFREDAANFMINPFNRLPVITHSEEQTLSSSPFSHTSSAASLTSSFDSSNNSVAFSQDDAHAFTSLENSESLHNSENSSELQHEASTTSDSNTNTFDKGSRSTEHD

SEQ ID NO: 61840 - protein, 481 aa, Caulobacter crescentus CB15
MGCVRDLTQRGMRQGAKPVRYFGERTDVSDLLAHTLQTVADILGPHGPATKAAEHSYTPNDYSIHFFLQLAVILLACRVTGWFGKKFLAQPQVVGEMIAGVVLGPSLLGLLFPDFQLSLFPKETRNILYVGAQLGVGLYMFLVGASFQAGHFKTKARSAMSVSFAGIAAPFAIAVIITPFLLKVPGLFAPTITPGAATLFMGACIALTAFPMLARIINERGLQKTSLGTLSLTAGAFDDAVSWCVLAVVLAMFGGGPGVAVLAIGGGLLWVLFVLTLGPKILAPLGRMVEREGELSAHALALVILAFCVSAFLMDAVGIHAIFGGFIMGVVMPRGLLTQELKKKVEPLVVVLLLPMFFTYSGLNTRLDMVNSLDLLLIALGILACSILAKWGACYVAARATGEDHATAMGIGALMNSRGLMELIIINIGLQKGIIGPTLFAMLVLMAIVTTMMASPLFEIVYGKKARERGELDAVPDAKRA

SEQ ID NO: 61841 - protein, 1447 aa, Candida glabrata CBS 138
MTFLKKIAGSNGHSKSGSVSSIRYSANSQASPSASVSSSRSFKTHVRNSSNSTDYSGSTYVFGTGNTASSGSNHGTPTSSKTFSKMGSSYNRRSIDSPRSTSNRNSEYTLDNSSLNSHPQANKGGDNVSRPTSLEKNADTDSSTYSRKSSGSTSSLSFDNLILSWDPTNPDEWTLSRVIAWFKFHDFPDSWIAVFKRHQLCGQRFLRLLAYDNFAIYEKHLPISKNASFDKFQALLKDTMKKNVSSSHSRQRSGNSVAAMHIEPNKGVNLRHKSSRSQDDIVGSRSASESGINNEQLNLGKPPEKGVVKSHKKTKSTGSLYRRSFISLMGSSSHSSAENTQMEKNNPNIKIHIPSRPQSVVESEPSTAKTLSPLSPPYSALFNKLDQKNRSDPTLFEISDEKYSRLKNDDYNDDIAAQSSSTNFNGKQQHSSSATYSKSKKNEKGGFNVRNSAVMPEDKSTFWEKLKRKSQTISPSTQNHTQLNSANLSKNRVSLQQIQGGFDMTDQVKPDNIVTPKIHQAHKSSSIDTKSQNFENVFDKFLLDKKYYPAKIKSSTNEEDFVLITKDNVSFIPLLISELPNECSKLKEYFMRKLRIVSGECSVHMTDFGCDIGASLNDTLLDTIRNSLFMNTSRKLFIRDTGTHKYSPGKPIINSSQREMLRKKESIKSINSSILASNDEISTITSSSDIASFDDRSSAPGRQYPQTPSYFYDASNVNDDVNYWNFKENQSSLVPGKVPDVKPEAQFTLKIPDKIKHKGLEDDLQRNSFHVLRKDEGKEIDFNNRRRSPYTNPELAPKREAPKAPITGSPMRLQKSRSLSKSVSIVTNNDRSRRDELSPSRKSYKNSETNSPSSEKIVSSYTPGSSHVLVPQPYKGVGDISRKGKLEDDHMFSMTEVLRSRVNRSTSSVSNNSVIYSTSPILKRGSSKRIVSSASAADVFEENTINFNDVPELSDSDEDSASSEDIIWGSETKISETEVVPENNNFNKTDSEDDDKIYSMNNKLTPVRKMTLRPTAEIVYQNLERFFPRAHLDKPVVEELHNSKSPVSKTSDKARINSILEQHSNISEKGVKSQNNDNVIKEKKSNTSLPRRTRTIRAIAHEAGEARRNSMKVKRSNTKMWGTKIVEITDKNTIEINKSKNARGEYKEFAWMKGEMIGKGSFGAVYLSLNITTGEMMAVKQVEVPKYGTQNELVKDMVEALKSEVATLKDLDHLNIVQYLGSEIRGNIYSLFLEYVAGGSVGSLIRLYGRFDEKLIRHLNTQVLSGLKYLHSKGILHRDMKADNLLLDEDGICKISDFGISKKSKNIYSNSDMTMRGTVFWMAPEMVDTKQGYSAKVDIWSLGCVVLEMFAGKRPWSNLEVVAAMFQIGKSKSAPPIPDDTIQLISSKGKDFLSKCFEIDPEKRPTADDLLEHSFSKVDPAFNFSRTRLYEFIKTNDKLNSSVLRNT

SEQ ID NO: 61842 - protein, 440 aa, Oceanicola granulosus HTCC2516
MRIAMIGTGYVGLVSGVCFSDFGHDVVCVDKDPRKIERLNNGEVPIYEPGLDELMARNVAAGRLSFTLDLEEALAGAEAVFIAVGTPTRRGDGHADLSFVMAAAEEIAKTATDYVVVVTKSTVPVGTNRKVAETIRAANPDLAFDVASNPEFLREGAAIDDFMRPDRVVVGVQSDRAAEVMAEIYRPLFLREFPIITTDLESAEMIKYAANAFLAVKITFINEIAALCEKVGADVKEVSRGMGLDGRIGNKFLHAGPGYGGSCFPKDTKALARIGQEFAAPMQITETVIKVNEEVKRRMIDKLLDLCGGSFNGRTVTVLGVTFKPNTDDMRDAPALTIVPALVGGGAKVRVVDPQGRHEGEQMLPGVTWQDDPYAAAEGADLLVILTEWNEFRGLDLGRLSGAMARPRMADLRNIYSAGDAEKGGFEAYVSIGRSPFMVM

SEQ ID NO: 61843 - protein, 482 aa, Ehrlichia canis str. Jake
MSIPITVAYGDGIGPEIMEAVLLILSEAESGLVIETIEVGHNLYKKEWSSGIAPSSWDSIFRTKVLLKSPTMTPQGQGHKSLNVTLRKKLGLYANIRPCISYHPVIKTKYPNLNIVIIRENEEDTYTGIEHRLTSDTYQCSKVITRSGSERICNYAFHYATVHNRKKVTCLIKDNIMKMTDGIFHKSFSKIAENYPSITSDHYIVDIGMAKVAANPENFDVIVTTNLYGDIVSDIVAELSGSIGLAGSANIGDNYAMFEAVHGSAPDIAGKNIANPSGLLNAAIQMLIYLKKFDKAELIYNALLKTLEDGMHTADIYQSQVSKGKVSTMGFAKAIIDNFGQSPTQFPKSIFQNSAGESGISYTYKPSYATKVLVGVDLSISCDSADLNLKQLISNIQGVTHDKLELVLIHSKGLEIWPDESSNANLSYMDQICCRFYMKGQSDKIVNEHVNQLLFDMSKKKIDVVKMEKLYLYDNQPGFFTM

SEQ ID NO: 61844 - protein, 323 aa, Oryza sativa Indica Group
MAGRSELVVSFGEMLIDFVPTVAGVSLAEAPAFVKAPGGAPANVAIAVARLGGGAAFVGKLGDDEFGRMLAAILRDNGVDDGGVVFDAGARTALAFVTLRADGEREFMFYRNPSADMLLTHAELNVELIKRAAVFHYGSISLIAEPCRSAHLRAMEIAKEAGALLSYDPNLREALWPSREEARTKILSIWDHADIVKVSEVELEFLTGIDSVEDDVVMKLWRPTMKLLLVTLGDQGCKYYARDFRGAVPSYKVQQVDTTGAGDAFVGALLRRIVQDPSSLQDQKKLEEAIKFANACGAITATKKGAIPSLPTEVEVLKLMESA

SEQ ID NO: 61845 - protein, 229 aa, Pseudomonas fluorescens PfO-1
MSDLIAYHLEDGIATLTLSNGKVNAISPDVIAAFNAALDQAVADRAIVIITGQPGILSGGYDLKVMTAGPKEAVSLVTAGSTLARRLLSHPFPVIVACPGHAVAKGAFILLSADYRIGVDGPFSIGLNEVQIGMTMHHAGIELARDRLRRSAFHRSVINGEMFDPQSAVDAGFLDKVVAAEELQGAALAAARQLKKINMTAHKNTKLKVRKALLETLDNAIIQDQEHLG

SEQ ID NO: 61846 - protein, 145 aa, Ehrlichia canis str. Jake
MEIILLERTLSILKPDVVKRNITGQVNSYIENSGLKIVTQKMCLLTRFQAEEFYAIHKSQHFFIPLVDFMVSGPIIVQVLEGENAISLYRELMGATDPKKANPGTIRGDFAENIDANCVHGSDSLDNAVREIRFFFSDYELLSLK

SEQ ID NO: 61847 - protein, 560 aa, Ralstonia eutropha JMP134
MYQYDQYDQRIVNERVAQFRDQVRRRLSDELTEEEFLPLRLQNGLYMQRHAYMLRVAIPYGLLASKQLRKLAHIAREYDRGYGHFSTRQNIQYNWMELERVPDVLAELASVEMHGIQTSGNCVRNITTDHFAGVAPDESVDPRVLAELLRQWSTFQPEFAFLPRKFKIAISASKDDRAVVQMHDIGIYVYKNDAGETRIRVLAGGGLGRTPILGTIIKDDLPWQHMLTYVESAIRVYNRYGRRDNKYKARIKILVKAIGAEKFAEEVEEEWQYSKDGPGTLTQDEFDRVAQYFTPPAYEKLADTDASYEKHLLEDKAFARWVSRSVHGHKVPGYAAVTLSTKPGPVSPPGDATAEQMEAVADLADQFGFGELRVAHEQNLVLPDVKKHDLYDLWQLAKKAGLATANIGLLTDIIACPGGDFCSLANAKSIPIALAIQERFDNLDFVHDLGEVSLNISGCINACGHHHVGNIGILGVDKDGSEWYQVTLGGAQGNSTALGKVIGPSFSAEEMPDVISRIIETFVANRIEDERFIETVNRIGIAPFKERVYADKQPRERAEA

SEQ ID NO: 61848 - protein, 300 aa, Symbiodinium sp. JCUCS-1
RIGRQVARIAMKDPETELKLINASYDSDYLAYMMKYDTIHGKYDGTVEADGDSLVVDGEKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNIIPSSTGAAKAVAKVIPDVKGKLTGMALRVPTIDVSVVDLTVELEKETTYEEICAEMKKRSEGDMKGFLGYTDEALVSTDFETCPISCTFDAKAGIMLDPTFVKVVC

SEQ ID NO: 61849 - protein, 464 aa, Mycobacterium sp. JLS
MRIAQHVSELIGNTPLVQLNSVVPEGAGTVAAKIEYLNPGGSSKDRIAVKMIDAAEASGELKPGGTIVEPTSGNTGVGLALVAQQRGYKCIFVCPDKVSEDKRNVLRAYGADVVVCPTAVAPDDPDSYYSVSNRLVTEIEGAWKPDQYSNPMGPESHYETTGPEIWRDTDGKVTHFVAGVGTGGTITGAGRYLKEVSGGKVRVIGADPEGSVYSGGTGRPYLVEGVGEDFWPSAYDPAVPDEIIAVSDADSFDMTRRLAREEGLLVGGSCGMAVVAAIEVAQKAGPDALVVVLLPDGGRGYLSKIFNDSWMSSYGFLRNRLDGSIEQPTVGDVLRGKSGELPDLVHTHPSETVRDAIGILREYGVSQMPVVGAEPPVMAGEVAGSVSERELLSAVFEGRAKLADAVAEHMSPPMPLIGAGELVSTAAKTLRECDALMVVEEGKPVGVVTRHDLLGFLSDGSTRR

SEQ ID NO: 61850 - protein, 107 aa, Desulfovibrio vulgaris subsp. vulgaris str. Hildenborough
MAAQITDATFEASVLKSAIPVLIDFWAPWCGPCRAMGPVIDELAAEYEGKVLIVKMNVDDNPATPSKYGIRAIPTLILFKNGEVVEQVTGAVSKSSIKDMIAQKALG

SEQ ID NO: 61851 - protein, 347 aa, Symbiodinium sp. JCUCS-1
MATKIGINGFGRIGRMVFQAICDQNLLGTKLDVVGVVDMSTDAEYFAYQMKYDTVHGRFKHDVKIGEKDELIVNGNKIKCIQASREGPKALPWKEMGVEYVIESTGLFVEAEKAAGHIEAGAKKVIISAPGKGDLKTLVCGVNHTEYDKANHNVVSNASCTTNCLAPIVHVLLKEGVGIEKGLMTTIHSYTATQKTVDGVSAKDWRGGRAASCNIIPSATGAAKAVGEVLPTTKGKLTGMAFRVPTPDVSVVDLTFTAEKDTSIEEIDALFKKASETYMKGVLSFTDEELVSADFIHNVNSSIYDSKATLQNNLKGEKRFFKIVSWYDNEWGYSNRVVDLLMHMISA

SEQ ID NO: 61852 - protein, 502 aa, Triticum aestivum
  misc_feature (164)..(164): Xaa can be any naturally occurring amino acid
MARKMLKDGEAPAVADGGGGEGEGSYDYDLFVIGAGSGGVRGSRTAAGFGAKVAICELPFHPISSEWLGGHGGTCVIRGCVPKKILVYGASFRGEFDDAKQFGWEINGDINYNWKKLLENKTQEIVRLNGVYKRILGGSGVTMIEGAGSIVDAHTVEVTQPDGXSKQRHTTKHILIATGSRATLVDIPGKELAITSDEALSLEELPKRAVILGGGYIAVEFASIWKGLGAEVDLFYRKELPLRGFDDEMRTVVASNLEGRGIRLHPGTNLTELSKTADGIKVVTDKGDELIADVVLFATGRAPNSNRLNLEAVGVEVDQIGAIKVDEYSRTSVPSIWAVGDVTNRINLTPVALMEATCFAKTVFGGQTVKPDYKDVPCAVFCIPPLSVVGLSEQEALAEAKNDLLVYTSSFNPMKNSISKRVEKSTMKLVVDAETDKVLGAAMCGPDAAEIMQGIAVALKAGATKATFDSTVGIHPSAAEEFVTMRTLTRRVSPPSKPKTNL

SEQ ID NO: 61853 - protein, 267 aa, Shigella flexneri 2a str. 301
MHPMLNIAVRAARKAGNLIAKNYETPDAVEASQKGSNDFVTNVDKAAEAVIIDTIRKSYPQHTIITEESGELEGTDQDVQWVIDPLDGTTNFIKRLPHFAVSIAVRIKGRTEVAVVYDPMRNELFTATRGQGAQLNGYRLRGSTARDLDGTILATGFPFKAKQYATTYINIVGKLFNECADFRRTGSAALDLAYVAAGRVDGFFEIGLRPWDFAAGELLVREAGGIVSDFTGGHNYMLTGNIVAGNPRVVKAILANMRDELSDALKH

SEQ ID NO: 61854 - protein, 104 aa, Glycine max
  misc_feature (6)..(6): Xaa can be any naturally occurring amino acid
  misc_feature (9)..(9): Xaa can be any naturally occurring amino acid
  misc_feature (28)..(28): Xaa can be any naturally occurring amino acid
  misc_feature (30)..(30): Xaa can be any naturally occurring amino acid
  misc_feature (32)..(33): Xaa can be any naturally occurring amino acid
  misc_feature (35)..(37): Xaa can be any naturally occurring amino acid
  misc_feature (39)..(39): Xaa can be any naturally occurring amino acid
  misc_feature (44)..(44): Xaa can be any naturally occurring amino acid
  misc_feature (70)..(70): Xaa can be any naturally occurring amino acid
  misc_feature (72)..(72): Xaa can be any naturally occurring amino acid
  misc_feature (86)..(86): Xaa can be any naturally occurring amino acid
  misc_feature (100)..(100): Xaa can be any naturally occurring amino acid
ARLLVXYIXRLYSDDKYRYEIKDILEMXMXVXXLXXXYXVVYHXYRSLSPLLQDAGLNDLNMTQLTWGLXDXTYKMDLILVHPPHXCLACIYIASVLREXDTLG

SEQ ID NO: 61855 - protein, 491 aa, Azoarcus sp. EbN1
MGDEAMEERFVNRMSMGKGWIGGWTDLDGGVLAVTEPATGERLAEVGLASAGDVRRAAQLAAEAQPAWAAMPFLKRAAIFRRAAVILEREQQAVADWIVRETGGIRPKAEGEVAAVINHLHEAAAMLTQPRGLILPSDEGTLSYARRVPHGVVGVISPFNFPFLLSSRSLTPALGAGNAVVLKPDPRTPVSGGLLLALLFEAAGLPPNLLQVLPGEAEAGEAVVTDPDITMISFTGSTAVGRRVGELAGRHLKKVALELGGKNSLIVLDDADVDLAVSNGAFASWMHQGQICMSAGRHLVHEKVADAYVERMARKAKSLPVGDPYREAVALGPLITAKQLDRVERIVSESVRAGARLKAGGTARGQCYSPTVLDGVTPSMPAFREEIFGPVVSVTTFASDDEAVRLANDTEYGLSAGILTRSMTRGKAIAERLRVGLVHINDQTVIDDGFMPMGGRGASGNGSRHGGPANWDEFTQWQWVTYRDTPPEYPF

SEQ ID NO: 61856 - protein, 301 aa, Oryza sativa
MAEHLASIFGTEKDRVNCPFYFKIGACRHGDRCSRLHNRPTVSPTIVLANMYQRPDMITPGVDAQGQPIDPEKMQEHFEDFYEDIYEELSKFGEVETLNVCDNLADHMIGNVYVQFREEEQAVAAHNALQGRFYSGRPIIVEYSPVTDFREATCRQFEENSCNRGGYCNFMHVKQIGRELRRKLYGGRSRRSHGRSRSPSPRHRRGNRDRDDFRRERDGYRGGGDGYRGGGGGGGGDGYRGGDSYRGGGGGGRRGGGSRYDRYDDGGRRRHGSPPRRARSPVRESSEERRAKIEQWNRERE

SEQ ID NO: 61857 - protein, 330 aa, Helicobacter pylori
MRYIDDGLENQTILITGGAGFDGSNLAFYFQENHPKAKVIILDKFRSNTLFSNNRPSSLGHFKNLIGFKGEVIAADINNPLDLRRLEKLHFDYLFHQAAVSDTTMLDQELVMKTNYQAFLNLLEIARSKKAKVIYASSAGVYGNTKAPNVVGSNESPENVYGFSQLCMDEFVRFHSNDNIQVGLRYFNVYGPREFYKEKTASMVLQLALSAMAFKEVKLFEFGEQLRDFVYIEDVIQANVKAMKAQKSGVYNVGYSQARSYNEIVGILKEHLGDFKVSYIKNPYAFFQKHTQAHIEPAILDLDYTPLYDLESGIKDYLPHIHAIFKEQHA

SEQ ID NO: 61858 - protein, 494 aa, Alkalilimnicola ehrlichei MLHE-1
MPAEPIWPFDNSYARLPERFFARVRPTPVAQPGLVRLNEPLAEALGLEVAALRGKAGLAMFAGNRLPEGAEPIALAYAGHQFGQWVPQLGDGRAVLLGEVVDRDGRRRDIQLKGSGITPFSRGGDGRAPIGPVVREYLASEAMHALGIPTTRSLAAVTTGEPVLRERVEPGGILTRVAHSHVRVGTFEYFHWREDVDALRTLADYVIARHYPELADDARPHLALLKAVIDRTAELVAHWISVGFIHGVMNTDNTSLVGETLDYGPFGFLDAYHPRTCYSAIDIENRYAFDQQPRIAHWNLTRLAETLLPLLHEDEDEAVARAGEALNGFLPRFEACHHARLRAKLGLAESRRGDIDLAHELLDLMARQQADFTQVFRALSDERMDDPDEGPARRCFARPEALDGWRARWIQRLRQEGRPEPARQAAMRAVNPKFILRNHLAQWAVDAATERGDFGPMDRLLQVLTRPYDPQPEAEALAAPPRPEQQVYQTFCGT

SEQ ID NO: 61859 - protein, 503 aa, Rhizobium sp. NGR234
MSDTRTYDLFVIGGGINGAGIARDAAGRGLSVLLCEKDDLAQGTSSRSGKLVHGGLRYLEYYEFRLVREALIEREVLLQSAPHIIWPMRFVLPHNPVDRPAWLVRLGLLLYDHLGGRKRLPGTRTLDLRTAPEGAPIKPAYRRAFEYSDCWVDDARLVVLNALDAEQRGARILTRTACSNIRRRGDLWHVEMTDAVTGAKAEVRARCVVNTAGPWVNDVIGRVAGLNSRRSVRLVKGSHIVVPKFWEGRQAYLVQNPDKRVIFINPYQNDLALIGTTDIPYDGRPEDVAADADEIAYLVKSVNRYFKQQLSDADIIQSFSGVRPLYDDNAENPSAVTRDYIFELDAANGEAPLLSVFGGKITTFRKLSEHALERLKPFFPKIGPAWTARAHLPGGDMADADFDRFLGELRSRYRWLPADLAKHYARLYGTRTHALIGDANSLEELGTAFSRLFREREARFLIETEWARTVEDLLQRRTKHGLHMSEAEKRSFSGWLEGQQAAA

SEQ ID NO: 61860 - protein, 337 aa, Oceanicola granulosus HTCC2516
MRHALITGTAGFIGFHLARRLLAEGWRVTGYDGMTDYYDVALKRRRHQVLLQSEGFAAHEGMLEDSARFDAVADAAAPDVIVHLAAQAGVRYSLENPRAYLEANVMGTFTVMEAARRHGVAHLLMASTSSVYGANTELPYAETHKADRPLTIYAATKKANEAMGHAWAHLHRIPVTMFRFFTVYGPWGRPDMALFKFTRGILEGTPIDIYNHGDMWRDFTYVDDLVRGIALLIDTPPPPPGAPRPDIAGDTLSDAAPWRVVNIGNSESVRLLDFVEAIEAATGRRAIRNLMDMQPGDVPATWADSTLLRALTGYGPETKVAEGVAQFVGWYRDYYQI

SEQ ID NO: 61861 - protein, 693 aa, Oryza sativa Indica Group
MAAGSHGGYRGYEVAREREHDVGVSRRSKEHYHHRHPSRHRDSERRRDGGRSGGRELSNGYSHRRDSPRPPPRRRPSEGRTEDREPGEVSGGSGSERSGERPMKTREPRENGVTRVSKEEAKMSPSKKRKQSPVIWDRNGSQRQARDPVRGIREVDAVVAEIIMHQSHSLPVMSSLSSIGDGHSPMILDVSVDKVQEYEKNRIVDEEEEGYPTMRNILTSRWADAGDEEENVFVPKKKKSVSPVDSIERGSTKKVTSPESGEVLVYNSVRSSSRSSDSGVLQGSANRDLEVEKGDNIDVEKAADDDYPAGHLLDSDFEGEDCRSETPECTRSPRRCINMLQGCRSVDEFERLNTINEGTYGVVFRVRDKRTGEIVALKKVKMEKEREGFPLTSLREMNILLSFHHPSIVEVKEVVVGSNDRDIFMVMEYMEHDLKGVMETMKQPYSQSEVKCLMLQLLEGVKYLHDNWVLHRDLKTSNLLLNNRGELKICDFGLSRQYGSPLKPYTQLVVTLWYRAPELLLGAKDYSTAIDMWSLGCIMGELLSKGPLFNGKSEIDQLDKIFRTLGTPDENIWPGYSKLPGATVKFGKQTHNRLRDKFRAVSFTGGPMLSEAGFDLLNRLLTYDPEKRISAEDALNHEWFRELPLPRSKDFMPTFPALNEQDRRFKKHMKSPDPLEEQWMKEQGNNGDRGLFG

SEQ ID NO: 61862 - protein, 441 aa, Myxococcus xanthus DK 1622
MELICIGLSHRTAPLTVRERLALPESRQVDVLQRLAQAPVEALWVSTCNRVEVYLFAPDAAMARQRALMELQVLGGVEALEHLYEHQGEAALVHLFRVACSLDSMVLGEAQILGQVKEAFERGQGAGAVRGELMRACAAAFSCAKRVRTETAIGRAATSMAAAAVQLASKVFDGLAGKTVLVVGAGEMGELAARHLKQAGASKLYVTNRTLSRAEALAAEVGGQARPFEELLGLVAAADVVVCSTASQAPLFTRDNVGALGRGRRGRPLFMVDLAVPRDIDPAVGTLDWVHAYDVDDIQKFVADNAAARAEEAQKAGVLVAQEVARFVKERALREGTPVLARLRQRAEAIARSEVERTLGALGDGLNEKQRKSIEAMGRAIVNKLLHEPTARLRAVGPEGEGNRLAGAAAELFGLLEEEVGTAAAAPSVMAAPVQVATGGK

SEQ ID NO: 61863 - protein, 116 aa, Ostreococcus tauri
MLRRGALRAIARASATRAPTASEALTLRAYGAGFLNKDDVTDRVVRVVKNFAKVDAAKVSATSAFASDLGLDSLDVVEVVMAMEEEFAVEIPDAEADKIQSVPEAVAYLAANPNAK

SEQ ID NO: 61864 - protein, 337 aa, Desulfovibrio vulgaris subsp. vulgaris str. Hildenborough
MPEVTVTEHLLLHQKKSPAATGQFTTLLNDLVLSAKIISRSVTKAGLLDVLGGTGEVNVQGELVQKLDEFANRVLIYRMERSGAVCAMASEENADIIKVPEKLHRGDYVLIFDPLDGSSNIDVNINVGTIFSILRRKSPASDDVCIDDVLQPGYEQVAAGYILYGPSTMLVFSTGQGVHGFTLDPSVGEFLLSHPDMSIPERGRIYSINESYWNYWDEPTREIVSYFKGDHNERGKPYSLRYVGSLVADFHRTLLYGGIFMYPMDYRHPDKPQGKLRLMCEASPLAFLAEQAGGRAIDGSRRILDVCPGTLHERIPLFIGSARDVDKVEEIYARHRA

SEQ ID NO: 61865 - protein, 216 aa, Triticum aestivum
KQAESRHRKNKMQRAIQAIGSHGSVLKSAVLQHISVVKPAMLPAVFPRFMSVSSAQIEESGFESSTVADILKSKGKSADGSWLWCTTDDSVYDAVKSMTQHNVGALVVVKPGEDKSIAGIVTERDYLRKIIVQGRSSKSTKVGDIMTEENKLITVKPETRVLKAMQLMTDKRIRHIPVISGTEMMGMVSIGDVVRAVVSEHKEELNRLNAYIQGGY

SEQ ID NO: 61866 - protein, 272 aa, Agrobacterium tumefaciens str. C58
MADRDTSTSHAGETASIVEEIARKAGDLALAHFRSLSSLSVETKGHLDLVTKADKEVETFLIAQLREAFPADGIFGEEGGEIKGRSGRIWVIDPIDGTFNFVRGGQNWAISIGLYENKRPTFGVIFAPVRNLMFVGGKTVETKLNGMAVKPLPPLDMSRASTGFSYHPSASTADRLEVIRYISDDLNISFRFCGAATLSMVEVAMGETDGYVSLGDSTWDVMAALPILSNLGVADTIDWDRTDLSAKLRFACGSHDFLEKVKPLLDKVALAA

SEQ ID NO: 61867 - protein, 535 aa, Glycine max
MKVRSEREKTKVVIRHLPPSLTQSDLFQHIDSHFASRYNWFSFRPGNNSHKRQRHSRAYIDFKCPDDVFEFAEFFDGHVFVNERGAQHKVIVEYAPSQRVPKPSAKKDGREGTIFKDPDYLEFLKLIAKPQEHLPSAEIQLERKESEQVGASKETPIVTPLMEYIRQKRAVDSGMQASSAVAKVCRRSRAALPGKPGSGNIKRGSEKKKYVQKDNAKSATRKESKNMSAFIVVPRRDDQFAESSIKGISDIKTLHGVEGSISGIPLTSESGKKKFLLLKGKQQDIPSATEATVKQQNVQSGNSPISTPAKQNQRREASGRLIRSILLNNEARQSQSTTGTQHKIQILSSENGQRPSRRFGSRSGLNNQVSNHDAAQINSEGDSRRALDEKFIKRDLHGLGSSAKTEKRTRNKDRPDRGVWTPLRRSDVSHAGNDYSSSSLAQPTQSNPESAEGEVKENVPSGNRGGEFSASAGGHGGNPSIENGSQRNFIHHGASYVVKDDGAVSSISKGKPSKKSVGHSAHEKQVWVHKSSSGS

SEQ ID NO: 61868 - protein, 300 aa, Symbiodinium sp. CS-156
RIGRQVARIAMKDPETELKLINASYDSDYLAYMMKYDTIHGKYDGTVEADGDSLVVDGQKIALSHTRDPAEIPFGEHGAEYVCESTGVFLTTEKVQGHLKAGAKKVIFSAPAKDDSHTIVMGVNEDTYDPSMECVSCASCTTNGLAPAVRVLQEKWGIKRGLMTTCHAMTASQPTVDGTSKKDWRGGRAGPGNTIPSSTGAAKAVAKVIPEVKGKLTGMALRVPTIDVSVVDLTVELEQDTTYEEICAEMKKRSEGDMKGFLGYTDEALVSTDFETCPISCTFDARAGIMLDPTFVKVVC

SEQ ID NO: 61869 - protein, 347 aa, Physcomitrella patens subsp. patens
MKESKKPKYTKFTQQELPACKPLLTPGWVMATFMVVGIIFIPIGAVTLLASNSVVEVVHRYDLECLPSTLATQADRVRYIQDSSIDHSCTVTLNIPKRMEPPVYVYYELTNFYQNHRRYVKSRNDQQLRGDSVSSLDACKPLATTPGGQTIVPCGLIAWSLFNDTFLFNPTQAAPNAIGSITVEKTGIAWKSDVTSKFGANVKPQNFPNNDRTGALGWIGGAALDPSKPLKEAEDLIVWMRTAALPNFRKLWGKINQQLEANQTITVRISNVYNTYTFKGSKKLVLSTTSWLGGKNSFLGIAYLTVGLICMFLALVFFLIHLKNPRPLGDTSYLSWNRKSAASNSRS

SEQ ID NO: 61870 - protein, 400 aa, Brassica napus
MALATFSVPKPSLQGFTDFSGLRSSSASLPFGKKLSSDEFVSAVTFQTSAMGSSGGYRKGVTEAKLKVAINGFGRIGRNFLRCWHGRKDSPFDVIAINDTGGVKQASHLLKYDSTLGIFDADVKPSGDAALSVDGKIIKVVSNRNPSLLPWKELGIDIVIEGTGVFVDREGAGKHIEAGAKKVIITAPGKGDIPTYVVGVNADAYNPDEPIISNASCTTNCLAPFVKVLDQKFGIIKGTMTTTHSYTGDQRLLDASHRDLRRARAAALNIVPTSTGAAKAVALVLPNLKGKLNGIALRVPTPNVSVVDLVVQVTKKTFAEEVNAAFRDSAEKELKGILEVCDEPLVSVDFRCSDVSSTIDSSLTMVMGDDMVKVIAWYDNEWGYSQRVVDLADIVANNWK

SEQ ID NO: 61871 - protein, 185 aa, Desulfovibrio vulgaris subsp. vulgaris str. Hildenborough
MFNLANRITMARVLLVPLIIVLLYFPGRITCLLAVVFFIIASLTDLLDGHIARKENMVTSFGKFLDPLADKLLICSILVMLVELNWIPAWVSIIIICRELMVTGLRAMAADEGIVIAADKYGKIKTVLQMVALVPLMLHYPWFGFDPQPLGQFVLYMALVLTVFSGFNYLNGFYRNWLDKDAAAG

SEQ ID NO: 61872 - protein, 297 aa, Desulfovibrio vulgaris subsp. vulgaris str. Hildenborough
MSSCSSCSSGRKGGEGGVDAATAIQDQLISSTLGRIKYKLFIMSGKGGVGKSSVTVNTAAALAARGFKVGILDVDIHGPSVPNLLGLHATLEADERGGLINPAKCNENLYVVSMDSLLRDRDTAVLWRGPKKTAAIRQFVADVNWGDLDFLLIDSPPGTGDEHMTVLKTIPDALCVVVTTPQEISLADVRKAINFLQYAQANVLGVVENMSGLCCPHCGKEINLFKKGGGRELAEKYALPFLGAIPLDPATVVAADTGVPVVLLEGDSHAKQGFLALADNIAAAVGNSLEAISSSHA

SEQ ID NO: 61873 - protein, 535 aa, Symbiobacterium thermophilum IAM 14863
MRFDPLDYPYPSRRNCVYAARGMVATSQPLAAQAGLTVLQQGGNAVDAAVAAAAALTVVEPTSNGIGSDAFALVWAGGQLHGLNSSGPAPRKLTLESLNRAGLSEMPRYGLAPAMVPGAPAAWVELNRRFGRLPLAQVLAPAVEYAERGYPVSPTLGRNWEAAYENYRRNLAGEEFRPWFDTFAPAGRAPAIGEIWRSPGHARTLRLIAETAGEAFYRGELAERIAAFARRHGGFLDLEDLASFRPEWVQPLHVRYRGYDVWELPPNGQGLVALMALNILKGFSFGSREEPEAYHLQIEAIKLAFADGLRYIADPQSMDVTPEELLSDAYAEERRRLIGRTALEPAPGRPPKGGTVYLAAADAEGNMVSYIQSNYMGFGCGIVIPETGIALNNRGHTFRLDPAHPNCLAPGRRPYNTIIPGFLTRDGQAVGPFGVMGGFMQPQGHVQVIVNAIDFGMNPQACLDAPRWRWVEGRTVEMEHAVPEHIADALARRGHAVRWALGSGGFGRGQIIWRQDSGVLVGATEPRTDGHVAAW

SEQ ID NO: 61874 - protein, 300 aa, Polarella glacialis
RIGRQVARIAMKDPEVELKLVNASYEADYLAYMMKYDSIHGRYDGTVEVDGDSLVIDGHKVALSHTRDPAEIPFAKYGADYVCESTGVFLTTEKIQAHLKAGAKKVVFSAPAKDESHTIVMGVNQETYKPEMQAVSCASCTTNGLAPMVKAINDAFGIKRGLMTTIHAMTASQPTVDGASKKDWRGGRAASGNIIPSSTGAAKACALVIPAIKGKLTGMAFRVPTIDVSVVDLTCELEKATTYEEICAEIKRRANGDMKGYLGYCDESLVSTDFETCPISSTFDAKAGIMLDSTFVKLVA

SEQ ID NO: 61875 - protein, 251 aa, Oryza sativa Indica Group
MKSPELQASVIRDLVLLSCVGLHPVLVHGGGPEINSWLLRVGVEPQFRNGLRVTDALTMEVVEMVLVGKVNKHLVSLINLAGGTAVGLCGKDARLLTARPSPNAAALGFVGEVSRVDATVLHPIIASGHIPVIATVAADETGQAYNINADTAAGEIAAAVGAEKLLLLTDVSGILADRNDPGSLVKEIDIAGVRQMVADGQVAGGMIPKVECCVRALAQGVHTASIIDGRVPHSLLLEILTDEGTGTMITG

SEQ ID NO: 61876 - protein, 234 aa, Pleurochrysis haptonemofera
MLKRVAVGVGKALRDTGQAIERMGCRAQDNFIFNEPYCRHRAVMNLYDQRPRVAQGAFIAPNAAVIGNVDIEPRTSIWYGAVIRGDQSNIFIGGESSIGDRSVVQSSTVNPTGFSARTCIGDWVKIGQGCVLRACTIEDYCQIGDGCIVQEGALIENGAMLEPGSVVPQGARVPAGEVYAGNPATFVRKLSKEEIEEFGEYAEEVCDLAAKHLDEFLDYPTTYQLREQMAKETK

SEQ ID NO: 61877 - protein, 156 aa, Helicobacter pylori J99
MQIIEGKLQLQGNEKIAILTSRFNHIITDRLKEGAMDCFKRHGGDEELLDLVLVPGAYELPLILDKLLESGKYDGVCVLGAIIRGGTPHFDYVSAEATKGIASAMLKYSMPVSFGVLTTDNIEQAIERAGSKAGNKGFEAMSTLIELLSLCQTLKD

SEQ ID NO: 61878 - protein, 606 aa, Oryza sativa Indica Group
MATQAIAPMHAAVVHRHHVLPPRRCVRRRGVFVRASAAAAAETDTLSAAFWDYNLLFRSQRDECLDSIPLRVTEGAIPPDFPAGTYYLAGPGIFSDDHGSTVHPLDGHGYLRSFRFRPGDRTIHYSARFVETAAKREESRDGASWRFTHRGPFSVLQGGKKVGNVKVMKNVANTSVLRWGGRLLCLWEGGQPYEVDPRTLETVGPFDLLGLAADDDNKATNASAARRPWLQEAGLDAAARLLRPVLSGVFDMPGKRLLAHYKIDPRRGRLLTVACNAEDMLLPRSHFTFYEFDAHFDLVQKREFVVPDHLMIHDWAFTDTHYILLGNRIKLDIPGSLLALTGTHPMIAALAVDPRRQSTPVYLLPRSPETEAGGRDWSVPIEAPSQMWSVHVGNAFEEANRRGGLDVRLHMSSCSYQWFHFHRMFGYNWHHKKLDPSFMNAAKGKEWLPRLVQVAIELDRTGECRRCSVRRLSDQHARPADFPAINPSYANQRNRFVYAGAASGSRRFLPYFPFDSVVKVDVSDGSARWWSTDGRKFVGEPVFVPTGGGEDGGYVLLVEYAVSKHRCHLVVLDAKKIGTENALVAKLEVPKNLTFPMGFHGFWGDE

SEQ ID NO: 61879 - protein, 950 aa, Pseudomonas putida GB-1
MLELAKEQIAMGQTAADKAEALSLLADRLVGDGLVAEGYLQGLQAREVQGSTFLGQGIAIPHGTPQTRDLVYTTGVRLLQFPEGVDWGDGQMVYLAIGIAARSDEHLRLLQLLTRALGETDLAEALRRASSAEALLKLLQGAPQALALDAQLVGLNLPAEDFDELAWRGARLLQRADCVDSGFAAVLQQAEPLPLGEGLWWLHSERQVRQPGLAFITPQQPLRYRDQPLNGLFCLASLGAAHQALLERLCEVLIEGRGQMLYQATSSRAVLEVLGGEAPADWPSARIVLANPHGLHARPAKVLAQLAKGFEGEIRVRLVDSAQPAVSLKSLSKLLSLGARRGQVLELVAEPGIAADALPVLLAAIEQGLGEEVEPLPQSVTPMADHPPEVLQAPAAGSRIQGVGAAPGIASGPAHVCVEREFDYPLRGESCAQERQKLRAAIASVNSELQALVLRSDKAIGEIFVTHQEMLADPALTDDIEQRLAQGESAAAAWMAVIEAAARQQESLHDALLAERAADLRDIGRRVLAQLCGVQAQVEPEQPYVLVMTEVGPSDVARLDPNRVAGIVTAQGGATAHSAIVARALGIPAVVGAGASILLLESGTPLLLDGQRGVVSVAPPVDELQQALAERDLREQRLQAAWANRFEPAVTRDGHAVEVFANIGDSNGIAKVVEQGAEGVGLLRTELIFMAHPQAPDVATQEAEYRRVLDGLGGRPLVVRTLDVGGDKPLPYWPIAAEENPFLGVRGVRLTLQRPQIMEDQLRALLRAADQRPLRIMFPMVGQVHEWREARAMVERLRAEIPVADLQLGIMVEVPSAALLAAQLAREVDFFSIGTNDLTQYTLAIDRGHPSLSAQADGLHPAVLTLIDMTVRAAHAQGKWVGVCGELAADPQAVAVLLGLDVDELSVSARSIAEVKALVRQADHQTARALAREALQQDSAAAVRALVERY

SEQ ID NO: 61880 - protein, 358 aa, Methylococcus capsulatus str. Bath
MGNPDQPTPQHIVDKLIESSRKGTNHRYSVSKGIPRLRRAICHWYLNRYGVELDPDSQAIVTIGSKEGLAHLALATVGPGDAVLVPNPAYPIHPYGFVLAGADVRHVPLLPGVDFFAELEMAIKTSWPKPKMLVLNFPANPTAQCVDLEFFEKVVEIAREYKIWVVHDLAYADLVFDGYVAPSILQVPGAEDIAVEFFTLSKSYNMPGWRVGFMCGNRELVSALGRIKSYLDYGTFTPIQVAAITALEGPQDCVENIRLMYQNRRDVLCKGLNDIGWPVEKPKGTMFVWARIPERYQSLGSLEFAKKMLLDAHVAVSPGIGFGEFGDDHVRFGLIENEHRTRQAIRGVRDMMRKDNAV

SEQ ID NO: 61881 - protein, 416 aa, Cryptococcus neoformans var. neoformans B-3501A
MSFTNFWAGVPEGPPDPILGVTDAFKKDTSPKKVNLGVGAYRDEDGKPYVLDSVLKAEDILHKKKLDKEYLPITGAADFIKLASELAYGKDSKPLREGRVAVSQSISGTGALRIATGFLSSFYSGPKVIYLPNPTWGNHVPLAESVGIKVERYRYFDKKTVGLDFEGMKEDIKNAESGSIILLHACAQNPTGIDPTQEQWKELSDLLKAKKHLPLFDMAYQGFASGDIIRDAFAVRYFVEQGHQIILCQSFAKNLGLYAERAGTFSMVCASPEEKERVMSQIKRVVRPLYSSPPIHGAQLVATILGTPELYDEWLTEVKKMADRIIAMREKLYNLLIELKTPGEWGHIKSQIECLGMFSFTGISKEQVDDLAEYAHVYMTKDGRISMAGLNEHNIQYFAESLSKAVKGELRTKSAL

SEQ ID NO: 61882 - protein, 313 aa, Rhizobium sp. TAL1145
MTDIREWTSTVGLENELGEVLSGLANACATIARTLRTAPLAQLSGSAGSLNVQGEAQKPLDIISNEVFVNACRELAQISLAVSEEEEDPIPISATGSYAVVFDPLDGSSNLDVNVTVGSIFSVVSATTPKHILPGGRPQHIAGFASYGPSTDLTVLAKGRVARFTLDASDTWRLVELDMRLPDRFPEIAINAARADSWDDVIRGFVNDAFHGNEIRYNARWVASLVAETQRILSRGGLFLYPADSSGRGRLRLLYEARPIAAIVEAAGGRCSTGFMPILEVNAETLHDRVPLIFGGASQVEALEAAYRADKEN

SEQ ID NO: 61883 - protein, 364 aa, Shigella flexneri 2a str. 301
MKINRIVNEGFMKTMLAAYLLGNSTVDLREVAVPTPGINQVLIKMKSSGICGSDVHYIYHQHCATAAAPDKPLYQGFINGHEPCGQIVAMGQGCRHFKEGDRVLVYHISGCGFCPNCRRGFPISCTGKGKAAYGWQRDGGHAEYLLAEEKDLILLPDALSYEDGAFISCGVGTAYEGILRGEVSGSDNVLVVGLGPVGMMAMMLAKGRGAKRIIGVDMLPERLAMAKQLGGMDHGYLATTEGLPQIIAELTHGGADVALDCSGNAAGRLLALQSTADWGRVVYIGETGKVEFEVSADLMHHQRRIIGSWVTSLFHMEKCAHDLTDWKLWPRNAITHRFSLEQAGDAYVLMASGKCGKVVINFPD

SEQ ID NO: 61884 - protein, 369 aa, Oryza sativa
MEQGQGDRYWCHHCEEVIEPVEPDMKCPSCDSGFVEEMGSAGFEPSTNLRSDRISLWAPLLLGMMGGSSQRARRLRRQIMEDDDDDDDNEDDEDDSDHELEDLFRRQRRGSSLVRLLQNLRDDLRGLDDIGRDSDRDRQRERRERERLRERARERERLEERERERRRERTESLILINSNNEAIILQGTFGPDDNQDDSSNTSSGVSLGDYFLGPGLDILLQHLAESDLNRSGTPPAKKEAVEALPTVNIQEVLGCSVCLEDFEMGTEAKEMPCQHKFHSQCILPWLELHSSCPICRFQLPTEESKNPCESAGGIVSVNDDGDDAGTSSDVDSANQPGSPIFSALSALFSNPSSSSSSSSDDNAPHSSES

SEQ ID NO: 61885 - protein, 259 aa, Agrobacterium tumefaciens str. C58
MMTDARTTAEGGMETSYGFHKVDEGKKQGLVNEVFHKVAKRYDIMNDVMSAGLHRLWKDAMVSALSPRKDPSYKILDVAGGTGDVAFRIIEASNRLAHATVLDINGSMLAVGEERAAKKKLSDNLTFVEANAEELPFEANTFDAYTVAFGIRNVPRIDVALKEAYRVLKRGGRLLVLEFSEVDMPLLDRVYDAWSFNAIPQFGKMITGDAEPYQYLVESIRKFPNQEDFATMIRTAGFSRVTYTNYTGGIAALHSGWKL

SEQ ID NO: 61886 - protein, 166 aa, Oryza sativa
  misc_feature (45)..(45): Xaa can be any naturally occurring amino acid
MAKEVDPCDHGEVVDAGCVRAVLAELVLTFVFVFTGVAATMAAGXPVHTLGSGIGPMQGLVMEIILTFSLLFVVYATILDPRSSVPGFGPLLTGLIVGANTIAGGNFSGASMNPARSFGPALATGVWTHHWIYWLGPLIGGPLAGLVYESLFLVKRTHEPLLDNSF

SEQ ID NO: 61887 - protein, 380 aa, Ostreococcus tauri
MSFTGLTSTALPTKAEQTFAGRVQRQTATKATGSKTVAAMKGKTIKVAINGFGRIGRNFLRCWHGRANTMLDIVAINDSGGVKQASHLVKYDSVLGTFEADVKIVDDTHISIDGKKIEIVSSRDPLQLPWKALGVDLVIEGTGVFIDTPGASKHITAGASKVLITAPAKGDDIPTYVLGVNADGYKHSDKIISNASCTTNGLAPFVKVIDEKFGLVKGLMTTTHSYTGDQRILDASHRDLRRARAACLNIVPTSTGAAKAVALVLPQLKGKLNGIALRVPTPNVSVVDLVVQTSKKCTADEVNAAFREAANGPLKGILAVADEPLVSCDFRCTDVSCTIDAALTMVMGDDMLKVVSWYDNEWGYSQRVVDLAELCAANWE

SEQ ID NO: 61888 - protein, 380 aa, Ostreococcus 'lucimarinus'
MSFTGLTSTALPTKAEQTFTGRVARQTATKATGAKTVAAMKGKQCKVAINGFGRIGRNFLRCWHGRANTMLDIVAINDSGGVKQASHLVKYDSVLGTFEADVKIIDDTHISIDGKSIEIVSSRDPLQLPWKALGVDIVIEGTGVFIDTPGASKHLTAGAKKVVITAPAKGDDIPTYVLGVNADQYKNTDKIVSNASCTTNGLAPFVKVLDDRFGIVKGLMTTTHSYTGDQRILDASHRDLRRARAAALNIVPTSTGAAKAVALVLPQLKGKLNGIALRVPTPNVSVVDLVIQTSKKVTADEVNAAFREEAAGKLKGILAVADEPLVSCDFKCSDVSTSIDAALTMVMGDDMLKVVAWYDNEWGYSQRVVDLAELCAANWE

SEQ ID NO: 61889 - protein, 255 aa, Rhizobium sp. NGR234
MSKSRLWVGTSWKMNKTLSEAIAFADGLAAADAKRDDRIQRFVIPPFTVVREMKERLKETSVKIGAQNMHWEDAGAWTGEISPLMLKDCGLDLVELGHSERREHFGETDRSVGLKTAAAVRHGLVPLICIGETLAEREAGEADAVLKRQVEGAFALLDGAAKQAPILLAYEPVWAIGVNGIPATADYADARHQRIAEVAEAALGVAVPVLYGGSVNPGNCEELIAQPHVDGLFIGRSAWEVDGYLDILERVAGTI

SEQ ID NO: 61890 - protein, 85 aa, Glycine max
ENGELLGRADQGHTITAISSERLLKPILSADEVSVCVHGTYRKNLDSILKSCLKRMTRLHVHFSCGLPTSGDVISGTLLNIIILM

SEQ ID NO: 61891 - protein, 439 aa, Ostreococcus tauri
MSAAVQTVELTARTAIAGNFRKATTPRADAKVRVCAIDRDRARVRRARGARRLTNATACVTQANVNVVTEAKVKVAINGFGRIGGRNFVRCWKTRGPDCPLQVVCVNQSGGAKPAAHLLKYDSILGTFKSDVKVIDDSTISVDGDVIKVVSDRDPLNLPWKEMGIDIVIEGTGVFLDGPGAGKHITAGAKKVVITAPAKGNDIPTYVVGVNADQFDPSANIVSNASCTTNCLAPFAKVIDDKFGIVKGTMTTTHSYTGDQRILDASHRDLRRARAAALNIVPTSTGAAKAVALVLPQLKGKLNGIALRVPTPNVSIVDLVVNVEKKGVTAEEVNAAFKEYADGPMKGVLAITDTPLVSVDFRCTDVSTTIDAALTMVIGDDMVKVVAWYDNEWGYTQRVVDLTLIVANSLINEGSVTLDPLDQLCSDDPSADECKVFDS

SEQ ID NO: 61892 - protein, 400 aa, Actinobacillus pleuropneumoniae serovar 1 str. 4074
MNMQQTEAFRSQFPFFRQQAEWSYLDSAATTLKPQILIDSTVEFYASAGSVHRSQYDLIQSRAYERARDLVASRFNTESRNAVIWTSGTTHAINLVAYGLEHLLEAGDEIVISVAEHHANFIPWQQLAQRKQAKLIVLPLDANFQLNPTALTQAVSERTKIVALNLVSNVTGVRQPVERLIPIIRRRSNAKILLDCAQAVCCERVDVQKLDADFYAFSAHKMYGPTGVGVLTGKLQSLEQIRPLFFGGKMLEDISESALSVAALPYRLEAGTPNIAGIIGFGKTLEWLEQWDFEALNHVVDNLAEEAYKRLKKYKNIRIFSQPNCSIISFAFDGIHHADIAAIMTESKIALRSGEHCAKPYLHYLQQSGTLRISLAHYTSPDELDKFFKALDLALDILLD

SEQ ID NO: 61893 - protein, 818 aa, Ustilago maydis 521
MASAATASRQAGPTAAPSQTPASNSSPTTAPSAMAPPILEPWDGLDTRILTDLARRGLMSTLDTIKEAKTLMLDPSLAGPLGLVADVSSLKQHGVEKMFWLEPASAAFVTKNDAKHSQAQVKAGLKFVNAPTKSVVYICRPEIKWMKAIAERGDLPDKDAPNEAPSLYNPALLSPPQMLGCAGRRHPILSPLILLISLYSSEHLRADRSVRPTSPLQHTYTISFVPHRTEPCLQFLDQEAVLSDVSLLDFGLEFVPLDHDLISLEDETAWKRIYCDGDHTPIFRSAQALMTLQHAYGLFPRILGKGALARRLADLLIRQRREHLASDPSSPALTAPSHLIDSLIIIDRAVDYATPLCTQLTYEGLVDEVVGINNGHVEVDPALLTGHAQTAEVGAQPHASGSGTPLQMTSAPKKRKHRLDASTDLLFAEIRNLNFAVVGDCLHRAAKRLNQDYEGRHQAKTVSQIRAFVGKLGGLQSEHACLRLHTGLTEKIMEWTSREEFNRMLEVQQNSVAGLDLPAQYQAIEDMVNEERDLVGVLRLLCLTSVVGLGSTAGGIKAKNLEFVKREILQTYGYQHLPLLLALQKVGLLTRASAIPATSSTGGFGGALSSVVGVGNSSANAAGDSESRGSAEEGGKGGFASVRRSLRLINDDVDERAPTDISYVYSGYAPLSIRLVQAIAQKEALLDPSRSDPNAKPVRAVKPRAHPIVGWRGFDDAVNQLPGATFDEIQSGSMAGNTGSNAELGQGASSSGAASLLPPTDPDAVTSTLVFFLGGVTYTELAALRFMNAQTRNRRFVVATTNTINGNKMINDLAETRL

SEQ ID NO: 61894 - protein, 351 aa, Oryza sativa
  misc_feature (220)..(220): Xaa can be any naturally occurring amino acid
MENGHAKNLVAVIGSGNWGSVASRLIASNTAKLPSFHDEVRMWVFEEILPTGKKLSESINQANENCKYLPGIKLGANVIADPDLENAVKDANMLVFVTPHQFVEGICKKLVGKLRPGTEGISLIKGMEVKMEGPCMISKLITNILGINCCVLMGANIANEIAVEKFSEATIGYKKDKEVATRWAKLFTTPYFLVSVVEGIEGVELCGTLKNVVAIAAGLXGGLDMGNNTKAAIMRIGLREMRAFSKLLSPTVRDNTFFESCGVADLITTCLGGRNRRVAEAFARNGGKRSFDELEAEMLHGQKLQGVSTAKEVYEVLTYRGWQELFPLLSTVHEICIGQLPPTSIVEYRIH

SEQ ID NO: 61895 - protein, 315 aa, Actinobacillus pleuropneumoniae serovar 1 str. 4074
MLGNEKEPAAARRYTARGNLVAVISNGTAVLGLGNIGALASKPVMEGKGVLFKKFAGVDVFDIEINEHDPDKLVDIIASLEPTFGGINLEDIKAPECFYIEKKLRERMGIPVFHDDQHGTAIIVGAAAVNGLQIVGKDIGEVRLVVNGAGASAIACTNLLRSLGFKKENITMCDSKGVIYQGRGDNMDETKQFYAIEDNGWRTLADAVAGADVFLGCSKAGALTQDMIKTMAKDPLILALANPVPETTPHEAKAVRADAIVCTGRSDYPNQVNNVLCFPYLFRGALDVGATTINEEMKMAAAHAIADLAKEPVPF

SEQ ID NO: 61896 - protein, 559 aa, Bifidobacterium longum DJO10A
MRTIQGVSVSAGIAIGTVRVLAAVDYAVERRLIDDPQAEMDRFRAARDTAVAQLKQLRDNVAAEFGENKAELFDAHRLMLQDPDYAECVEGLIAQDKVNAEFAVKSAAEQFAAMFAAMDSSTMQARAADVKDVSRRVMNVLQGKRDSTAQDGSVQGDAVQNGIVQNGIAQNGESHIIFAEDLAPSDTAQLDRAKVLGLVTAKGSANSHTAILARTMGLPAITGIGDAFDPADDGHVAVIDGTSGAVFVDPDEATLTEYRRRKAEAEEHLSLLRKLKGKPTETKSGQRVHLYANISRPSDAAAVLANDAEGIGLFRSEFLYLEREDWPTEEFQFDAYGQVAQEMGDRPVIIRTLDIGADKQVDYFNLSHEDNPALGYRAIRICLTRPEIFKVQLRALLRASAYGNIAIMLPMITSVQEVRDAKRILEEAKSELRGERIDFNESIQIGVMIETPASVIMADELAAEVDFFSIGTNDLTQYTLACDRQNPSLERFADPHSPAVLRMIQMTIEAAHRHGIWCGICGELGADLSLTDTFLRLGIDELSVSPTSVLPLRNVIRNH

SEQ ID NO: 61897 - protein, 209 aa, Mycobacterium tuberculosis H37Rv
MSRSTRYSVAVSAQPETGQIAGRARIANLANILTLLRLVMVPVFLLALFYGGGHHSAARVVAWAIFATACITDRFDGLLARNYGMATEFGAFVDPIADKTLIGSALIGLSMLGDLPWWVTVLILTRELGVTVLRLAVIRRGVIPASWGGKLKTFVQAVAIGLFVLPLSGPLHVAAVVVMAAAILLTVITGVDYVARALRDIGGIRQTAS

SEQ ID NO: 61898 - protein, 127 aa, Arabidopsis thaliana
MLKFLSKVRIEFNTLDPRLASCVEFLAQCNARKAKESNPNCQVLVKRRTDEQPPQITVTFVNGVEEAFDAAATSAQSIRKMILDKGQYLETEQMFREAGEQWPVIIPDEELLQEAPGVKPRKAEDKK

SEQ ID NO: 61899 - protein, 125 aa, Glycine max
  misc_feature (90)..(90): Xaa can be any naturally occurring amino acid
MADEEKPNGEEQVKDNNNNNLYDADQRLILEPCKIKACLIPLFPETSRTYSRQLLQWSSQGYSLRRILFISIGIVALGALLRLGAFTLFXLAATGNAIFVFLLKSLAVAGGFLGLDFAFVTAIYN

SEQ ID NO: 61900 - protein, 336 aa, Porphyromonas gingivalis W83
MTKVGINGFGRIGRLVFRAAQTQNRSDIEIVAINDLIDVEYMAYMLKYDSVHGRFNGTVEVKDGQLIVNGKAIRVTAEKNPADLKWDQVGVEYVVESTGLFLTKEKSEAHLAAGAKYVVMSAPSKDDTPMFVCGVNTDKYVKGTKIVSNASCTTNCLAPIAKVLNDNWGMVGGLMTTVHATTATQKTVDGPSAKDWRGGRAAGGNIIPSSTGAAKAVGKVIPELNGKLTGMSFRVPTLDVSVVDLTCQLAKPAKYEDICAAMKKASEGELKGILGYTDEEVVSSDFIGETRTSVFDAKAGIALTDTFVKIVSWYDNEIGYSNKVLDLIAYMAKVNA

SEQ ID NO: 61901 - protein, 224 aa, Porphyromonas gingivalis W83
MTLIAERLVPILRSLPQGVRLAAVSKFHPVEELMEAYEAGQRVFAESRVQELMSKVEAMPDDVEWHFIGPLQTNKVKYIVPFISMIQSVSSLKLFDEISRQASKVGRTVPVLLEVHIASEDTKSGFTPEELPQVLEAVLARGSDTGVKIAGLMGMATFTDDREQIRREFRRLASLFREMKERFFSDSADFCELSMGMSGDFELAIEEGSTIVRIGTTIFGERRY

SEQ ID NO: 61902 - protein, 527 aa, Oryza sativa
MARAARGKAPRPRPMPPRGLAASLRRLLAGAGGGLGVAAAAYVGVDYLRYLSPVWHGRVMPALWAALALAAGARAPFYRHWSAELRAALPFLGSIAFMLGAFLCEAVSVRFVSAVMGLQWHRSAAPLPDTGQWLLLALNEKLPQTRYQIPGHPHPWAQKYYVPYASDSDAIRRVIRDDVAYAAVQSYPGEYRPDWGRMSFLVDILRPTPGEGPSWYHLLKKASGGCNDLMYSGHMLVAVLTAMAWTEAYGGWISVAIWLLVLHSAQREIRERHHYTVDCVVAIYVGILLWRMTRFIWSARDASRARRLAKLDEVHNRLIHAAKDSDVDEIRGLLKEVELAGQEKQGVSQRAILAFAAATIIFTLTCVVLALTLTSDGSNRIGGLSASGIREVLEEGGEIAEGVLEGSLLMLSARKSRMKNYVGLSNGLTIEKVALWAVMTNSVEVQISEEQSLGIAVYGPSFSWFNHSCCPSASYRFVLVPQNEGCTSNKPESCVVPVSKGAAPDANWLGKGPRTEGKALFAKSKDQ

SEQ ID NO: 61903 - protein, 357 aa, Vitis vinifera
MQTQSVDVVKRMKEITLVMQTPEQVLEAQGVTSADIEDMLDELQEHVESIDMANDLHSIGGLVPLLGYLKNSHSGIRAKAAEVITTIVQNNPRSQQLVMEANGFEPLLSNFTSDPDITVRTKALGAIASLIRHNKPGIAAFRLANGYAALRDALGSESVRFQRKALNLIHYLLHENSSDCNVVSELGFPRIMMHLASSDDSEVREAALRGLLELAQDKTSGGSDGLGEEDEKLKQLLQERIKGISLMSPEDLGAAREERHLVDSLWNACYNEPSSLRGEGLVVLPGDDAPPPDVASKHFEPPLRAWAANQEANRAPGTEKKEAAPLLLGFSPQQPETPHVHSSSSGGEDAGQRSIPR

SEQ ID NO: 61904 - protein, 300 aa, Protodinium simplex
RIGRQVARIAMKDPETELKLINASYDADYLAYMMKYDTIHGKYDGSIEVDGDSLVIDGKKVALSHTRDPAEIPFGEHGADYVCESTGVFLTTEKVQPHLKAGAKKVVFSAPAKDDSHTIVMGVNEDTYKPEMECVSCASCTTNGLAPAVRVLQEKFGIKRGLMTTCHAMTASQPTVDGTSKKDWRGGRAGPGNIIPSSTGAAKAVAKVIPAVKGKLTGMALRVPTIDVSVVDLTCELEKETTYEEICAEMKRRAEGDMKGFLGYTDEALVSTDFETNPISCTFDSKAGIMLDPTFVKVVC

SEQ ID NO: 61905 - protein, 134 aa, Triticum aestivum
  misc_feature (44)..(44): Xaa can be any naturally occurring amino acid
  misc_feature (73)..(73): Xaa can be any naturally occurring amino acid
  misc_feature (115)..(115): Xaa can be any naturally occurring amino acid
MAEQTFIMIKPDGVQRGLIGEVISRFEKKGFYLKGLKLQNVEKXSFAEQHYADLSSKPSSLGSWEYIRLRPVXSAMAWEGQERPSPLGRKIIGRHQPLGSGARHIVGDFASDIGXNSPWEHQRQKESPVPGIGG

SEQ ID NO: 61906 - protein, 396 aa, Symbiobacterium thermophilum IAM 14863
MERRFGELNPPQRLLMGPGPSNVDPRILRAMATPVIGHLDPAFLSIMDETMGWLREVYETRNHHTVPISATGSAGVEAMMVNLLEPGDDVVVGIIGYFGQRMADVASRTGANVRVIEAPLGEAIPPERFEEELRRKPAKLVALVHAETSTGAEQEIAPVAEIAHRYGALIAIDCVTSLGGMPVRVDEWGVDAAASCSQKCLGAPPGLSPVTFSPRAMEVITGRKSKCQSWYLDVNLLFAYWGDGKANNRVFHHTGPITMIYAMREALRIALEEGLEARYARHRKAHEAFAAGLEAMGLTLFTKGKRLPMLNVINIPEGIDDLAVRRRLLEQNIEISGGFGPLAGRVWRVGLMGVNANPAPVITLLGALEQALVEQGYRCERGAAVAAARAVYKQST

SEQ ID NO: 61907 - protein, 791 aa, Pseudomonas fluorescens PfO-1
MVEYVVSLDKLGKHDVEHVGGKNASLGEMISNLAGAGVSVPGGFATTAQAYRDFLELSGLNDQIHKALDALDVDDVNALAKTGAQIRQWIMEAEFPEKLNTEIRTAFAALSAGNPDVAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKGTLEAGRPAILRRNLGSKAIKMIYGDEAKAGRSVKTVDVDKAERARFCLTDAEVSELAKQAMIIEKHYGCPMDIEWAKDGDDGKLYIVQARPETVKSRTQANVMERYLLKETGTVLVEGRAIGQRIGAGKVRIIKDVSEMDKVQPGDVLVSDMTDPDWEPVMKRASAIVTNRGGRTCHAAIIARELGIPAVVGCGNATQLLKDGQGVTVSCAEGDTGYIFEGELGFDIKKNSVDAMPELPFKIMMNVGNPDRAFDFAQLPNAGVGLARLEFIINRMIGVHPKALLNYDGLPQDIKESVDKRIAGYDDPVGFYVEKLVEGISTLAAAFAPKKVIVRLSDFKSNEYANLIGGKLYEPEEENPMLGFRGASRYISESFRDCFELECRALKRVRNEMGLTNVEIMVPFVRTLGEASQVVDLLAENGLARGDNGLRVIMMCELPSNAILAEEFLEFFDGFSIGSNDLTQLTLGLDRDSGIIAHLFDERNPAVKKLLANAIAACNKAGKYIGICGQGPSDHPDLAKWLMEQGIESVSLNPDTVLETWFFLAEGQAAE

SEQ ID NO: 61908 - protein, 403 aa, Thermobifida fusca YX
MSATEQLQKRFEAVLMPNYGIPPVALVRGEGCRVTDADGKTYLDLIAGIAVSSLGYGHPALVAAVTEQAATLIHTSNLFLHEREVELAEKLVSLLGGSARVFFANSGTEANEAALKLVRRAAGPERTYYVSTVAGFHGRTSGSLALTGKPAIRDPFGPFNLDVRFVPHGDVAALREAVTDQCIAVFVEPVQGEAGVVPARPGYLAAVREICDATGAAFVLDEIQSGIGRTGHWFAHQAEGVRPDVLTLAKGLGGGLPIGACVGFGRYGTAFAKGDHGSTFGGNPVAAAAALAVLTTIEQDRLLESVTELGELLAAEITGIGHPLVAAVRGVGLWRGIQLTAPAAAHVQTRAAEAGFLVNAVTPEVVRLAPPLIITRAEILEFTRALPDILNAAARDAEEDQRR

SEQ ID NO: 61909 - protein, 302 aa, Akashiwo sanguinea
RIGRNVLRCWLKRETKPFDIVAINAGSMSAQTTAHLLKYDTVLGTLDAEVTYTDDALTIDGKEIKLLSGRDPAAMPWKDMGVEVIIESTGAFNSLDGGAKHLEAGAKKVVLTAPGKNCPTYVVGVNEGDYDAENDTVVSNASCTTNGMASVCKVLDDSFGVEYGLMTTTHSYTGDQMILDGRHRDLRRARAGACNIVPTSTGAAKAVAAVLPKYKGKLNGIALRVPTPNVSIVDLVVKVSKKCTTEEVNAAVKAAADGPMKGIINFEEQPLVSSDFKGTDYSNSVDAALTMVMGEDLVKVVM

SEQ ID NO: 61910 - protein, 302 aa, Thermobifida fusca YX
MISRTRQEALDKAKTLIEALPWLSALHGKTVVVKYGGNAMTDPDLRARFAENIVFLRYAGLRPVVVHGGGPQINAHLERLGVESTFTAGLRVTTPETMEIVRMVLVGQVNREIVGLINEHGPFAVGMSGEDAHLFTAERKYAMVDGEPVDIGLVGEVVDVQPGAVRSLLDDGRIPIISSIARSAEGGVYNVNADTAAAALAVALGAAKLIVLTDVEGLYADYPVNSELISHMTASELEEMLPTLSSGMVPKMEACLRAVRGGVPQAHVLDGRIPNAMLLEIFTDEGVGTMVLPDKDPAGGDA

SEQ ID NO: 61911 - protein, 513 aa, Hordeum vulgare subsp. vulgare
MDGNNRGGGHSEVLKNYNLGKTLGLGTFGDVKVAEHKLTGQRVAIKILNRRKMETMEMEEKANREIKIMRLFIDFIHPHIIRVYQVIETPKDIFIVMEYCNNGELLDYIIENGRLQEDEARRIFQQILAGVEYCHRIMVVHRDLKPENLLLDSKYNVKLADFGLSNVMRDGHFLKTSCGSLNYAAPEIISSKLYAGPEVDVWSCGVILYALLCGSVPFDDDNIPSLFRKIKGGTYILPSYLSDSARDLIPKLLNIDPMKRITIHEIRVHPWFKNHLPCYLAVPPPYKAPKAKMIDEDILRDVVNLGYDKDHVCESLWNRLQNEETVAYYLLLDNRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSAMLLDSNHNFVDDSTIMDNGNADGRLPAVVKFEIQLYKTKDNKYLLDIQRVTGPQLLFLEFCGAFFTNLRVL

SEQ ID NO: 61912 - protein, 695 aa, Pseudomonas putida GB-1
MQTFFIAPTDFGVGLTSISLGLVRTLERAGLKVGFFKPIAQPHPGDTGPERSTELVARTHGINPPVPLSLAQVERMLGDGQLDELLEEIIRLYQQACIGNDVVVVEGMVPTRHASYAARVNLHLAKSLDAEVILVSAPENEVLSELSGRVELQAQLFGGPRDPKVLGVILNKVRTDESMADFATRLREHSPLLRGNDFRLLGCIPYQPELNAPRTRDVAELLGAQVLNAGDYEQRRMSKIIICARTVANTVPLLTSGTLVVTPGDRDDIILAVSLAAINGVPLAGLLLTSDSKPDARILGLCRGALQAGLPILSVSTGSYDTANQLNSLNREIPVDDRERAEFITDFVASHLDAAWLHQRCGTPREMRLSPAVFRYQLIQRAQQANKRIVLPEGAEPLLVQAAAICQARGIARCVLLAKPEDVEAVARAQGIALPPGLEVLDPELIRGRYVEPMVALRKSKNLNAPMAEQQLEDPVVIGTMMLALDEVDGLVSGLVHSTANTIRPALQLIKTAPGSSLVSSVFFMLFPEQVLVYGDCVMNPHPSAAELAEIARQSAESAQAFGIAPRVAMISYSSDSASDEEVEKVREATRLAQGAAEALLIDGPLQYDAAANPAIARELAPGSPVAGRATVFVFPDLNTGNTTHKAVQRSTDGVSLGPMLQGLRKPVNDLPRGAQVDDIVHTIALTAIQASVVR

SEQ ID NO: 61913 - protein, 565 aa, Glycine max
EALQVHGQVVKLGMGHKDASRKLSKVFTFAALSPFGDLNYARLLLSTNPTLNSYYYNTLLRAFSQTPLPTPPFHALSLFLSMPSPPDNFTFPFLLKCCSRSKLPPLGKQLHALLTKLGFAPDLYIQNVLLHMYSEFGDLLLARSLFDRMPHRDVVSWTSMIGGLVNHDLPVEAINLFERMLQCGVEVNEATVISVLRACADSGALSMGRKVHANLEEWGIEIHSKSNVSTALVDMYAKGGCIASARKVFDDVVHRDVFVWTAMISGLASHGLCKDAIDMFVDMESSGVKPDERTVTAVLTACRNAGLIREGFMLFSDVQRRYGMKPSIQHFGCLVDLLARAGRLKEAEDFVNAMPIEPDTVLWRTLIWACKVHGDADRAERLMKHLEIQDMRADDSGSYILASNVYASTGKWCNKAEVRELMNKKGLVKPPGTSRIEVDGGVHEFVMGDYNHPEAEEIFVELAEVVDKIRKEGYDPRVSEVLLEMDDEEKAVQLLHHSEKLALAYGLIRIGHGSTIRIVKNLRSCEDCHEFMKLISKIYKRDIIVRDRIRFHHFKNGECSCKDYW

SEQ ID NO: 61914 - protein, 513 aa, Hordeum vulgare subsp. vulgare
MDGNNRGGGHSEVLKNYNLGKTLGLGTFGDVKVAERNVTGQRVAIKILNRRKMETMEMEEKANREIKIMRLFIDFIHPHIIRVYEVIETPKDIFVVMEYCNNGELLDYIIENGRLQEDEARRIFQQILAGVEYCHRIMVVHRDLKPENLLLDSRYNVKLADFGLSNVMRDGHFLKTSCGSLNYAAPEIISSKLYAGPEVDVWSCGVVLYALLCGSVPFDDDNIPSLFRKIKGGTYILPSYLSDSARDLIPKLLNIDPMKRITFHEIRVHPWFKNHLPCYLAVPPPYKEQQAKMIDEDILREVVNLGYDKDHVCESLWNRLQNEETVAYYLLLDDRFRSTSGYLGADHQHLMDRSFNEFTLSESASPSTRNYLPGINDSQGGGLRPYYPVQRKWAIGLQSGAHPRDIMIEVLKALKELNVCWKKNGLYNMKCRWCPGFPQVSDMLLDSNHNFVDDSTIMDNGNADGRLPAVVKFEIQLYKTKDNKYLLDIQRVTGPQLLFLEFCGAFLTNLRVL

SEQ ID NO: 61915 - protein, 514 aa, Listeria monocytogenes str. 1/2a F6854
MKDFTEQEKIIVLDFGSQYNQLITRRIREFGVYSELHPHTITVEEMKALNPTGIIFSGGPNSVYDEDAFRADERIFDMGIPILGICYGMQLMTTHFGGKVERAKDREYGKADIHVEKPSRLFAGLPTDQVVWMSHGDLVVEEPAGFEVTVTSKSCPIAGIADEERSLYGVQFHPEVRHSVHGNELLKNFALNVCGCKGDWTMENFSEVEIAKIQEIVGDKKVLLALSGGVDSSVVGVLIHKAIGDQLTCIFVDHGLLRKGEADQVMTTLQGEFNMNIIKVDAKKRFMDKLAGVSDPEQKRKIIGNEFIYVFDDEANKLDGVEFLAQGTLYTDIIESGTATAQTIKSHHNVGGLPEDMQFKLIEPLNTLFKDEVRALGTELGMPDAIVWRQPFPGPGLGIRVLGEITEEKLEIVRDSDYILREEIKNAGLEREIWQYFTALPNIRSVGVMGDGRTYDHTVVVRAVTSIDGMTADWARIPWDVLEKISVRIVNEVDHVNRVVYDITSKPPATVEWE

SEQ ID NO: 61916 - protein, 867 aa, Oryza sativa Japonica Group
MAGAGAVGGSNWEEMVRRMLPPGTTIPEAPANLDYSIALEYDGPPVSYELPRIDPVDLPAIPTAQPVSGPLVPGRSNGVVAPVVRPVFMPPVHRKQDAHRAEPPPVAAQGRRRRSSESVDSAPQNEGFSDDDDSCSVSQESAHNFHGQRGGRTAAQEGRRAQVVTFGVTEDSRYESKEFDDVSEQYVAVTKKEKRGRTCSRCGKRKWESKESCIVCDARFCSYCVLRAMGSMPEGRKCITCIGQPIDESKRSKLGKGSRILSRLLSPLEVRQILKAEKECQANQLRPEQLIINGFPLNPDEMASLLSCQRPPQKLKPGRYWYDKESGLWGKEGEKPDRVVSTNLTFNGKLQPNASNGNTQVYMNGREITKIELRVLKIAQVQCPRDTHFWVYHDGGYEEEGQNNIKGKIWESPVTRFACALFSLPVPPANSDEPKDEAPYSARTVPDYLDQKRIQKLLILGSPGAGTSTIFKQAKLLYDTRFTQEELDSIKLMIQSNMFKYLGILLEGRERFEEEALAGSNNPSSEDENTQHDGNKSNGSDSCIYSINAKLKKFSDWLLDIIAMGDLDAFFPAATREYAPIVEEMWKDPAIQATYKRKDELHFLPDVAEYFLSRAIEVSSNEYEPSEKDIIYAEGVTQGNGLAFIEFTLDDRSPMSEMYTDNHEPHSQTLNKYQLIRVSAKGMNEGCKWVEMFEDVSMVIFSVALSDYDQLGAPSSGGNSPLVNKMIQSRDLFEATIRQPCFRDMPFVLVLNKFDLFEEKIGRVPLSTCEWFSDFCPLRTHHNNQSLAHQAFYYVAMKFKELYAACTDRKLFVWQARARDRLTVDEAFKFIREVLKWEDEKDGGGYYPDESFYSTTELSSSRLIRQE

SEQ ID NO: 61917 - protein, 246 aa, Triticum aestivum
  misc_feature (107)..(107): Xaa can be any naturally occurring amino acid
MGGEKENLDLSDLNSSLPAAAAALSAEDRVGLVNALKDKLQSLAGQHADVLESLSPNVRTRVEFLRGIQSQHDEIEAKFFEERAALEAKYQKLYEPLYAKRYDIVHXNGVVEVDGVAKERTSENAAEGGDSDAKGVPDFWLTALKTNDVLTEEIQERDEPVLKYLKDIKWSRIDDPKGFKLLTARAAAESGSKRTCAAELHNLSDKRRRSRINEKMKALQSLIPNSNKVGTTKPTRHPCLTRPLSI

SEQ ID NO: 61918 - protein, 91 aa, Triticum aestivum
  misc_feature (62)..(62): Xaa can be any naturally occurring amino acid
VLVVGRRGCCLSHVVKRLLQGLGVNPAVHEVADEAELAAVVTGDAGGEAVVALPAVFVGAGXLLGGLDRLMAVHISGELVPILKDAGALWL

SEQ ID NO: 61919 - protein, 781 aa, Ostreococcus tauri
  misc_feature (431)..(437): Xaa can be any naturally occurring amino acid
  misc_feature (780)..(781): Xaa can be any naturally occurring amino acid
MHLERKGRRGGGRAREREVTLTRGLILNKLVVTRASGARLGSACELWVDTDSWDVVAMDIRENAFVGVVDHVLLESLRQVGDSAVERRWSSYGYTTVVGKDVVSESGQFIGRVRDYEFNPEDGSIARLIVDAWGVPTVPEGVISTYAVDIREVIRCGQERIIVSEGAESRVEQLSVSVLQRLSLTVPPWEEEMEAYGDPYYDDAYEYASRAPPRARRVAADEYAAFSERRRREPTRENAARSSRAREGIPLVRPTQPYERRDVDGGYGDRPGFSDWVIRDRDDRRETVDAYWDRPVRRTSAAASRPRYVDRASDASRRRDDARAAPRPAPRRGLLRPRGHVVIHPTARTGTLERDVAPAVRSSARHPPRAPTHQSRCHFDDVDVSHAPSMTSRTPRRRARGADEPPADARTCHARRVAPRERARGSIARAXXXXXXXDTLDAGGTAVKKTSLLVIGATGTLGRQVVRRALDEGYDVRCLVRPRLNPADFLRDWGMLPPAFVGVHTVIDCSTARPEEDSYAIDWEAKVATIQTAAAMGIARYVFFSIDQCDKHREVPLMNMKYAVEEYLKVSGMDFTVLRLCGFMQPLIAGYAVPVLEEQPLWGTDDDTRTAYLDTQDVAKMTLAAVRRDEAANKVLTLAGPKSYSVREVIALCEKLGGAEAKVQKVPVGLLKFTRAFTRFFQWSSAASDRLAFAEILASGIKFDADMTETDDARAVFGGILLEDSEKVERSRRRIETARLLPLSLALVTRVIARRSNNVIVCTLYSSIHFRYYQILSFRXX

SEQ ID NO: 61920 - protein, 62 aa, Triticum aestivum
EKLRREHPELYKGQDSQANETGGKPTDGNNPGGPPPGRREAATDELLLERFRKREKFRVMRR

SEQ ID NO: 61921 - protein, 427 aa, Glycine max
MAIRNSLTGQFLRRSSVAGARLMSSSSSWFRSIEPAPKDPILGVTEAFLADQSPNKVNVGVGAYRDDQRKPVVLECVREAERRVAGSQFMEYLPMGGSIKMIEESLKLAFGDNSEFIKDKRIAAVQALSGTGACRLFAAFQQRFHPNTQIYIPVPTWANHHNIWRDAGVPMKTFRYYHPESRGLDFSGLMDDIKNAPDGSFFLLVLTAHNPTGVDPSEEQWREISSQIKAKGHFPFFDMAYQGFASGDPERDAKAIKIFLEDGHLIGLAQSYAKNMGLYGQRAGSLSVLCEDEKQAVAVKSQLQLIARPMYSNPPLHGALIVSTVLGDPDLKKLWLKEVKVMADRIIGMRTTLRENLEKKGSTLPWQHITNQIGMFCYSGLTPEQVDRMTNEFHIYMTRNGRISMAGLNTGNVGYVADAIHEVTKSF

SEQ ID NO: 61922 - protein, 307 aa, Akashiwo sanguinea
RIGRLVFRAASANSDVTIKAVNDPFMDLKYMVYQLKYDSVHKQFPGTIATKEEDGKEFLVINDVPIRIFHEKDPASIPWGEAGAEYVCESTGVFTQREKAELHIKGGAKKVIISAPPKDDVPIYVVGVNHKEYKTTDTVVSNASCTTNCLAPLTKVVHEKFGIVQGLMTTVHAMTATQLTVDGPSRGGKDWRGGRCASQNIIPSSTGAAKAVGKVLPSVNGKLTGMAFRVPTPDVSVVDLTCQLAKEASYDDIVAAIKEAAAGDMKGVLDWTEDEVVSTDFVSCKASSVFDVGAGIALNKTFVKLVS

SEQ ID NO: 61923 - protein, 368 aa, Synechococcus sp. WH 8102
MSLFQNLRRRFAATPVMQDWPGLIEAYRAWLPVTSTTPVITLREGATPLIPVPAIEERIGKGVKVFVKYDGLNPTGSFKDRGMTMAISKAKEAGCEAVICASTGNTSAAAAAYARRGGMRAFVLIPDGYVAQGKLAQALVYGAEVLAIRGNFDRALDIVREAAEKYPVTLVNSVNPYRLQGQKTAAFEVVDALGDAPDWLCIPMGNAGNITAYWMGFQEYRQAGHSRTLPRMMGFQASGSAPLVNDTTVSDPDTIATAIRIGNPVNRAKAIAARQASNGAFLDVTDAEIIEAYKLLGGQEGIFCEPASAASVAGLLKRKDEVPAGATVVCVLTGNGLKDPDCAINNNDAAFHTDLNPDLATVAGVMGF

SEQ ID NO: 61924 - protein, 790 aa, Debaryomyces hansenii CBS767
MTFEEKSSPENKGFNDSDIFLTPSKKHVSLSATPSHRQSPFDLTLSPNKSPSKRGVIKLEKTADDIVLFSPVKTPNGRAGLPSPKKRTIAELDKSARKRAILTSGIYSKLMDDDLEENNNEYLDRQEVSLAEAIIKESRDNKQEDVDEYFRAYGSDVELEEDLTVNKKPKRRGRKPKKEVKVEEDDEIDDEDIEIEDDGELEDDDDEEFKLPKKERKAKNKRIIREVSDIDDISEEDEAEKEILPKRQKITASPFAVTLVDEAISPSKRKVGRPSKASKVIGKIKSIFQMDDEAFFTENKQATNRIKENADTSDVTKDSDSFFSMTLDNVTQSSIVSVPTVSGIPNTKEGKRKVEVATVDSNKFIPLPIPNINEEGEIEDEEYVKKYLPNVNIEEKYSGRLIDERAFFLDGTEGYFEQHMGRPKASANSLSQLAPPLEYDEFIPYVELSKLIRSKEKNKLNDLHKSLYHQWCFELTCGFSLNFYGVGSKIKLIGDFVQNYLVDWYEQNMQEDEEYPDILVVNGYNPAVKFKKVAHDILSVFISQEKKKQDNVKFPKHISETIPFLMKYVEDRRVHRPGQFIKPKLILVIHNIDGKPFLNERTQSLLSQLCSIPEIWLISSTDNINVSLLWDLFKLKSFNFLWHDLTTYEPYTVEMSFRDVLSMGKSKKFVGNKGAKYVLSSLTKNARNLYKILLTKQLEIMRNTTTTKAGRNGLKGSIKLGIEFKQLYNTCLEEFVTSNEISFRTMLGEFVEHKMCSAVKDEAGVEMVFVPFNFDEMEKLLAEEFASNEM

SEQ ID NO: 61925 - protein, 300 aa, Amphidinium operculatum
RIGRQVARIAMKDPETDLKLINASYDADYLAYMFKYDTIHGQYDGTIEVDGDSLVVDGQKIALSHTRDPGEIPFGKEGAEYVCESTGVFLTADSVKPHLKAGAKKIVFSAPAKDDSHTIVMGVNEDTYKTSMTEVSCASCTTNGLAPAVRVLEEGWGVKRGLMTTCHAMTASQPTVDGTSKKDWRGGRAGPGNIIPSSTGAAKAVAKVIPAVAGKLTGMALRVPTIDVSVVDLTVELEKETTYEEICAEMKRRSEGDMKGYLGYTDEALVSTDFETCPISCTFDSKAGIMLDPTFVKVVC

SEQ ID NO: 61926 - protein, 307 aa, Amphidinium operculatum
RIGRLVFRAASANPDVTVKGVNDPFMDLTYMVYQLKYDSVHGRFKGTIETKTADGKEFLIVNGNEVAVFHEKDPTAIPWGASGCDYVCESTGVFTAKEKAELHLQGGCKKVIISAPPKDAVPIYVMGVNHTDYKTSDTVVSNASCTTNCLAPLAKVVNDKFGLLEGLMTTVHATTATQLTVDGPSRGGKDWRGGRCASQNIIPSATGAAKAVGKCLPALNGKLTGMAFRIPTPDVSVVDLTCRLEKPAKYDDIVAAIKEAAAGPMKGVLDWTDEEVVSTDFVSCPSSSIFDVQAGIASNDTFVKLVS

SEQ ID NO: 61927 - protein, 121 aa, Symbiobacterium thermophilum IAM 14863
MDRIVISGMRFYAYHGVLPEETRLGQEFLVDAELYLDLQAAGQEDDIRQTVHYGKVYQTVKAIVEGTPFKLIEAVAERVAAEVLAQYRNVEAVTIRVHKPRAPIPGALGGVMVEIQRRRGR

SEQ ID NO: 61928 - protein, 251 aa, Staphylococcus epidermidis ATCC 12228
MIVKTDEELQALKEIGYICAKVRDTMKEATKPGVTTRELDHIAKDLFEEHGAISAPIHDENFPGQTCISVNEEVAHGIPGKRVIREGDLVNIDVSALKNGYYADTGISFVVGKSDQPLKQKVCDVATMAFENAMKKVKPGTKLSNIGKAVHATARQNDLTVIKNLTGHGVGQSLHEAPNHVMNYFDPKDKTLLKEGQVIAVEPFISTHATFVTEGKNEWAFETKDKSYVAQIEHTVIVTKDGPLLTTKIDD

SEQ ID NO: 61929 - protein, 300 aa, Heterocapsa triquetra
RIGRQVARIAMKDPEVELKLINASYDAEYLAYQMKYDSIHGRYNGTIEVDGDSLVIDGQKVALSHTRDPAEIPFKKHGAEYVCESTGVFLTTEKVQPHLKAGAKKVVFSAPAKDDSHTVVMGVNQETYKSSMECVSCASCTTNGLAPLVKCINDAFGIRRGLMTTIHAMTASQPTVDGASKKDWRGGRAASGNIIPSSTGAAKAVAKVIPEVAGKLTGMAFRVPTIDVSVVDLTCELEKATTYEEICAEVKKRAEGDMKGFLGYCDEDLVSTDFETCTISSTFDSKAGIMLDPTFVKLVA

SEQ ID NO: 61930 - protein, 425 aa, Helicobacter pylori J99
MAYNPKILQKPKEGEEITIKDGKLHVPNYPIIPFIEGDGIGSDITPAMIKVVDSAVQKAYKGEKKIAWYEVFVGEKCYQKFKDHKELSPEEQWLLPDTIEAINHYKVSIKGPLTTPIGEGFRSLNVALRQKMDLYVCLRPVRWYGSPSPVKEPQKVDMVIFRENSEDIYAGIEWQEGSAEAKKLIHFLQNELKVEKIRFPESSGVGIKPISKEGTERLVRKAIEYAIDNDKPSVTFVHKGNIMKYTEGAFMKWGYALAQKEFNAQVIDKGPWCSLKNPKTGKEIIIKDMIADAFLQQILLRPSEYSVIATMNLNGDYISDALAAMVGGIGIAPGANLNDTVGMFEATHGTAPKYAGLDKVNPGSIILSAEMMLRHMGWVEAADLIVSAMEKAIKSKKVTYDFARLMDGAKEVKCSEFASVMIENM

SEQ ID NO: 61931 - protein, 184 aa, Bradyrhizobium sp. BTAi1
MLGIGSKLPSFEIVGVKPGFQLHEEKGESAFETLTETSFPGKWKVIFFYPKDFTFVCPTEIAEFARLAKDFEDRDAVVLGGSTDNEFCKLAWRRDHKDLHKLPIWQFADTKGSLVDGLGVRSPDGVAYRYTFVVDPDNTIQHVYATNLNVGRAPKDTLRVLDALQTDELCPCNREVGGATLKVA

SEQ ID NO: 61932 - protein, 307 aa, Heterocapsa triquetra
RIGRLVFRAAVSNPSISLKAVNDPFMDLKYMVYQLKYDSVHGRFAGTVEAKEADGKEFLVVNGTEIQIFHEKDPAAIPWGAAGADYICESTGVFTAQEKAELHIKGGAKKVIISAPPKDAVPIYVVGVNHLDYKASDTVVSNASCTTNCLAPLTKVVHEKFGIIEGLMTTVHAMTATQLTVDGPSRGGKDWRGGRCSSQNIIPSSTGAAKAVGKVIPSVNGKLTGMAFRVPTPDVSVVDLTVRLEKGAKYEEIVAAVKEAAAGPMAGVLDWTDEEVVSTDFTTCKASSIFDVGAGISLNDTFVKLVS

SEQ ID NO: 61933 - protein, 377 aa, Oryza sativa
MARRSAPLLRRILSSPSPAPAPAPAHHGGAGARRTVTYMPRPGDGNPRAVTLIPGDGIGPLVTGAVQQVMEVMHAPVYFETYEVRGDMPTVPPAVIESIRRNKVCLKGGLATPVGGGVSSLNMQLRKELDLYASLVNCSNFPGLPTRHQDVDIVVIRENTEGEYSGLEHEVVPGVVESLKVITKFCSERIAKYAFEYAYLNNRKKVTAVHKANIMKLADGLFLESCREVASKYPGIQYNEIIVDNCCMQLVAKPEQFDVMVTPNLYGNLVANTAAGIAGGTGVMPGGNVGQDHAVFEQGASAGNVGNENILEQKKANPIALLLSSAMMLRHLQFPSFADRLETAVKRVIAEGKYRTKDLGGTSTTQEVTDAVIANLD

SEQ ID NO: 61934 - protein, 346 aa, Cryptococcus neoformans var. neoformans B-3501A
MKAAQIVGFEAPYKVTDIPKPVPQGNQILLRVKAAGFCHTDEAVKMGYTGSPLPLTGGHEGAGLVEATGGDVTNFTVGDRVAALLFREPCGQCGECKNNSAVFCDNIKMNGFNVDGAFAEYMIVDQRFTLHVPENIDFAQAAAFMCSGATVYNGLKAAKLPPKSVVGIYGIGALGSLGVQFAKAMGHQVIAIDNRPQPLEHIRALGSLSPDLTLSSDHTVEEGLKAIEEMFPEKLLRGVDAMLVTGPQAHEFDYAFKMTAKHGVVVALSCCNQPMIEIDWKDIVLRDIRVVGGFCATIEVTKELLELASMKNVKSKIRTFSLDEVNDLLTVYHQPDMHGKLVVTFD

SEQ ID NO: 61935 - protein, 377 aa, Xanthomonas oryzae pv. oryzae KACC10331
MSRPIPSPSAQSFGDPAAIRCERAASELRAGRPVLLTAADGQARAVLALDSSTAQSHTAFARAAQARHYLFVTPTRAQVLGLRAPQGARVRLSDHSYDQIAALAYLRDTTVPTQWTAGDALDAGGVEIARLGLLLPALLAVELRDVHDHAAFAGCQSLALGDLSRGCATSAAAGYELVTRTPVPLRGLGMSEFVVFRGGVAQRDQLAILVGQPDLMSAVPVRVHSSCLTGDLFGSLKCDCGDQLRHGLAKLKELGGGVLLYLDQEGRGTGIAAKMRAYGYQHAGLDTIDADAQLGFGPDERRYGSAVAMLQGLGIGRIRLLTNNPAKAERLRAAGIAVEDRIAITGDITAENEQYLRTKAARAGHALDVDALILAAQ

SEQ ID NO: 61936 - protein, 411 aa, Schizosaccharomyces pombe
MALYSISKPVGSKINKHSYQDENTLVGKQALSKGTEKTKLSTNFEINLPRRTVLSDVSNVGKNNADEKDTKKAKRSFDESNLSTNEEADKPVESKFVKKLKVYSKNADPSVETLQKDRVSNVDDHLSSNPLMAEEYAPEIFEYIRKLDLKCLPNPKYMDQQKELTWKMREILNEWLVEIHSNFLLMPETLYLAVNIIDRFLSRRSCSLSKFQLTGITALLIASKYEEVMVPSIQNFVYMTDGAFTVEDVCVAERYMLNVLNFDLSYPSPLNFLRKISQAEGYDAQTRTLGKYLTEIYLFDHDLLRYPMSKIAAAAMYLSRRLLRRGPWTPKLVESSGGYEEHELKEIAYIMLHYHNKPLEHKAFFQKYSLKRFLKASIFVHQLVRNDTSVNRTDDDDLQSEPSSSLTNDGH

SEQ ID NO: 61937 - protein, 612 aa, Oryza sativa Japonica Group
MGNVCIGPRRNFAKNGLLGILRPRHAAPSSPSQPTTTSRSIPVVLPSAPSSKPPPPTQTAPPVPVVISEPPPPQPQPEPQPAAPSQPPPPQEQPSAPRAASLKTTQQPPPPQQRQQSRAKKPAHIKRISSAGLQVESVLRRKTENLKDKYSLGRKLGQGQFGTTYLCVDKANGGEYACKSIAKRKLLTDEDVEDVRREIQIMHHLAGHPNIISIRGAYEDAVAVHVVMELCAGGELFDRIVRKGHYTERQAAGLARVIVAVVESCHSLGVMHRDLKPENFLFVGNEEDAPLKTIDFGLSMFFRPGEVFTDVVGSPYYVAPEVLKKSYGQEADVWSAGVIIYILLCGVPPFWAETEQGIFEQVLHGTLDFESDPWPNVSDGAKDLLRKVLVRDPKKRLTAHEVLCHPWLQMSGSAPDKPLDSAVLSRLRQFSAMNKLKKMALRVIAENLSEEEIAGLKEMFKMMDTDNSGQINYEELKAGLERVGANMKESEIYQLMQAADIDNSGTIDYGEFIAATLHLNKVEREDHLYAAFQYFDKDGSGYITSDELQQACDEFGIEDVRLEDMIGEVDQDNDGRIDYNEFVAMMQKTTTGFGKKGGHNFSGFRDALKSHS

SEQ ID NO: 61938 - protein, 572 aa, Treponema pallidum subsp. pallidum str. Nichols
MAYQVTATRYRPQRFQHVLGQKFVVATLQKSLEENKVSPAYLFSGPHGCGKTSCARILAKALNCVQREASEPCGECPSCREIATGTNLNVIEIDGASHTGVGDVRQIKEEILFPPHGTRYKVFIIDEVHMLSNSAFNALLKTIEEPPPYVVFIFATTEVHRIPATVKSRCQQFHFRLVDTQTLVCALAQAAQQMQIAVEDGVLSWIARESAGSMRDAYTLFDQTVVSCAGPVTLENIQKKLGLMTDDSLAALFSHCCRKDARAALELVDALVSSGVSVEQCVIDCVRYARALLLFTQGITNESLVGIAANQVPEYVRTTWNASQIERALGLLLQLFRDIRFSVDPRYELELAISRLAWLSEYVSIQEVRVALDSVQQILDTHAVPGVCSASVGSDDGETGVVSPHGIRPPMSTSVCTVRALQDALVEKLRASHQMLATALGSSYSWREEDTSVCMCVRTHYERSVISQHASLLKEYASELLGREVCVRVLLDSVPSSKVAPSHLPQSPAPSALFTTSLLISGQECDRVSGDLPAQVKLLCDCVQGHVVRVYEGTARCVPGEGKIAGAVRTPY

SEQ ID NO: 61939 - protein, 146 aa, Catharanthus roseus
RTLRELKLLRHMDHENVVAIRDIIPPPQRESFNDVYIAYELMDTDLHQIIRSNQALSEEHCQYFLYQILRGLKYIHSANVLHRDLKPSNLLLNANCDLKICDFGLARVTSETDFMTEYVVTRWYRAPELLLNSSDYTTAIDVWSVG

SEQ ID NO: 61940 - protein, 400 aa, Caulobacter crescentus CB15
MSLESAALRRIAPSATIAISAKARALKAAGRDVIALSAGEPDFDTPDNIKNAAIEAIKAGKTKYTDPDGMPELKAAICAKFKRENGLEYKPSQIHVAPGGKPVIYNALVATLNPGDEVIIPAPYWVSYPDMTLLAGGTPVSVETTAESGFKITPEALEAAITPKTKWLIINSPSNPSGGAYSRAELQAIADVLLRHPQVWVLTDDMYEHLVFDDFEFTTIAQVEPKLYDRTLTMNGVSKGYSMTGWRIGYAAGPEPLIKAMGKMISQTTSNPCSISQWAALEALNGTQDFIKPNAKLFQERRDLVVSMLNQATGLHCPTPEGAFYVYPSCAGLIGKTAPSGKVIESDEDFATELLESEGVAVVHGAAFGLSPFFRISYATSNEVLEDACSRIQRFCASVK

SEQ ID NO: 61941 - protein, 734 aa, Triticum aestivum
  misc_feature (272)..(272): Xaa can be any naturally occurring amino acid
MTVTPQITVSDGRLAVRGRTVLSGVPDNIAAAHAAGAGLVDGAFVGATAAEAKSHHVFTFGTLRDCRFMCLFRFKLWWMTQRMGTSGRDVPLETQFILIEVPAAAGNDDDDSDGDSEPVYLVMLPLLEGQFRTVLQGNDQDELQICIESGDKAVQTEQGMNSVYVHAGTNPFDTITQAVKAVEKHMQTFHHREKKKVPSFVDWFGWCTWDAFYTDVTADGVKQGLRSLAEGGVPPRFLIIDDGWQQIGSENKEDPSVAVQEGAQFASRLTGXIKENTKFQSKHDQDDTPGLKRLVEETKKEHGVKSVYVWHAMAGYWGGVKPSAAGMEHYESALAYPVQSPGVTGNQPDIVMDSLSVLGLGLVHPRKVYNFYDELHAYLAACGVDGVKVDVQNIVETLGAGHGGRVALTRAYHRALEASVARNFPDNGCISCMCHNTDMLYSAKQTAVVRASDDFYPRDPASHTVHISSVAYNTLFLGEFMQPDWDMFHSLHPAAEYHGAARAIGGCPIYVSDKPGNHNFDLLKKLVLPDGSVLRAQLPGRPTRDCLFSDPARDGASLLKIWNMDKCAGVVGVFNCQGAGWCRVVKKTRIHDEAPGTLTGSVRAEDVEGIAQAAGTDDRGGDAVVYAHRAGELVRLPRGATLPVTLKRLEYELFHVCPIRTVAPDVSFAPIGLLHMFNAGGAVEECTVKTDEDEKATVALRVRGCGRFGAYCSRRPVKCSLDSGDVELVQTENG

SEQ ID NO: 61942 - protein, 442 aa, Pneumocystis carinii
MSLLNDRQKEELYKALLFYFSKSDFPKTFSAFESELRNKGIIININEENEHKYDKLLEKKWTSVIRLQKKIMDLEARLCAAQTELSTIPSDKNHSIDMASWIPCAPAKHTLTGHRQPITSLAFHSVFTILASASEDSTIKIWDWETGDFERTLKGHTKAVLDIEFNTFSDSSCLVSCSSDLTIKLWDSKNEYKNIKTLYGHDHSISSIKFLPPNGDRIVSVSRDKNIKIWEISTGFCIKTISNAHIDWIRTICPSNDGKLLLSAGNDRIAKIFNTHNGECKLEFQGHEHVIECAIFAPNSAYKFLMQLSGVHLSKNSMGYVATGSRDKTIKLWGCQNGQIIKTLLGHDNWLRALVFHPSGRYLISASDDKTIRCWDLSQSGKCTRIIEEAHSHFINCLCWASESTESTTNGSNETSNNKSLNSKRLAIASGGVDLVIRIWMP

SEQ ID NO: 61943 - protein, 938 aa, Pneumocystis carinii
MILKILLTLTLYWIYLVRVRCETVPVDFENNDYYHFHFSEEVDIEDFSRALGFKYHEKLEYLDNQHIFSIEKGVLEDEIKEKIENYFGLEKGRNAIDGFNSDKLFYYEKQKLVKRENRGAIRDDIYFDNEGLYNRRVVKNVVKDPTVDQAKKSTEDLKKRLKEIKGELNIEDRYFDKQWYLFNTKDPGVDINVTGLWLEGITGKGVTVAIVDNGVDYTNLDLAPNFNAEASLNFATGTFDVKPEYTYNNHGTRCAGEVAAARNTLCGIGVAYESNISGLRYVPSAHSSWNEGDALIYKYDVNYIYSCSWGPADTGNLIQDISYTSYSAIIKGINEGRNGLGSIYVFGSGNGGYFDDCNYDGYANSPYTITIAAIDAEEKRFRFSEPCPCILASTYSGKSGAYIYTTDVGTTECTFLHTGTSASTPLAAGVIALLLSACPNLTWRDVQALIVETAVPFNLEYPGWEQVHSKRYYNNYFGYGKLDAYRMVERAKTFQKLNPQTMFSTQLIPLNKKFSENGGHITSSFYIHRGYPTHYNFKSLEYVGVSFRYKHQRRGHLEFNITSPSGVTSVLAHRRNPDKHGGSILWTFMTVKHWGEPIVGNWTIDVEDKKDQNLDGEVFYWQLHFFGESSKSEGVPPASYPFLSIYPTTMPPPEPTTTLPPTPSSTSSSRPPPPAPQPQPQPQPQPDPGSLPSSDPESPPSSEPGSQPPSKPGPQPPSDPQPPSKPGPQPPSEPAPPSKPAPPSKPAPPSKPDPNPSSDPSSQKDPDTSLSSNPTSTSSSEPPPPSPPPPPPPPPAPAPAPPPPPPPPPPRPELEPEPEPVPQPPQPQPPQPQPEPPAPPPKPQPPQPPPPPPPPEQKPTSITSSTSTTSSSKTKISTTRKASSTKTSSTTKTSTRPSPTEGTFTGSSASHLSFFEKRHLLLQMILLLLFFLFLGYSF

SEQ ID NO: 61944 - protein, 406 aa, Glycine max
  misc_feature (330)..(330): Xaa can be any naturally occurring amino acid
MAASLQLFQCKLARPFRSFPLRRSTPPLSLRCCASPPSSYSITLIPGDGIGPEIISVAKDVLVLVGSLEGIKFEFQEVLMGGAALDATGVPLPDDTLSAAKQSHAVLLGAVGGYKWDKNEKHLKPETGLLQIRKELGVFANLRPATVYSPLVDASTLKREVAEGVDIMLIRELTGGIYFGEPTGFGTNENGEEIGFNTEIYATHEIDRIAHFAFKVAQKRCGKLCSVDKANVLEASMLWRKRFLAIAQEYPDVELSHMYVDNASMQLIRNPKQFDTMVTNNIFGDILSDEASMVTGSIGMLPSASLGASGPGLFEPIHGSAPDIAGQDKXANPFATVLSAAMLLRYGLGEEKAAKRIENAVVDTLNRGFRTGDIYSAGTKLVGCKQLGEEILKSVESNVHAGAATV

SEQ ID NO: 61945 - protein, 293 aa, Listeria monocytogenes str. 4b F2365
MQDLTLFLEQYKKVIDESLFKEISERNIEPRLKESMLYSVQAGGKRIRPMLVFATLQALKVNPLLGVKTATALEMIHTYSLIHDDLPAMDNDDYRRGKYTNHKVFGDATAILAGDALLTLAFSILAEDENLSFETRIALINQISFSSGAEGMVGGQLADMEAENKQVTLEELSSIHARKTGELLIFAVTSAAKIAEADPEQTKRLRIFAENIGIGFQISDDILDVIGDETKMGKKTGVDAFLNKSTYPGLLTLDGAKRALNEHVAIAKSALSGHDFDDEILLKLADLIALREN

SEQ ID NO: 61946 - protein, 492 aa, Gibberella zeae PH-1
MAEITITGAGGRKIQIPTGLFINNRFIPSTTSETLTTENPTTNTPLGQVSAAQPSDVDAAVSSSKEALKTWKTSQPAERRRLLNRLADLIERDARELASIEAIDAGMLFNMSLGFCIVQAVETLRYFAGWADKIDGQSLEFDQGLAYTKREPIGVCAAVVPWNTPLLITAWKLGPALAAGNTLIIKTPELAPLYGQKLAQLVLEAGFPPGVVNIITGLGPVAGQALADHHQVRKISFTGSLAVGRTILVSAAKSNLKRVTLELGGKGPSIIFNDANFENALAFATAGITMHNGQICAAGSRIYVQADVYDRFVSEFAAKTRDAVMGDPLLDDTVKGPVISSTQKNRIMEYITKAKSEGIELLHGSAEPDSKGNFVPNTAFINVSPTATIMREEVFGPVASFAKFKTEEEVISLANDNEYGLAAAVFTNDISRAVRVSDQIEVGIVFVNTWGSISANSPFGGIKQSGFGRENGTDALNDWTQVKCVKINVFNL

SEQ ID NO: 61947 - protein, 495 aa, Oryza sativa Indica Group
MGRGCGRWWWVAVALVVAAAAAAAEGAREEAAVAVAVAPRRHAYAAMMYMGTPRDYEFYVATRVMMRSLGRLGSDADRVVIASLDVPPRWVQALKDDGVKVVSVENLKNPYEKQENFNMRFKLTLNKLYAWSLVSYDRVVMLDSDNIFLQNTDELFQCGQFCAVFINPCIFHTGLFVLQVGLLAIWVSPFFCKISFNFLHPSMDVFKNMLHELAVGRDNPDGADQGFLASYFPDLLDRPMFHPPVNGTKLEGTYRLPLGYQMDASYYYLKLRWSIPCGPNSVITFPSAPWFKPWYWWSWPVLPLGLSWHEQRRENLGYSSELPVVLIQALFYIGVIAVTRLARPSLSKMCYNRRMEKSTIVLLTTLRVVAAWSILAAYTIPFFLIPRTVHPLLGWPLYLLGAFSFSSIVINVFLLHPLAVLTTWLGIIGALFVMAFPWYLNGVVRALAVFAYAFCCAPLIWGSLVKTMSSLQILIERDAFRLGEPNQTAEFTKLY

SEQ ID NO: 61948 - protein, 300 aa, Scrippsiella trochoidea
RIGRQVARIAMKDPEVELKLINASYDAEYLAYQMKYDSIHGRYDGTIEADGDSLVIDGHKVALSHTRDPAEIPFTEHGAEYVCESTGVFLTTEKIQPHLKAGAKKVIFSAPAKDDSHTVVMGVNQDTYESSMTAVSCASCTTNGLAPMVKAINDAFGIKRGLMTTIHAMTASQPTVDGSSKKDWRGGRAASGNIIPSSTGAAKAVAKVIPEVKGKLTGMAFRVPTIDVSVVDVTCELEKETSYEEICAEIKRRSEGDMKGFLGYCDEPLVSTDFETSPISSTFDAKAGIMLDPTFVKLVA

SEQ ID NO: 61949 - protein, 307 aa, Scrippsiella trochoidea
RIGRLVFRAAMGNPDVAVKAVNDPFMDLKYMVYQLKYDSVHKQFAGTIAAKEDGGKEFLVVNGVEIQIFHEKDPAAIPWGDAGAEYVCESTGVFTAKEKAELHLKGGAKKVIISAPPKDSVPIYVVGVNHKEYKATDTVVSNASCTTNCLAPLTKVVHEKFGIVEGLMTTVHAMTATQLTVDGPSRGGKDWRGGRCASQNIIPSSTGAAKAVGKVLPAVNGKLTGMAFRVPTPDVSVVDLTCRLEKPAKYDEIVAAVKEYAAGDMKGVLDWTDEEVVSTDFVSCKSSSIFDVGAGISLNDTFVKLVT

SEQ ID NO: 61950 - protein, 310 aa, Chlamydomonas reinhardtii
MRSAVLQRGQARRVSCRVRADGSGVDSLPSTSASSSARPLIDRRQLLTGAAASVITFVGCPCPLCKPGEAKAAAWNYGEVAGPPTWKGVCATGKRQSPINIPLNTSAPKVDAEMGEFDFAYGSFEKCDVLNTGHGTMQVNFPAGNLAFIGNMELELLQFHFHAPSEHAMDGRRYAMEAHLVHKNKSTGNLAVLGIMLEPGGLIKNPALSTALEVAPEVPLAKKPSPKGINPVMLLPKKSKAGTRPFVHYPGSLTTPPCSEGVDWFVFMQPIKVPDSQILDFMRFVGDNKTYATNTRPLQLLNSRLVEYEL

SEQ ID NO: 61951 - protein, 371 aa, Azoarcus sp. EbN1
MTIKSRAAVAFGPKQPLQIVEVDVEPPKAGEALVRIVATGVCHTDAFTLSGDDPEGIFPAILGHEGGGIVEAVGEGVTSLEVGDHVIPLYTAECRECKFCKSGKTNLCQAVRATQGKGLMPDGTTRFSYNGQPIYHYMGTSTFSEYTVVPEISLAKIPKEAPLDKVCLLGCGVTTGIGAVLNTAKVEAGATVAIFGLGGIGLAAILGAKMAKASRIIGIDLNPAKSDLARQLGATDIVNPNDHAKPIQDVIVEMTDGGVDYSFECVGNVKLMRAALECCHKGWGESTIIGVAGAGQEICTRPFQLVTGRVWRGSAFGGVRGRTELPGYVEKAQRGEIPLDVFITHHLPLEDINRAFELMHEGQSIRSVIRF

SEQ ID NO: 61952 - protein, 582 aa, Glycine max
MVLKSMVASASDLSLVSVAGNSPLDFKNRVFGGRLISLGFRFNKGSKCKGNERFNFEVRAAVEVGVERSKSKALEGGFGLDVVSEAELTVKGFAGLRKTKLVCTVGPACSSMEDLENLALGGMSVARLNMCHGTREWHRDVIRKIKKLNEEKGFCVSVMIDTEGSQIHVVDHGAPSSVKVEEGSNWVFTAEHYEGSRPFTVQTNYRGFSEGTEVGDELVIDGGMACFEVTEKTGNDLHCKCIDAGLFLPGAKFSFWRDGKLVRGNNKLPTLSTKDWADIDFGIAEGVDFFALSFVNHADSVKDLKMYLSTKSTKSIKVLAKIESLESLHKLEEIVQASDGIMVARGDLGVEIPLEQIPTVQEDIIYVCRQLNKPVIVASQLLESMVEYPTPTRAEVADVSEAVRQYADALMLSGESAIGSYGRKALAVLDMASSRMESWSREENRQSLVSHHQLGESLPECITEQICNCAVEMANNLGVDAIFVYTKYGHMASLLSRNRPNPPIFAFTNDDSTRMALTLQWGVVPILVDLSDDAESNISKSVQLMKSRGLISQGDVVLVVSDVAPTRASPMAFQSIQVKTII

SEQ ID NO: 61953 - protein, 263 aa, Bradyrhizobium sp. BTAi1
MSDIVDTPIAKPVAADMRPPSLLQLIREDIGCVRSRDPAARSEIETLLTYPGIHALIWHRLAHRLWIHGWRFPARLLSWLGRFLSNVDIHPGAEIGRRFFIDHGACVVIGETAEVGDDVTLYHGVTLGGTSWSPGKRHPTLENGVVVGAGAKILGPITIGPRTRVGANSVVIQSTPPDVTVVGIPAKVVRPEFTHRRTVGRIDLDHHLMPDPVGEALSVMLDRIEFLEAQLAHVRQKVRQGPPPPAPINGCEVDPILTQGAKR

SEQ ID NO: 61954 - protein, 73 aa, Physcomitrella patens subsp. patens
MVNAIKGILVTCDIPMAQLLISINDSMPNAHKFIVYMLDDTHIYVQPDVGKMLQSKLQEFRDQNTYEKPFGTS

SEQ ID NO: 61955 - protein, 309 aa, Streptomyces sp. KO-3988
MLPRVDSLSMTLDVLPTTTRVRRAPEAGQDEVTLDGRPAEGEALRRVVAFLDLVRERAGLADRAVVDTANTVATGAGLASSASGFAALAVAAAAAYGLDLDATALSRLARRGSGSASRSIFGGFAVWHAGLHSGAAAEADLSSYAEPVPVGDLDPALVVAVVDAGPKAVSSRAAMRRTVDTSPLYEPWAVSSGDDLVDMRAALLAGDIEAVGEIAERNALGMHATMLAARPAVRYLAPATLTVLDSVLGLRRDGVPAYATMDAGPNVKVLCRSADAERVAKTLRVAVPDGTVLVARPGPGDRLLHGDVR

SEQ ID NO: 61956 - protein, 356 aa, Treponema pallidum subsp. pallidum str. Nichols
MASIAILGGGAWGTALAASLTVNGHTVMLWARRRQTCDAINARNENVQYLPGITLPAALCASPDMAYVCAGADLIVLAVPSCYLAEVAALMNTTPRFQRLRTAAVGQEYPLIGILTKGFIPDQEGMPHLITDALGALLPSGAHGQLVYISGPSHAQEVAQGKVTGLIAASQNPMAAIRVRELLRSKRVQVYSSLDVVGVQVCAAVKNVIAIAFGLLDAMAEHSEAFGDNTESMLLAAGLNEIQTIGKQLGSTHPETFTSLAGIGDLDVTCRSAYGRNRRFGRDIVHKGILDSFSGIQDLVSRLPEVGYLAEGVVACMHVQRLAERDRLKVPICAGLYAILNREKGADTFMQEILGW

SEQ ID NO: 61957 - protein, 325 aa, Vitis vinifera
GGGNFGVARLVSDKRTRELFAVKFIERGQKIDEHVQREIMNHRSLMHPNIVRFKEVLLTPTHLAIVMEYAAGGELFGRICNAGRFSEDEARFFFQQLISGVSYCHSMRICHRDLKLENTLLDGSTAPRVKICDFGYSKSSVLHSQPKSTVGTPAYIAPEVLSRKEYDGKLSDVWSCGVTLYVMLVGAYPFEDPDDPRNFRKTIGRILSVHYSIPDYVRVSIECRHLLSRVFVANPDKRITIPEIKTHPWFLKNLPIEMMDGGSWQKNDVNNPSQSVEEILSIIQEARKTTGVRKAGGPFMEGSMDLDDIDADEDIETSGDFVCPL

SEQ ID NO: 61958 - protein, 149 aa, Treponema pallidum subsp. pallidum str. Nichols
MAFETTFVMLKPGVLQRRLVGEVLSRFERKGLVLTALRLLCVDTATAELHYAEHREKPFYPSLIAYITSAPVVALAFKGENAISLVRTLCGSTRVEHAQPGTIRGDFALRTTTNIVHASDSPESAARELALYFSAQDFVEWRDGNYDFF

SEQ ID NO: 61959 - protein, 358 aa, Azoarcus sp. EbN1
MSKFHDMRVASVRPETRDAIVVTFDVPPSLADSFHYAPGQHLTLRTEIGGEDVRRSYSICSGADERALRIAIKRVHGGLFSNWANDFMKPGVSVEVMPPSGHFGVAPDPQHHRNYAAFAAGSGITPILSQIKTILAAEQGSRFTLVYGNRSSSSVMFREELADLKDQYGERLNLVHVLSREQQDIELFNGRIDRERCDALLTRWIDAKRIDVAFICGPMDMMEAVSASLQAHGVAKSAIKMELFATSLPKGPRPVHSHPVKGTEDCEVTVIQDGRVRQFTMPKNRDSVLDAGLGQGIEMPYSCKGGVCSTCRCKVIDGEVDHDTNFALEDYEIARGFRLSCQSYPVTDKLVLDFDQET

SEQ ID NO: 61960 - protein, 551 aa, Oryza sativa Japonica Group
MDMDSSPSTQDCGGWLLYVSLAAKCGGDPCRVVGFVAVAVVAFAVTSLLHWLSPGGPAWGRYWWNRRGGLGIAAAIPGPRGLPVLGSMSLMAGLAHRKLAAAAGGSPARRRLMALSLGETRVVVTADPGVARELLASAAFADRPVKESAYGMLFHRAIGFAPYGTYWRALRRVASTHLFSPRQVSASAAQRAVIARQMVEAMRSAAAAAAGGGVAARPFLKRASLHNVMWSVFGRKYELAAPESEETAELRSMVDEGYDLLGQLNWSDHLPWLAPFDLKKTRSRCSSLVPRVNRFVTRIIDEHRARLSLAVDAAVDFTDVLLSLHGGDKLSDADMVAVLWEMIFRGTDTVAVLIEWVAARLVLHQDVQARVHDELDRVVGSDRAVTESDASKLVYLQAVIKEVLRLHPPGPLLSWARLATSDVHVGGFLIPSGTTAMVNMWAITHDPAVWPDPNEFKPERFVAGPSSDQATEFPIMGSDLRLAPFGSGRRSCPGKSLAIATVGFWVATLLHEFDWLPLSDKSRGVDLSEVLKLSCEMATPLEARLRPRRKV

SEQ ID NO: 61961 - protein, 390 aa, Cryptococcus neoformans var. neoformans B-3501A
MTQTSSSSVSVPGEPLKNVLVTGGLGYIGSHVVLSLLMSGRYLPIVIDNAHNAYPQALERCNQIAQSEVGPHAPKPIYHQCDIRNAEEINKVFKQYQSKGGIWAVIHLAALKAVGESSEIPLDYYEVNVGGSISLLKIMQQSQTNNLVFSSSATVYGTPAVIPIPETSEIIPESVYGRTKAITEEVIRDVCRAGAATADNQGLKAISVRYFNPAGAHPSGKLGEEPKGRPGNLLPILAQIAVGRLSSDLKVFGNDYPTRDGTCLRDYLHIMDLAEGHLLALDALAKSEIKTQSSGIFQSIDTKKEGYFRAFNLGRGKGITVLEMINEMKVATGYGYQCEIVERRSGDVPDLTADPRLAQEELGFIARRGLQEMCQDLWRFQSSNVNGYSS

SEQ ID NO: 61962 - protein, 532 aa, Cryptococcus neoformans var. neoformans B-3501A
MLKMGSEELRPIPAFHNLSEIYNTEETLERERQRWSALVQSFVEEFGGQPNYIIRAPGRVNVLGEHIDYSLFPVLPAAIEQDIIVGIRPTATFPNKISVDLANAVKSYPNAELQLARDQELWSLKVPLPSKAKGWERYVVAVLLECLERFAEQLQDGAAGMEVMVSGTVPEGAGLSSSAAFVVGIIVAFLVANGLQEGVSRVQVVDIAMAAEHRLGLKSGGMDQAASILSVPNSLLHLSFYPSLKPAILPLPSSLTLVITNSMAPHSLADSAPDRYNLRVVENLCATRILLHTFGADAGVLSTTQRGSTGRLWLREALEHWAEDAHMVEETVYRNLLARIVGVLGKEGRDKNGWTKNQMIEESGMTAEDFEATFLAFIPIRATRFYLLQRVQHTLEESLRVCSFKRLCEASVATSDNRVSETGLVKELGALITASHVSMRDLYEATVPEVDDLQALCLQCGSLGSRQTGGGWGGAVISLLPSNRASDFLREVRNMYSLYRGLSVDELDKAAFITVPGSGAGFYPLMEGCKIV

SEQ ID NO: 61963 - protein, 392 aa, Alkalilimnicola ehrlichei MLHE-1
MDIKLANRVQRVKPSPTLAVTAKAAELRAAGKDIIGLGAGEPDFDTPEHIRDAAITAINEGETRYTPVDGTPALKKAVINKFKRENGLDYDGKQVLVSSGAKHSLYNLMCALLNEGDEVIIPAPYWVSYPDMAKLADAEPVIIEAGQEQGFKITPEQLEGAITDRTRLFVINSPSNPTGSAYSKAELAALGEVLKKHPQIVVVTDDIYEHILFEGEFVNIVNACPELKDRTVVVNGVSKAYAMTGWRVGYAAGPEALIGAMKKIQSQSTSNPASVSQAASVAALDGDQGCIPPMLEQFKKRHDFVVDALNKIDGVECRPCEGTFYCFPNMQGAIDKLDGVGNDVELAGFLLEQGVALVPGSAFGLEGYARISFATSMENLEKAMERIAKALG

SEQ ID NO: 61964 - protein, 195 aa, Arabidopsis thaliana
  misc_feature (65)..(65): Xaa can be any naturally occurring amino acid
  misc_feature (87)..(87): Xaa can be any naturally occurring amino acid
  misc_feature (100)..(100): Xaa can be any naturally occurring amino acid
  misc_feature (128)..(128): Xaa can be any naturally occurring amino acid
  misc_feature (130)..(130): Xaa can be any naturally occurring amino acid
  misc_feature (138)..(138): Xaa can be any naturally occurring amino acid
  misc_feature (146)..(146): Xaa can be any naturally occurring amino acid
  misc_feature (160)..(160): Xaa can be any naturally occurring amino acid
TDQGVNGHFISTFSAATKALEPGCYKGGSGLNGFIGGGTMVIPSDSSLRAWELGKQNVILNSMDXEKVVFFMPDSPEFMKGELLKRXTWDIQILNPPKLXAPRLSCFALHCRNVQKSHSSMAMRLTRXDXLRMTCSCXSGAMTQMXKLLLILRSAGRMSXGRPQCPREAPAAIEHPLEPYLPLGQYLSNLLLPLL

SEQ ID NO: 61965 - protein, 155 aa, Oryza sativa
MAAAAAMAMKDPSLWHKVAAISGVAALGLGTYGAHMFRPKNPAYKEVWHTASLYHLVHTAALLGAPITKRPDVFGGLLTAGIVLFSGTCYTVAYLEDRKYSSTAPLGGFAFIAASSITDDTPPKNPPPFFSGGHLFRRGPSPPRRVFSRFLTKYP

SEQ ID NO: 61966 - protein, 97 aa, Spinacia oleracea
  misc_feature (1)..(1): Xaa can be any naturally occurring amino acid
XAYKVTLVTPTGNVEFQCPDDVYILDAAEEEGIDLPYSCRAGSCSSCAGKLKTGSLNQDDQSFLDDDQIDEGWVLTCAAYPVSDVTIETHKKEELTA

SEQ ID NO: 61967 - protein, 547 aa, Glycine max
MASHLLNHSSKMRNASKLLHHERALLVRWFSGDAHSSLNRNRDVWKTQFHESSARSSVFEPASCFNKHSFGMQKRNIFMATIKRGSIIGSEFNGEISRSLQVLSRRCYASASDLPPHQEIGMPSLSPTMTEGNIARWLKKEGDRISPGEVLCEVETDKATVEMECMEEGFLAKIIRGDGAKEIKVGEVIAVTVEDEGDIAKFKDYQPSASEPSEPPAKETSAPPPPKKEEVVEEPAREPEPKVSKPSAPPSSGDRTFASPLARKLAEEKNVPLSSIKGTGPEGLIVKADIDDYLASGAKEVSASSKAKVAADAALDYTDIPVSQIRKVTASRLLLSKQTIPHYYLTVDTCVDKLMSLRTQLNSLQEASGGSRISVNDLVIKAAALALRKVPQCNSSWANDYIRQYHNVNINVAVQTDNGLFVPVVRDADKKGLSKIGEEVKQLAKKAKENSLKPQEYEGGTFTVTNLGGPFGVKQFCAIINPPQAGILAVGSAERRVVPGSGAEEFKFASFMSVTLSCDHRVIDGAIGAEWLKAFKGYIENPETMLL

SEQ ID NO: 61968 - protein, 358 aa, Triticum aestivum
MAVDLTPRQPAKAYGGDGGAYYEWSPAELPMLGIASIGAAKLALAAGGMSLPSYSDSAKVAYVLQGKGTVGIVLPEATKEKVVAVKEGDALALPFGVVTWWHNTPESATELVVLFLGDTSKGHRPGQFTNFQLTGASGIFTGFSTEFVGRAWDLKEDDAAKLVSSQPASGIVKLTAGQKLPVPVDADRKDMALNCLEAKLDVDIPNGGRVVVLNTANLPLVKEVGLGADLVRIDAHSMCSPGFSCDSAYQVTYIVRGSGSVQVVGPDGKRVLETHIEGGSLFIVPRFHVVSKIADASGMEWFSIITTPNPIFSHLAGKTSVWKAISPEVLEASFNTTPEMEKLFRSKRLDSEIFFAPN

SEQ ID NO: 61969 - protein, 487 aa, Rhizobium sp. NGR234
MQRFQCYIDGEFADGEGRFESVDPATGAAWAEMPEAREADVDRAVEAAHKALDAGPWSKLTATLRGKLLYRLADLVAENAQRLAELETRDTGKIIRETSAQIAYVAEYYRYYAGIADKIEGSYLPIDKPDMEVWLRREPIGVVAMVVPWNSQLFLSAVKIGPALAAGCTMVVKASEDGPAPLLQFARLVHEAGFPAGVVNIITGFGPACGAALSRHPKVDHIAFTGGPETARHVVRNSAENLASTSLELGGKSPFIVFADADLESAANAQVAGIFAATGQSCVAGSRLIVEKSVKDRFLEILKRKAEAICIGSPLDMATEVGPLATERQRAHIQALLGRSLAAGARLVTGGTAPDGAGFFYQPTILDCDGNSTPALEEEFFGPVLSVVSFETEAEALALANATRYGLAAGLFTRDLTRAHRLMKGIRTGIVWVNTYRAVSPIAPFGGFGLSGHGREGGMEAALDFTRTKTVWLRTSDDPIPDPFVMR

SEQ ID NO: 61970 - protein, 609 aa, Listeria monocytogenes str. 4b F2365
MSCFYLDLLKIKDPSFMKQLDIQELEALAADIRAFLITSTSKSGGHIGPNLGVVELTIALHYSFNSPKDKFIWDVGHQSYVHKILTGRASQFGTLREHGGLDGFPKRKESIHDVFETGHSSTSLSAAAGMVIARDIKKEEFYVIPIIGDGALTGGMALEALNHIGDMGKDMIVILNDNDMSIAPNVGAIHNILGKLRTSDTFKQTKAKVDGTFFEELGFMYLGPINGHDIEEVITNLELAKRTKGPVLLHIVTKKGKGYQPAELDSRGTWHGTGPYKVETGSFIKPAKRAASWSSVISNELIRLAEKDERIVAITPAMPVGSKLEKFAKAFPERFFDVGIAEQHATTMAAGLATQGMKPFLTIYSTFLQRAYDQLVHDVCRQKLNVVIGIDRAGLVGADGETHQGIFDISFLNSIPNMTISMPKDEVEARQLMDTAFSYNDGPFAIRYPRGEAPGAQVAESNTLIPIGKWETIIQPIDAVILTFGPTIRLALKAAEQLELEGYHVGVINARYIKPLDEALLHQILKQKIPILTVEESLLKGGFGASVLEFIEASNYSDVVMHRIGLPDEFISHGSVSIILESFGISTTGIVLKIKEMLAQSGKLRAKRL

SEQ ID NO: 61971 - protein, 767 aa, Oryza sativa Japonica Group
MAILSALGTEVFIPVAAAVGVAFAVAQWLLVARVKVNPAHAAAAAASGGSKNGGYGDYLIEEEEGLNDHNVVVKCHEIQTAISEGATSFLFTEYQYVGIFMSIFAVVIFLFLGSVEGFSTKSQPCTYSKDKYCKPALFNALFSTASFLLGAITSLVSGYLGMKIATFANARTTLEARKGVGKAFIIAFRSGAVMGFLLASSGLVVLYIAINVFKLYYGDDWEGLFESITGYGLGGSSMALFGRVGGGIYTKAADVGADLVGKVERNIPEDDPRNPAVIADNVGDNVGDIAGMGSDLFGSYAESSCAALVVASISSFGINHDFTGMCYPLLVSSVGIIVCLITTLFATDFFEIKAVKEIEPALKKQLIISTALMTVGIAIISWLALPAKFTIFNFGAQKEVTNWGLFFCVAIGLWAGLIIGFVTEYYTSNAYSPVQDVADSCRTGAATNVIFGLALGYKSVIIPIFAIAVSIYVSFSIAAMYGIAVAALGMLSTIATGLAIDAYGPISDNAGGIAEMAGMSHRIRERTDALDAAGNTTAAIGKGFAIGSAALVSLALFGAFVSRAGVKVVDVLSPKVFIGLIVGAMLPYWFSAMTMKSVGSAALKMVEEVRRQFNSIPGLMEGTGKPDYATCVKISTDASIKEMIPPGALVMLTPLIVGTLFGVETLSGVLAGALVSGVQIAISASNTGGAWDNAKKYIEAGASEHARTLGPKGSDCHKAAVIGDTIGDPLKDTSGPSLNILIKLMAVESLVFAPFFATHGGLLFKWF

SEQ ID NO: 61972 - protein, 512 aa, Bifidobacterium longum DJO10A
MSESPNWSNPLRDSRDLRLPRIAGPCSLVIFGVTGDLAQKKLLPAVYDLANRGLLPPSFGLTGFARRDWTQERFIEFVKAAVQAHCRTPFKESTWRNLAAGIRFVQGTFDDPEAFERLSATVQELDRDRGTQGNHAFYMSVPPRAFPQVAKQLAASGLSRSSEGAWRRVIIEKPFGHDLASAKELDSVVSEVFDPSSVFRIDHYLGKETVQNLLALRFANAMYEPIWNANYVDHVQITMAEDIGIGGRAGYYDGIGAARDVIQNHLLQLMALTAMEEPVSFTAKDLTAEKTKVLSAVRLPKDLAANTARGQYAKGWQGSHEVVGYLEEKGIDPKSTTETYAAIRLDIDTRRWAGVPFYLRCGKRLGKRVTEIAVVFKRAPHLPFEQTAVRELGKNAIVIRVQPDEGVTMRFGAKVPGGSTMEVRDVNMDFSYGRSFTENSPEAYERLILDVLLGDPPLFPTTEEVNLSWEILDPIEQFWSTLGQPQAYRAGTWGPAQADEMLARDGRHWRMP

SEQ ID NO: 61973 - protein, 590 aa, Cicer arietinum
MLSTSTTNSSILPFRSRASSSTFIARPPANFNSIFTTSVRVFPISMSRYCVFPHTWERDHNVPGVPGVLRKVVPAAPIKNKPTCADSDELPEYLRDVLRSPVYDVVVESPVELTERLSDRLGVNFYVKREDRQRVFSFKLRGPYNMMSSLSHEEIDKGVITASAGNHAQGVPFPFPGRRLKCVAKIVMPTTTPNIKLDGVRALGADVVLWGHTFDEAKTHAVELCEKDGLRTIPPFEDPAVIKGQGTIGSEINRQIKRIDAVFVPVGGGGLIAGVAAFFKQIAPQTKIIVVEPYDAASMALSVHAEHRAKLSNVDTFADGATVAVIGEYTFARCQDVVDAMVLVANDGIGAAIKDVFDEGRNIVETSGAAGIAGMYCEMYRIKNDNMVGIVSGANMNFRKLHKVSELAVLGSGHEALLGTYMPGQKGCFKTMAGLVHGSLSFTEITYRFTSHRRSILVLMLKLEPWRYIEKMIEMMKYSGVTVLNISHNELAVIHGKHLVGGSAKVSDEVFVEFIIPEKADLKKFLEVLSPHWNLTLYRYRNQGDLKATILMVIASFLCEIVIRKNQIDDLGYPYEIDQYNDAFNLAVTE

SEQ ID NO: 61974 - protein, 416 aa, Vibrio cholerae O1 biovar eltor str. N16961
MVAMRFTPESVRQQFPALAQIVNDKPVVFFDGPGGSQVPQSVLDAMVAYLGRYNANLGGHYFSSKKTVELVQSAREHVQALLNASTPESIVFGANMTSLTFQFSRAISRDWRVGDEVIVTALDHYSNVSSWQQAAQDKGAIVHQARVNTADCTLDQAHLLSLINPRTRLVAVTFASNTTGSLVELEAIIEAAHQVGAMVYVDAVHYLPHHLPDVQALGCDFLACSAYKFFGPHVGIVYVAPQWQNTILPYKVEPATNQGPGRFETGTLSFEGLAGVIAVVQYLAQWGDPNSRLRERLVESYQQYQQHEQRLSEYFLQKLSDMPALKLHGLQLADAAKRTPTFALTCTDCTPQSMAKMLGEQNVCVWNGHFYALGLVRQLGLESSGGVLRIGLMHYNTTEEIDHLFALLRDGLPQLA

SEQ ID NO: 61975 - protein, 475 aa, Listeria monocytogenes str. 4b F2365
MATEYDVVILGGGTGGYVAAIQAAKNGQKVAVVEKGKVGGTCLHRGCIPTKALLRSAEVLQTVKKASEFGISVEGTAGINFLQAQERKQAIVDQLEKGIHQLFKQGKIDLFVGTGTILGPSIFSPTAGTVSVEFEDGSENEMLIPKNLIIATGSKPRTLNGLSIDEENVLSSDGALNLETLPKSIIIVGGGVIGMEWASMMHDFGVEVTVLEYADRILPTEDKEVAKELARLYKKKKLIMHTSAEVQAASYKKTDTGVEIKAIIKGEEQTFAADKILVSVGRSANTENIGLQNTDIATENGFIQVNDFYQTKESHIYAIGDCIPTIQLAHVAMEEGTIAANHIAGKVAEKLDYDLVPRCIYTSTEIASVGITEEQAKERGYEVKKGKFFFRGIGKALVYGESDGFIKIIADKKTDDILGVSMIGPHVTDMISEAALAQVLNATPWEVGNTIHPHPTLSESFREAALAVDGNAIHG

SEQ ID NO: 61976 - protein, 262 aa, Oceanicola granulosus HTCC2516
MPRSANLNVMMKTARAAGRSLVKDFREVENLQVSSKGPGDFVSRADRRAEEIIHAALMEARPTYGFLGEEGTVVEGEDPTRRWIVDPLDGTTNFLHGMPHWAVSIALEHKGQIVAGVIYDAAKDELFFAEKGEGAWMNESRLRVSGRGRMIDSVFATGLPFGGRRELPAALQDLARLLPACAGVRRWGAAALDLAYVAAGRYDGYWERGLKPWDVAAGIIIVREAGGFVEPIDPEGDIFDDGTILCGNDPIFPAFSKVIRNG

SEQ ID NO: 61977 - protein, 333 aa, Ehrlichia canis str. Jake
MKIGINGLGRIGRCLIRAIYENTQSSIELSALNGSTSSEIHAHLIQYDSVHGKFPYNVESEEGYIIINDKKIPLSIEKEPKNIFWEKHNIDIVLECTGKFNKKSLAIQHINSTVKKVIVSAPVQDSDVTIVYGVNNEMLKKEHNVISAGSCTTNCIAPILKIMNDTVGIKNGFITTVHSYTNDQNLVDNNHKDLRRARACMMSIIPTTTGATKTIDLIIPELKGKLNGTAIRVPTPNVSMIDLVFNSVKSTNANEINDIIKNSSQNSKVISITDKKLVSIDFCHSTYSSIVDANETCVTDNNLCRIAAWYDNEWAFAMRMLDIVSLLSELIQN

SEQ ID NO: 61978 - protein, 248 aa, Debaryomyces hansenii CBS767
MARQFFVGGNFKMNGTRESVSKIVDGLNKAELPSNVEVVIAPPAPYIALAVNENKQKTIEVSAQNCFDKASGAYTGEISPEQIKDLGATWTLTGHSERRTIIKESDDFIASKTKFALDQGLSVILCIGETLEERKANVTLDVCARQLDAVARVVSDWSKIVVAYEPVWAIGTGLAATPEDAQETHKAIREHLSKSIGADAAEKTRILYGGSVNGKNAPEFKDKADVDGFLVGGASLKPEFVDIIKSRL

SEQ ID NO: 61979 - protein, 268 aa, Ehrlichia canis str. Jake
MNILLIGCGNLGSILLNKWSHNAQISKVIVVQPSLSKRDAFNSITKVTFVKDYEKISRDFVPQVVVIAIKPQQIFDVMPNYGIYSKSASFISLCAGIDVNLLKKCLGNTATIIRVMPNIAMSLSKSVNLSYMEEESHNEKQKVSIIFNDTGLIYWIQKEDIFDKLSPITGSGPAFFFSLAEELVKHTVEAGINEEDAIKLVSQTFIGSAKLLETRKTTISNIISSITSRGGITQAALQVLNLDLPKTISSCLKAAMERLLYLKDMHNK

SEQ ID NO: 61980 - protein, 491 aa, Ehrlichia canis str. Jake
MSFALKYRPSNFKDLIGQEVLVRVLHNAFHLDKIPESILLTGTSGVGKTTAARIISMCLNCAFGPTSDPCNTCQNCISIKNFNHPDVIEIDAASNTSIEDVKVILENSRYMPISSKFKVYIIDEVHMLSNSAFNALLKVLEEPAHYVKFILATTEVKKIPVTIISRCQRFDFQKISTDKLIKHLKAISEKENITSDEESIKLIADNADGSIRNALSILEQAAIYSNKVLSEKSTKEMLGYVSRHTLLEIIEPLVTGNTLEALKKFEESCNSYSPVIILDNMLQIIYEICYFSITKNNDSLSDNNVITHIKNDKILSTTFLSRLWQMLFKGIQEVKLSSCTKHAANMLIIRLCYLSPLPSPKQIIDKIQDNIKTNNKSDNYKEELLELLKVNNMQDLYNQIYESDLEITNYNDGILNIKANNTLSKDLHNDLSNFLNSSTNKKWNISIEQNFNINKNSNTCYNQSFNSTVCNILQEFDGAKVVNIENIKKEQ

SEQ ID NO: 61981 - protein, 335 aa, Debaryomyces hansenii CBS767
MNMATKQVKSYQAPTTTSIDVESSVVLSLIRHTSEHYPSLYSGALLGFESDSGALDITHAFAYPYPDQYEGGSLRSRSGAKYQQDILDSLKKLGYGIGFQGWFQSTVSGNFVTTQLVDALVQQQLTNKNSFILIHNMASIGKELDLKAIRLSESFVRTYLDGKWKSKDLENHKLSFLNIFDEIPIRIRNQHLVNLYLASSTNDTKSENEFDILNLSSNQNVTAQLLESLYGQVDAYNYDQTNYNYYQRQHQKEQSKIMQWKQQRKLDNLERAKIGEKELDTEEWQSLFKLPTEPSRYNNMLHSHAIDVLADDILKRCDEDLTKSFAIERKLTTDK

SEQ ID NO: 61982 - protein, 504 aa, Oryza sativa Indica Group
MPVYSWSSCCCLEDFGQEPKIMASLADSFLADLDELSDNEAYPEEENAEAVGTEEIGDDDMPDLESLNYDDLDSVSKLQKTQRYNDIMQKVENALQKGTDFSNQGSILEEDPEYQLIVDCNALSVDIENEIIIIHNFIRDKYRLKFPELESLVHHPIDYARVVQKIGNEMDLTLVDLEGLLPSAIIMVISVTASTTSGKPLSEENLVKTIEACERALTLDAAKKKVLEFVESRMGYIAPNLSAIVGSAVASKLMGTAGGLGALAKMPACNVQLLGAKRKNLAGFSTATSQFRVGYLEQTDVFQSTPPALRTRACRLIAAKSTLAARIDSIRGDPTGKAGRNLLEEIRKKIEKWQEPPPAKLPKPLPVPDFEPKKKRGGDGLGEGYGMLGQAGSGKLRVSTAPSKLSAKITKKFKEKSYGSSGATSGLTSSLAFTPVQVYSAMLLVIAQLRGFYVAILVRLISELICACIGIELSNPQAHGNLLGSGTQSTYFSETGTFSKIKRT

SEQ ID NO: 61983 - protein, 558 aa, Physcomitrella patens subsp. patens
MLNMRICGSNRDVETRPYTRIRVPYDDSTNIRLSNQSPTSQRRDNRPHTKSFLQSSLAFVKKTFPVGVFEGKEQRSPSPIRGGFSDPRQQSQEYPYNASLHSPVDNQRSYSAPSHPSSNYTPDISPQCEWNTNSGPTYYAPPSSVTPSKRQNNEPASSGSGATRCASYDRQNRSKVEDSYHYSGPPPGSYLDDDTGPSPKLLSMAVTAVKSALNPFAKMLMSHMKNHSSELKKLESMISHEGSVERTNHLKFLVQAFTCNLLFDCFTTKNGYCESNDDRSRQSFFADFTRFKDKAATISMLLSNQPLSHMRDDNSIGNYCFEKFKLICSDPDTNQPFPIYEKDWRIVSGEQHPDSEFYRSFLKVAVSVWLLHRLTHSFPHKWQMLTCSRGEAFERKYMESVVPGGYDEDDEDADANIVVGFLVIPGFRVSKSIVKCEVYLHSKQRHNDGRIVESPVKASKQGNVGHRTPDNNSFRSNSSYTDKQPYPKHSTSVEERQEHRVGSMSSRRGPRTTVPGYEDCINSVASAMYICRNFPESSLRQIFTERDFVYIIYWSDND

SEQ ID NO: 61984 - protein, 458 aa, Fulvimarina pelagi HTCC2506
MICTGRSDYPNQVNNVLCFPFIFRGALDCGATHITEKMKMAAVDAIAALARENVNEVAAKAYGSGTPIFGPQYLIPTPFDPRLILKIAPAVAEAARQEGVATRPIEDMNQYMEQLNRFVFRSGLIMKPIFKVTQGTDHKVIFADGEDERVLRASQVLLEDRVCQPILVGRPSVIESRLERFGLSIAPGKDFQVVDPTDDPRYRDYVDAYFAKVGRKGISPDSARTIMRTNSTVIAATAVTRGEADAMICGLEGRFPHHVRDISQVIGLEPGVRRFAALSVLIAQQGSKFFVDTYVQRNPSADDIAEMTILAADEIKRFGIEPKAALVSHSNFGSDDTEDTRKLRNALGIIREQRPDIEIDGEMHGDAALNQATRDRTMPASTLTGEANLLVFPTLDAANITLNVVKTMLDALHVGPILLGTNSPAHVLTPSVTSRGVVNMAAIAAAQCVQNAKQIENG

SEQ ID NO: 61985 - protein, 478 aa, Klebsiella pneumoniae
MTAPVQHPMYIDGQFVSGRGDGWIDVLNPATEALLSRIPDGTAEEARLAIDAAERAQPGWEALPAIERAGWLRKIAAGIRQRADEIAGLIVAEGGKIQQLAAVEVAFTADYLDYMAEWARRYEGEIVQSDRPGENILVFKRALGVTTGILPWNFPFFLIARKLAPALITGNTIVIKPSEFTPNNAIAFAEIVHQVGLPKGVFNLVLGRGETVGQELAGNPKVAMVSMTGSVAAGEKIMAAAAKNITKVCLELGGKAPAIVMDDADLELAVKAVVDSRVINTGQVCNCVERVYVQQGIYDRFVNRLGEAMKAVQFGDPATRDDIAMGPLINAAARDQVAGKVRSGGAGGAGGAGGQPLEGKGYFYPPTLLLDVRQEMDIIHEETFGPVLPVVAFSTLDEALATANDSDYGLTSSIYTRDLNVAMKAIKGLKFGETYINRENFEAMQGFHAGWRKSGIGGADGRHGLNEYLQTQVVYLQA

SEQ ID NO: 61986 - protein, 352 aa, Streptomyces sp. KO-3988
MTTDTGQDAVGLARRTGADLLHRVEDRLRSLLAVERDAWAAVHEQAVVPVDALSELIASGGKRIRPAFCITGYLAAGGDPAEPGIVAAGAALEMLHLSALVHDDVLDDSSSRRGVPTVHTQAMALHESSGWQGEPRRYGEGVAILVGDLALVYSEELMAEAPRRVLPEWNKLRSEVMIGQYMDVHAAAEFSVDPRSSRLIARIKSGRYTIHRPLVVGAKRGRGRGDLAPALEEYGEAVGEAFQLRDDLLDASATPAETGKPTGLDFTQHKMTLLLGWAMQRDEHIHTLVTEPGHTPDEVRRRLLDTGVPADVERHIAGLVERGCKAIADAPVDQVWRGELAAMAGRVAYRTA

SEQ ID NO: 61987 - protein, 742 aa, Cryptococcus neoformans var. neoformans B-3501A
MISVRLNEYNLPEGKDEDKVSFDLAELDNLSDWSGWAFYRIAPTWIEARPLDNVSLLSNQLTTHLLLVKRKSQPDHIACVYPISSSSALSNIVNDNGDIKVQLRRAKGNSDAKAAVVIGTASDASQLNCLIGDVVRTARGWLLDVPAKEVVDFKSFPSGGPLDGVGFCTWSSLGEDIRPDRENMSGLFNALTDHNLPIQSFILDDGWLNQKTYEKGDSSPFVSTTGPEEERGTWQLRGLYDFDAWSGLGHDGIKMIVDEATTRLSKIDGVKDTIQVGVWMSLVGGYWDGISPDSPLIAKYKCRPYPASRARLPGISNEPFTVGFLPGGKGTYWLPPPSESLRFWRDWFNYLKSQGVDFLKVDNQGSMSLVDGTEGVECQHAIWENMVKASDEVFGKGKVIHCMSHHESIWGGIQGLGIVTEGEKFVWRNSDDFGLGHKKANAHQQHIFTNLSNSLLTSHLAMILDADMFMSAEQDPVPHAFLRALYPGPLLLSDRPGIHDSRLLGRMISKDKTGIARVIKTQHPAVPLSHRALDIDVIGKGEGSGLYAAAPTEAGVILGVWNVREDNDNGRVVDKLTFTDVKYALNGKDMSSPWLIVESDLEKGGISRAGLLSSSDEVITDIVLERMKAASFWLTPLRPVNKVGVAVLGLTKHFAGLMAVTDVQSNDTRVTAQVNGEGTFGFVVVSSQRPMYTIHVDDQVQDATLALTPSFHGADKVWLIETEIRANGIRGDGWTVAIDILG

SEQ ID NO: 61988 - protein, 153 aa, Triticum aestivum
  misc_feature (58)..(58): Xaa can be any naturally occurring amino acid
  misc_feature (78)..(78): Xaa can be any naturally occurring amino acid
  misc_feature (87)..(87): Xaa can be any naturally occurring amino acid
  misc_feature (92)..(92): Xaa can be any naturally occurring amino acid
  misc_feature (102)..(102): Xaa can be any naturally occurring amino acid
  misc_feature (104)..(104): Xaa can be any naturally occurring amino acid
  misc_feature (115)..(115): Xaa can be any naturally occurring amino acid
  misc_feature (118)..(118): Xaa can be any naturally occurring amino acid
  misc_feature (124)..(124): Xaa can be any naturally occurring amino acid
  misc_feature (134)..(134): Xaa can be any naturally occurring amino acid
MAPTVMASSATSVAPFQGLKSTAGLPVSRRSNGASLGSVSNGGRIRCMQVWPSEGIKXSETLSYLPPLNTEASFKQVXDYLIPSKWXPFLRXQKFGSLPVEXNXPLGYYDGRYWXMLXLPMFRXTDPPSVNEVXGGKEGLTLCIITNLKGRNR

SEQ ID NO: 61989 - protein, 216 aa, Glycine max
  misc_feature (118)..(118): Xaa can be any naturally occurring amino acid
GKQKVGGLPRGWGALFKIKGVFGGVGGGPPHLPFPWDHRFGEKTVILAGFFLGCGSPLPPDRRFSGKKKSGAWGLEKKKGYTLRGGWFPPSLNKSACGSFSIFAHGHGGGPVLGLPPXMGKRKGGVRCSMEPKQGNVSAVGAGVSAAATAALTAVMSNPAMALVDDRMSTEGTGLPFGLSNNLLGWILLGVFGLIWTFYFTYTSSLDEDEESGLSL

SEQ ID NO: 61990 - protein, 676 aa, Methanosarcina mazei Go1
MDMLIYLTPICALIGLIFAGISYKNVRNEGEGNELIKKITAAIHGGAMVYLNRQYRAIAVFVVFIAIVLALVLPNGVLTAACFVFGAVLSATAGYAGMLTATIANGRTTNAATRGIGPAFKVSFASGTVMGMSVVGLGLFGLSLSFIILGNIYTDMDLFTLLNIIAGFSFGASSIALFARVGGGIFTKAADVGADLVGKVEAGIPEDDPRNPAVIADNVGDNVGDIAGMGADLYESYVGSIIATMLLAASTAAATFPGIPVMNVVMVPLVIAAVGILASVIGTFFVRTNKTESSAIHMAFNMGLIAAIVLTVIASYVVTGHLLGGYGLNVFFSTVAGLVAGFLIGQITEHYTSYDKKPTLTVAHSCQTGSATNVITGFAKGMESTLWPAVIISIAIYIAFQLAGLYGIAIAAVGMLATLGISLSVDAYGPVADNAGGIAEMSHQKKEVRQITDTLDAVGNTTAAMGKGFAIGSAALTALSLFASYAIAVGLTSIDVMNPNVFIGLIIGAMLPFLFSSMTILAVGNAAGEVVVEVRRQFKEIKGLMEGKADPDYSKCITISTHSALKEMIPPGILAVIAPILVGLVLGAGALGGLLAGSVVSGFMLAITMSNAGGSWDNAKKFIELGNFGGKGSDAHKAGVTGDTVGDPFKDTAGPAINILIKLMSIVALVFAPLFI

SEQ ID NO: 61991 - protein, 277 aa, Corynebacterium sp.
TVPSIVLNDGNSIPQLGYGVFKVPPADTQRAVEEALEVGYRHIDTAAIYGNEEGVGAAIAASGIARDDLFITTKLWNDRHDGDEPAAAIAESLAKLALDQVDLYLVHWPTPAADNYVHAWEKMIELRAAGLTRSIGVSNHLVPHLERIVAATGVVPAVNQIELHPAYQQREITDWAAAHDVKIESWGPLGQGKYDLFGAEPVTAAAAAHGKTPAQAVLRWHLQKGFVVFPKSVRRERLEENLDVFDFDLTDTEIAAIDAMDPGDGSGRVSAHPDEVD

SEQ ID NO: 61992 - protein, 671 aa, Methanosarcina mazei Go1
MERLIFTAPLAGLISLTFAAFFAKSILKEDAGNKRMKEIAEAIKEGSTAYMKRQYRTIAVVSVIISLLILFLLDEGLKIAAGFLAGAISSAAAGYIGMSISVRANVRTASAASGGAGKALKIAFRGGAVTGLAVIGLALLGTSSLYILYGDADLVVGFGFGASLISLFARAGGGIFTKAADVGADLVGKIEAGIPEDDPRNPAVIADNVGDNVGDCAGMGADLFETYVVTSLAAMLLGSLIIGTYKNAVLYPLMLGSAAIFASIISVFFVKVEKEGKVMSALYRGVGGSTVLSLIAFYYITGFLMGDSRFFYVTVAGVVITVLMVIVTEYYTSKSCRPVKTIAVSSETGAATNIISGLSAGFESTLVPAVVIAAGILVSYFIVGGSADPGTGLYGIAIASVAMLSTAGMIVALDSYGPITDNAGGIAQMANLPAQVRKVTDELDSVGNTTKAVTKGYAIGSTALGALALFADYRNKVSLESQSISLDSPVVLSGILLGAVLPFLFSAVMMSAVGKAAFEVVNEVRRQFREIPGIMEGTAKPEYGRCVDIVTKAALHDMAMPGFLAVIIPLLTGFFLGPEALAGLLTGLIVVGFMLALMMDNGGGAWDNAKKLIEDGYYGGKGSEAHRAAVVGDTVGDPFKDTAGPALNSLIKVVNMVAILFSPLIIGGGFL

SEQ ID NO: 61993 - protein, 598 aa, Zea mays
MGGEVPEPRRLSRALSFGCGGVPEEALHLVFGYMDDPRDREAASLVCRLWHRIDALSRKHVTVGFCYAVEPARLLARFPRLESLALKGRPRAAMYGLIPEDFGAYAAPWVAELAAPLDCLKALHLRRMTVTDEDIAVLVRARGHMLQVLKLDKCSGFSTDALCLVARSCRSLRTLFLEECIIEDEGSEWLHELAVNNSVLVKLNFYMTELKVEPADLELLAKNCKSLISLKMGDCDLSDLIGFFQTSKALQEFAGGAFFEVGEYTKYEKVIFPPRLCFLGGLTFMGKNEMPVIFPYSTMLKKLDLQFTFLTTEDHCQLIAKCPNLSVLEVRNVIGDRGLEVVAATCKKLRRLRIERGDDDPGQEEQGGVSQIGLTAVAVGCRELEYIAAYVSDITNGALESIGTFCKNLYDFRLVLLDKQKKITDLPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPSPESAYRVMADGQPCVDTHAQVLAYYSLAGRRPDCPQWLVTLHPASL

SEQ ID NO: 61994 - protein, 448 aa, Magnetospirillum magnetotacticum MS-1
SHGSHDDHKTRIFTIRELEKKVKRPIAILADLQGPKLRVGDFVDGRARLEAGAVFRLDMDDALGTALRAPLHHPEVFAALKPGSELLIDDGKLRLAVESCGPDFAETRVVVGGEISNHKGVNVPNVMLPISPLTEKDRRDLEFAVEMGADWIALSFVQRPSDVQEARKLIAAYVGSRVRILSKLEKPSAIEHLASIIEWSDAVMVARGDLGVECPPETVPILQKRIIKACRRAGKPVVVATQMLDSMVHSPSPTRAEASDVATAVYDGSDAVMLSAETASGEYPMEAVTMMDRIIQQVEHDKNYLLITDASRLDPEHTTRDAISAAARQVAHTLGAAAIVTYTSSGSTTLRAARERPEQPILSVTADIEVARQMALVWGAHSIMAKDVRSFTEMVTKAVHFAQGEGFARVGDRVVITAGVPFGHSGTTNILRVAEVEDSGHHHKHESD

SEQ ID NO: 61995 - protein, 428 aa, Oryza sativa Japonica Group
MVNKHFLSLSVLIVLLGLSSNLTAGQVLFQGFNWESWKENGGWYNFLMGKVDDIAAAGITHVWLPPPSHSVGEQGYMPGRLYDLDASKYGNEAQLKSLIEAFHGKGVQVIADIVINHRTAEHKDGRGIYCLFEGGTPDSRLDWGPHMICRDDPYGDGTGNPDTGADFAAAPDIDHLNKRVQRELIGWLDWLKMDIGFDAWRLDFAKGYSADMAKIYIDATEPSFAVAEIWTSMANGGDGKPNYDQNAHRQELVNWVDRVGGANSNGTAFDFTTKGILNVAVEGELWRLRGEDGKAPGMIGWWPAKATTFVDNHDTGSTQHLWPFPSDKVMQGYAYILTHPGNPCIFYDHFFDWGLKEEIERLVSIRNRQGIHPASELRIMEADSDLYLAEIDGKVITKIGPRYDVEHLIPEGFQVVAHGDGYAIWEKI

SEQ ID NO: 61996 - protein, 235 aa, Rhodopirellula baltica SH 1
MSRAKLDSIRAAGPAILPSLLQCDFGDLRTEIEKLTVAGTRVLHLDVMDGHFVPNLTYGMPIVEGLRRHTDMPLDVHLMISDPIAYAQPMVDAGADLLTFHVEAVDDCVEVAGKIRDMGVGVGVAINPDTDFAKLDCCLDSVDMVLVMSVNAGFGGQQFNPVALDRLRSLKERKPDLLLEIDGGIKAETIGDARAAGCDLFVVGSAIFGQHDYETAINELTQAMHGSPPATGDQS

SEQ ID NO: 61997 - protein, 418 aa, Oceanicola granulosus HTCC2516
MQNEPFFGLNPYHIVLVVLGATIIVARWLPRLVSHREPAAAPLMILFGAGISLLLPELVTLPDPRETPLPWELVSELTVIIALFGAGMRIDDLTPWRRWGPTARLLAIAMPLTIFAVAALGVWLAGLTLAGAILLGAVLAPTDPVLAADVQVGPPQEGAEHPVRFTLTTEAGLNDGLAFPFVYLGLIIAAEGTTSGSLAFDWLLRDVLYRILVGAAMGWLGGRALGLVLFHIPRDAALAETSSGIIALAGVLLCYGSTELLEGYGFISVAVLGLTLRRIEQNHTFHRRLHDFSESIEHALTALLLVALGTVLPLLFLDLTWVQVLIAVLLLLVVRPVAGWLSLIGSNLPNRDRAIASVYGVRGIGSIYYLCYAGSHMEFHNEEALWSLVALVILVSTFLHGFSVGWAMEHASEQTEEQ

SEQ ID NO: 61998 - protein, 375 aa, Oryza sativa Indica Group
MATGKVIKCKAAVAWEAGEALSIEEVEVAPPQRMEVRVKILYTALCHTDVYFWEAKGQTPVFPRILGHEAGGIVESVGEGVTELAAGDHVLPVFTGECKECDHCKSEESNMCDLLRINVDRGVMIGDGKSRFTIKGKPIFHFVGTSTFSEYTVIHVGCLAKINPEAPLDKVCILSCGFSSRFGATVNVAKPKKGQTVAIFGLGAVGLAAMEGARLSGASRIIGVDLNPAKFEQAKKFGCTDFVNPKDHSKPVQVLIEMTNGGLDRAVECTGNINAMISCFECVHDGWGVAVLVGVKDDVFKTHPMNFLNEKTLKGTLIFGNYKPRTDLPNVVELYMKKELELEKFITSVPFSEINTAFDLMLKGESLRCVMSMYE

SEQ ID NO: 61999 - protein, 418 aa, Thermococcus litoralis
VEQDPFEIAVKQLERAAQYMDISEEALEFLKRPQRIVEVSIPVEMDDGSVKVFTGFRVQYNWARGPTKGGIRWHPEETLSTVKALAAWMTWKTAVMDLPYGGGKGGVICNPKEMSDREKERLARGYVRAIYDVISPYTDIPAPDVYTNPQIMAWMMDEYETISRRKDPSFGVITGKPPSVGGIVARMDATARGASYTVREAAKALGMDLKGKTIAIQGYGNAGYYMAKIMSEEYGMKVVAVSDTKGGIYNPDGLNADEVLAWKKKTGSVKDFPGATNITNEELLELEVDVLAPSAIEEVITKKNADNIKAKIVAELANGPTTPEADEILYEKGILIIPDFLCNAGGVTVSYFEWVQNITGDYWTVEETRAKLDKKMTKAFWDVYNTHKEKNINMRDAAYVVAVSRVYQAMKDRGWIKK

SEQ ID NO: 62000 - protein, 469 aa, Solibacter usitatus Ellin6076
MTPQEVLDYAKTNGAQQLDLRFTDIPSLQHHVSYPMNQVDESSFEEGFGMDGSSIRGWAAIHESDMLLIPDSTTAFMDPFAEVPTLVMYGDVKDPITKQRYERDPRWIAQKAELYLKNSGVADTSYFGAEAEFFIFDNVSFDQNQHSGFYYIDAEEGRWNSGRRENNLGYRPRYKEGYFPVPPTDHYQDLRSEMVRTMIECGLNIECHHHEVATGGQCEIDQKYDTLVRSADNMMLYKYVVRNVANQYGKTVTFMPKPIFGDNGSGMHCHQSLWREGKPLFAGDSYAGLSQMALHYIGGLLKHARALSAIIAPTTNSYKRLVPGYEAPVNLAYSRRNRSAAVRIPMYSASPKTKRVEFRPPDASANPYLAFAAMLMAGLDGVMNRINPGEPLDKDIYDLSPEEMKSVPSMPGSLDEALTCLEDDHGFLMRGDVFTEELLETFIDYKRKNEAEAVRLRPHPYEFALYYDI

SEQ ID NO: 62001 - protein, 176 aa, Thermobifida fusca YX
MSTDVSTLIDRYVRDIPDYPQPGVVFKDITPLLSHPTALRTAIDALAEPLLGSEIDLVAGLEARGFIFAAPVAVRLGAGFVPLRKAGKLPAETLAESYDLEYGTATVEMHADAVPPGSRVLIVDDVLATGGTGRAAVDLIRRAGGTVVGLSVLLELGFLKGREKLADVELRALATV

SEQ ID NO: 62002 - protein, 367 aa, Carica papaya
QMGLAENQLCFNLIHEWLLKNPEASICTAQGAAEFRDIAIFQDYHGLAELREAVAKFMGKVRRNRASFDPDRIVMSGGATGAHEMIAFCLADPGDAFLVPTPYYPGFDRDLRWRTGVKLIPVVCESSNDYQITIEALEAAYETAQEADIKVKGLLITNPSNPLGTIITKDTLEALVTFTNHKNIHLVCDEIYAATVFSQPEFTSIAEIIEEDKICCNRDLIHIIYSLSKDMGFPGFRVGIVYSYNDAVVSCARKMSSFGLVSSQTQYLIASMLADDEFVDKFIVESRKRLAMRHSFFTQRLAQVGINCLKSNAGLFVWMDLRRLLKEQTFEAEMVLWRVIINEIKLNVSPGSSFRCSEPGWFRVCFA

SEQ ID NO: 62003 - protein, 212 aa, Photobacterium profundum SS9
MAQAHIVLLDNFDSFTYNLVDQFRSLGHPVTIYRNSLSVEQMEQALADKVNPVLVLSPGPGAPADAGCMPALIKRIKGEVPIIGICLGHQAIVEAYGGKVEGAGEIVHGKSAMMSHTKHNVFGDLPNPLSIARYHSLVATEVPETLDIVADVDGLVMAVINDADRVCGFQFHPESILTTQGAQLLTNTLNWVMSKVESDIETTKTPQTNDKD

SEQ ID NO: 62004 - protein, 303 aa, Alkalilimnicola ehrlichei MLHE-1
MHPRHFLTLLDFTPDELRRVIHRASELKHIRDQGQLHEPLRGKVLGMVFEKSSTRTRVAFEAGMNQLGGSAIFLSPRDTQLGRGEPVEDTARVLSRMVDIIMIRTYGHEVLERFAEYSRVPVINGLSDRFHPCQLLADIQAYEAHRGSIQGRTVAWVGDGNNMCHSWINAARQLDFQLRIAVPEGYDPDPDLIHAGGDRVSVHRDPREAVEGVHLVTTDVWASMGQEEEAKARMKAFSGFCVDDALMGLAAKDAVFMHCLPAHRGEEVSASVIDGPQSVVWDEAENRLHAHKALMEFLLLAQE

SEQ ID NO: 62005 - protein, 394 aa, Alkalilimnicola ehrlichei MLHE-1
MLEALMPTYKRLPVAFERGEGAWLWDDQGRAYLDALSGIAVCGLGHAHPAVTRALQEQAATLLHTSNLYRIPVQEQLGARLTQVAGLDEVFFCNSGAEANEAAIKLARLYGHRRGIERPRILVMDNAFHGRTLGTLAATGNPAAQEGFGPLPEGFLRIPYDDLEAARRAAREHDDIVAVLVEPVQGEGGVRTPAADYLPGLRELCDQQDWLLMLDEVQTGMGRTGRLFAYQHANIRPDVLSLAKGLGNGVPIGACLVGGAARGVFGPGNHGSTFGGNPLAARAALAVLETLEEDRLAERAAVQGRRIREGLMQALGDHSGVREIRGLGLMIGIELTQPCAGLVTEALEQGLLINVTAGSVVRLLPPLVISDEEADRIASGVADLIRAFLTRECA

SEQ ID NO: 62006 - protein, 191 aa, Listeria monocytogenes str. 1/2a F6854
MQLIFARHGETDWNVAKKYCGQLDVPLNEHGVQQMEHLREKLEDYSFDLVVTSDLMRVKQSANILSNAKTVRFPALNEMNFGDFEGYTYQEISTKFPKAWNEYCNNWQTALFPNGESFPIFYERVVEVLEVEMEKWQQIDTVLLVGHLGVLRVIALFLQKQTIAQYWDVDFKQGCYSLWDNKSQRFLISNQ

SEQ ID NO: 62007 - protein, 130 aa, Brassica napus
  misc_feature (27)..(27): Xaa can be any naturally occurring amino acid
FSSRVLQISQWRFPPDIPLPYKGYKNXDWQANDGGLTPISMTPPRIPVEHSTPIVHSDPDCLPLHPGIWFYKMVEGGHFFFFVNQKKAGVEFFLIYASIFEGGRKHVFRKSPQTLPNEAPHHQLGGAQKK

SEQ ID NO: 62008 - protein, 215 aa, Bartonella quintana str. Toulouse
MTKYSSLSGIFSRKWIFIRGIPTIHFLPPEGPPEIAFAGRSNVGKSSLINALVQQKSLARTSNTPGRTQELNYFVPDGFSGEPGNLPPIALVDMPGYGFAEAPKNLVDAWTHLIFSYLRGRTTLKRVYVLIDSRHGIKKNDGDVLDLLDKAAVSYQIVLTKSDKTKSNELAKLIMITKTKLLKHPAAYPELLVTSSEKALGLEELRAAILQAIAV

SEQ ID NO: 62009 - protein, 215 aa, Vibrio vulnificus YJ016
MYKRVVRLDVTNQVSRDMAEVRARVDFKVGAKSNIDAEILSFRGLKTDKEHVAVIFKSADVTQEVPLVRMHSECLTGDVFHSSRCDCGEQLEETINRMGESGGIILYLRQEGRGIGLYNKIDAYRLQSEGMNTYEANNHLGFDDDLRDFTEAVQMLEALGIKQIRLVTNNPKKIRELSEYGIEIVEVVNTSAHIKEGNESYLKAKVSHGKHHLKV

SEQ ID NO: 62010 - protein, 721 aa, Bradyrhizobium japonicum USDA 110
MNRTVFALPARSDYVTRGGLAITRVAEQFTGGASRLDDLVNLLDRRRGVVLSSGTTVPGRYESFDLGFSDPPLKLETTGVNFKLEALNERGQVLIAFLADVLREPCVVISEKTASRLAGHIIRGDAPVEEDQRTRRASVVSLVRDLVAAFSANDDGLLGLFGAFAYDLVFQIEDLVQKRARESDQRDIVLYVPDRLLAYDRATGRGVVLSYDFTWKGRSTEGLPRETADSPYMKTPRQGFADHAPGEYQATVETARAAFARGDLFEAVPGQLFAEPCDRSPAEVFQRLCVINPSPYGALMNLGDGEFLVSASPEMFVRSDGRRVETCPISGTIARGTDAIGDAEQIRQLLNSEKDEFELNMCTDVDRNDKARVCVPGTIKVLARRQIETYSKLFHTVDHVEGMLRPGFDALDAFLTHAWAVTVTGAPKLWAMQFVEDHERSPRRWYAGAIGAVNFDGSINTGLTIRTIRMKDGLAEVRVGATCLFDSDPAAEDRECQVKAAALFQALRGDPPKPLSTFAPDATGSGKRVLLIDHDDSFVHMLADYFRQVGASVTVVRYVHALDMLKQKRWDLLVLSPGPGRPEDFGIRKTIDAALENKLPVFGVCLGVQAIGEYFGGELGQLTHPAHGRPSRVQVRGGRLMRNLPSEIVIGRYHSLYVERDSMPEVLSVTASTEDGVAMALEHKTLPVAGVQFHPESLMSLGGEVGLRIVENAFRLDARVD

SEQ ID NO: 62011 - protein, 557 aa, Gibberella zeae PH-1
MAPANTLPAWSDLQSHRDSVGKSFVLKEAFASDPQRFDKFTRTFTSGGVSSEILFDFSKNFLNDETLDLLVKLAEQAGVEKKRDAMFAGEKINFTEDRAVYHTALRNVGGWDMKVEGVDVMNTQGGVNDVLQHMKEFSEQVRSGEWKGYTGKKLTTIINIGIGGSDLGPVMVTEALKHYGADDMKLHFVSNIDGTHIAEALKESDPETTLFLIASKTFTTAETTTNANTAKKWFLEKTDNKGEIAKHFVALSTNEEEVTKFGIDSKNMFGFESWVGGRYSVWSAIGLSIALYVGFDNFHKFLSGAHAMDKHFRETPLKENIPILGGLLSVWYSDFFQAQTHLVAPFDQYLHRFPAYLQQLSMESNGKTITSDGSSAKYTTANQSGPILFGEPCTNAQHSFFQLVHQGTKLIPTDFILAAKSHNPVSDNLHQKMLASNYFAQAEALMVGKTDEQVRAEGAPEELVPHKRFLGNRPTTSILVGGAIGPAELGALIVYYEHLTFTEGAIWDINSFDQWGVELGKVLAKKILKELDEEGNGEGHDASTGGLIGAFKKYGQN

SEQ ID NO: 62012 - protein, 206 aa, Bartonella quintana str. Toulouse
MGRTLVLIRHGQSEWNIKNLFTGWKDPGLTEKGHAEAITAGKNLKAAGLKFDIAYTSALQRAQKTAQHILEQMGQSDLPLIKNSALNERDYGDLSGLNKDEVRQQWGEQQVQIWRRSYAVAPPNGESLRDTGARVWPYYLYHIQPHILRSQTVLIAAHGNSLRALIMALEGLNSEEIISQELTTGIPLIYTFNSDSTISSKTIITP

SEQ ID NO: 62013 - protein, 179 aa, Bradyrhizobium japonicum USDA 110
MTFDHDLKASVRTIPDYPKPGIMFRDITTLLADARAFRRAVDELVNPWAGNKIDKVAGMEARGFIIGGAVAHQLSAGFVPIRKKGKLPHTTVRIAYSLEYGIDEMEMHVDAIQPGERVILVDDLIATGGTAEGAVKLLRQIGANVVAACFIIDLPELGGAAKLRAMDVPVRTLMTFEGH

SEQ ID NO: 62014 - protein, 445 aa, Oryza sativa Indica Group
MRTGRRLSMILLLLLLGLASGDKILFQGFNWESWRQSGGWYNLLMGKVDDIVAAGVTHVWLPPPSHSVSTQGYMPGRLYDLDASRYGTSMELKSLISALHGKGIQAIADVVINHRCADYKDSRGIYCIFEGGTPDGRLDWGPHMICRDDTQFSDGTGNLDTGADFAAAPDIDHLNGVVQRELTDWLLWLKSDEVGFDAWRLDFARGYSPEVAKVYIEGTTPVGLAVAELWDSMAYGGDGKPEYNQDAHRQALVDWVDRVGGTASAGMVFDFTTKGIMNTAVEGELWRLIDQQGKAPGVIGWWPAKAVTFVDNHDTGSTQQMWPFPSDKVMQGYAYILTHPGNPCIFYDHFFDWGLKEQIAALVAVRQRNGVTATSSLKIMLHDADAYVAEIDGKVVMKIGSRYDVSSLIPPGFHLRPWPYAVWEKTPPPPPPPPIIAPLPAHRSD

SEQ ID NO: 62015 - protein, 477 aa, Methanosarcina mazei Go1
MEIPDHKTKIVCTIGPASSSEEMIRKLMLAGMNVARINFSHGDFESHSRVVRIIRKVADELGRTIAILADLPGPKIRIGKLEKEPVMLHKGNPITLTIDDTPGNEERIPVSYKQLPESVTPGSLIYLSDGFIQLLCKEVTGKDVLCEVLIGGELYSHKGLNLPGAKIFLDAVTEKDFRILEFALEEDIDTFSISFVENAEDIRKVRNFAASRGKQVNIVSKIERRQAVENIGEILDETDALMVARGDLGVEIPIQEVPSVQKELIQRAKLLGVPVITATHMLASMTDNIRPTRAEATDVANAILDGTDAVMLSEETAVGNYPVEAVEMMAKIAKTTENWRSRTKWGLDTMIKSITAREMSVDEVITLQVYEALQKLPVAAVLTPTRSGATPRRISRFNPDPWILAFSRVPKTCRFLSLSYGVYPVAVNESIESWEKETTERTKELGFAKSKDLVIFTQGPASGKPGGTNMLKILTLD

SEQ ID NO: 62016 - protein, 347 aa, Bifidobacterium longum DJO10A
MSETMKAAIFVEPGKMTVEEVPKAMLEQDDDIVIRVVRTCVCGSDLWFFRGLSGQAAHSQVGHESIGVVEEVGAAVESVKPGDFVVVPFPYSCGKCPVCKAGFESVCPHGGYFSACQAEYLRVPEADGTVVKVPGSPEDYSDEQLASLLTISDVMSTGYHAAVSAEVKPGDTAVVMGDGAVGLCGVIAAKMRGATRVIAMSRHEDRAALAREFGATDIVPERGQEAIDKVLEMTGGYGADAVLECVGSKQSFDTAIGLIRRGGVIGRVGLPHDVEISAEGTFYGNIGIKGGPAPVRHYDLDEGLLDAVLKGEINPGRVFTAEYDLDHIQDAYEAMDQRKVIKALIRF

SEQ ID NO: 62017 - protein, 182 aa, Brassica napus
  misc_feature (8)..(8): Xaa can be any naturally occurring amino acid
  misc_feature (112)..(112): Xaa can be any naturally occurring amino acid
  misc_feature (126)..(126): Xaa can be any naturally occurring amino acid
  misc_feature (148)..(148): Xaa can be any naturally occurring amino acid
MASSMLSXAAVVTSPAQATMVAPFTGLKSSAAFPVTRKANNDITSIASNGGRVSCMKVWPPVGKKKFETLSYLPDLTEVELGKEVDYLLRNKWIPCVEFELEHGFVYREHGXTPGYYDGRYWTMWXKLPLFGCTDSAQVLKEVQECKXEYPNAFIRIIGFDNNRQVQCISFIAYKPPSFTGA

SEQ ID NO: 62018 - protein, 417 aa, Triticum aestivum
  misc_feature (20)..(20): Xaa can be any naturally occurring amino acid
  misc_feature (359)..(359): Xaa can be any naturally occurring amino acid
MLCNRLTRLEGNPICSKLKXTYCSNKKNTMHIMLTAVIVPVVVVSLLVVMCILWKLCWKAKSGDHEDYAMYEEETPLHIDIRRFTYAELKLITSDFQSIIGKGGFGIVYHGTLENGDEVAVKVLMETSIAEATDFLPEVQTLSKVYHKNLVTLQGYCQNKKCLALVYDFMPRGNLQQLLRGGDDYSLNWEQRLHIALDAAQGLEYLHELCTPSIVHRDVKTPNILLDKNLVGVISDFGLSRAFNDAHTHISTVAAGTLGYLDPEYHATFQLTVKTDVYSFGIVLLENITGQPPVFMDPQTVHLPNWVRQKIANDSIHDVVDKKLLDLYDAGSLQSVVDLAMNCVGNAAIDRPTMTEVAXRLKVWLPAASGTPRRTYSMDSEIPRQFQLMISGARNEGSSFQSGYTNGMSQMSLFSGR

SEQ ID NO: 62019 - protein, 518 aa, Polyporus ciliatus
MARFQSLLSFVTLLFAVSAYAAIGPVTDLTVTDANISPDGFNRAAVVVNGVFPAPLITGQKGDRFQLNLVNQMTNHTMLKTTSIHWHGFFQKGTNWADGPAFVNQCPIASGNSFLYDFQVPDQAGTFWYHSHLSTQYCDGLRGPFVVYDPADPHLGLYDVDDDSTVITLADWYHVAAKLGPRFPPSSDSNLINGLGRSPSTPTADLAVISVTQGKRYRFRLVSISCDPNYTFSIDGHQLTVIEADGISTQPVTGIDSIQIFAAQRYSFVLTADQPVDNYWVRANPNFGNTGFAGGINSAILRYDGAPAIEPTTNQTGTNLLLETDLHPFTPTPVPGNPTQGGADFNLNLAFNFNGTDFSINGATFTPPSVPVLLQIISGANSAQDLLPSGSVYALPSNSSIELTFPATAAAPGAPHPFHLHGHAFAVVRSAGSTVYNYDNPVYRDVVSTGTPGDNVTIRFQTDNPGPWFLHCHIDFHLDAGFAVVFAEDIPDVASANPVPQAWFDLCPIYNALDPSDQ

SEQ ID NO: 62020 - protein, 524 aa, Polyporus ciliatus
MSKFQSLVAFVALTLATSRLAAAAIGPVADLTITNADINPDGFTRAAVLANNVFPGPLITGNKGDNFQLNVVDNLSNDTMLTATTIHWHGFFQKGTNWADGPAFVNQCPISTGNSFLYNFNAPDQAGTFWYHSHLSTQYCDGLRGPMVVYDDADPHASLYDVDDESTVITLADWYHTAARLGPCFPLGSDSTLINGLGRFAGGDADAPLTVISVTSGKRYRFRLISISCDPNFTFTIQGHTMTVIEVDAVNVQPYEVDSIQIFAGQRYSFVLTADQAVDNYWIQAIPSIGTITTDGGVNSAILRYDGADIVEPAAATVTGSNPLVETSLVPLENLAAPGEPTIGGVDYPLNLDFSFDGTNFAINGATFTPPTVPVLLQIMSGAQDVADLLPSGSIYSLPSNATIELSFPITATNAPGAPHPFHLHGHTFYVVRSAGSTEYNYVNPPQRDTVSTGTAGDNVTIRFTTNNPGPWFLHCHIDFHLEAGFAVVFGEDIPSISDANPPSSAWEDLCPTYNSVYPNGDGN

SEQ ID NO: 62021 - protein, 313 aa, Frankia sp. EAN1pec
MATSGRITTPFTAESTAAEVVAGIDLGGRRVVVTGASSGIGVETARALAGAGAEVTLAVRDVEAGRWTADDIVAAMGNKEIHVAPLDLADRASVAAFVAGWDGPLHILVNNAGVMATPELRTPEGWELQFATNHLGHFAVASGLRGALAAAGGARVVSVSSSGHLRSPVVFSDIHFRERAYEPWAAYGQSKTANVLFAVEATRRWADDGITVNALMPGAIATRLQRHISTEDLDRLRGQINAPALVWKSVEQGAATSVLLATSPLLDGIGGRYFEDCNEALPNTPGVRGGVAAYALDPEAAARLWDVTVDTLT

SEQ ID NO: 62022 - protein, 398 aa, Pseudomonas putida
AGNKSVVYHGTRDLRVETVPYPKLEHNNRKLEHAVILKVVSTNICGSDQHIYRGRFIVPKGHVLGHEITGEVVEKGSDVELMDIGDLVSVPFNVACGRCRNCKEARSDVCENNLVNPDADLGAFGFDLKGWSGGQAEYVLVPYADYMLLKFGDKEQAMEKIKDLTLISDILPTGFHGCVSAGVKPGSHVYIAGAGPVGRCAAAGARLLGAACVIVGDQNPERLKLLSDAGFETIDLRNSAPLRDQIDQILGKPEVDCGVDAVGFEAHGLGDEANTETPNGALNSLFDVVRAGGAIGIPGIYVGSDPDPVNKDAGSGRLHLDFGKMWTKSIRIMTGMAPVTNYNRHLTEAILWDQMPYLSKVMNIEVITLDQAPDGYAKFDKGSPAKFVIDPHGMLKNK

SEQ ID NO: 62023 - protein, 128 aa, Synechocystis sp. PCC 6803
MIATPLAQAATTPSHLPTETRPWGSFTTLEEGNGYKIKRIEVNPGHRLSLQMHHHRSEHWIVVSGTARIVCGDKEELLEPNQSTYVPQCTAHRLENPGVIKLVLIEVQNGEYLGEDDIIRFQDDYARG

SEQ ID NO: 62024 - protein, 477 aa, Polyporus ciliatus
AVVVNGQFPGPLVTGNKGDNFQINVIDQLTNNTMLKSTTVHWHGFFQKGTNWADGPAFVNQCPISTGNSFLYDFTAADQAGTFWYHSHLSTQYCDGLRGPMVVYDPNDPHASLYDVDDESTVITLSDWYHTAAKLGPAFPLGPDSVLINGLGRFAGGDANADLAVISVTQGKRYRFRLVSISCDPNFVFSIDKHNMTVIEADAVSHEPVTVDSIQIYAGQRYSFVLTADQAIDNYWIRALPSGGTVNFDGGVNSAILRYDGAAEIEPVTNRTMSMAPLVESDLVPLDNPAAPGDASIGGVDYALNMAFSFNGTNFFVNGATFVPPTVPVLLQIMSGAQSATDLLPGGSVYSLPSNATIELSFPITATNAPGAPHPFHLHGHVFSVVRSAGSSEYNYVNPPRRDVVNTGTAGDNVTIRFTTDNPGPWFLHCHIDFHLEAGFAVVFSEDSSSGGDSDLSSNDAWNNLCPTYDALSADDL

SEQ ID NO: 62025 - protein, 446 aa, Porphyromonas gingivalis W83
MKVLKFGGTSVGDAERIRSVARLITSVKGRKIIVLSAMAGTTNSLVEIASHLVKRNVAQAKEVVQVLREKYHREINALYKRPDTLSAAKKAVDSLLDSLGHMCDVEGFTLFEEKRVLILGELMSTTMMQIYLQEMGAVVAMLPALEYMRTDKNAEPDKDYIRKHLLPMIEAHPDEDMLFLTEGYICRNAFGEIDNLQRGGSDYTASLIGAALNADEIQIWTDIDGMHNNDPRVVDVTAPVRRLHFEEAAELAHFGAKILHPTCIKPAKEKNIPVRLLNTMDPDAPGTLISLDTEKDCIKAVAAKDGITVIKVKSSNKLLSWHFMRKLFEIFEFYQEPVDMVATSEVGVSLTIDNDKNLPDIVRALSDIGDVTVDKDMVIICIVGDMEWDNVGFEARIINALKGVPVRMISYGGSNYNVSVLVKAEDKKKALIALSNKLFNSRATKA

SEQ ID NO: 62026 - protein, 743 aa, Magnaporthe grisea 70-15
MANPRVEELPDEEVKKTVVDDHDDDSSSDSDGEEETNLPAGSTAVIHSRNEKKARKAIEKLHLIRVDGITRVTLRRPKNILFVINNPEVYKSPNSGTYIASCYGYCAPALYLFSHTICYFAMSLKWYLRASISYVGCIYRSDLSFKMAWTLVDRSRDKWITLAGLSEFAVGTSASIIATTTTSFSISTPPNTHINRKNGRTLKIDWAQVTTSLGLRGQTAASLQAFKKRNDDVRRKVQQLSQQSTQVDFAHYRSVLKNQAIVDEIEKRFAAFKPATYDVSRQLKAIDAFEVEAVKNAEATKNQVDMTLKDLQKTLENIETARPFEDLTVDEVAAAEPSIDEKTAKLVSKGRWQVPGYKANSRVLTVRLMIIVRFCFSTKLSVKSIHILLEQLPSTYQVSQMATRQVPDSLILKTAPQLDPAWVAYEQSDTPFTPPDDILERQKWYAERCRSRHASIISPGMPDHHLTQDVATRWLEVPTSNSDEDHKIPILQYTSPRSTAAPKTVVVYYHGGGLFVGEADSEDLSCRKLAKSPCVDVVYSVGYRLMPTHPASVCVSDALDAFRHVAGDLHRDARVLVVGSSSGGELAALVAQAAAVSASRDGALLQGVLLRGPVTSDAFTGLDPYVPESVRHMHTSVDEPSFANSMLRPWKRAVPRDGLPLMPLEAGDEVLRAMPRTWVQVCTNDVLYSDGVCYARRLDDCGVDVRVDVVVGWPHTFWLKAPELERARKADDEMLEALAWVCQ

SEQ ID NO: 62027 - protein, 106 aa, Physcomitrella patens subsp. patens
ETCYNCGQQGHWAAECTKQAREKPCYVCGNFGHFSYDCPEALRCYICKRTGHMCCIDVSDASPTPVSCYRCGDLGHSGVVSISQDSYENQTACYRCGNEGHFAREC

SEQ ID NO: 62028 - protein, 195 aa, Oryza sativa Japonica Group
MAEEKKTPCLNERILSSLSKRSVAAHSWHDLEIADADAFSLSKCCIGPGAPQVFNVVVEITKGSKVKYELDKKTGMIKVDRVLYSSVVYPHNYGFIPRTLCEDGDPMDVLVLMQGEKDDKIIAVCVDDPEFRHFNDLKELSPHRLAEIRRFFEDYKKNENKEVAVNDFLPPATAQEAIKYSMDLYAEYILHSLRR

SEQ ID NO: 62029 - protein, 579 aa, Magnaporthe grisea 70-15
MQRPQAYGQSPPLHHPVPQHVSTVPQLRSPPPPVSQSAQSGQGYGGSPYPQQQQGGAGPQNMFGQYGQFMNDPAAQVAAHFGSTAFRQGQEIIDQNINRYLSVHLLKHYFNVTNSYVINKIYLVLFPWRHKPWSRKPAMGPGGQEGYLPPRDDVNSPDMYIPVMSLVTYILLSTAIAGLRGQFQPELLGNTAGTALIVVAAEIIILKLGCYIMSISNNSQLLDLVAYSGYKFVGVIVTVAVAEVMNGGKGTGGWSGWSVFIYTFLANSLFLMRSLKYVLLPENADNSRMQTDTRAKRNQRTQFLFFYSAIVSFISTASLKTSAGRPSSHLHAPSSPQAIMALPPIVTATLQSSVLAAVANLLAQALTAFREEEKLIVDWIPVFQFVLYAVLSTPPNFMWQDFIESSFPATKKVVPTTEAVAAASAKDDKALDRTAKKGQLLEPVPKLDMKNTIIKLILDQTIGSAANTFMFSVFFHSVQMAMAHRPVGAEHSMMFLVRSFARSGKDDRPALDFTAVRWDEVMPKAKAEFMPLLSAGWRLWPVVSLINFAFVQTVEMRNLVGGLAGIAWGVYVSLFTAGN

SEQ ID NO: 62030 - protein, 188 aa, Rhodopseudomonas palustris CGA009
MFIQTEPTPNPATLKFIPGRSVLDSGTLEFTDASQAARSPLAARLFDIDGVSGVFYGTDFVTVTKDKGEWQHLKPAILGAIMEHYMSGTPILADGKSDGEDGDDDEFYADADAETVEIIKDLIETRVRPAVANDGGDITFRGFKDGIVYLNMRGACAGCPSSTATLQHGIQNLLKHFVPEVVEVRPVT

SEQ ID NO: 62031 - protein, 259 aa, Xanthomonas oryzae pv. oryzae KACC10331
MPHARAFFHALMQQVLDLAGRNVGKPQVPDALHDEQVLFLSDILPTGYQAVIDAGITQGSTVAIFGAGPVGLMAAACCRMLGAERIFMVDRHAYRLDFACKIHGVIPINFDEVDDPADVIVSQTDGRGVDASIEAVGFKAEDSALETALTNLKLEGSSGVAIRQCIAATRRCGVVSVPGVYAGFIHAFLFGDAFDKGLTFKMGQTHVQKHMPHLLECIGNGRLKPSSIISHRMPLTDAARGYALFDKKQDDCRKVVLTP

SEQ ID NO: 62032 - protein, 449 aa, Zea mays
PRVRLSTAAMAAAPQPPPLEADQTLALPDVLLLRVLACLPEPQLTGAASLVCRRWTRLAGRLRRRLAVRDWAFVAHRLPYRFPDLADLDLFPASIAAPTTAAPHGTAASPLLTCGAVSLTLDTSADPPLGACRFIDDDALDRGLAAVAASFPNLSRLSATAASESGGLMAIAVGCPTLQELELHRCTDLALRPVSAFAHLQILRIVAASPALYGTAEGGGVTDIGLTILAHGCKRLVKLELQGCEGSYDGIAAVGRCCAMLEELTIADHRMDGGWLAALAFCGNLKTLRLQSCSRIDDDPGPAEHLGACLTLESLQLHRCQLRDRSALHALFLVCEGAREIQFQNCWGLEDDMFALAGLCRRVKILLLEGCSLLTTRGLESVITSWGDLQSLEVVTCNKIKDEEITPTLAELFSNLKELKWRPDNKSLLAASLVGTGMGKKGRVFFKRV

SEQ ID NO: 62033 - protein, 355 aa, Rhodopseudomonas palustris CGA009
MHRPDPHDCGIFLISPRYGSNSMSSAQYDVLAIGNAIFDVLVRTEEDFLVKHGMAKGGMALIDEARAAAIYADMGQATEMSGGSAANTIVGLASFGARTAYLGKVKDDQIGKLYTHDIRAAGVTFDTKPATAGPATGCSYILVTPDGQRTMNTYLGAAQDLSPADIDEAKIAASAITYLEGYLWDPPQAKEAFLKASQIAHGAGRKVALTLSDAFCVDRYRGEFLELMRSKTVDLIFANEAELHSLYQTSDFDAALTLLAQDVALGVVTRSEKGCAVVDKDGVTLVPAAAIDQLVDTTGAGDLFAAGFLFGLVRNLGYENAGRLGALAAAEVIQHIGARPQVSLKELAQQHGLAV

SEQ ID NO: 62034 - protein, 167 aa, Salmonella typhimurium
MAHIEKQAGELQEKLIAVNRVSKTVKGGRIFSFTALTVVGDGNGRVGFGYGKAREVPAAIQKAMEKARRNMINVALNNGTLQHPVKGVHTGLRVIMQPASEGTGIIAGGAMRAVLEVAGVHNVLAKAYGSTNPINVVRATIDGLENMNSPEMVAAKRGKSVEEILGK

SEQ ID NO: 62035 - protein, 427 aa, Candida albicans SC5314
MSSGSIATTTIPSTPMSIESIEDHQYHNSFLAMVERNQIPLSRNLLIILYLSHLLLQNNNTTITPYTSKFIHIQNCVGIDEFTGKSIYDIDINDTYFVIHSLVIVTFLRSFLMKWCFEPFASKFCHIHSKKAKTRFAEQSWSFVYYSISFIFGVVLYWDSPYYNNLDQVYINWPNHYMSWEFKTYYLVSMGFWLQQIFVLNVEKPRKDHYQMFSHHIITCLLIIGSYYYYYFRIGHLILMIMDSVDIFLAAAKMLKYAGFSNACDAMFLLFLVSWIVLRHGVYNYIFYHAWYKSVDLMKNGQCVEGLMQKRCWTPVVIDTFLGLLGGLQIITCIWMYLILKVAYKVVTGSGAEDVRSDEDDTDIELEEEEKEEEEEEEVGQPIFVEKKEEEVVLEIEEDKYSFERDSFSSSSESTLDEKKDIRKRKV

SEQ ID NO: 62036 - protein, 434 aa, Candida albicans SC5314
MSADYWNSSQRNQWQLTRFSLLEARRRVLLLERKMIQNGLIKDYPNIIYDYNMRIYLHNLLIKLGRRLNIRQIALATAEIYLTRFLTRVSLKEINVYLLITTCIYVACKIEECPQHIRLILSEARNIWPEYIPHDVTKLAEFEFYLIEEMDSYLLLHHPYKSLMQINEFLSNNYNVFGFKLTVEELQNAWSLINDSYITDLHLLLPPHTIAVAAIYITVVLKKNLSRVRQGNNNDNNININTMHISTGSSTNPININNNNNTNTSNNNGTTSTTTTTTAQETQVLGQDDNTEMNIDDLMNLTKSSNNSQDKSDDKMDIDNPLQSQVNLSQIQNQTQHQHQESTHNNTSSTNTGRNGINGQISQSNQELNNFDLDILDEDTIKINKFMNFLEHSHINLDEVVEAVQDMMNMYVLWNRYNEQGVKKALQVMLLNRI

SEQ ID NO: 62037 - protein, 497 aa, Rhodopseudomonas palustris CGA009
MSPTAAARAADQAASLRDRLKDPSLLREQCYIDGAWSGTSTIAVTNPASGQTIAKVPHLGAAEATQAVEAAAQAFPAWAKLTAKQRSNILRKWFELIIANREDLALILTSEQGKPLTEALGEVDIGAAYVEFFAEEARRVYGETIPTQRADARLIAIKQPIGVCGAITPWNFPSSMITRKVSPALAAGCTVVLKPAEETPLSAFALAALAEKAGVPKRVFNVLTGDAPAIGKVLCEHPAVRFVGFTGSTEVGKILYKQASVGVKKLGLELGGNAPFIVFDDADVDAAVEGAMVSKYRNMGQTCVCANRLYVQDGVYDAFVEKLAAKVKAMKVGDGTEQGVTQGPLINEAAVEKTERHIADALSNGAKIITGGKRHALGGTFFEPTVLADVRPDALVAHEETFGPLAPVFRFKDEAEVIKLANNSPFGLASYFYARDLGRVWRVAEALESGMVGVNTGLITTEVAPFGGVKESGLGREGSHHGIEEYVEIKYVMMAGI

SEQ ID NO: 62038 - protein, 584 aa, Gibberella zeae PH-1
MSLKETNEANHEAKASTPAEAVRDITSPGVQRIKAMSEVITMTDRIFIFLGVFLISYAYGLDGTVRYAYQPSALNEFKEHSLQSSVNTLRAVIAAAAQPTAGKIADVFGRVELICISVFFYTIGTVIEAASQNLDTYSAGAVIYQIGYTMILLLVEVIIGDITSVRSRLFFSYIPALPFIINTWVSGDVTAAVLGATTWRWGIGMWCIIYPVCALPLIVSLLVVGRRAKKQGHLVGYRSSFQQLGLKSFTVELFWLLDIIGVILLIAVFALLLVPLTIAGGFESKWSSPQVVAPLVIGFVCIPVFVVWELRAPHPLVPFHHMKDRSVWAPMGIACMLNFAWTMQGDYLYTVLQVSFNFSIKAATRVQSLYSFASVVTGTILGLIVYKVRRFKVFIVSGTCLFLVAFGLLIRYRGDPSDSNQSGVIGAQILLGIAGGMFPYPAQASLQAYVTHERLAVMTGLYLALYQVGSAMGNAVSGAIWTQVLPARLASSFSGFGNETLAVYTYSQPLSAILDFPVGSVERDAMIDAYKHVQRLLTITGICLCIPLIAFSLCLRNPKLTDQQNLVEDDKPSEATERTTSASA

SEQ ID NO: 62039 - protein, 364 aa, Oceanobacter sp. RED65
MGFKCGIVGLPNVGKSTLFNALTKSGIGAENFPFCTIEPNSGIVPMPDPRLDKLAAIVSPEKVIPTTMEFVDIAGLVKGASKGEGLGNQFLANIRETDAIAHVVRCFEDPNVIHVENKVNPADDIDVINLELILADLESADKQLQRVSRTAKSGNKDAVADKALLEKMVAHLENDQPIRTMDLNDDEQKRIRMFHMITIKPTMYIANVAEDGFENNPHLDTVRDIANKENAVVVPVCNKIEQEISELDDPEDVAMFLEEMGQSEPGLNRVIRAGYELLGLQTYFTAGVKEVRAWTVKKGATAPQAAGVIHTDFERGFIRAETMSYDDFIEHNGESGCKAAGKLRVEGKDYIVKDGDVMHFLFNV

SEQ ID NO: 62040 - protein, 714 aa, Vibrio vulnificus YJ016
MSRTIMLIPASAGVGLTSVSMGVLRAMERKGVKVSFYKPIAQPRSGGDLPDLTTTIVGANSDMKIGEPLLMSVAENLIGNDNMDELLETVVERYNQINKDADVTLIEGLVPTRKHPFANQVNAEIAATLGAEIVLVATPGTDNPAQLKERIEVACSNFGGTKNKNISGVIINKLNAPVDEAGRTRPDLSEIFDDADSAKQNQLEVMQIFNSSPIRVLGCVPWSINLIATRAIDMAKHLKAEVINEGDINTRRIKSITFCARSLPHMIEHFKPGSLLVTSADRPDVIVAASLAAMNGVEIGAVLLTGGYDIPTEIENLCKPAFESGLPIFKAQGNTWQTSLNLQSFSLEVPADDKERIEFINDHVAGHIDGNWIESMTEGTERSRRLSPPAFRYQLTELARKAGKRIVLPEGDEPRTVKAAAICAERGIAECVLLGNPEEIKRVAAQQGVELGAGVKIIDADAIRENYVARLVELRGSKGMTEVVAREKLQDSVFLGTMMLENDEVDGLVSGAVHTTANTIVPPFQIIKTAPNASIVSSVFFMLLPDQVLVYGDCAINPDPTAEQLAEIAIQSADSAAAFGIDPRVAMISYSTGESGKGADVDKVREATKLAQEKRPDLIIDGPLQYDAAIMENVAASKAPNSPVAGKATVFVFPDLNTGNTTYKAVQRSADLVSIGPMLQGMRKPVNDLSRGALVDDIVYTIALTAIQATQDQK

SEQ ID NO: 62041 - protein, 243 aa, Triticum aestivum
  misc_feature (80)..(80): Xaa can be any naturally occurring amino acid
FNKFVQKSRLVPARNSLDIVDPRVRVMGVVGNPSGSKCGTVGIQGIAWSFGGMIFVLVYCTAGISGGHINPAVTFGLFLXARKLSLTRAVFYMVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 62042 - protein, 345 aa, Frankia sp. EAN1pec
MRATYMYGAGDVRITDVGDPVLEQPTDALVRVVLACICGSDLHPYHSLAATPAGVPMGHEFIGVVEEVGGEVSTLRAGDLVIAPFAWSDGTCEFCREGLHTSCRTGGFFAAGGVGGGQAEAIRVPQADGTLVKVPVPEDSAILPSLLTLSDVFGTGYHAAVRAGVNPRTTVTVIGDGAVGLMAVLSARRLGAEQIILMGRHKARTDLGLEFGATDVVAERGEEGVARVRELTGGDGSHAVLEAVGYRAAYDQALGVVRPGGVISRVGVPQYADAPIGFPSLFGRNITLTGGPAPVRAYIETLLPAVLDGEVEPGKVFDRTVSLEDVPAGYRAMDDRKALKVLVRP

SEQ ID NO: 62043 - protein, 310 aa, Oceanobacter sp. RED65
MVFTGNANPELARLIVERLDLPLGDAVVGQFSDGEITVEINENVRGKDVFIIQPTCVPTNDNIMEVLLMADALRRSSAGRVTAVIPYYGYARQDRRVRSARVPISAKVVADMMQAAGVDRVLTVDLHADQIQGFFNIPMDNIYGSPILLDDIEKQNYDNLMVVSPDVGGVVRARAIAKQLDEADLAIIDKRRPQANEAQVMHIIGDVTDRTCVLVDDMVDTAGTLCKAADALKQFGAKKVVAYCTHPVLSGAAIENIRGSQLDELVVTDTIPLTKDAKACKQIRQLTLSGLLAESIRRVNNEESISAMFR

SEQ ID NO: 62044 - protein, 645 aa, Porphyromonas gingivalis W83
MISVNNLTVDFGTRLLFDQVSFVINRRDRIALVGKNGAGKSTLLKLIAGMEEPTSGHIARPKGIRIGYLPQVMRLQDGHTVYEEVEQAFNDIRQIEEEIRRLSDEMAGRTDYESDDYIRLIEHYTNMSETLSLMQQGNYHAAIEQTLIGLGFGREDFHRPTADFSGGWRMRIELAKLLLQRPEVLLLDEPTNHLDIESIGWLEQFIATNAGAVILVSHDRAFIDNTTTRTIEIELGHIYDYKTNYSHYVELREERLRQQMRAYENQQKMIRDTEDFIERFRYKATKSVQVQSRIKQLEKVERVEIDERDRSAFHFRFIPAQPSGSYPLIVDDLAKAYGDHQVFSGATYTIERGEKVAFVGKNGAGKSTMVKCIMGELTDYTGKLELGHNVQLGYFAQNEAQELRGDLTVFDTIDREAVGDIRLRLNDLLGAFLFGGEASEKKVSVLSGGERARLAIIRLLLQPANFLILDEPTNHLDMRSKDVLKEAIKNFDGTVIVVSHDREFLDGLVSKVYEFADGQVNEHLGGIYDYLRTRRMQTLTELERTTTIETKTTREAIPETEAKADYRRQKEVAKQLRTLERTVATCEERIGKLESELQAIEMLLQDPKHATDANLFERYAGMKQELEKAMEDWEQASEALSEAQG

SEQ ID NO: 62045 - protein, 461 aa, Synechocystis sp. PCC 6803
MFMNPLLPPLWPMIATAVETETEIAPLVLAGVLLSLVVIYFASKLGGEVCLRLNLPPVLGELVGGVLVGVSALKLLLFPEGGLAPEDSLVIQLLMGSADLSPEAAQSVFSAQSEVISVISELGVIILLFEIGLESNLKELIRVGPQAAIVAVVGVVTPFSLGTIGLMTIFGVAAIPAIFAGAALTATSIGITAKVLAEINRLSSNEGQIIIGAAVLDDILGIIVLAVVGSLVKTGEIQISNIIYLILSATGFVVGSILIGRLLSPFYVSLVNRMKTRGQLLLVSICVAFVLSYIAQIVQLEAILGSFAAGLILAETEKREDLEEQILPLADFFVPVFFVCVGAKTDVSVLNPAVPANREGLIIAAFLILVAIVGKVVTGFTLFGKSELNKLAIGVGMIPRGEVGLVFAGVGAASGALDPATDAAIIVMVIVTTFVAPPWLRAVFEGAKKEEAPEKPVPTPD

SEQ ID NO: 62046 - protein, 704 aa, Oryza sativa
MGKSSKKSAVEVAPTSVSVSEGKSGKKGKRNAEDEIEKAVSAKKQKTVREKVVPSKEEAKKVKKQPPPKKVESSSSEEDSSESEEEVKAQPKKTVQPKKAAQPAKEESSDDSSDDSSSDDEPAKKPVARPNKAALSTNSSSSDDSSDESSSDDEPVKKPAAPLKKPVTLATNGSKKVETDSSSSDEESDEDDKKTAAPVKKPSVAAIQKKTQESDSSDSDSDSESDEDVPTKAPAVAKKKEESSESSDSESDSDSDDEAAAVKKEEESSDSSDSDSESEYDSDEPAKPTIPAKRPLTKDTKKGQSKDESEDSSDESSEESDDEPPQKKIKDSTTSGTTKPSPKATKKEISSDDESDEDDSSDESSDEDVKQKQTQAKKVQAPVAQESSSSDESSEEDSDMESDEPAKTPQKKETAVSVGSNKSATKLGQEEPKTPASNQNQATGSKTLFVGNLPYNVEQEQVKQFFQEAGEVVDIRFSTFEDGNFRGFGHVEFATAEAAKKALELAGHDLMGRPVRLDLARERGAYTPGSGRDNSSFKKPAQSSGNTIFIKGFDTSLDIHQIRNSLEEHFGSCGEITRVSIPRDYETGASKGMAYMDFADNGSLSKAYELNGSDLGGYSLYVDEARPRPDNNREGGFSGGRDFNSSGRGGRRGGRGDGSRGRGDRGRGRGFGRGDRGRGGRGTPFKQSAGTPSAGKKTTFGDDD

SEQ ID NO: 62047 - protein, 538 aa, Porphyromonas gingivalis W83
MITVNDLSVQFGKRILFQDVNLTFTPGNCYGIIGANGAGKSTMLRVISKQLDPTRGTVTLGPGERLSVLSQDHFAFDENTVMDTVLMGHSVLWAIMEEKNALYAKPDFSDEDGTRVAELEDKFAEMEGWNAESDAAMLLSGLGIKEDLHYMLMKDLSGKQKVRVLLARALYGKPDNLLLDEPTNDLDLETVSWLENYLSNFENTVLVVSHDRHFLDSVCTHTVDIDFGKVQQFSGNYSFWYESSQLALRQQQQQNKKAEEKRKELEEFIRRFSANVAKSKQTTSRKKMLEKLNIEEITPSSRRYPGILFTPGREPGNKILEVKGLTKSIEGQLLFRDLNFNVEKDDKIVFISRDPRAMTALFSIINGEMTPDEGTYEWGQTITTAYLPLDNSGYFNTDLNLVEWLSQFAKDTNEVFLKGFLGRMLFSGEEILKKASVLSGGEKMRCMISKMMMLDANTLVLDTPTNHLDLESIQAFNNTLKTYRGNVLFASHDHEFIQTVANRIIELTPNGIIDKIMDYDDYITDPIVAEMRQKLYGQ

SEQ ID NO: 62048 - protein, 321 aa, Symbiobacterium thermophilum IAM 14863
MVPYQDRKLKIFSGNANLPLARAIADHMGISLGNMNVGRFSNGEIRVDINESVRGTDCFVIQSGVHPVNENVMELLVIGDALRRASARRITAVVPHFPYARQDRKARGREPITAKLLANLITTAGFRRLLTIDLHAAQIQGFFDTPVDHLHAGPLIANYFRQKGLQNAVVVSPDTGGVPRARDLAERLGVGLAIIDKRRPEPNVAEVMNIIGDVEGKTAILVDDLIDTAGTIVKGAEALLERGATEVYAACTHPVFSGPAYERLAASPIKEIVVTDTIPVDADKMGGKLRVVSVAPLLGKAIIRIHEDLSVSKIFEEEPRL

SEQ ID NO: 62049 - protein, 330 aa, Wolinella succinogenes DSM 1740
MALKVAINGTGRIGLCACRVIGNRDDIELVALNTTAPIDTLVHLLKYDSVHRDYDAEKIDEQTIRIGKHRHVKVYSDRDPLKVPFGESGAKVVIECTGAFNSLEKSSIHLHGGIEKVVISAPADNAPTFVYGVNHESYQGESVVSNASCTTNCLAPIAKVLHEAFGIENGLMTTIHSYTNDQNILDVKHKDLRRARAAAMNMIPTSTGAAKAIGLVMPELKGKMSGFSVRVPTPDVSLVDLSVNLSCAITKESINAAMREAALGAMKGLLLVDEEKRVSSDFIGSPYSAIFVPDCTTVVGEKSAKVLAWYDNEMGYSHRLVDMALWVGTH

SEQ ID NO: 62050 - protein, 420 aa, Wolinella succinogenes DSM 1740
MLEFQHFFTASFSDEEREALLGRVKKEREEGVSAYYDLPFQRRALEDSDRYMKANAALLERLETILVVGVGGSSLGLKAIDSLLSHLPERRAIDLHFLEHTDPIAIEKSLRGIQTKSSLFIVISKSGSTIETSSLTKYVLKRFELLKEENRSHLLVITDEGSPLEQWSKQEDVACVTIHPKVGGRFSVLSAVGILPLSLLGYPANEILEGAKGMAVEFFAGRATQILDKALFYAKERNRLSINVLFSYASAFKEFNAWYVQLWGESLGKLNAQGNRTGMTPAALIGSIDQHSFLQLIVQGPLDKSVTFLSIKEPLKEPIEIPNWSMEFLEGTDFVNGSSFKDLLRHQREATMETVIEEGVPTDLILIDRLEGRSVGALLYYYELLTSCVGTLLEINTYDQPGVEFGKRRLREKFHSKDTL

SEQ ID NO: 62051 - protein, 440 aa, Triticum aestivum
MERYKVIREIGDGTCGNVFRAYNIETNEIVAVKKMKRKFYHWEECISLREVKALQKLNHPNIVQLKEVTMENHELFFIFEHMDCNLYDVISERSAPFSEEEIRTFMLQILQGLVYMHNNGYFHRDLKPENLLVTNGIVKIADFGLAREVCSSPPYTDYVSTRWYRAPEVLLQASAYTPSIDMWAIGAILAELFTLSPLFPGETETDQVYKICAVLGTPDYSLWPEGMNLPRSSSFQFFQIPPRNLWELIPNASLEALDLIKQLCSWDPRRRPTAEQALQHPFFNVRKWVPRPLHDASYSKRNEPRATPRLELDLWCFGKESDDLDLTLSLKPSSVSDLGKHVPEHREEENLLYPGYGNPPVQPGLWPLMASSHRPLGEAPAMPSWQQAYMVDSQAATLPAAGGGGGGFPGSSPFGLFPLQPNLMEKRSLAPAPIRQVNFF

SEQ ID NO: 62052 - protein, 338 aa, Lactobacillus sakei subsp. sakei 23K
MTTKVGINGFGRIGRLALRRIYATSSDVLEVVAINDLTSPDMLAHLLKYDTAHGQFDHEVSATENSIVIDGKNIPVYAESDARNIPWVKNDGVDLVLESTGFYTSEEKAQAHLDAGAKKVLISAPAGAVKTVVYGVNDDTITADDNIISAASCTTNCLAPLAKAVNDAFGIKAGTMTTIHAYTATQKLQDGPDRGGNVRAARAAAANIIPHSTGAAKALGLVVPALKGKLDGHAQRVPVITGSLTELVATLDKEVTADEINAAVKKVTEGNESFGYNADQIVSSDIIGTEFGSVFDPTQTQIVGGGAGQVVKVVAWYDNESGFTAQMIRTLEKFASLI

SEQ ID NO: 62053 - protein, 1008 aa, Magnaporthe grisea 70-15
MSYDGGYPQQRPYNGPAAPRPPPQRQYPPGPNGPPGRQFAGPPAQNYNSPPQAYDQQYHDGYGGYDDYGGRGGGYGGPEYDQQYDDMNYQRGPPQNYPPHDQYGPGPGPGPMGPGPGRGRPMQGPGGRGGMPPRGPMPPRGGGPGPGPGRGFHNGPVPGRGGGPNPLQRSATADPFAGRGGARGPMLSPQEMGFGGAFPAFPGQRKRTEIDDENKILEKMGGMAIQDRTGLGDAPPPPANRGGPMGPPGPNDGPRGPPQRGFSQDRGYPGQRGPPGSDEGYGAPGDFRDEFGPPQRTMTMPNDPRAGPGPRGPPPGRAETAPYPGPGPGPGPGPGPAGRGMGMGLPARPSTAQGMRGPPRGYPANGMPPPQAPLREDGQYQRGFDDPNDGYGQQAQRPVSFDDFYDYYDNPPQQQQQQQPRNDGIAEIPDFNRSANHLRNGSMDQHMRQQPEGPQERGGLGRQPDLNRTKSQPDLRQPQAAVFEMVGDVPPIPNQYKPYPAGQPNGPGPGPGPDGYGQGYDQGYDQGYDQGYDQRMSGGQGLPMGPAPVRAGSGASTQSAPLPGQNADNLPSHPAPIRPGLMHNSVASQMMNKPPPVRHYNNTPPMNSSMSAPPVSQISAPMAPPRPEPQASVTVEELEHLRAVIKTDPNDQNSALRLAKRLVEAMDVLVPNIPDPRGRQKSRERYANDAHKILKKLSHAQNAEAMFFMADCLGRGVFGPEPDNKEAFTLYQSSAKLGNAAAAYRTAVCCEIGHEEGGGTRKDPLKAIQWYKRAAMLGDTPAMYKVGMILLKGLLGQQKNPREAVGWLKRAAERSDSENPHALHELGLLYESAQPNDAIVRDEGYAFSLFSQAADLGYKFSQFRLGAAYEYGLMGCPIDPRSSIMWYSKAATQEEHQSELALSGWYLTGSEGVLAQSDTEAYLWARKAALAGLAKAEYAMGYFTEVGIGVPANLEDAKRWYWRAAAQDFPKARERLEDLKRAGKNGPMRQRERISRSTPKQEGECVVM

SEQ ID NO: 62054 - protein, 534 aa, Zea mays
MQAAIDQSPHLRFRAGMDDKSCYVATGLSLAAILLVLHRLVVRAGGKGNAAARRLPPSPPAVPFLGHLHLLASECPLHSSLARLAARHGPVLSLRLGSRAAVVVSSPECAEACFTEHDVAFANRPRLTSQALASFGGAALAVSSYGPYWRNLRRVAAVRLLSTHRVACMCPVISAEVRAMLRRVGRAAEAAGRVQLKASLFELSLSVLMETIAQTKTSRADDADDAVSPEAHEFRRIVDEILPYLGATNLWDYLPLLRRFDVLGVRNKIRDVVGRRDAFLQRLIDAERRRLDGDGDGDDGEKKSMIAVMLSLQKSEPDVYTDTMIMALCGNLFTAGTETTSSTIEWAMSLLLNHPEALKKAEAEIEAAVGASRLITMDDVPGLGYLQCVINETLRLYPVAPLLLPHESAADCTVGGYDVPRGTLLFVNAYAIHRDPAAWEEPDEFRPERFRDGKAEGRLMLPFGMGRRRCPGETLALRTAGLVLATLIQCFHWDRIDDAEIDMTESGGLTMPRAVPLEATCKPREAMRHVLQQL

SEQ ID NO: 62055 - protein, 410 aa, Symbiobacterium thermophilum IAM 14863
MTVTFADIEKARILLSGHIKRTPMLQSPGITEHLGLPVYLKAENLQRAGSFKVRGALNKIHSLTEEEKARGVIAASAGNHAQGVALAASSLGIRSVICMPEGAPIAKLEATQGYGAQVVLHGETYDDAYQKARALQAEHGYTFIHGFDDPYTIAGQGTVGLEIVEDLPDIATVVVPIGGGGLMAGVALAVKSLKPGVRVVGVQAAGAPAVFLSRQQGKLVATDSVHTIADGIAIKKPGALCWEIIREHVDDIVLVDEEEIAQSILFLLERAKVIVEGAGAVGMAALLGDKIPDLQGPVCVVLSGGNIDVNIISRIIERGLVKAGRYIRISTFVPDRPGGLQQLLATVAQAGANVIDVRHERWLNKVTIGEVEITLALETRNARHVDEILATLKAKGYHVWIIPPYRPNDW

SEQ ID NO: 62056 - protein, 401 aa, Wolinella succinogenes DSM 1740
MVAGINLMQETKSIRDVEIEGKRVLIRVDFNVPMDSDFNISDDTRIREAIPTINHCIDNGAKSIVLVSHLGRPRGKSSEFSLKHILKRLERLLNRSVIFVESLEGVSSVMATLPQKSVILLENIRFLEGEEKNDEKLSKNLASLCDIYINDAFGASHRKHASTYGVAKFAPVKVAGLLLKKEIDSFAKALASPLKPVLLIVGGSKVSSKITLLSNILDVVDKIVIGGAMSNTFLKSLGYDMQRSLVEDPLVPEAAKILGLAKQKGVKIYLPVDVVCTDDIKNPKEIKITPAQDVPENFLAADIGPASVKLFGEVIRDCETIIWNGPMGVYEVQNFSRGTFQLAHVVADTYAYSVIGGGDTADAIDRAGEKDNMSFTSTGGGASLELLEGKILPAFEVLERK

SEQ ID NO: 62057 - protein, 212 aa, Chlamydomonas reinhardtii
MSNCSASGKYDKAKNRPKALQFTEEEEELERTSKQRHRKVQAKQTSADTMSKKQKQQPQAPAALPKLPKLVAKHGIELRGLYPEDAPTIYALHNALSASEYKEGQGFGPHYDEEDACPATARASCYTLLLYLNDVAAGGETVFYRSRGREVAAVTPEQGLVVVHAQGPDCLLHEGRPAQAEQDAAVSSLASGPQEGRRGAAGRLVKVCTLQP

SEQ ID NO: 62058 - protein, 154 aa, Gossypium hirsutum
AAITDWLDGYIARRMRLCSAFGALLDPVADKLMVAATLVLLCSRPLNIAEFGQVPWLLNVPSIAIIGREITMSAVREWAASQNGKLLAAVAVNKLGKWKTATQMAALTILLATRDSSLGETGILVASGVIFLYLSAGLSVMSLVVYMEKIRKVL

SEQ ID NO: 62059 - protein, 331 aa, Gibberella zeae PH-1
MATQRGRPWARIISLTVLVLTFAITVDASTGDRLPEFKDCLKVCNAENCAPNKPQTPIPVLHRLLLWNCASECDYACQHIVTGQRMATGLSVEQFYGKWPFYRFLGMQEPFSVLFSLGNLWAHWYGLKTMDQARIPKSYSMRIFYDWLAYIGIASWTFSSIFHTRDFHVTEELDYFAAGASVLYGLYYTVVRVFRLDKRTPRRRTTLRLWSLLCASLFLSHVSYLKFVRWDYTYNMAANVAAGIVQHVLWSWFSFNRYRESRRIWAAWPGFVVAWIIFAMSMELFDFPPWLGCIDAHSLWHLMTIGPTILWYNFLVKDAQDDMARSQRLKL

SEQ ID NO: 62060 - protein, 124 aa, Triticum aestivum
GGANVVAPGYTKGDGLGAEIVGTFILVYTVFSATDAKRNARDSHVPILAPLPIGFAVFLVHLATIPITGTGINPARSLGAAVIYNQHHAWADHWIFWVGPFIGAALAAIYHQVIIRAIPFKSRS

SEQ ID NO: 62061 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSAATVYGDQPKIPYVESFPTGTPQSPFGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 62062 - protein, 420 aa, Oceanobacter sp. RED65
MALITLGINHKTAPVALREKVAFSPDHLPQQLRQAGSEVGVEEIAVLSTCNRTEVYCAGEASAEVLLQWLQQVHQIPLEQLADCHYALEGEAAVQHLMRVASGLDSLILGEPQILGQMKSAYAVAQEAGTVGPELGRLFRQTFTIAKQVRTQTAIGENPVSVAYAAVNLAQRIFSQLSQSKALLIGAGETIDLVARHLMDAGVKEITVANRTLERAEALAQQFNAKAILLSDIPDHLPNADIVISSTAAPLPILGKGTVERALKKRKHAPMFMVDIAVPRDIEEEVDELDDVYLYTVDDLKDIIEENVRQRQNAAKDAEEIIEVGSADFMRQLRTLDAVSTLKAFRTKAERIRDTEVEKALKRIRNQEDAEKVLHTLANTLTNKLIHQPTVQMREASASGRKQVMDWVQELYQLNDDDLD

SEQ ID NO: 62063 - protein, 338 aa, Escherichia coli
MRVLVTGGSGYIGSHTCVQLLQNGHDVIILDNLCNSKRSVLPVIERLGGKHPTFVEGDIRNEALMTEILHDHAIDTVIHFAGLKAVGESVQKPLEYYDNNVNGTLRLISAMRAANVKNFIFSSAATVYGDNPKIPYVESFPTGTPQSPFGKSKLMVEQILTDLQKAQPDWSIALLRYFNPVGAHPSGDMGEDPQGIPNNLMPYIAQVAVGRRDSLAIFGNDYPTEDGTGVRDYIHVMDLADGHVVAMEKLANKPGVHIYNLGAGVGNSVLDVVNAFSKACGKPVNYHFAPRREGDLPAYWADASKADRELNWRVTRTLDEMAQDTWHWQSRHPQGYPD

SEQ ID NO: 62064 - protein, 472 aa, Burkholderia pseudomallei K96243
MSYRPSNASAWIQPAAPAHRTSAEYRALDAAHHLHPFSDMGSLNRAGSRVIVKAEGVHLWDSDGNRIIDGMAGLWCVNVGYGRDELIEAGSRQLRELPFYNTFFKTTHPPVIELSALLAQIAPPAFNRFFYCNSGSEGNDTVLRIAHQYWRAQNRPQKKFVISRRNGYHGSTIAGATLGGMSYMHEQMPSKVEHIVHIDQPYYFGEAREGQTPEAFGLERARQLEAKILELGAQNVAAFIGEPFQGAGGVIFPPSTYWPEIERICRQYDVLLVADEVIGGFGRTGEWFAHQHFGFAPDLMTLAKGLTSGYVPMGAVALSDRIADALIAHGEFNHGMTYSGHPVAAAVAIANLKVLRDERIVERVKTDTGPYFQQRLRETFANHPIVGDIAGAGLVAGIQLAREPRTRKRFENGGEVGTICRDYCFNGNLIMRATGDRMLLSPPLVISKPQIDEIVEKAKRAIDATAQQLGLS

SEQ ID NO: 62065 - protein, 461 aa, Methanosarcina acetivorans C2A
MDLNQNTGGSLIKIAMLSPIAWSTPPKKYGPWEYMVSLLTEGLVKRGIEVTLFATADSHTAGELHAVCPRPYEEDKDMVRKVYEGLHISEVFERANEFDIIHNHFDYLPLTYSGLVDTPVVTTIHGFSSRKILPVYKKYNNSTFYVSISDAYRCNELDYIATVRHGIDIETFPFNDRPEDYLLFISRIHREKGAKEAIEVAKKAGRKLRMAGFIADPEYFKNEVEPHIDNDQIVYEGHVSQERKKELLSNAYALLHMINYEEAFGLGVVEALACGTPIIAINRGAMPELIMDGETGFLVNNVTEAAEAVEKLNSISRRRCRESVEKRFSVDRMVEDYIRVYETILEKRKREAKRPWGFYEILAQKPGYKVKRITVLPQEQISLQRHAHRNEHWYVVSGEGLVTKNSDYLKVLVGDTVDIPVNEIHRIKNTGIQNLVFIEVAQGDYLGEDDIERLEDKYGRT

SEQ ID NO: 62066 - protein, 267 aa, Zea mays
MSSTAARVVHPAAAAPPPPRPRRLAPARCAAGSATDTATAGPTRVTTVSNRGDSLAICRVLNGMWQTSGGWGRIDRDAAVDAMLAHADAGLSTFDMADHYGPAEDLYGMFINRIRRERPPEFLEEVKGLTKWVPPPVKMTRSYVEDNINRSRKRMDVTALDMLQFHWWEYSNPGYLDALKHITDLKEEGKIKTVALTNFDTDRLQIILENGIPVVSNQVQHSIVDMRPQQRMAELCQLTGVRLITYGTVMGGLLSEKFLDTNVSIPF

SEQ ID NO: 62067 - protein, 124 aa, Arabidopsis thaliana
  misc_feature (23)..(23): Xaa can be any naturally occurring amino acid
  misc_feature (40)..(40): Xaa can be any naturally occurring amino acid
MEQTFIMIKPDGVREELIGEVIXKVEKKGFTLKGLKLISXVERSLAEKHYEDLIFTVFLQWNVDYIVSGPGVDYDLGTERMLVLTGTTIIGATTPVAPDPGTISADFAIDIGGRDHGTDWSSVP

SEQ ID NO: 62068 - protein, 444 aa, Burkholderia pseudomallei K96243
MQDIDEFLKKHRITEIEAIIPDMAGIARGKIIPRSKFETGESMRLPQAVMIQTVTGDYPEDGSLTGVTDPDMVCLPDASTIRLIPWAIDPTAQVIHDCVHFDGTPVEISPRRVLRRVLELYKAKGWKPVIAPELEFYLVDMNKDPDLPLAPPIGRTGRPETGRQSYSIEAVNEFDPLFEDIYEYCEVQDLEVDTLIHEVGAAQMEINFLHGDPLNLADRVFLFKRTVREAALRHHMYATFMSKPMENEPGSAMHVHQSIVDEETGRNLFTGDDGGPTDMFYAYIAGLQKYTPALMPIFAPYINSYRRLSRFMAAPINVQWGYDNRTVGFRVPHSSPVSRRVENRIPGVDCNPYLAIAGTLAAGYLGMTRRLEPTEPLASDGYSLPYQLPRNLEEGLTLMSACEPLAEILGEKFVKAYLALKETEYEAFFRVISSWERKHLLLHV

SEQ ID NO: 62069 - protein, 418 aa, Triticum aestivum
  misc_feature (136)..(136): Xaa can be any naturally occurring amino acid
  misc_feature (139)..(139): Xaa can be any naturally occurring amino acid
  misc_feature (214)..(214): Xaa can be any naturally occurring amino acid
  misc_feature (226)..(226): Xaa can be any naturally occurring amino acid
  misc_feature (265)..(265): Xaa can be any naturally occurring amino acid
  misc_feature (382)..(382): Xaa can be any naturally occurring amino acid
  misc_feature (410)..(410): Xaa can be any naturally occurring amino acid
HYRTSLYKKAGWYRSGIPGISSTHASAGRNHLFVPGPVNIPDQVIRAMSRQNEDYRSPAIPALTKTLLEDVKKIFKTTTGTPFLFPTTGTGAWESALTNTLSPGDRIVSFSLGQFSLLWIDQQQRLGFSVDVVESXWGXYGADLGALESKLRTDSQHTIKAICIVHNETATGVTNDLHAVRKLLDAYRHPALLLVDGVSSICALDFRMDEWGVXVPLTGSQKALSXLPTGLGLLCRQPQGAGRRPRTAKSGARLLSTGRDYLRFXTRWGTYWPYSPSIQLLYGLRAGLDNVIKRHTRLGTATRLAVAAWGLKNCTAKEENFSDTVTAVVVPPYIDSSEIVKHAWKRYNLSLGLGLNKVAGKVFRIGHLGHLNELQLLGCLSXVEMVLKDIGYPVKLGSGVAAAAAYLSNXTPLIPSRI

SEQ ID NO: 62070 - protein, 538 aa, Bradyrhizobium japonicum USDA 110
MHIVRIGAEATELRPAEEIGAKAANLARMAALGLPVPPAFVLPVKLCADIIAGHAHAERHLSDGLKEGIAFLESATGRRFGDRRLPLLVSVRSGAARSMPGMLDTVLNVGCTSDAVHGLIRATGRPRLAWDCRRRFLESFGETVLGLDAAAFAARISELVEAEGAENDRALDSEALERLAGDEQALVEDHADGWLEDAVAQLEAAAQAVYRSWTSERAKTYRKLQQLEGLQGTAVTVQAMVFGNGGLASGAGVAFSRDPSTGAPRPMIDLVLDAQGEDVVSGRRSPDAEDAIVRALPRTEAELGDILKRLEREFCDVQDVEFTVEDGRLWILQTRAAKRTPRAAVRIAIDLVHEGLITQDEALERIAGIDLASLAATALVCAGEPAAIGIGASGGIGVGRAVFDAESAQRLSATGDPVILLRPDTSTADVAGFAVAAGIVTAVGARTSHAALVARQMGKPCVVGCHALKIDPVSRQAQLADATLSEGDWITIEGDAGQLYLGRCRTVETRPDAELAEIAKWQSQAGDLDPPARAAAAQ

SEQ ID NO: 62071 - protein, 194 aa, Oceanobacter sp. RED65
MLLMIDNYDSFTYNLVQYFGELGVEVKVARNDEISIEEIEQLKPDHLVVSPGPCTPNEAGISVAAIKHFAGKLPILGVCLGHQSIAQAFGGNIVRAGQVMHGKTSKVFHTDSSVFKGLDNPFTATRYHSLVIEKDSIPECLEITAWTQNEDGSVEEIMGVQHKTLAIHGVQFHPESILTQHGHDLLNNFLKTTV

SEQ ID NO: 62072 - protein, 85 aa, Triticum aestivum
  misc_feature (7)..(7): Xaa can be any naturally occurring amino acid
  misc_feature (26)..(26): Xaa can be any naturally occurring amino acid
LVFMLAXAALYMPFMMITVLNLGLYXKVVAGLSVRSGDRFAYYLYRRFLDMFWVVVMDIGNALIEEKLAVMNAVTVIYNDIFSHC

SEQ ID NO: 62073 - protein, 542 aa, Magnetospirillum magnetotacticum MS-1
MRVSKDLSSSVNSLRGYKSALAAATGTALLVLSACGDPARPVGQIGHITGFGGMVAVDEPRAAILGRDVLSAGGTAADAAAAIYFTLAVTYPSTASLGGGGTCIVHDSGKKKTEVIDFPAIASNMSGPAPSAVPANPRGFYALHAKYGRLRWESLLVEPERLAREGAPVSRALANDLARSLPIIGRDPVARAVFMRPDGSVPREGDLIAQPQLAAMISTLRHQTGNFYTGPQARDLIKGVQAAGGTLSLEDLRDIRPVWRDAITVKTDFETAAFSPPPSVGSAMTAQLVAALWPRWSSADEAERPHLLAETSARAFAERARWMRPTGWTDEAPDSLVSDARINAMMAGYAADRHQPVSGVTSPPTESQSGTGFAVLDSSGLGVACAVTSHGLFGNGRMAPGTGIMLSGVPGPNGPPSTAVMVTYNNHNAAVHFIGAASGGGTAAMGLTQSFLAAVKDNKPLSEALAQPRLVQAGKPDAVFVETGAITLDPASLASRGHQISATPMPSRVEAIYCPLGYKAEEGCDMATDPRGFGLAAVAGKK

SEQ ID NO: 62074 - protein, 384 aa, Magnetospirillum magnetotacticum MS-1
MSFKAAERGAIAPFIVMDVMRAAAAREAQGADIIHLEVGQPSGQAPSGVREAAARAVGAEPLGYTLALGRDSLREAIARHYRQAYGRSVAPERICVTTGSSAGFLLAFLAAFAPGDRVAVAAPGYPAYRNILQALGVDCVLVPVGPDSRWQITAQVLARIEGKLDGVVVASPSNPTGSMLSAAEVAELAAWCESNGVRLISDEIYHGITYGRAAATVAGMATSPHAVVINSFSKYYAMTGWRLGWMVLPEDLARSVECLAQNLYISPPTLSQVAAEAVFDCLDELEARVAAYRANRDILLNALPEAGFDRLAPSDGAFYLYADVSERTEDSREFCARMLAETGVACTPGVDFDPLEGRRTLRFSYAGSAEHMAEAAKRLKAWKT

SEQ ID NO: 62075 - protein, 404 aa, Lactobacillus sakei subsp. sakei 23K
MAKQTVADLKDIKGKKVLVRVDFNVPIKGGVIGDDNRIVAALPTIQYIIDNGGKAILLSHLGRIKSDEDKKELTLKPVAARLGELLNKDVAFVASNEGQELEDAINAMTDGQVLVMENTRFQDIDNDFGKRESKNDPKLGEYWASLGDMFVNDAFGTAHRAHASNVGIATAMKANNKPAVAGYLLEKEIKFLGEAVDAPERPFVAILGGAKVSDKIGVIEHLLAKADKVIVGGGMTYTFYAAKGLSIGNSLVEEDKIELAKELIEKAGDKLVLPVDNVVADAFSNDAKTETVEGNIPDGYMALDIGPKAIADFENVLKDAKTVVWNGPMGVFEMDNFAKGTLAIGEFLGNLSGATTIVGGGDSTAAVKKLGVGDKLTHISTGGGASLEYLEGKTLPGIAAISDK

SEQ ID NO: 62076 - protein, 361 aa, Porphyromonas gingivalis W83
MAVKDNYCVIMGGGIGSRFWPFSRESHPKQFLDFFGTGRSLLQMTYDRFARFIPRENILVVTNELYVDKVREQLPEIEPDQILREPTRRNTAPCIAYASYHIYARNPKANIIVAPSDHLILREDEFVRAASEALEFVADHEHLVTLGIRPSRPETGYGYIQMAEEKTGDFIRVKTFTEKPNAEMASIFLASGEFLWNSGMFVWNVESILAAFRKHLPEVTSSLENGLAHFNTPEERRFIDQAFPYCPSISIDFGVMEKADNVLVMPVDFGWADLGTWGSLYELAQKDDAGNASLKTRTLFYEAERNIVTTDNPQKLVVVQGINDCIVAESGNVLLICRAEEEQRIKHFVADAALKYDKEYN

SEQ ID NO: 62077 - protein, 547 aa, Gibberella zeae PH-1
MSSSILNNRSARSTPAGANPAFNPPAEASSSSTQSGVPYIRENSPEAESIPSNPAMTPIITHGDSLASPGGRNSEADTVVPLQPAVSQDAIRSRPGSRTGNFVTPKAARFSQDGAEPIMQYSSGSVKSARRRTREREDYDFDQAADYAPMSEYERYYRNEGRNDRDRYTRRGPYPPPTFMNRRRAPPLDSDEEFYSSDDPRIPPNDRRRMMDEEAGYPGRPHAFRRTSTLNGFNITTGKLQWNELSRQEKSEIMRLPLTQWMNSNFKNHFVAGVGEFIGTTMFLFFAFAGTEVANIQADTTNRTTTGESTGSLNVSKLLYISIIFGFSLMVNVWVFFRISGGLFNPAVTMAMLMVKAISVTRAIVLFLAQILGSMLASVVVRYLFPETFNVRTTLGGGASLVQGVFIEALLTAELVFTIFMLAKEKHRATFIAPVGIGLALFIAEMVGVQFTGGSLNPARSFGPCVITGSFDTEHWIYWVGPAIGSLIAVCFYWFIKTLEYEMANPGADGDDLNDPTKNPEKRAEIQASKPVPTAAFGSGKTASILS

SEQ ID NO: 62078 - protein, 251 aa, Lactobacillus sakei subsp. sakei 23K
MRKPIIAGNWKMNMNPTQTTEFVNAIKANLPKFDQTESVIGAPAVDLPALLEAAKGTDLKVAAENCYFEEAGAFTGETSPKTLNEMGVDYVIIGHSERRDYFHETDEDINKKAHAIFKNNMTPIFCCGESLETREAGKAEEWVSNQVTEGLKGLSADQVSSMVIAYEPIWAIGTGKTASADQAQEICAVVRQTVAKLYDQTVADKVRIQYGGSVKPANVKEIMGKEDIDGGLVGGASMEPASFLDLVHFND

SEQ ID NO: 62079 - protein, 123 aa, Citrus x paradisi
MAEEGQVISCHTVESWNEQLQKGIAAKKLIVVDFTASWCPPCKLMSPILSELAKKLPAVIFLKVDVDELQSVAEEWAVEAMPTFVLTKDGKVLERIVGAKKDELQLAVEKHATTVENATTANA

SEQ ID NO: 62080 - protein, 431 aa, Lactobacillus sakei subsp. sakei 23K
MSIITDILGREVLDSRGNPTVEVEVYTEDGGFGRAIVPSGASTGEHEAVELRDGDKSRFGGKGVLKAVENVNGPLAKEIVGFDTTDQRGIDAAMIKLDGTENKGKLGANAILGVSLAAARAAADELGLPLYEYLGGPNAHVLPTPMMNVINGGAHSDNKVDFQEFMIMPVGAKSVREAIRMGSETFQALKSLLSADGKVTSVGDEGGFAPDFANNEEPLQYLIKAIEKAGYKAGEDISIAIDVASSELWNNEDKTYKLRWSTGEEFTTPEFVKYLEGLVAKYPIISIEDPIDENNWEDWASITKELGEKVQLVGDDFFVTNTDYLRKGIKMGAANSILVKVNQIGTLTESLEAIEMAKEAGYTAVVSHRSGETEDTTIADLVVATNAGQIKTGSMSRTDRLAKYNQLMRIEEQLGDTASYKGINSFYNIKK

SEQ ID NO: 62081 - protein, 1388 aa, Arabidopsis thaliana
MPQTDGVEFASRNNLENGDGDQVRSQWVAIERSPTCKRITTALFCKRDEQGKRSQRRVMDVSKLEDLDRRLFIDELIRHVEDDNRVLLQKIRTRTDEVGIDLPKIEVRFSDLFVEAECEVVHGKPIPTLWNAIASKLSRFTFSKQEDKISILKGVSGIIRPKRMTLLLGPPGCGKTTLLLALSGRLDPSLKTRGEVSYNGHLFSEFVPEKTSSYVSQNDLHIPELSVRETLDFSGCFQGAGSRLEMMKEISRREKLKGIVPDPDIDAYMKAASIEGSKTNLQTDYILKILGLTICADTRVGDASRPGISGGQKRRLTTGEMIVGPIKTLFMDEISNGLDSSTTFQILSCLQQFARLSEGTILVSLLQPAPETFELFDDLILMGEGKIIYHGPRDFICSFFEDCGFKCPQRKSVAEFLQEVISRKDQEQYWCHRDKPYCYVSIDSFIEKFKKSDLGLQLQDELSKTYDKSQTQKDGLCIRKYSLSNWDMFKACSRREFLLMKRNSFVYVFKSGLLIFIGSIAMTVYLRTGSTRDSLHANYLMGSLFFSLIKLLADGLPELTLTVSRIAVFCKQKELYFYPAWAYAIPSAILKIPISFLESFLWTMLTYYVIGYSPEAGRFIRQVLILFALHLSCISMFRAIGAVFRDFDVATTIGSISIVLLSVFGGFIVRKPSMPSWLEWGFWLSPLSYAEIGLTSNEFFAPMWRKMTSENRTLGEQVLDARGLNFGNQSYWNAFGALIGFTLFFNTVFALALTFLKTSQRSRVIVSHDKNTQSSEKDSKIASHSKNALPFEPLTFTFQDVQYFIETPQGKKLQLLSDVTGAFKPGVLTALMGVSGAGKTTLLDVLSGRKTRGDIKGQIEVGGYVKVQDTFSRVSGYCEQFDIHSPNLTVQESLKYSAWLRLPCNISSETKSAIVNEVLETIELEEIKDSLVGVPGISGVTAEQRKRLTIAVELVSNPSIIFMDEPTTGLDARAAAIVMRAVKNIAETGRTVVCTIHQPSIDIFEAFDELILMKNGGKIIYYGPLGQHSSKVIEYFMSIPGVPKLKENSNPATWILDITSKSSEDKLGVDLAHIYEESTLFKENKMVIEQTRCTSLGSERLILSSRYAQTSWEQFKACLWKQHLSYWRNPSYNLTRIIFMCFTCMLCGILFLQKAKEINNQQDLFNVFGSMFTVVLFSGINNCSTVIFCVATERNVFYRERFSRMYNPWAYSLAQVLVEIPYSLFQSIIYVIIVYPMVGYHWSVYKVFWSFYSIFCSLLIFNYFGMLLVVVTPNVHIAFTLRSSFYAIVNLFAGYVMPKPNIPRWWIWMYYLSPTSWVLNGLLTSQYGDMEKEILAFGEKKKVSAFLEDYFGYRYDSLALVAVVLIAFPILLASLFAFFIGKLNFQKK

SEQ ID NO: 62082 - protein, 460 aa, Bacillus licheniformis
MHTLEKMEQTNVQMARDYVTKAYETVRQRNLHESEFLQAVKEIFDSLVPVLARHPKYIEHRILERIAEPERMITFRVPWVDDEGNIQVNRGYRVQFNSAIGPYKGGIRFHPSVNASIIKFLGFEQIFKNSLTGQPIGGGKGGADFDPKGKSDREIMSFTQSFMNELYRHIGPDTDIPAGDIGVGAREVGFMFGQYKKIRGRYDAGVLTGKGLEYGGSLTRKEATGYGLVYFVEEMLKDQGLRFENSTVVVSGSGNVALYAMEKAAQFGGKVVACSDSDGYVYDEKGISLETVKRLKESGNGRIREYVSEHPEAHYFEGCSGIWSIPCDIALPCATQNEIDEEAAGVLISNGVKAVGEGANMPSEEGAVKRFLDAGVLFGPAKAANAGGVAVSALEMAQNSARLHWTAEETDEKLRMIMTDIYKRSVEAASEYGRPGNLLDGCNIAGFIKVADAMIAQGVV

SEQ ID NO: 62083 - protein, 634 aa, Porphyromonas gingivalis W83
MMEVRPTTLIDHINSPADLRALKPEQLPQVCRELRRYILEVLSVTPGHLGSSLGAVDFTVALHYVFDTPYDRIVWDVGHQAYSHKILTGRREDFRHLRQWGGISGFPSPKESEYDTFPAGHASNSISAALGMAVASAAKDEKRKVIAVIGDGSMTGGMAFEGLNNASSFPNNLLIILNDNNMSIDRNVGGLNRYMVDILTSKTYNTIRYDLYKGLRKINLISETNRKNLLRFNNSFKALLARESNLFEGFSIRYFGPVDGNNVLRLVEVLNQIKDMAGPKILHLRTIKGKGYSPAEKQATIWHAPGEFDIKSGERKKGENKPEPPKFQDVFGHTLVELADRDERVVGVTPAMPTGCSMTFLMKKYPNRAYDVGIAEGHAVTFSAGLAKEGLIPFCNIYSSFIQRGYDQVIHDVALSGSHVVICLDRAGLVGEDGATHHGVFDMAFLRCVPDIVVASPLNEHELRNLMLTAYKGYDGPMVIRYPRGKGVLTDWRNTPRLVEIARGRCLTEGEAIAFLSIGPIGNMVQKVVERLAEKGVSAAHYDMVFLKPLDEEMLHGIAKKFDTIISVEDGCIQGGFGSAVMEFMADHDYHPRIRRVGVPDRFIGQGSVPEQYADCGMDADSLLHLTEELLLHP

SEQ ID NO: 62084 - protein, 515 aa, Wolinella succinogenes DSM 1740
MIIGYVTTGTLIVYAFGLASVAGSSTLSHIAEFGIVFLMFMIGLEFSFDKIKAMKQEVLLFGTLQILLSWVIFYLVAHLFFGIESKVALVVSAAFSLSSTAIVLKSFNETRETHTGYGRNAIGILIMQDIAVIPILLLISLLANHEARLEELLLHTFLSAVLVLFILFVPGKKVATMILKLAADARMDEIFVGTILFIVLGASALAGYFGFSYSLGAFIAGMIIAGTKYKYQAEADLSHFRDLLLGLFFITVGMQVDLEFLRNHLFRILWVLLAVMGLKALIIYIIIRFFRSAKVAFKTALSLAQVGEFSFAIFALSQSNGLLDKETHQLLVLTVIFSMILTPFLLKNLRAISAVFVREREKSVPAFSGTIGLHNHIVVCGYGTFGKEVVTYLKRYDINYIAIDYNLAQVEEGIRAGDNVQFGNIAQKAILEKLNLEECVAVVVAVDDTRKIRVICESILQKAPHCHIIAKVTTKAEEEELGELDIYRVVNEKHEIARLLGQAAISCEYERLKGR

SEQ ID NO: 62085 - protein, 230 aa, Physcomitrella patens subsp. patens
MEEQVLAEQEALLAECKLYKGEKEPETKEVKTEDEAAVVDGLPVASTVLGAPVSRSDWSTGLLCCFGNGGEHFTSDLQVCVLGTFAPCVLYGSNMERLYPGEEGAFLYHCMMYTCLSLGGSLLVDVNLAPFMSVGSRMDLRRKYNLPVIFVLNLVVLILQSAGGCCFGGTCDQESGVGCATVCDVLTHFLCHNCALCQEGRELRRRTLSPSYQPYMPMAPPVVQSMTPQM

SEQ ID NO: 62086 - protein, 390 aa, Chlamydomonas reinhardtii
ELDLETPLPGFDSISSALADLAAGKVVVVIDDEDRENEGDLIMNADKVTTETMAFFVEYTSGVVCISMEGQDLDRLKLPLMINSAENEEAMYTAFTVTVDLRDDITTGISASDRAKTIRRLADPSATWTDFRRPGHIFPLRYRPGGVIVRPGHTEAAVDLARLSGSFPAGVLCEIVNKEDGSMSRTPQLLEFAKRHGLKCITIADLIRYRLRNEAIVTPAGEPTPLTAASGARLTAQAFRNAVDGTEHVAFVHGAVADSASDVLLHVHHERTVADLLDCAAPGTSAGGAADCSLPAANASSLDGALRSVAAAGAGVVVYLRGQSARGLPPSAELAALGSGGAGAGALYSCDLKDAAVVAQMLRQLGVRSVSLAGGEGAMATALRSCGLAV

SEQ ID NO: 62087 - protein, 491 aa, Photobacterium profundum SS9
MGNKDKFSIFSFTGKMKILHLSWFAFFITFMVWFNLAPFLQSVKESLGLTTAEIKTLLILNVAFTIPARVVIGMLTDKYGPRIVYSALLAICSIPCFAFALSETFIQAAISRFALGFIGAGFVVGIRLVSEWFPHNELGTAEGIYGGWGNFGSAAAAFTLPTVAVMLGGEDGWRYAMAITGVMSLLFSFVFYANVTDTPKGSTYFRPKNLGAMEVTSTGDFFLLLVMKLPMYGALALLAWKLSPAGISMLSDMVVNSIYAGLAALYLYEVWQVWKVNKKVFSEPVPKIHQYKFKQVAVLNILYFATFGSELAVISMLPLFFSEMFELTPVMAGMVASAYAFMNLMSRPGGGWLSDKFGRKPTLLILTAGLAVGYFFMGQVSSEWPLWLAVVAAMACSFFVQSGEGAVFATVPLIKRRMTGQIAGMTGAYGNVGAVCYLTVLSLVDYSTFFLVIAGTAVLGFITLLFMEEPSGQIAEVNDDGSVTLIDVANN

SEQ ID NO: 62088 - protein, 353 aa, Candida sp. HA 167
MSTPENLSFVLQKPFDVKFEDRPIPKLSDPYSVKIQVKKTGICGSDVHYFTHGAIGDFVVKAPMVLGHESSGVVLEVGSEVKSLKVGDRVAMEPGVPSRHSDEYKSGRYNLCPHMAFAATPPYDGTLCKYYILPEDFCVKLPEHVSLEEGALVEPLSVAVHSSKLGNIKPGSHVAIYGAGPVGLLVAAVASAFGAESVTIIDLVESRLNLAKELGATATVQVDFKDTPKESAAKVVAANNGIAPDVVIDASGAEASINSAINAIRPGGTYVQVGMGKPDVSFPIATLIGKELTVKGSFRYGYGDYPLAVSLLASGKVNVKKLITHEVKFEDAAEAFQLVRDGKAIKCIINGPE

SEQ ID NO: 62089 - protein, 587 aa, Cucumis sativus
MAKVADKPFFPKPFLSFLVLSIIFGFGITLSEAGFPKIKHYKWDVEYMFWSPDCVENIVMGINGEFPGPTIRANAGDIVVVELTNKLHTEGVVIHWHGILQRGTPWADGTASISQCAINPGETFTYRFVVDKAGTYFYHGHLGMQRSAGLYGSLIVDPPEGRSEPFHYDEEINLLLSDWWHQSVHKQEVGLSSKPMRWIGEPQSILINGKGQFDCSIAAKYNQGLKQCELSGKEKCAPFILHVQPKKTYRIRIASTTALASLNFAIGNHELLVVEADGNYVQPFVTSDIDIYSGESYSVLITTDQNPLENYWVSIGVRARLPKTPPGLTLLNYLPNSASKLPISPPPETPHWEDFDRSKNFTFRIFAAMGSPKPPVRYNRRLFLLNTQNRINGFMKWAINNVSLALPPTPYLAAMKMRLNTAFNQNPPPETFPLNYDINNPPPNPETTTGNGVYKFNMGETVDVILQNANMLNPNMSEIHPWHLHGHDFWVLGYGEGKFYAPEDEKKLNLKNPPLRNTVVIFPYGWTAIRFVADNPGVWAFHCHIEPHLHMGMGVVFAEGVHMVGMIPPKALACGSTALVKNYPRLP

SEQ ID NO: 62090 - protein, 536 aa, Candida albicans SC5314
MVSLNIDSIGIIGAGPGGLASLYEFLHTNKDGTSTVGTGKRAETPAFSKIVAFEQKDHAGGIWAPATPDADLPIPPQEILNTGKFNDPAIIRPRNEPPQEINGATKETPIVVAVPKSKSKTNDNLQNELEWKRSGVYPYLSTNIPSRFTRFSYLPDEEKYHDKSRPIYPFLYHQELSQRFTDFVNNENLHEFIRLNTTVEDVYKNEDTGKWIISVRHKNPITGANEWYQEEFDAIVVANGHYTIPSIPAFPGLAEFNANYPDVLIHAKSVRELDEFKDKDVLFVGGSISTANIIQYIIPVAKSVTISKRSKNLVFDYINRALVTPEIDQRGEIVKFDPKTGKVHFVANDYGNGGEPKKFDKIILTTGYHYHYPFLSKYFEVVNPSHLSRVKGLYYHTFNQQDPTIGATGILVSHLNFHTIEASAAALAGVWSGAKELPTLKEQQEWENQEVETKGDSLFFHFLDHHNAQEHFVDKLYQFAPKNRYNPLEKEGPLVGEVDEGVDKLEKLFYDIKDKKLGIDDVSLPSLEKLSIESKA

SEQ ID NO: 62091 - protein, 587 aa, Vibrio vulnificus YJ016
MAKIILSQWFPGLVQLQHYQKEWLADDVRAAFSVVAVALPVAIAYAQLTGVSAIVGLYSCVLPMLVYALMGTSRQLIVGPDAATCAVIAAVVTPLAAGDATKHWQLVMTMTAMTGMWCVLASRLKLGILADFLSRPILLGLLNGVALTIIVGQFAKVVGWKYEQRYLLERLWEAPQRLADLHWPTLALSVATVVVYLITKRFRPSWPAAMLAILITTASVWLLRLQEVGVSVVGLTQGGFPNFQTPEFELGVTRELVVPALNLAMVSFVSMMLTARSFAAKNGYDIDADKEFRALGFANIASAFSQGFAISGADSRTAVNDANGGKSQLVSIIAAITIAVIAVFIYQPLQFIPIASLGVVLIIASLSLLDLKGIWILRKRDKDAFYLASITFVSVLVIGVIPGITLAVLLGLFQFLRIVMRPSDQLLGLDEEGTIRTVDGTGKATPIPGMVIYRFNSPLTYFNAPYFKRRLLEHAEHTKDVGCVVVDAVSSFTHLDLSVMATLADVHETLKKRGIRLILAGRKRRLRQWCELTGISTSEGGILLRADMYLAIKLSGCYLSAVGEGQVPTVQKEPDLEEPPKAIPEVA

SEQ ID NO: 62092 - protein, 496 aa, Burkholderia pseudomallei K96243
MDKTTLADWQDKAATLAIEGRAFIDGAYRDAHGGKTFDCVSPIDGRVLAKVADCGAADVDAAVAAARRAFDAQAWAGLNPRERKAILLRWAALMRAHLDELALLETLDAGKPIGDTTSVDVPGAAYCVEWFAEAIDKVGGEVVPADHHLVGLVTREPLGVVAAVVPWNFPILMASWKFGPALAAGNSVVLKPSEKSPLTAIRVARLAHEAGIPAGVFNVVPGGGEPGKLLALHRDVDCLAFTGSTGVGKLIMQYAGQSNLKRVWLELGGKSPNIVLPDCPDLDRAAKAAAGAIFYNMGEMCTAGSRLLVHREIKDAFVEKLVAAARAYKPGNPLDPNVSMGAIVDAIQLERVLGYIEAGRAEARLLLGGARVNEASGGFYIEPTVFDTAPDTRIAREEIFGPVLSMITFDSVDEAVRIANDSEYGLGAAVWTANLTTAHELARRLRAGTVWVNCYDEGGDMNFPFGGYKQSGNGRDKSLHALEKYTELKSTLVRLR

SEQ ID NO: 62093 - protein, 152 aa, Trifolium pratense
MATTPALYGTAVSTSFMRRQPVPMSVATTTTTKAFPSGFGLKSVSTKRGDLAVAMATYKVKLITPEGPQEFDCPDDVYILDHAEEVGIELPYSCRAGSCSSCAGKVVNGNVNQEDGSFLDDEQIEGGWVLTCVAFPTSDVTIETHKEEELTA

SEQ ID NO: 62094 - protein, 348 aa, Erwinia chrysanthemi
MERWFKSLFVLVLFFVFTASAADKLPNIVILATGGTIAGSAATGTQTTGYKAGALGVDTLINAVPEVKKLANVKGEQFSNMASENMTGDVVLKLSQRVNELLARDDVDGVVITHGTDTVEESAYFLHLTVKSDKPVVFVAAMRPATAISADGPMNLLEAVRVAGDKQSRGRGVMVVLNDRIGSARYITKTNASTLDTFKANEEGYLGVIIGNRIYYQNRIDKLHTTRSVFDVRGLTSLPKVDILYGYQDDPEYLYDAAIQHGVKGIVYAGMGAGSVSVRGIAGMRKAMEKGVVVIRSTRTGNGIVPPDEELPGLVSDSLNPAHARILLMLALTRTSDPKVIQEYFHTY

SEQ ID NO: 62095 - protein, 331 aa, Acinetobacter glutaminasificans
KNNVVIVATGGTIAGAGASSTNSATYSAAKVPVDALIKAVPQVNDLANITGIQALQVASESITDKELLSLARQVNDLVKKPSVNGVVITHGTDTMEETAFFLNLVVHTDKPIVLVGSMRPSTALSADGPLNLYSAVALASSNEAKNKGVMVLMNDSIFAARDVTKGINIHTHAFVSQWGALGTLVEGKPYWFRSSVKKHTNNSEFNIEKIQGDALPGVQIVYGSDNMMPDAYQAFAKAGVKAIIHAGTGNGSMANYLVPEVRKLHDEQGLQIVRSSRVAQGFVLRNAEQPDDKYGWIAAHDLNPQKARLLMALALTKTNDAKEIQNMFWNY

SEQ ID NO: 62096 - protein, 150 aa, Oryza sativa Japonica Group
MRVSKHTCEVRYGELQGLNKQETADRFGNEQVHKWRRSYDIPPPNGESLEMCAERAVAYFKEHVVPQLTAGKHVMIAAHGNSLRSIIMQLDKLTSQEVISLELSTGIPMLYIFKEGKFIRRGSPVGPSEASVCAYTRKLAQYRQKLDSMV

SEQ ID NO: 62097 - protein, 636 aa, Zea mays
MLSTRTAAVAASASPASPWKVGGRSEGGASCDGCRTYRNTLRRRAAPAKVRALPPRRVDAVAMVSNAETETEKEQEEAAAASEELPVMPWATYVASGYTLLRDPHHNKGLAFTEEERDGHYLRGLLPPAVLFQELQIKKFMNTLRQYQTPLQRYIAMMNLQETDERLFYKLLIDNVVELLPFVYTPTVGEACQKYGSIFGRPQGLYVSLKDKGKVLEVLRNWPHRNIQVICVTDGERILGLGDLGCQGMGIPVGKLALYTALGGVDPSVCLPITIDVGTNNEKLLNDEFYIGLRQKRATGEEYDELIEEFMSAVKQFYGEKVLIQFEDFANHNAFDLLEKYSKSHLVFNDDIQGTASVVIAGLLAALKMVGGTLAEQTYLFLGAGEAGTGIAELIALEISKQTNAPLEECRKKVWLVDSKGLIVDSRKGSLQPFKKPWAHEHEPLKTLYDAVQSIKPTVLIGTSGVGRTFTKEIIEAMSSFNERPIIFSLSNPTSHSECTAEQAYTWSQGRSIFASGSPFAPVEYEGKTFVPGQSNNAYIFPGLGLGLVISGAVRVHEDMLLAASKALADQATQDNFEKGSIFPPFTSIRKISAHIAAAVAAKAYELGLATRLPPPSDLVKYAENCMYTPVYRNYR

SEQ ID NO: 62098 - protein, 292 aa, Polaromonas sp. JS666
MTAAHAQHPKFGPGDEALAALPTVYRDDLFAGKVVLVSGAGSGIGKAIAFLFARLGATLAICGRKADKLEDCAEKLRALSDREVFIYPMTIREPEQVDAMLSAVWESFGGVDVLVNNAGGQFAAHAMDFTDKGWNAVIDTNLNGSWYMMQGAARRWVEQGRPGNIVNITAAIERGLTGMAHTTASRAGVIALSRTLAVEWAEHNIRVNCIGAGAIESNGFNNYREENVSTFYQCNPMKRPGDVQDIAEAVVYLAAPSGKFITGELLNIEGGMLLWGEFWPAGKPDYFKVDPS

SEQ ID NO: 62099 - protein, 741 aa, Debaryomyces hansenii CBS767
MSANNQPSLYPLQDAIAKFDCKPVNPNGKLSDVWLQNEYQKLSIISDQLGRESRKRIRNREETAGEGDAYDREGTESCDDMIISDTDCNSQISGQSAIISGISSFRENGLVHPPKRRLMSVPSPTNTVTPAVTETNNSNETLLQTNQIIQEHIIVQPRTPTAINSPTNTPISDIEEQSQQLPLPSPSASPVQSTGDKISNFDPIEHQLSNIPTTQSELMEMMVSLSGYLSEKNQNHFIFRLLQNTNRSSLSSFSGLIENSLKRDLISNLPLEITYNILSHLDYKALCSLARVCSNWYKIIDNSGIWAQLLKKDKLILSDGAIEREIADPQKLLKEWSLKSDINEANVMQTLYKKRCTILNRWMDPTYEPKRISVPGHGSHVVTCLQHDDEKIITGVDDKLINIYSTKTGELLKVLKGHEGGVWALKYTGNTLVSGSTDRTVRVWNIKTGKCTHVFRGHTSTVRCLDILHPVKIGKNDNGEDIIFPEVPLLVTGSRDHNLHVWKLPLMNEGEEAEDDVVGQQTYDSNEIENPYLITVLLGHTQSVRSVSGYGNIIVSGSYDTTVRVWDLLDNGNCKHVLAGHGDRIYSTALNFHTKRCYSGSMDSSINVWDIESGKLLHTLEGHSSLVGLLELSEEYLVSAAADSTLRVWNPKSGDNICKLEGHSGAITCFQHDSLKIVSGSEIMLKLWDINSGKFVRDLLDDITGCAWGLCFDNNICTAAVQRCRNDTDETFIEILDSSGP

SEQ ID NO: 62100 - protein, 413 aa, Bradyrhizobium sp. BTAi1
MHAAVNGSGYDVGRIRADFPILGMQVHGKPLVYLDNAASAQKPQAVLDRMNQVYTAEYANVHRGLHYLANAATEAYEGARAKVAAFLNAESPEQIIFTRGATEAVNLVAQTFGRERIGPGDEIVLSIMEHHANIIPWHFLRERQGAVIKWAPVDDAGNFLIDEFEKLLTPRTKMVAMTQMSNVLGTVVPVKDVIRIAHARGIPVLIDGSQAAVHMEVDVRDLDADFYCITGHKIYGPTGIGALYGKRELLASMPPFNGGGEMIREVSRDWVTYGDPPHRFEAGTPPIVEAAGLGAAIDYVASIGKQRIAAHEHDLVTYATEQLREINSLRIIGNAADKGAIVSFEMQGAHAHDFATVIDRSGVAVRAGTHCAMPLLERFGVTATCRASFAMYNTREEVDALVRALKKAQEFFS

SEQ ID NO: 62101 - protein, 778 aa, Oryza sativa
MPHRRRLLNPAPSLPPPPAAAPAGFHHHLLAVDDTRLPLLADYALLQGDAAAAPASAEWSAGSGFTGISTDPATATTATMASTATAPGSASNLTAATAGGGGRETWVRRAREGYYLQLSLAIRLTSEAFLAGVPPELLIGCGGGGEAENHADVAADAAAVSYRLWVNGCLSWGDKIAHGFYNILGVDPHVWAMCNAAAEDGRRLPTLVALRAVDSGESSVLEVVLVDKCGDPALADLERRALDLYRAAGVSLDLVRHLAVLVSDHMGGALRSEDGDLFMRWKAVSKQLRKRHRCVVVPIGSLSIGFCRHRAILFKSLADFIGLPCRIAQGCKYCSAPHRSSCLVKIDNERRFVREYVVDLVVEPGRLSSPDSSINGQLLSSVPSPFKTSCTMSSANYATPAASWNRAISGDRRNSILSNPQYSVAKYCVAEEKSSVQVATKEAMLPKCGQITQNGNCNKNSMAVFEVSKQMKAMEISSESGDKDNISSATPLKRLSIEPSFCADWLEISWDEIELKERVGAGSFGTVYRADWHGSDVAVKVLTDQDVGEAQLKEFLREIAIMKRVRHPNVVLFMGAVTKCPHLSIVTEYLPRGSLFRLINKASAGEMLDLRRRLRMALDVAKGINYLHCLNPPIVHWDLKTPNMLVDKNWSVKVGDFGLSRFKANTFISSKSVAGTPEWMAPEFLRGEPSNEKCDVYSFGVILWELMTMQQPWNGLSPAQVVGAVAFQNRRLPIPQETVPELAALVESCWDDDPRQRPSFSSIVDTLKKLLKSMLGGS

SEQ ID NO: 62102 - protein, 414 aa, Vibrio parahaemolyticus RIMD 2210633
MLKGINTSRPLRLTWMKIMFEKVVAAPADPILGLTEEFKKDPRAEKINLGVGIYKNEQGETPVLATVKKAEAALIETEKTKSYLTIEGTAEYGLAVQKLLFGADAEIVAEKRAKTAQAPGGTGALRVAGEFIKRQLGNVKIWISNPTWANHNGVFTAAGLETAQYTYYNAETKDKDFDAMLNDLQAASEGDIVLLHGCCHNPTGIDPTAEEWETLAKLIAEKKLLPLFDFAYQGFAKGVEEDAAGLRIFAKYNKEILVASSFSKNFGLYNERVGAFTLVAESEEVATTAFSQVKAIIRSIYSNPPAHGSAVVTHILNNKELRAEWEAEVQEMRDRIQEMRELFVATLKEEGVDADFSFIERQNGMFSFSGLSKEQVNRLKDEFAIYIVGSGRISVAGMTKSNMGPLCKGIAAVL

SEQ ID NO: 62103 - protein, 311 aa, Photobacterium profundum SS9
MRQVSEKLQPWLEDFNQQVAVLIENGFKPTATNAREGLANLTKDLVTDIPAIAWVQDDVVIKDEDTVPVRIYHPAPEQALPVLVYYHGGGHMAGSIAVYDPICRKLASATQHIVVAVDYRLAPECPYPAGVNDAYAVVKGIWTTLDSCQIEYQRELVVAGDSGGGALVATVSGQAQFDDTVNIAKQVMIYPSLDYTMHSGSMEQNAAGYLLQKDKVAWYFDNYLQNNENRQRVSPLYGRFTPALPETLLFTAEFCPLRDDGVSYCKKVEATGVQVEHVHFPNMIHAFMNMEDLVKEECAQVYQTITRFLRT

SEQ ID NO: 62104 - protein, 544 aa, Xanthomonas oryzae pv. oryzae KACC10331
MLPVHGVLTDRLFMSEHALRRDVGPFALMLTGLGSIIGSGWLFGAWRAAGLAGPDAVWAWVLGAAIITTIAVSYAELGAMFPESGGMVRYSHYSHGSLVGFIAGWANWIAIVSVIPVEAEASVQYMASWPWAWAQGLYAQAPGGAGELSVPGLLISAVLVLVYFLLNFWSVKLFARSNTLITVFKLAVPAATGVALIASGFHSENFSVGVHGDAQVLDLAAVLTAVATAGIVFSFNGFQSPVNLAGEARNPGRSIPFAVLGSIALATVVYVILQVAYIGAVPPDLLAKAGWHGIDFRSPFAELAIIVNLQWLAMLLYIDAFVSPSGTGITYTATTARMVYGMEKNGTMPAALGKLHPVWGVPRMAMFFNLAVSFVFLFFFRGWGTLAAVISVATIISYLTGPISAMALRRHAPELHRPLRIAALPLLAGVAFVMATELLYWARWPLTGEIILLIVVALPVYCYYQARQGWRDLRRNLKGAAWMICYLPMIALLSWAGSSKFGGHGYLSYGTDLAMVAAVGVVFYIWGVRSGWRTPSVEKPVAQA

SEQ ID NO: 62105 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIDANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 62106 - protein, 245 aa, Brassica napus
  misc_feature (17)..(17): Xaa can be any naturally occurring amino acid
  misc_feature (32)..(32): Xaa can be any naturally occurring amino acid
  misc_feature (94)..(94): Xaa can be any naturally occurring amino acid
MALTSCLKTGVVPMSPXTGLYLSGSLLKSDSXGFAVPTKLQSVRKSDRERLRIQAVFSFPPAFLTRNGRAEKQKQLKQDLLEAIEPLERGAIAXSPDDQLRIDQLARKVEAVNPTKEPLKSDLLNGKWELIYTTSASILQAKKPKFLRSITNYQSINVDTLKVQNMETWPFFNSVTGDIRPLNSRKVAVQLKVFKILGLIPVNAPETARGELEITYVDEELRLSRGDKGNLFILKMFDPTYRIPL

SEQ ID NO: 62107 - protein, 204 aa, Triticum aestivum
  misc_feature (17)..(17): Xaa can be any naturally occurring amino acid
  misc_feature (35)..(35): Xaa can be any naturally occurring amino acid
CPFELAVKKTPWGLARXPAISQDHGLVPIVEPEIXLDGEPGIERTFEVAQKVWAETFYYMAQNNVMFEGILLKPSMVTPGAECKDRATPEEVASYTLKLLQRRIPPSVPGIMFLSGGQSEVEATLNLNAMNQAPNPWHVSFSYARALQNTCLKTWGGRPENVAAAQEALLLRAKANSLAQLGKYTSDGEAAEAPENMFVKNYSY

SEQ ID NO: 62108 - protein, 510 aa, Candida albicans SC5314
MSEPTQDQPQEQQSQEQQQQEQQQQQQQQQQQEHQPEQQQSTESSENESQQAQQPSSQDDEKQVNAASAKEGGREVSNKILYVGNLPKSASEETIQELFSVGGNPVKTIKILNDKNKAGFNYAFIEYDTNEVADMALNTLNGRLVDDVEIKVNWAFQSAAIAGNPNNTEEPLFNIFVGDLSPEVNDEGLRNAFSKFESLKQAHVMWDMQTSRSRGYGFVTFGNQSDAELALQTMNGEWLCGRAIRCNWASHKQQQQQQHYNNQHGGGYSRGYRNNNGGNNNNRQFRQFNNINNGNNNGFSQPLVNNNPQFIGQQPPQPDQHQHQQQQQQQQQQQSVNGANGVPQQMLQGLTNGNLGPGTPINGSNNAAGGFNNNGTAGNVAGAPVAGGPGAIPVMSPQSYDIVLRQTPSWQTTVYLGNIAHFTQQQELIPLLQNFGFIVDFKFHPERGCAFVKYDTHERAALAIIQLAGFNLNGRPLKCGWGKERPPQFQNFPRNGNMHQVPMYGPGGRP

SEQ ID NO: 62109 - protein, 446 aa, Methanosarcina mazei Go1
MKAVVYRGPNQVSVEEVEDPKIEHPADAIIRLTSSGICGSDLHMYEGRTVEKPGKVLGHEPLGVIEEVGDAVTSFKKGDRVVVTFNIACGHCLNCIRGFTSACLTVNPESAGGAFGYAKMGPYRGAQAEFLRVPFADLNCTKLPGSPGDKWEDDFIMLSDVFPTGFFATQLAMVMPGFPVAVFGAGPVGLLSAYSAILQGAAQVFVVDYIPERLKLAKSIGAIPVDFTLSDPVAMIEALRSQHSRVDTVLPGEEKLQGIMSSIENLAKSIGANLELARSDPVTMIQMLRAGNPAIVQSLIPGEEKMKGVMSGIDAVGYQARDRQDPSRENPTQVISDLVRLINPTGHLGVIGVYVADDPGAYNERAKKGEYILPFGQLWEKGISVGTGQTPVKKLQPMLRDMIIAGVAKPSFIVSHKISIEEAPDAYREFAKRSEGFTKVTIQFEK

SEQ ID NO: 62110 - protein, 635 aa, Oryza sativa Japonica Group
MRGFLAAALLVFGILLNLDTAASAWEDKDFFSYCPPSRCSEHGPEVRFPFQLESNNTTQSSCGLPFMKLSCSGQDTILDNKCLGRPYKVTAIDYKHPVLTAVPLADEGNSSSPCPLLKSISIRPSLKADNGYHYMMYQKPSETYVEHYYAALVSCSTEFAPASIPDATDDIVGPISCLSNQTHLSYLVEVHASMSLLTLDCEVISDGPIPIPVFHYSIYDLPTFRGSAERILNFSDTTVWWYRYDCPQCEQLGGRCAFSSQRNQTFCMRRGSHVKVIAATSSVAAFVVLLLMVATALYLSLKTRYNEEIHLKVEMFLKTYGTSKPTRYTFSEVKKIARRFKVKVGQGGFGSVYRGELPNGVPVAVKMLENSEGEGDEFINEVATIGRIHHANIVRLLGFCSEGTRRALIYEYMPNDSLEKYVFSHDSDTSQEVLVPSKMLDIAIGIARGMEYLHQGCNQRILHFDIKPNNILLDYNFSPKISDFGLAKLCARDQSIVTLTAARGTMGYIAPELYSRNFGEISYKSDVYSFGMLVLEMVSGRRNSDPSVESQNVVYFPEWIYEQVNSGQDLALGREMTQEEKETVRQLAIVALWCIQWNPKNRPSMTKVVNMLTGRLQNLQVPPKPFLSTDSYPVL

SEQ ID NO: 62111 - protein, 248 aa, Methanosarcina acetivorans C2A
MSYLIIVRHGESGWNVDGRFGGWVDVPLTGKGIKEALLCAAELEGIDLDVTFTSKLIRAQETLFLILSKQKKIGVFVHEEAGTGEDRTEREDGSRKDRKEKRYAYPPNTEKNLIPIHSNEALNERYYGILQGKKKDKMKAKYGEEQILHWCRSFDEGPPEGESLKDIYRRAVPYFEKEIFPILQDGKNVIVCAHQNSLRALIKHIEGISNEDIRKIRLANARPVIYTFSGGRLVRENAETDPSVKRNL

SEQ ID NO: 62112 - protein, 485 aa, Polaromonas sp. JS666
MKPASPVIQMPLVSPGEPVTQSEIARIFAAQRETALRLRQSTAAQRLDKIDRLKRAVLARQADIQRAGALDFGKPAAEVDLTEILPIVAEANDARRHLRRWMKPRKVFPTLLMFGTSSHVQCEPKGRCLIISPWNYPLNLTFGPLISAIAAGNTAILKPSEMTPHLSEVMAEIVREVFTEDEVALFQGEASVSQALLDLPFDHIFFTGSPAIGRVVMAAAAKHLTSVTLELGGKSPTIVDATANLKAAAANLMWSKHTNSGQTCIAPDHVYVHESVKESFIQHCREALAKAYGEGDAVRSSPHLAHIVNERHAKRIVGLLDDALQKGARLLVGGQHQTDRQFVAPTLIDNVSPDAKIMQEEIFGPLLPVIAYRDLDEVITKINDQPKPLALYIWTKNHKVADKVLRETSSGGACVNHSVVQFLHGRLPFGGVNNSGLGSAHGIYGFKAFSHERAVVKTWLLLASNFYPPYTPLSRRLINWTLRLV

SEQ ID NO: 62113 - protein, 187 aa, Burkholderia pseudomallei K96243
MPIINSPIKPFKATAYHNGDFVQVSDETLKGKWSVVVFYPADFTFVCPTELGDLAERYAEFQKLGVEIYAVSTDTHFTHKAWHDTSDTIAKIKYPMIGDPTLAISRNFDVLIEEEGLALRGTFVINPQGEIKLCEIHDNGIGRDAGELLRKVQAAQYVAAHPGEVCPAKWTPGADTLTPSLDLIGKI

SEQ ID NO: 62114 - protein, 981 aa, Bradyrhizobium japonicum USDA 110
MQAMAKAASKPKKIPAKSKSSVKAKAAPAARKALSKSAPKPIAKPAAKSAAKSAVKAVSKAATKPVAPKAAAKVALKPTPSKPAPAAAKAGKWVFTFGDGKAEGRTEMRDLLGGKGANLAEMANLGLPVPPGFTIPTSVCTYFYAHGKTYPKELQSQVEKALDHVGKLTGKVFGDTKNPLLVSVRSGARASMPGMMDTVLNLGLNDETVEALSELSGDRRFAYDSYRRFITMYSDVVLGFEHHHFEEILDTFKDSQGYTLDTDLSAEDWVELVGKYKDAVARETGKNFPQDPHDQLWGAIGAVFSSWMNARAVTYRKLHDIPESWGTAVNVQAMVFGNMGETSATGVAFTRNPSTGESKLYGEFLINAQGEDVVAGIRTPQDITEEARKESGSDKASMEAAMPEAFKELTRIYTLLEKHYRDMQDMEFTVEQGKLWMLQTRGGKRTAKAALRIAVELANEGLITKKEAVTRIDPASLDQLLHPTIDPNAKRDVIATGLPASPGAASGEIVFSSDEAAKLQADGRKVILVRIETSPEDIHGMHAAEGILTTRGGMTSHAAVVARGMGKPCVSGCGTIRVDYGRGTMSIGSRTFKTGDVITIDGSLGQVLAGRMPMIEPELSGEFGTLMKWADQVRKIGVRVNGDTPDDARTAIKFGAEGIGLCRTEHMFFEETRIRTVREMILSEDEQSRRAALAKLLPMQRADFVELFEIMKGLPVTIRLLDPPLHEFLPHTHAEVEEVARAMNTDPRRLADRARELSEFNPMLGFRGCRIAIAYPEIAEMQARAIFEAAVEAEKRTGKAVGLEVMVPLIATKMELDLVKARIDATAQAVMRDTNTKLAYQVGTMIELPRACLLAAEIAESAEFFSFGTNDLTQTTYGISRDDAASFLGTYVSKGILPIDPFVALDQEGVGELVKIGVARGRKTRPKLKVGICGEHGGDPASVAFCHNIGLDYVSCSPYRVPIARLAAAQAALGKAVASQA

SEQ ID NO: 62115 - protein, 494 aa, Synechocystis sp. PCC 6803
MLVAMSMTPIAILFSTPLKRFLREKVLLGNAPSWELLAILSIYFVQGVLGLSRLAVSFFLKDELGLSPAAMGALIGLGAAPWILKPVLGLMSDTVPLFGYRRRSYLWLSGLMGSAGWLLFAAWVSSGTQAGLVLLFTSLSVAIGDVIVDSLVVERAQRESLAQVGSLQSLTWGAAAVGGIITAYASGALLEWFSTRTVFAITAIFPLLTVGAAFLISEVSTAEEEEKPQPKAQIKLVWQAVRQKTILLPTLFIFFWQATPSAESAFFYFTTNELGFEPKFLGRVRLVTSVAGLIGVGLYQRFLKTLPFRVIMGWSTVISSLLGLTTLILITHANRAMGIDDHWFSLGDSIILTVTGQIAFMPVLVLAARLCPPGIEATLFALLMSVMNLAGVLSFEVGSLLTHWLGVTETQFDNLALLVIITNLSTLLPLPFLGLLPAGDPQVKDKTEKEDNPDDPGDRLVLPPAEVFEHHTVGSLSDQNFLPEFFPEKSSSRP

SEQ ID NO: 62116 - protein, 336 aa, Colwellia psychrerythraea 34H
MKAAVNHQFKGKLEIEQLDKPTISSHEVLVKIHACGVCHTDLHACHGDWPVKPKMPLVPGHEGVGEIVEVGDQVSHCKLGDRVGIPWLYSACGHCDYCLTGDENLCLSQQNAGYSVDGSYAEYCKADGNYVVKIPDGISYVDAAPLFCAGVTTYKALKVSTAKPGEWVAIFGIGGLGHLAVQYAVAMGLNVIAVDTGEAKLDLAKKLGASLCLDFKRDDVVAKVLAETGGVHASICTAVSKSGFEQSYKVIRRGGKCVLVGLPPEDMPLPIFDTVLNGVSVVGSIVGTRKDLIECLDFAARGKVKAITIEKSLEDINDIFEEMINGEITGRVVMKF

SEQ ID NO: 62117 - protein, 397 aa, Fulvimarina pelagi HTCC2506
MRALTYHGTKDVRVDTVPDPEIINPRDAVIKITSTAICGSDLHLYDGVIPGTLNGDILGHEFMGEVVETGPKSTLKKGQRVVVPFTISCGKCYFCEKQQFSACDNANPAEKQDMTEQLYGHAVGGLFGYSHLTGGFSGGQAEYVRVPYSDVGPIVVPDHLDDDKVLFLSDILPTGWMAADNADIEEGDTVAVWGCGPVGLFCIQSALLMGADRVIAIDHYSRRLELARQAGAQVIDFKQTNVTEALMEMTGGIGPDAVIDAVGMESHGFSLGDQAQAFNLADTIKQKVGIGADRGGALREAIFACRKGGRLSMPGVYGGFVDKFPLGALMEKGIQIKSGQTHVQRYLNQLLRLIEEDKIDTTFMISHRLPLEEAPKGYKNFKDNQNDWTKVVLKPGV

SEQ ID NO: 62118 - protein, 300 aa, Prochlorococcus marinus str. AS9601
MTEVINNISDFEKYLKNTKKVVEEALDFSLGPENPEILRESMRYSLLAGGKRIRPILCLASCSLAGGEPSLAVPTAVAIEMIHTMSLIHDDLPAMDNDDLRRGRPTNHKVYGDAIAILAGDALLTRAFEMVSLRSPGVDPTRLLNVVGELSLVAGAPGLVGGQVVDLECEGKEVDLKTLEYIHLHKTGALLKACVRTGAMIAGANEKLLHALTTYAEGIGLAFQIIDDILDLTSSSEKLGKTAGKDLLADKTTYPKLLGMEESKKRAFDLVEKAKKAIEPWGPDAKYLISLADFITNRDR

SEQ ID NO: 62119 - protein, 423 aa, Oryza sativa Indica Group
MKMAVTLFGRGGGVATASGIRRRQMERRCIRPQKVGYGGRRHGVDSEPVSCWLSCQPPCSDESVDDGRSRGLSDELEQLLKGIAMMKELTLRTRDYLVSFGECMSTRIFAALLNKLGVKARQYDAFEIGFITTDDFTNADILEATYPAIAKRLHGDWVTGPAIPIVTGFLGKGWKTGAITTLGRGGSDLTATTIGKALGLREIQVWKDVDGVLTCDPNIHPNAKPVPYLTFDEAAELAYFGAQVLHPQSMRPAREGDIPVRVKNSYNRRAPGTLITKARDMSKTVLTSIVLKSNITMLDIVSTRMLGQYGFLAKVFSIFEDLGISVDCVATSEELDHVIEELEKIAVVHLLQHRSIISLIGNVQRSSLILEKVNISLVVHDSEAKQCVQALHSAFFESGFLPEVNDILQDDSVAHSNGTVYRH

SEQ ID NO: 62120 - protein, 338 aa, Mycoplasma penetrans HF-2
MINNRICILGTGAWATALGSRLSLNGNTVFLWGIDNNEVNDINSGYNKKYFGNTKFSSSLSATTDLKTAIGDSKYIIFAIPSTALDSVLDKVKEFLSDKKSQVILINVVKGIDAETSQILSNKIKSKLGSHYYSRLVTLCGPSFATEVFEEKPTVINGTGKNLKIVKQVCELFNSDVFKVIPINDIVGLQVFSSLKNLLAIAVGLSQAEYTSVNTMSAILTMGIEEIQKIACKMKAKKWTIMSFCGIGDIFLTCSSTQSRNYSFGQDLLKKGVEKTIKENKKTVEGFEVYKTAKNIITKYNINAPIFSSIIEVLEGKLDPKEFSKKCLELFWNQKINK

SEQ ID NO: 62121 - protein, 392 aa, Wolinella succinogenes DSM 1740
MNIHEYQAKALLAQYGVGIPRGGVAETPAEATVIAQRLGGEIWAIKAQIHAGGRGKAGGVKLAKTPEEAGEIAKAMLGSRLITHQTSLEGKEVHKVYVEEGLGIEREYYLGIVLDRSLEMPVIMASRQGGVDIEEVAKNSPNEIIKVAVDPMIGFRPFHGRKLAFALGLAKEQVGLFVDFCTSLFRLYVQKDAEIVEINPLVFTSCKRFVALDAKISFDNNALYRHPEIVAMRDLSEEESSEIEAGEYNLNYVKLQGNVGCMVNGAGLAMATMDIIKHEGGEPANFLDVGGGAKPETVAKGFEIILKDPNVKAIFVNIFGGIVRCDRVANGILEAAKIVHVSVPVVVRLDGTNAKEAKEILEQANIPNIFAAPSLEGGAKKAVELACQGGAS

SEQ ID NO: 62122 - protein, 130 aa, Zea mays
IISLVEKWNHSEGTPQVAYTFDAGPNAVLIAQNRKTAAHLLQKLLYYFPPQDNDLSSYLVGDKSILGVAGLHSMKDVEALPAPPETKIPDQKFKGDVSYFICSRLGAGPKVVSDEGQALIDSVTGLPKGV

SEQ ID NO: 62123 - protein, 293 aa, Staphylococcus epidermidis RP62A
MKKLQMNKLINIINTSLNKSIQSSPLKTNLEESMKYSLNAGGKRIRPVILLLTLKMLNKDYQQGLNSALALEMIHTYSLIHDDLPAMDNDDYRRGKLTNHKVYGEWKAILAGDALLTKAFELVSNDTTIEDSVKVSIIKRLSKASGHLGMVGGQALDMESEGKSIRLETLESIHETKTGALLNFSVMAAVDIAQVEQNIAKNLDEFSHHLGMMFQIKDDLLDVYGDESKLGKKVGSDIVNHKSTYVSLLGKEGAEEKLNNHQYLAMNCLNQISDQYDTSELSDIVDLFYNRDH

SEQ ID NO: 62124 - protein, 337 aa, Brassica napus
MSWLPVESDPGVFTEIIQQMQVKGVQVEELYSLDITSLDEIRPVYGLVLLYKWRPEEKESRVVITEPNPNFFFASQIINNACATQALLSVLMNSSGIEIGSELSELKEFAKDFPPELKGLAISNNEAIRAAHNTFARPDSSSTTTDEDEIAARRKKKEEEDDDVYHYISYLPVDGILYELDGLKEGPISLGQCLGEPDGIEWLKMVQPVVQERIDRYLQNEIRFSLLAVVKNRKEMYRAELKEYQMKRERILQQVGTLQADKYAEKSSYEALDKSLSEVNVGIETVSQKIVMEEERAKNWKKENLRRKHNYVPFLFNFLKILADKKKLKPLIEKARR

SEQ ID NO: 62125 - protein, 291 aa, Thermoanaerobacter tengcongensis MB4
MKIFIVDAFTEKPFSGNPAGVVVLENGEKIDETFMQNLAAELKHSETAFIEVVGEKDFKVRFFTPTSEVDLCGHATIASFTVLKRLGFVKAGDVVTMHSLAGKLPIYIEEDKIMMEQAAPQAGEKLNEDDLSKLAKALNISVEEIGDKNYDLVPQLVSTGLWDILVPVKSRETLFSINPDYQAISQITKEKNAVSLHVFTLEEKKAIANCRDFAPLYGINEEAATGTANGALTYYLYLNKVIDLEKTYLIHQGESMKRPSKIYVKLPKKEEGIRVLVGGPARILISGNWSD

SEQ ID NO: 62126 - protein, 442 aa, Cupriavidus necator
MPQRHLPESRRPAMNRRQSQPFRTGDVMYQHIKVPAGEKITVNQDFSLNVPDNPIIPYIEGDGTGLDITPVMIKVVDAAVAKAYCGKRKIAWMEIYAGEKSTKVYGLDVWLPDETLEVLKDYVVSIKGPLTTPVGGGIRSLNVALRQTGPDVCLRPVRYFKGVPSRCVSSEKTDMVIFRENSEDIYAGIEWAAESEHAKKLIKFLQDEMGVKKIRFPRTSGIGIKPVSREGTERLVRKAIQYAIDNDKPSVTLVHKGNIMKFTEGGFRDWGYELAHKEFGAELVDGGPWCKFKNPKTGKDIVIKDAIADAFLQQILLRPAEYSVIATLNLNGDYVSDALAAQVGGIGIAPGANMSDSVAMFEATHGTAPKYAGKDYVNPGSEILSAEMMLRHMGWTEAADLIISSMEQSILSKKVTYDFARLLEGATQVSCSGFGQVMIDNM

SEQ ID NO: 62127 - protein, 265 aa, Zea mays
MAVPMSAIESAWQLLIANFTEFQLATVITFLLHETVFFLSGLPSLLFERFGLFAKYKIQKRSNTSAYQNRCVLRLILYHVSVNLPVMILSYPAFKFMGLRSSLPLPHWTVVVSQVLFYFVLEDFIFYWGHRALHTKWLYKHVHSVHHEYATPFGLTSEYAHPAEILFLGFATVVGPALTGPHLFTLWLWMVLRVLETVEAHSGYHFPWSPSNFLPLYGGSDFHDYHHRVLYTKSGNYASTFVYMDWLFRTDNGYRKAKRPLRSKK

SEQ ID NO: 62128 - protein, 302 aa, Thermoanaerobacter tengcongensis MB4
MKIKKAIIPAAGLGTRFLPATKAQPKEMLPIVDKPTIQYIVEEAVQSGIEDILIITGRNKRAIEDHFDKSVELELELKKKNQESLLSLVEDISNMVNIHYIRQKEPKGLGHAIYCAKSFVGNEPFAVLLGDDVVDAEVPVLKQMIEQFERYNCTIIGVQEVPEEDVHKYGIVSGTFIEDRLYKVNDLIEKPRREEAPSNIAILGRYIITPRIFEILEHTPPGRGGEIQLTDALKTLLNYEAIYAYNFIGKRYDVGDKLGYLMATVEYALKREDLREPFKRYLITIVQDLLGMEEAAVTERDV

SEQ ID NO: 62129 - protein, 242 aa, Mangifera indica
RLQLQKKGVGGDGLVLPKYKGLLGTVGTIAREEGLAALWKGIVPGLHRQCLFGGLRIGLYEPVKTFYVGSDFVGDVPLSKKILAAFTTGAIGITIANPTDLVKVRLQAEGKLPPGVPRRYSGALNAYSTIVRQEGLGALWTGLGPNVARNAIINAAELASYDQVKQTILKIPGFTDNVVTHLLSGLGAGFFAVCIGSPVDVVKSRMMGDSAYKSTLDCFIKTLKNDGPLAFYKGFIPNFGRL

SEQ ID NO: 62130 - protein, 390 aa, Pasteurella multocida subsp. multocida str. Pm70
MKKITIAGAGYVGLSNAVLLAQHHNVILLDIDQNKVDLINNKKSPITDKEIEDFLQNKSLTMMATTDKEVALKNADFVIIATPTDYNTETGYFNTSTVEAVIEQTLSINPQATIIIKSTIPVGFTENMREKFNTPNLIFSPEFLREGKALYDNLYPSRIIVGSTSYQAKVFADMLTQCARKKDVTVLFTHNTEAEAVKLFANTYLAMRVAFFNELDTYASLHHLNTKDIINGISTDPRIGTHYNNPSFGYGGYCLPKDTKQLLANYADVPQNLIEAIVKSNETRKRFITHDVLNKKPKTVGIYRLIMKSGSDNFRASAILDIMPHLKENGVEIVIYEPTLNQQAFEDYPVINQLSEFINRSDVILANRSEPDLNQCSHKIYTRDIFGGDA

SEQ ID NO: 62131 - protein, 2468 aa, Oryza sativa
MEPEREASSEWGDGVGALGFRVKASSREPAAQKAANVLEPDLRSHWSTATNTKEWILLELSEPCLLSHIRIYNKSVLEWEITAGLRYNKPDTFVKVRPRCEAPKRDILYPANHTPCRYVRISCMRGNPIAIFFIQLIGIPIPGLEPDLQPLVNYLLPHITAHKQSSQNIHLQLLKDIASRLPPFLPQIEADLASVTDTPESSVHFLALLAGPFYPILQLTNERDFTKSLISSADSDALKSSLASTPTVSSNFETQPRRSRSPSSVQPACFLAFRSETAVLLLRKAHRDRALGIVCLKASKVLQELLEPDPLLDDASDQVLCTDYSSLFGDEFNLSENCFDASILNILDIAAVEEGILHILYAASSQPLLCCKLAEKGSDMWSVLPLVQALLPALRPPLSPGSTEQIDGCLSQWNHPNVHKALSQIATMSMSSSVLHPLLRACAGYLSSYLSSHAKAACVLLDLCRGPLSPWVPMITAKVDLAIELLEDLLGIIQGVGQSLTRSRAALKYIALAISGHMDDVLTEYKVHSFFLLKDVKHKLLFILEMLDPFIDPSVSVMTDAMAFGDVSVVHLEKQASACNISLNIIRTAVKRPAVLPSLELEWRRGAVATSVILSTLDPHMPLPPDIDLCKSSMPEIDQISLIVPNCPPHSCSAEDADGRDTSETTPREDILEQCNSLFAPEELEQSELTKTLEEKKHEKISTDLDQNFPEDTKSNGKLPAGLFQLDNIFAADYYDAHADYLQLVNYQDCELRALEFQRLALNLCTQQEPTVEGHNAGIDAFLLAAECYVNPLFLLDFHSNSESLDEIERIHAELIQGNCFSEAKHLRAKDIDLMKIYNLENKRDKAVLDLLMQAARYDFEYQGKIPDGKPFPDDVEDGKQYIEISPEARHLADAVTLVRKNQAMLCHFIMKQFERKGHSPNEILLQSLLFLLHSATDLFCPPENVIDIILKSAEDLNGKLVCLYNSVNARNNKLDRVKLHYLRRRWALLQKLVLASSGSDNTRELVSIKRDGFRFKSLVPPSAWIHKISDFSRSSSPLPRFFGWMAVSRYAKEYLNEQLFLASDFSQLTSLLSIFTDELSLMGGVTTQKAKSAKIEQSGCNNYVLLKKEPLLSDQPSMRLFQILLPELHFFFPSMSKKFDAFGQSILEAVGLQLKCLPKSAVHDVLCWFSEMCLWPYLGNIREHLAFANGVNSLKGNIAAKAKAVVFYLLESIVAEHLEVIVPEMPRMVHILVSLCRASYTDVAFLDSVLCLMKPMISHFLRKSTDNGNVSGDITECSDFELLCFEELFETIQFGKQSEDTPGNKNQVPFLIFILGSLFPDLSFKRRIEILGSLLVWVDFGSSDPSSLLCSYLQGFQAFIDGCETILVQNIELFGVHVLSERNQSTEFANSASPDDTMDNKKAQASVAQVQRRSTEYHENGENSKGVDSPHTVCIKEFCGALERLVSNLAPSIEGSWKWHLQLASRLSLSIAKCLLYAKCLKSIAEGGMIYSSIKQEVGTEISTDLSQKHWESALQGLAETILVNQKKQCWQVASVMLDYMIKLPNILAWDNVLNVMSSAMKHLCSHAPRISWRLQTEIWLSILVSYGIEGLKNSENSLIDLFCTLLSHAEPEQRSVALQQLGRIIMSTTKVDSEYTTYKQNSLSSGSTVTSLLVTHTWDRVAALAFYDSSMLLRKHALALLTEYIPFVDRNHLQSFLGSSNSILNGAEQFSYAIEQGYLTRMSLLLLSRACLYSAPEDIALIPECVWRKLENMQTSIPGCFGDMEKDLCRALCQLRSESDAKTVVKELLTESTAKPVETDFKGIRESILQVLSSLSSVESYFEFFSTRSDQEYQELEEAEIELEIVKNEKALHSFIVHPQDTMIPDMSSYYKDGNEVNKQLQQIQEDIRSLERSKLREEIIARRQKKLLIRHTREKYLEETSSREMELLQELDRERAHEMEREIERQRQLDLERVNSRELQFNLDMEREKQTQRELQRELDQVELGRSSRREFSANTNSRSRERYRERDDGRGQQEGRSRGGGVEAGGSATRSFSGNLPTILQQPRERTTSDERTSTGGNYYEENAEGSGDASSVGDPESAAALEAGTRHGPRGGSKSSSSSSRQERRSVCGVHMDPFFRRASSDPLCLEDNSVQHGIERCPFLRNINEPTSFSFSSVNFPVPARGDKGPIFEDGPNFDMAFRVFHGQDGVVPLSHGSFERFEKPMPKPNPEFNPLAAKAATISLSAFGGFFSFGDFSNKRNKKNSNQKKPNNLPQNGGQPNNHEALSNEWLEMGQCPLAKSYRALSGVVPLVAKMMTPPAGMKLRCPPAVVAARAALSRTAFAKGLRPQPLPTKILVMALLGMAANVPLGIWREHTEKFSVQWFAAVHAAVPFIGMLRKSVLMPKTAMALTIAASILGQTIGSRAERIRLKRAAKVAAGSQGDASTRMSLKTGRYTDDVQFWDPLALRVESTIGTGTPVLVPTFH

SEQ ID NO: 62132 - protein, 441 aa, Glycine max
  misc_feature (348)..(348): Xaa can be any naturally occurring amino acid
  misc_feature (350)..(350): Xaa can be any naturally occurring amino acid
  misc_feature (353)..(353): Xaa can be any naturally occurring amino acid
  misc_feature (369)..(371): Xaa can be any naturally occurring amino acid
  misc_feature (383)..(383): Xaa can be any naturally occurring amino acid
  misc_feature (406)..(406): Xaa can be any naturally occurring amino acid
  misc_feature (416)..(416): Xaa can be any naturally occurring amino acid
MGCLHSKTAHLHSPEDPPTALPDSKKPDPGNGGDDVDQECQVPAFKEYGLIELRRATNEFSTDYIVSESGEKAPNVVYRGKLENNRLVAVKRFSKLSWPDAQQFMAEAAGVGKVRHKRMVNLIGCCAEGDERLLVAEYMPNDTLSKHLFHWDKQPLPWEMRVRVAYHVAQALDHCSLENHKIYHDLNAYRILFDEDGDPRLSSFGLMKNSRDGKSYSTNLAYTPPEFLRTGRIIPESVIYSYGTVLLDLLSGKHIPPSHALDLIRGKNVLLLMDSSLEGQYANDDATKLVELASKCLQFGARERPEITFLLTAVAPLSRAEEVASLVVMGLTKNTAVAVLPTTLSPLXKXCAXMDLTAVHDILVKTGYXXXEGAENELSFKDXTQQYRYLDTKKFGDIAFRRQDFXNGIEYILRLXVMKAVPSALGWQGSLLYLVMFSKIV

SEQ ID NO: 62133 - protein, 408 aa, Fulvimarina pelagi HTCC2506
MKAVVFHGVRDISLDTVPDPSIKEPTDAIVRITSSAICGTDLHMVRGTMPGMVEGTVLGHEGVGVVEEVGPGVRNLSPGQRVVIPSTIACGTCSYCRSGYTAQCDDANPNGHLAGTSFYGGPGPTGPFDGLQAQYARIPYANVNLVPLHPEISDHQAICLSDIASTAWFGADIADIQAGDGKTVLVMGCGPVGLFTILGAWHYGAQRVIAVDRRTDRLDMARRLGAETINFEEENPIEAVRDLTGGIGPDRAIDAVGVDAFKPTKGPMKEMVDKRSDFYAMQVKHLAEESADTHAVQYAAGDAPSLSLEWAVQSLAKAGTLSIIGVYPQSDPFFPIGTAMNKNITMRMGNANHKKYVQHLVELVRRGGLKPEAILTEEEPMRDVLKAYETFDDQQKGWIKVELDPTAV

SEQ ID NO: 62134 - protein, 114 aa, Brassica napus
MASKNITIALFLTINLVFFGFTMAQAPGPQAPICRRSSTQVQACVNRLTSIVGLNVLPLTQCCSLVAGLAPSVASVCICNALKLSVLDILGIIVTLGQVLGSCGVSPPAGFICA

SEQ ID NO: 62135 - protein, 177 aa, Triticum aestivum
MQKQTGKSGGGGGSAAAKRGRPFGSTTGSGAAAAAAAAAVGDPAAPAALVGPSLHVLTALSDQNNKRIVLALQSGLKSEILWALNALTVLSFKEKDDLRRDTTPLAKVPGLLDALLQVIDDWRDIAMPRDHTKPPRVRTLGVNTTISGFGLENVGKVYSDSTTPPNDQSKIEGSTIT

SEQ ID NO: 62136 - protein, 507 aa, Prochlorococcus marinus str. AS9601
MPSTLSNPLRLGLRQERVISPQSLVIFGASGDLTHRKLIPALFELYLQRRIPSEFGIVGCARRPWTDYEFREKMKVKLSNQISGKEREWEQFSNYLFYEPVDLQESDHVVRLSRRLNEIDKTQATHGNRTFYLSVSPNFYASGCKALKGAGLLDNPKKSRLVIEKPFGRDYSSAKKLNKIVQSCAEESQIYRIDHYLGKETVQNILVLRFANTIFEPIWNRNYISSVQITSSETVGVEDRAGYYESSGALRDMLQNHMTQMLAVTAMEPPGKFEPEAIRNEKAKVLQASKLADENQPWNCCIRGQYGEGGNISNRLKGYRQEDGVNSNSTTETYIATKVFVDNWRWQGVPFYLRTGKRLPKRLGEIVLTFKDVPVHLFESTIINPAPNQLILRIQPNEGATFKFEVKSPGSGMKSRPVEMEFSYDESFGEPSDEGYVRLLADAMLSDPTLFTRSDEVEAAWKLYTPLIELMDNSPWKLPIYNYESMTWGPPESDQLISKDNIFWRRP

SEQ ID NO: 62137 - protein, 382 aa, Oryza sativa Indica Group
MAFFVKISAPCSLAGHGTTSSSSGSSRSKRGLLLPVGAGAGAGAYGGRQYSDVVPVPALSQAQASSSGGRLRIFSGTANPRLAQEVACYLGMELGRVKIKRFADGELYVQLQESVRGCDVFLVQPTCPPANENLMELLIMIDACRRASAKTITAVVPYFGYARADRKMRGGRESIAAKLVANLITEAGAHRVLACDLHSGQSIGYFDIPVDHVYGQPVILDYLASKTICPDEVVVVSPDVGGVARARTFAKKLSDAPLAIVDKRRQGHNQSEVVHLIGDVRGKVAVMVDDMIDTAGTVSQGAELLHREGARAVYACSTHAVLNPPAVDRLSSGLFQEVIVTNTVPVLHHRTFPQLTVLSVANLLGETIWRVHDDCSVSSIFQ

SEQ ID NO: 62138 - protein, 376 aa, Arabidopsis thaliana
MPMPNLPKELVEEILSFVPATYLKRLSATCKPWNRLIHNDKRFARKHYDNAAKEFLVFMMRKNFRIIRRGVNLHGADPSAEVKGELTLPDPYFKNSADEFHIDRVFHCDGLLLCTSKLERRMVVWNPLTGETKWIQTHEEGDNFFLGYSQEDKNISCKKSYKIMGFYRSGSKVWEYDFNSDSWRVLNGILPNWYFDKSYKCVSLKGNTYMLAGAVTDMGFDLSLQSYDFSTEKFAPVSLPVPSQARSLNGANRLSVVRGEKLALLYRRDKRSKAEIWVTNKIDDTTEGAVSWTKVLELDLSRELHALFTSNFLVDEEKKVFICCVSWKEDEDENKSNKVYIVGEDNIVKEIDSGEDATSGCEPTILSLYVPSLVYM

SEQ ID NO: 62139 - protein, 261 aa, Thermus thermophilus HB27
MRLAFVGLGKMGRSILKGALERGFLRPEEVGVLGRTPERSRELAEPFGVRPLTRADLGMAERVLIAVQPRDFPALAPEIAHHRLGYISIMAGISTSVLARRLDNRRVVRAMPNLAVVIGESSTALTALKEAREAEDLAFARALFATVGDVYEIPEHLFDAFTGMSASAPAYLAVVAEALADAGVKMGMPRALALRLAADALAATGELLKGRHPAQVKDEVASPGGTTIHGLHALEARAVRAAFYEAVEAATRRGHELGESE

SEQ ID NO: 62140 - protein, 331 aa, Prochlorococcus marinus str. AS9601
MTSFITAMQSKESNFNLTNSRLRLVSGTTNPKLAEEIASYLGIENVPLISKRFADGELYVQIQQSIRGCDVFLIQPTCAPVNDSLMELMIMIDACKRASARQITAVIPYFGYARADRKTSGRESITAKLTANLLEKSGVDRVLAMDLHSAQIQGYFDIPCDHIYGSPVLIDYLESLDLEEIVVVSPDVGGVARARAFAKLMNDAPLAIIDKRRSAHNIAESLTVIGEVKGKTAILIDDMIDTGGTICSGANLLKKEGANRIFACASHAVFSPPSYERLSSKNLFEQVIVTNSIPVKHKDNFPQLKVLSVANMLGEAIWRIHEESSVSSMFR

SEQ ID NO: 62141 - protein, 659 aa, Xylella fastidiosa Ann-1
MLHRIACSGRLWGGQWWFRWNAKTMIDSTCYPRLSRIQTPEDLRAFQESELPAVADELRNYLIESVGLSGGHFAAGLGVVELTIALHYLYCTPIDQLVWDVGHQTYPHKILTGRRDKISTVKHQGGLAPFPKREESIYDTFGVGHSSTSISAALGMAIVAQRNGDERKVVAIIGDGAMTAGMAYEALNHAGGMSPAPNLLVILNDNRMSISEAVGGLTKMLGRATGSKALNAIREGGKRIFGDKKTNATARFLRRWEEHWKGMFVPSTLFEEMGFHYTGPIDGHDLPALLGALKTLRTLKGPQLLHVITTKGKGYELAEGDQIGYHAVAPFDPQKGLIKAGAKKQTYTDVFSEWLCDMAAVEPRLLAITPAMREGSGLVRFSQEYPQRYFDVAIAEQHAITLAAGMATQGAKPVVAIYSTFLQRGYDQLVHDVALQKLDVLFAVDRGGVVGPDGATHAGNLDLSFLRCVPNMMLMAPADEAECRKMLSTGFHYSGPVAVRYPRGTGPGVVPSAELDVLPVGVAQLRHSGTRIALLGFGVCVAPAEQVGRRLGLTVVNMRFIKPLDRTLLLELARTHEVFVTIEDNVVAGGAGSGVAELLNAEGIVLPIVHLGLPDAFQQHASREDLLAEAGIDAAGVYAALLSRWPDLAVQNHPLSAVS

SEQ ID NO: 62142 - protein, 1340 aa, Aspergillus nidulans FGSC A4
MDRAIRWSPSSTPAEQRFLSVDVAGKVFRLCKVTSFTNSILSHSVLSTHTKVPAFRAFDWSPVDETLVAVGQSSGDATILRMREGDDSQESFSFPVRHQRYCNAIAFSTHGLLAAGLDRVRNDFCLNVWDVNQRLAMKGAKGHVEPLRKLASSEPITSVKFFRDQPDTLVTGVKGQFVRIYDLREGPGLPSLQFPTRCVHNLAIDWLDENYIASGLTSHDSTVCVWDRRVGARLSAAATPGLETGQMEPALEFKNVIAPKSAIWSLRFSRTKRGCLGVLSSNGHLKTYNIVKEYVVEEYRSPIDRTLGQNSVSNYPEQIYTKSVRDVFSPYDHPSRGYEVSQRVVSFDFLNMSSSNEPSVLTLSADDQVKIITVKPPPPPVRLSSQGTLICGRFDEHRDFKAIYPLGTEGSSIAQIAKSLRDNALERQEEQAETRGLRENPEQPLSSRENRERMLSVGTLGSPLTAEEALTLLTVNRLRCKEGYLFNGMRNKQILADDPSLQDFWDWIERARSYSADDSMIMNHLDLNYLGVFDVWTGDLGVSLEARWLGPSAAHYPDINDTIVDLVQEKLNLPSSESLHSRYPEQRRLGLRICGAAQSRRELEELVKTLSAESQHTKAAALAVFQGEPKLAYLALRSHTPTQAHKLLAMAIAGAAKEKPDPDWEETCAEIAKELTDPYARAIIAFVSKGDWRSVIQETTLPLKYRVEVALRWLPDDDLTTYLTETTKRAIQQGNIEGIVLTGLGHSAMELFQSYINKFNDVQTPVLAMSHTVPRLVNTPANKHRFETWRETYRWQINSWKLQLERARFDVGSRKFAATWDGRRLVEPPRQQVSLTCNYCTRPLTQHDASSQLSPSTSGEVVHATPGNPLGSAAMSGSPDPMSKACVAAETATATDQRKLSEAEFMRRFIVFCINCNHGFHAHHAREWFDKHNLLDFHQPLLATLEIFKIKLNLNRIFSHHLLHLPRRVLRDNFNPAQPLHTLRPPQPPIMPNSGPSAEKRKEGGGKGGGKGGRGRERKPPSREVTVSKALSLLLRHAAEREGLKIDSQGYANVADVLAWRKLKSLKVTFPEIISAVETSDKKRFALLYQPPSEQTDTLPTKVEEPASAQDEPITATSTGTATATTAALAASKTDQTPAHYLIRATQGHSIKTVEAESGLLERLTLDNPDKLPETVVHGTYHSTWPLILESGGVKCMGRNHAHFATGPAVQDVLSAIDSSVSRGEEGDEKSGSGAGSHGMVISGMRADAAVLIYIDIRRALAGGCPFWRSENGVILSEGMEVNVATGTGTEKGVIPVEYFDVVVERRKGLGKIWEGGKMLRSEQCNTDLANYFDGRATKR

SEQ ID NO: 62143 - protein, 227 aa, Polaromonas sp. JS666
MTEATRIIAIRHGETTWNVDARIQGHLDIPLNDTGHGQARRMAQALVDEPITAIYTSDLSRAWETAQHLAGALGVEVIREPGLRERCFGEFEGKTFAEIEVLLPEQSLRWRKRDPEFAPPGGESLLDLRRRVVGTAERLAAEHPGELIALVGHGGVMDILYRAATRLDIQAPRTWALDNTAINRLLWTPEGFTLVGWADTQHLNGDAPHDNRFTDDAAPAPGTTHTQ

SEQ ID NO: 62144 - protein, 104 aa, Triticum aestivum
MAMANNPTKSGHYAQNKGRSLPKFGEWDVKNPATADGFTVIFQRARDDKKTTAGPGRPGIPPAFRNADGRYGTIKTGNGYPYARVATPKRSKKKSWFSCTSCRF

SEQ ID NO: 62145 - protein, 251 aa, Chlamydomonas reinhardtii
MADKPIAAALQDVLSRMKQATERANRTHPVRLVAVSKTKPAEALQEAYDAGQRVFGENYVQARCEMLDKAPALPGDVQWHFIGHLQSNKVKAVLEGVPNLAMVETVDSAKLADKLNKTLETVSGRTAPLAVMVQVNTSGEESKYGVEPTECVSLAKHIAQNCPKLRLAGLMTIGMPDYSSRPECFICLSGCRDAVATELGLRPEQLELSMGMSGDFEQAIEMGSTNIRVGSTIFGAREYKPKSPPASPKKE

SEQ ID NO: 62146 - protein, 290 aa, Lactobacillus rhamnosus
MKGIILAGGSGTRLYPITEAISKQLVPVYDKPMIYYPLSTMMLAGIRDILVISTPRDIDRFEDLLKDGKQLGLNISYKVQDKPNGLAEAFIVGADFIGDDSVCLILGDNIFYGSGLSKLVQRSAAKTTGATVFGYQVNDPERFGVVAFDKQHHVQSIVEKPEHPESNFAVTGMYFYDNQVVEIAKNLKPSPRGELEITDVNKAYLERGQLDVELLGRGFAWLDTGTHESLHEAASFIETVQKRQNLKIACLEEVAYRMGYIDRDQLRELAQPLKKNDYGQYILRLADEEA

SEQ ID NO: 62147 - protein, 187 aa, Mesorhizobium loti
MAQERREGGRGREREERDDGMVDKLVHINRVAKVVKGGRRFGFAALVVVGDQKGRVGFGHGKAREVPEAIRKATESAKRDMIFVPLRSGRTLHHDVEGRWGAGRVLLRAAKQGTGIIAGGPMRAVFETLGMHDVVAKSMGSSNPYNMVRATFDALKSQMHPKDVAAARGIKYSTLQARRGTAVAAEE

SEQ ID NO: 62148 - protein, 264 aa, Gibberella zeae PH-1
MAAMFSQNPLMNGPNYSFSEAPKTNHGEFREHRFNPYTDNGGSTLAIAGADFTIMAGDTRHTSGYSINSRMSPKVFRIGGTTASQEDATLVLSVVGFAADGEALRDHLDTICKIYRYRHGKPMSVNACAKRLSTVLYGKRFFPYYSHAMLGGLDEEGRGAVYSYDPVGSYEREQCRAGGAAGSLIMPFLDNQVNFKNQYIPGSGEGHELKERERRPLTRTEVETVVKDAFDGAVERHIEVGDNLQMLIITADGIEETFLPLKKD

SEQ ID NO: 62149 - protein, 358 aa, Haemophilus somnus 2336
MKSYTIAVLSGDGIGPEIMAEAIKVLDAVQKKYNFKLNYRTFDVGGIAIDNHGTPLPASTLNGCEESDAILFGSVGGPKWEHLPPNQQPERGALLPLRKHFKLFCNLRPAILYQGLEKFCPLRADIAAKGFDMMTVRELTGGIYFGQPKGRDGEGMQTRAFDTEVYYKYEIERIAKVAFETAMKRRKHVTSVDKANVLISSVLWRETVNEVAKNYPDVTLDHIYIDNATMQLIKQPEFFDVLLCSNIFGDIISDEAAIITGSMGMLPSASLNEHGFGLYEPAGGSAPDIAGKGIANPIAQILSAAMMLRYSFNLNEEADSIENAVKQVLSQGYRTADLADEHPPISTAEMGNLIANAI

SEQ ID NO: 62150 - protein, 87 aa, Zea mays
MAMRALYNEIRAMKVRDVPAYLKPRLTWENVKKSTDQAVDRYIEKYIETSSVDPLFHVCFGGMAFAYLVGLPQERRHLEHLEKHGGH

SEQ ID NO: 62151 - protein, 97 aa, Oryza sativa
  misc_feature (18)..(18): Xaa can be any naturally occurring amino acid
SLSLLLPSVSAYEIGQLXSIYEHRIPVQGFLWGINSFDQWGVELGKSLASQVRKSLHASRMEGKPVQGFNSSTASLLTRYLAVEPSTPYNTTTMPKV

SEQ ID NO: 62152 - protein, 192 aa, Bartonella quintana str. Toulouse
MFIQTETTPNPATLKFLPGRVVLSKGVLEFRNSEEAAKNSPLAAKLFNIPNVNGVLLGYDFITVSKKDGEWQHLKPAILGTIMEHFLSDAPVIKTNATIQAQTHALNEEFYDEKDVDIVSTIKELLETRVRPAVANDGGDITFCGFENGIVYLNMRGACAGCPSSTATLKTGIENLLRHFIPEVLGVEAMPQ

SEQ ID NO: 62153 - protein, 145 aa, Haemophilus somnus 2336
MERPMTLEQTLAIIKPDAVERNLIGNIISRLEDKGFQIIAMKMLHLNQEQAEGFYAEHRNKAFFTELVKYMTSAPIVVLVLQKENAVKDYRTFMGTTNPEIAENGTLRYEFAINQTQNSVHGSDSLENAQREIAYFFAEAEIYAR

SEQ ID NO: 62154 - protein, 698 aa, Synechocystis sp. PCC 6803
MDGLFAPIPSNPLIDFTILLLVTLILPPIFERLKLPGLVGLLFAGIVLGKSGLGVLNEDSESIKLFTDIGKIYLMFVAGLEIDMVDFRRTRNRSLLYGSLTFAVPLLTGLAVGLTFGYSFNASVLLGSLFASHTLLGYPIVQRLGIVRNQAVMVTIGATIFTDIAALLVLAICISIHSGSFSPAGLVVQLVAIAVYSALVLIGFDWAGREYFRRTGDEQSNQFLFVLLAVFLASVGSELINVDKIVGAFLAGLAVNDVLGNSPVKEKVEFLGTTLFIPFFFIGIGLLLDLPAFLVTLTTLFPLVVAIVVGLILSKGVAAILAQWKLGYTWVEGLTMWSLSIPQVAATLAAAVAGYQAVNAAGDRLVSETVLNTIIVLMLITSIVGPLMTAKFAPKIPIPNTLSSLTEDLDDPEENGAVTLIPPKASTFTVLVPTQNPQTLSYLLEMGALIARHESGVVIPLAIAKAPVHMDDPGLTSRLARNELLLQQATELATNLKVDAHPALRIDDDVARAISHTAREKNADLIIMGWSQQTLGLRAKLFGSTIDSVFWSAHCPVAVMRLLSDPRSFHRILFPIKNLTPQTLELFQFTQRLAETNGAIVTLLHVCPHNTSPQQVQAFKTEMERFLNQCRATADYPIKVICHDDAAKVLVRVSHTFDLVVLRSFRRRSVGGVALGEVTDKILREITSSFVLFGDPYA

SEQ ID NO: 62155 - protein, 715 aa, Oceanobacter sp. RED65
MTDAIRFEKDSDNIVTLTMDMPGQSANTMNADFRESILAIADRLESEKDSISGVIYASAKDTFFAGGDLKELIAVTKDDAEEFFNMVEKIKAPLRKIETLGVPVVAAINGAALGGGFEICLASHHRIALNNPKLKVGLPEVTLGLLPGGGGVARMVRLIGLEAAFPFLMEGKQVNPQKALKAGLIHEIAENQDDLMVKAKAWIKANPKSTQPWDVKGYKLPGGAPSHPAVAQKLAIAPSVLRQKTKGCYPAPEKILAAAVEGAQVTFDEACTIESRYFTELTTSQIAKNMIGTFWFQLNEIKAGGSRPSGIDKQVTKKVGILGAGMMGAGIAYSTAMSGIDVVLKDVSMEAAEKGKSYSEGLLKKRISRKQMSEEKAKTILDRILPSDKAEDLDGCDLIIEAVFENRELKAKVTQEAEVFMSKDGVFASNTSTLPISGLAIASKAQEKFIGLHFFSPVDKMPLVEIIMGEKTNDETLAKAFDYVLQINKTPIVVNDSRGFFTSRTFGTFVNEGLRMLAEGIEPQFIESAALQAGMPVGPLAVQDEVSLTLTRKVTRQTREDLRAEGSDLEVTPAESLTDRMIDDFKREGKAAGAGFYDYPAKGKKQLWPGLREHFVKADVSIEFEEAKERLLFVQAIETLRCYEEKVLTSVRDANIGSIFGIGFAPWTGGAIQYVNQYGVRNFYQRAKELANTYGDRFTPPSILEAQAEKDEAFV

SEQ ID NO: 62156 - protein, 388 aa, Colwellia psychrerythraea 34H
MKIAIAGTGYVGLSNAMLLAQHNEVIAVDIIAEKIELLNSGKSPIEDTEISDFLANRELNFTATLDKEAAYAGADYVIIATPTDYDPETNYFNTASVESVIKDVMAINPSACMVIKSTVPVGYTARIREELGCEGLIFSPEFLREGKALHDNLYPSRVIVGEDSDRARKFAGLLTEGAWKENIDVLFIRSTEAEAVKLFSNTYLAMRVSYFNELDTYAEVHDLDSRHIIEGVSLDPRIGNHYNNPSFGYGGYCLPKDTKQLRANYKDVPNNIISAIVDANSTRKDFVADSIIARSPKVVGIYRLIMKAGSDNFRASSIQGIMKRIKAKGIDVVIYEPVMEEDEFYHSKVIKSLSEFKAMSNVIVSNRMVDELIDVVDKVYTRDLFGSD

SEQ ID NO: 62157 - protein, 246 aa, Zea mays
  misc_feature (208)..(208): Xaa can be any naturally occurring amino acid
  misc_feature (214)..(214): Xaa can be any naturally occurring amino acid
  misc_feature (238)..(238): Xaa can be any naturally occurring amino acid
PAGSGPKDGTYDYEAASSIFFPAQTIQNACGTQAIVSLLLNREEEIDIGKELREFKEFAGDFPPDLRGETLSNSDLIRETHNSFARSSPFIDETQRTATEDDDVFHFIAYTSINNKLYELDGLQPAPISHGPCTSSEFPQKIIPVLQRRIARYPATEIRFNLMACCRDLRIRAREIGDEEELEEQEDKRARWLWENSLRRHNFVGFVXELLKSXVRAKLDQGGDAYDKWVEGGQGKSXQRREGLRN

SEQ ID NO: 62158 - protein, 432 aa, Thermus thermophilus HB27
MKPSVRTPLPGPKAWALLERGERVLSPSYVRPYPFVPARGQGAFLEDVDGNLFLDFMSGIAVNTTGYAHPKVVEAVRAQAERFAHVCFSDFTHEPTLSLAERLVGKLGGGYRVFFGNSGTEGVEAAIKLVRYHTRRPYLLAFTGAFHGRSLGALSLTASKSAYRQGFAPFLPGVVHLPFPNPFRPPLGARPEEAGDAVLDHLEHLFQTVLPPEEVAALFLEPIQGEGGYVVPPPGFIPRLKEVLDRFGILLVADEVQTGAGRTGRFFALEHEGVQADVYVLAKGLASGYPISAVLFREELGSWPPGAHGTTFGGQAVAAAAAHATLDLLEGGLQENAARLGEFLLAELRALKRRFPFLGDVRGRGLMIGLDFGDPDHPQPDLRDKAVRLAFEKGLLLLPAGPSALRIAPPLVLTQEEAALGLEILEEVFRAL

SEQ ID NO: 62159 - protein, 608 aa, Lactobacillus sakei subsp. sakei 23K
MTFSLESRQQAIQNLKNEQLDLLIIGGGITGAGVAIQSAASGIKTGLIEMQDFAEGTSSRSTKLVHGGIRYLKTFDVGVVADTVSERAVVQGIAPHIPRPTPMLLPIYDEPEATYDMFSVKIAMDLYDKLAGVTGTQYANYTIDRKEVLQREPGLKSDRLMGAGVYLDFVNNDARLVIENIKEADELGATVASHVKAVGMTYDANGRVNGLKAHDELTDETFDIHAKLVINTAGPWVDKVNALNTEVKAQETLRPTKGIHLVVDSSRLSVPQPTYFDSGLHDGRMIFVVPREGKTYFGTTDTDYTGDYKHPRVEQTDVDYLLKAINNRYPSVDIALNDIEASWAGLRPLISNNGSSDYNGGGANSGKVSEESFNNLIKTVDDYENKTAARADVEKAISQLRTAHAEETVNPSQVSRGSSLKVAENGLMTLSGGKITDYRKMAAGALEMIRDILKKDFNETVREIDSKKLQVSGGHFDPNNVEETLKFYTKVAMSKGISEDDATDLANRFGSNVSRVVSYADQGTADGLNLKETISLRYSVNEEMTLTPVDYLLRRTNFVLFHNDQLAAIKQPVINEMARLLNWDAAEKERQTAQLDAAIAEAQLDYLK

SEQ ID NO: 62160 - protein, 723 aa, Aspergillus nidulans FGSC A4
MATVDPEIVPFPEAPTSASPSSSADQIPLQQAQKVKGRHRLLQGLQRFSSSPSLTRRNRSRSASTTYRQNGASLSCVSLSQSAYAPCSSNGSATQLYGGLNIRPTTPGPTGSHAADDQEGNARIRFVADTINGPQPKKIALPTEMRPGSRGAVLEDTALIAKPKQFDFWGKMPNELGMLIFSYLTPKEIIRCSTVCKWWHRMCYDGQLWTVIDTTDYYSDISCDALMKLIMSGGPFIKDLNLRGCVQLRERWENEIDEITAVCRNVVNFSLEGSRMDKYPVHSFIGRNQRLQYVNLAGLDSVTNATMKIIAKSCHQLRTLNVSWCTNVTATGLKRVVKACPILADLLASEILGFDEVELSSELFKRNTLERLDISRTDITDESLKVLMHGIDPEIDILEERAIVPPRRLKHLDLHQCSELTDDGVKTLAHNVPHLVGLQLSGCPELTDNSIVPVIQTVPHLTHLELEELEHLSNRTLLELAKSPCAPFIEHINISSCESLSDPGMLQVMKSCPSLRFVEMDNTRISDLTLSEASYRVRKRGYDETLPQIGLRIVAFDCPNVTWVGVRDILAGNAYIPRQYKVPVPEAVSVINQALNSSKTSGSASEPLKPMISSSITPPPPPTVYPNHIIQLKCFYGWQATVEEHTKRVLRGDLAAANRLEKKWFDYMVATEEAGLGGAGARRRRRRAREAERIYNEDDEEEPYFGLLGGRRRARSGGSCVVM

SEQ ID NO: 62161 - protein, 426 aa, Mycobacterium smegmatis str. MC2 155
MPADTAIHFFLQLAVILMACRLAGLVARRIGQAQVVGEMIAGVILGPSLLGRIAPDLQGLLFPPGITNVVLYTTAQIGLVLYMFIIGLNFDVNHVKQRAGTAAAVSATGTLAPLALGGVAAIPLLAHGGFFGDGVNVGMAMMFLGASVAITAFPMLARIIFEKRLSGTSLGTLALACGATSDAISWCILAVVLAVYRNSPVMAVVAIVGGLVYTLVLLTLGRRAFAKLGDAAEARQAITAPMLSTVLIVLMACAWLTDTIGIYAIFGAFILGAAMPSGFFAERLTGRLEPLTTTFLLPLFFVYSGLNTEIGLVNTPFLWAVTAGLLVVAVVGKGVACAVAARLSRVPVRDSLALGSLMNARGLIELILLNIGLEAGVITPTLFTILVLVAIVTTLMASPIFEFVYGRHRTDETGDTTQERVPQPSA

SEQ ID NO: 62162 - protein, 248 aa, Alkaliphilus metalliredigens QYMF
MLKLQGKVAFVTGGSRGIGKAIALKLARCGSNVVINFTSNEEAAQAVVKEIEALGVRALALKGNVASAEDVKFMLESFEQQFESIDILVNNAGITRDNLLIRMKESDWDSVMEVNLKGVFLCTKAFARKMIKQKKGKIINISSVVGVSGNAGQSNYSASKAGVIGFTKSMAKELASKGINVNAVAPGFIETDMTAVLGESVKEGLIEGIPLKRYGRPEDIANLVAFLSSEEAHYITGQVIHVDGGMNI

SEQ ID NO: 62163 - protein, 261 aa, Xylella fastidiosa Ann-1
MTALSVKHAADPIRGLQTLTVEDIRSNLTKVYSRIIAACQRVNRDPSSVTLLPVSKTVDEVHIRLSYEAGCRKLGENKAQDAYHKWEAMSDLTDLHWSVIGHLQTNKAKLVARFASEFQALDSLRVAEVLERRLQIEGRSLDVLIQVNTSGETNKYGLPPEEVVRFVQALSAYPALRVRGLMTLALLSGDTSRVRQCFTQLRILRDRIQQASPQGHHITELSMGMSGDLEIAIEEGATVVRVGQAIYGARALPNLHLHHTV

SEQ ID NO: 62164 - protein, 684 aa, Aspergillus nidulans FGSC A4
MLEGTYPLAFLLFEDLNRKQWPDKISEARSTYVALKEHFLKYIEHPNDLQSSIDPLADDEQSPWQTLRQDEQLRAEISQDVDRCLQENLFFHDPATKAKMIDILFIYSKLNPDLGYRQGMHELLAPILWVVDRDAIDPKSREQFIPTGQLENSMLQLLDSEFIEHDAFSLFCSVMQSTRVYYEHNTHRSMNGQADALPIVLRYLELADHLQALEILPQIFLTRWMRLLFGREFPFQDMLAIWDLLFAEGLRSELIDFVCVAMLLRVRWELLSSDSSSALTTLLRYPSPHPHAPLSFVHDGLYLEQNPTAERGSFIISKYSGKPPELLRMSDSAHRFRPGRRFQFRGDVRGNSGTSSPTTSSARDSPLSIEALLQDVSEGIQRRTEIWGVAKAVRGAVSEAKKNMQSMQSEQVSRLASTRNSVPSTTSYREPEATTQLKSRIEGIWERNRGLAKSLGEAVNEIRSQLADSVTLNADTAKSVEQALTKVESVQTTLETRYSDANITQNSPGVEEPTNRTKQSDNSATADGGSTSLENDKPPRASFDSSVINTPGSRSPIESDTGQRNILSPKPVNKARPLRNPARPLLANSEFAWMLGGDRQLSSFVSPASVPPEQSRHVEPRAKQGTLFGNGEVEQKPNPEPDGLAMKSLRGTKGSGNEAKLMLLDSIRFFFRPRVTMASQGIYT

SEQ ID NO: 62165 - protein, 374 aa, Chlamydomonas reinhardtii
MAAMMQKSAFTGSAVSSKSGVRAKAARAVVDVRAEKKIRVAINGFGRIGRNFLRCWHGRQNTLLDVVAINDSGGVKQASHLLKYDSTLGTFAADVKIVDDSHISVDGKQIKIVSSRDPLQLPWKEMNIDLVIEGTGVFIDKVGAGKHIQAGASKVLITAPAKDKDIPTFVVGVNEGDYKHEYPIISNASCTTNCLAPFVKVLEQKFGIVKGTMTTTHSYTGDQRLLDASHRDLRRARAAALNIVPTTTGAAKAVSLVLPSLKGKLNGIALRVPTPTVSVVDLVVQVEKKTFAEEVNAAFREAANGPMKGVLHVEDAPLVSIDFKCTDQSTSIDASLTMVMGDDMVKVVAWYDNEWGYSQRVVDLAEVTAKKWVA

SEQ ID NO: 62166 - protein, 330 aa, Campylobacter jejuni
MMMKILISGGAGYIGSHTLRQFLKTDHEICVLDNLSKGSKIAIEDLQKIRTFKFFEQDLSDFQGVKALFEREKFDAIVHFAASIEVFESMQNPLKYYMNNTVNTTNLIETCLQTGVNKFIFSSTAATYGEPQTPVVSETSPLAPINPYGRSKLMSEEVLRDASMANPEFKHCILRYFNVAGACMDYTLGQRYPKATLLIKVAAECAAEKRNKLFIFGDDYDTKDGTCIRDFIHVDDISSAHLSALDYLKENESNVFNVGYGHGFSVKEVIEAMKKVSGVDFKVELAPRRAGDPSVLISDASKIRNLTSWQPKYDDLGLICKSAFDWEKQC

SEQ ID NO: 62167 - protein, 139 aa, Thermoanaerobacter tengcongensis MB4
MIFMEVTLAIVKPDGVKRGLIGEILKRYENKGLRLKAAKVVTPSIELLEKHYEEHKGKPFFKPLIEYMSSGPVFAMVLEGENAVKLVRMINGATKVEDALPGTIRGDFASSTTYNVVHGSDSVESAKREIALWFPELIL

SEQ ID NO: 62168 - protein, 130 aa, Triticum aestivum
MDQYEVLEQIGKGAFGSALLVRHKVEKKKYVLKKIRLARQTDRTRRSAHQEMQLIATVRNPFIVEYKDSWVEKGCYVCIVIGYCQGGDMSEAIKRTNGTYFSEEKLCKWLVQLLMALDYLHTNHILHRDV

SEQ ID NO: 62169 - protein, 373 aa, Staphylococcus epidermidis RP62A
MAKRDYYEVLGVNKSASKDEIKKAYRKLSKKYHPDINKEEGADEKFKEISEAYEVLSDENKRVNYDQFGHDGPQGGFGSQGFGGSDFGGFEDIFSSFFGGGSRQRDPNAPRKGDDLQYTMTITFEEAVFGTKKEISIKKDVTCHTCNGDGAKPGTSKKTCSYCNGAGRVSVEQNTILGRVRTEQVCPKCEGSGQEFEEPCPTCKGKGTENKTVKLEVTVPEGVDNEQQVRLAGEGSPGVNGGPHGDLYVVFRVKPSNTFERDGDDIYYNLDISFSQAALGDEIKIPTLKSNVVLTIPAGTQTGKQFRLKDKGVKNVHGYGYGDLFVNIKVVTPTKLNDRQKELLKEFAEINGENINEQSSNFKDRAKRFFKGE

SEQ ID NO: 62170 - protein, 550 aa, Rhodopseudomonas palustris CGA009
MQAVAGRFTQNQRGDVEAKFQIFLTLLAVLAGTALLARRVNIAPAILLLIAGITLAFIPGMPAIELPPDLILLLVLPPLIYSASVAMSWREFCANLRAIGLLAIGCVIFTACAVAAASHYLIGLPWSVGFLLGAIVAPPDVVAPLAIARKLGLPRRIVVVLEGEGLANDATALILYRFAVAAIMTGAFSLTKASGTFVAIMAGELAFGVAVGWLSLRARHWVRDPQIEITLSLLTPYIAYWIPEHHGGSGVIATVACGLYISWNGPLLISAATRLQGIFFWDLVIYLIEGMLFLLTGFQLRALLERSKEFAFGDILSATLLVAAIVIAARFIWVYPAFYLPRFLSRRLRASDPYPSWRTVFVIGFTGVRGAVSLAAALALPYALPGGETFPYRDLILFVTFGVILITLVGLGLTLPAVVKLLGVTRVGHREQIAEHDDEITARREALAAAQASLKKITDNRELTDEVLKLLHARHQTRASLLPDPIGSPEHEASAVGIALVRELIAVERKFIHAQLRAGKITDEARRRIERDLDLEEASLANRESGPAPL

SEQ ID NO: 62171 - protein, 346 aa, Rhodococcus ruber
MKALQYTEIGSEPVVVDVPTPAPGPGEILLKVTAAGLCHSDIFVMDMPAEQYIYGLPLTLGHEGVGTVAELGAGVTGFETGDAVAVYGPWGCGACHACARGRENYCTRAAELGITPPGLGSPGSMAEYMIVDSARHLVPIGDLDPVAAVPLTDAGLTPYHAISRVLPLLGPGSTAVVIGVGGLGHVGIQILRAVSAARVIAVDLDDDRLALAREVGADAAVKSGAGAADAIRELTGGEGATAVFDFVGAQSTIDTAQQVVAIDGHISVVGIHAGAHAKVGFFMIPFGASVVTPYWGTRSELMDVVDLARAGRLDIHTETFTLDEGPTAYRRLREGSIRGRGVVVPG

SEQ ID NO: 62172 - protein, 669 aa, Saccharomyces cerevisiae
MNQQLAEMQQIRNTVYELELTHRKMKDAYEEEIKHLKLGLEQRDHQIASLTVQQQRQQQQQQQVQQHLQQQQQQLAAASASVPVAQQPPATTSATATPAANTTTGSPSAFPVQASRPNLVGSQLPTTTLPVVSSNAQQQLPQQQLQQQQLQQQQPPPQVSVAPLSNTAINGSPTSKETTTLPSVKAPESTLKETEPENNNTSKINDTGSATTATTTTATETEIKPKEEDATPASLHQDHYLVPYNQRANHSKPIPPFLLDLDSQSVPDALKKQTNDYYILYNPALPREIDVELHKSLDHTSVVCCVKFSNDGEYLATGCNKTTQVYRVSDGSLVARLSDDSAANNHRNSITENNTTTSTDNNTMTTTTTTTITTTAMTSAAELAKDVENLNTSSSPSSDLYIRSVCFSPDGKFLATGAEDRLIRIWDIENRKIVMILQGHEQDIYSLDYFPSGDKLVSGSGDRTVRIWDLRTGQCSLTLSIEDGVTTVAVSPGDGKYIAAGSLDRAVRVWDSETGFLVERLDSENESGTGHKDSVYSVVFTRDGQSVVSGSLDRSVKLWNLQNANNKSDSKTPNSGTCEVTYIGHKDFVLSVATTQNDEYILSGSKDRGVLFWDKKSGNPLLMLQGHRNSVISVAVANGSPLGPEYNVFATGSGDCKARIWKYKKIAPN

SEQ ID NO: 62173 - protein, 200 aa, Pasteurella multocida subsp. multocida str. Pm70
MVLVTRQAPDFTAAAVLGNGEIVDNFNFKQHIAGKAAVVFFYPLDFTFVCPSELIAFDHRYEEFQKRGVEVVGISIDSEFSHNAWRKTPVENGGIGEVKYALVADIKHEIAQAFGIEHPEAGVALRASFLIDKDGVVRHQVVNDLPLGRNIDEMLRMVDALQFHEEHGDVCPAQWEKGKEGMTGSPEGVAKYLKQHADQL

SEQ ID NO: 62174 - protein, 341 aa, Zea mays
MAIGVPSMELHRSSPLLSGGRGGNTCLQKKPFFVQAKRLVGMEKASTRPGTQESGQTKKRAPLVRGTVSPPLPVPGNIPRPPYVGTEYVPEIAKEIQMHDKEGIVHMRAACELAARVLDYAGTLVKPSVTTDEIDKAVHKMIIDAGAYPSPLGYGGFPKSVCTSVNECMCHGIPDSRELQDGDIINIDVTVYLNGYHGDTSKTFLCGEVDEASKRLVKVTEECLLRGISTCKHGTSFKKIGRRISEHAERNGFGVVECFVGHGVGRVFHSEPIIYHQRNNRPGQMIEGQTFTIEPIISMGSIECDMWDDGWTAVTTDGSLAAQFEHTILITRTGAEILTKC

SEQ ID NO: 62175 - protein, 132 aa, Waddlia chondrophila
IKYELDKETGLLKIDRPQKFSSVCPTLYGFVPRTYAGNLSAAHCMEKTGLKGIKGDGDPIDICVLTEKMIPRGDIMLRAIPIGGFRMIDGNEADDKLISVLVDDFVYGGMKDLSDCPPALIERLRHYFHTYK

SEQ ID NO: 62176 - protein, 200 aa, Glycine max
CHELLFLLSRLLDIMNTMIREVPIKNPVHLMLGASFGSPTKGTGLTTLEFALSMCDSLDIYRFTVNPSYKEWTRYFSESRQGHTPLHGRAYYQMMECLGLIKIHSPMRADLNRVVKWVPSHHIIRAARIASEKLLRRVGAGSEDPLAACSIIKKQVKRNLNAVSKLRKAALDHLRYVKRTTMYPLEHSPGHGSLCTVPTD

SEQ ID NO: 62177 - protein, 506 aa, Colwellia psychrerythraea 34H
MIYANPGSEGSVVSFKPKYENFIGGKWVAPVKGNYFTNTTPVTGEAICEIPRSSAEDIELALDAAHAAKTAWGKTSVQDRSNILLKIADRIEANLELIAVAETWDNGKPVRETLNADIPLTVDHFRYYAGCIRAQEGTLSQIDDDTVAYHFHEPIGVVGQIIPWNFPMLMAAWKLAPALAAGNCIILKPAEQTPASILVFMELIADLLPDGVLNIVNGYGKEAGEALATSTRIGKIAFTGSTPVGQHILKCAAENLIPSTVELGGKSPNIFFSDITQFEDDYLDKCAEGFALGFFNQGEVCTCPSRALVQEDIFDVFMEKVLEKTKNIVRGNPLDVNTMVGAQASKEQYDKIQGYLQIGKDEGAVVLSGGSAESLEGSLETGYYIQPTILKGNNSMRVFQEEIFGPVISVTTFKDAEEALQIANDTAFGLGAGVWTRDANLAHRMGRGIESGRVWTNCYHLYPAHAAFGGYKKSGIGRETHKMMLDHYQQTKNLLVSYSTSPLGFF

SEQ ID NO: 62178 - protein, 456 aa, Gibberella zeae PH-1
MVRNIVVLGGNSHPQLTENVCHILGVPASNRILGKFSGGESRCEIKDSVRGKDVYIIQSGSGNVNDNLIDLCIMISACKTGSAKRVTAVVPLFPYSRQPDWPYNKAGAPLSQISGASKDYTFESVPPTPRPGGPKSAGLPNGVNNLTEKLSKTAEVANGVNGTNGHPTPRRSDTISSTTSENRGHHPENSTSSQRNAYTTHDYENQSNISVFQPKPGYKQWIAQAGTLVADLLTCAGADHIITMDLHDPQYQGFFDIPVDNLYGKALLQNYIQTNIQGHQNAVIVSPDAGGAKRATLIADSLKTDFALIHKVIPTTDLSHDDQSSFNASKERRPIRFTEHRNASMMLVGDVSNRICILVDDIIDTGNTITRAAKLLKKEGATKVYALVTHGVFSGDSIARINASSIDKMLVTNSVPQEEHRRLCPKLEVLDISPVFAEAIRRVHHGESISVLFQHN

SEQ ID NO: 62179 - protein, 448 aa, Pseudomonas putida KT2440
MNQAQTNVGKSLDVQSFINQQPLSRYQWRVVLLCFLIVFLDGLDTAAMGFIAPALSQEWGIDRASLGPVMSAALIGMVFGALGSGPLADRFGRKGVLVGAVLVFGGFSLASAYATNVDQLLVLRFLTGLGLGAGMPNATTLLSEYTPERLKSLLVTSMFCGFNLGMAGGGFISAKMIPAYGWHSLLVIGGVLPLLLALVLMIWLPESARFLVVRNRGTDKVRKTLSPIAPQVVAEAGSFSVPEQKAVAARNVFAVIFSGTYGLGTVLLWLTYFMGLVIVYLLTSWLPTLMRDSGASMEQAAFIGALFQFGGVLSAVGVGWAMDRFNPHKVIGIFYLLAGVFAYAVGQSLGNITLLATLVLVAGMCVNGAQSAMPSLAARFYPTQGRATGVSWMLGIGRFGAILGAWSGATLLGLGWSFEQVLTALLVPAALATVGVVVKGLVSHADAT

SEQ ID NO: 62180 - protein, 178 aa, Triticum aestivum
MAPAVMASSATTVAPFQGLKSTAGLPVSRRSSGSLGSVSNGGRIRCMQVWPIEGIKKFETLSYLPPLSTEALLKQVDYLIRSKWVPCLEFSKVGFVFREHNSSPGYYDGRYWTMWKLPMFGCTDATQVLNEVEEVKKEYPDAYVRVIGFDNLRQVQCVSFIAFKPTGCEESWKALTTS

SEQ ID NO: 62181 - protein, 275 aa, Mycobacterium smegmatis str. MC2 155
MSPRITLNDGNSIPQVGLGVWQTPAEDTERAVAAALQAGYRHIDTAAAYRNETETGRAIANSGVPREDIFLVTKLWNSDQGYDATLAAFDASVQRLGVDYLDLYLIHWPVPENNKFVDTFKAFAHLRDQGRIRSIGVSNFEPEHLTTLIEETGIVPAVNQIELHPLLPQQELRDVHAKLGIATEAWSPLGQGSLLADPVITGIAEQHGKTPAQVLIRWHIQLGNIVIPKSVNPERIASNFDVFDFELSGQDITSIASLETGKRLGPDPRTFNFTG

SEQ ID NO: 62182 - protein, 525 aa, Oryza sativa
MALLRAHHLLLMRPRAAFSSRPPPLSSSPCRRALPTTAIASRLLCSHHASSPPEDASASASPSIVADLLDYLNESWTQFHATAEAKRQLLDAGFTLLSENDDWDLQPGGRYFFTRNMSCLIAFAVGEKYKLGNGFNIIAAHTDSPCLKLKPRSASFKSGHQMVNVQTYGGGLWHTWFDRDLTLAGRVILKDADGSFKHELVKVSRPLIRVPTLAIHLDRTVNSDGFKPNLENHLVPLLATKHEETTANSSEKNSSSSTKVVHHPLLLQVLSDEIGCKSGEIIGIELNVCDTQPSCLGGGNNEFIYSGRLDNLASCYCALRSLMDSSKMPEELSNEKAIRMIALFDNEEVGSNSMQGAGAPTMFHAMRRIVDSLMHQSMGEGALERAINSSFLVSADMAHALHPNYPDKHEEHHRPELQKGLVIKHNANQRYATSAVTAFLFKEIARLHNLPVQEFVVRNDMGCGSTIGPILASGVGIRTVDCGIPQLSMHSVREMCGKEDVDTTYKHFKALFEMFSDIDRKLNVD

SEQ ID NO: 62183 - protein, 357 aa, Aspergillus nidulans FGSC A4
MPGQIMRAVVFKGPYKVAVEERPIPKIQNPEDIIIKATYTALCGSDLHVYRGIEPAGTGFVMGHEVTGEVVEVGDAVKTVQRGDLVVSAFTTSWISGTCFYCEQGFSSRCDENTLLGCDDLDGAQAEYVRIPHADGTVVKAPSGVSPQYLVLMGDIFPTGYFAAQNAFKNATAAQIAEQTVVIIGCGPVGLCALINALEYKPKHLLAVDCVPSRLDLAKSLGAEPWDFKNDREALDRRVSELTNGRGADAVIEVVGMSPALRMGFELLRPWGVISSVGVHNGEIPWTGSEAYGKNVTVQMGRCPVRSVSDAALEVLKKNQHLLGFMTENIMPLSQAAEAYDLFNAMKVQKVIFEAGK

SEQ ID NO: 62184 - protein, 63 aa, Arabidopsis thaliana
  misc_feature (10)..(10): Xaa can be any naturally occurring amino acid
  misc_feature (16)..(16): Xaa can be any naturally occurring amino acid
  misc_feature (21)..(21): Xaa can be any naturally occurring amino acid
  misc_feature (37)..(38): Xaa can be any naturally occurring amino acid
  misc_feature (47)..(47): Xaa can be any naturally occurring amino acid
  misc_feature (50)..(50): Xaa can be any naturally occurring amino acid
  misc_feature (53)..(53): Xaa can be any naturally occurring amino acid
  misc_feature (59)..(62): Xaa can be any naturally occurring amino acid
MASSMLSSTXVVTSPXQATMXAPFTGLKSSASFPGTXXANNDITSFXSKXGRXSCMKVXXXXL

SEQ ID NO: 62185 - protein, 307 aa, Campylobacter jejuni
MHNILFGNILNRSVTMKGIILAGGSGTRLYPSTLTLCKQLLPIYDKPMIYYPMSVLMLAKIKEVLIISTPKDIDRFKELFKDGSFLGMQIQYKIQERPEGLAQGLILAQDFIQNDDIALILGDNIFYGQGFSDILENAKDDLKKGFASIFSYHVKDPERFGVVEMDQNGNVLSLEEKPKNPKSNHVATGLYFYNNDAIDIAKNVKPSARGELEITDVNIEYLRLNKLKSQHLGRGFAWIDTGTHDSLIEASSFVQTIELRQGYKIACLEEIAYNNNWIDNEILEKRALLLSKSNYGQYLYKILSQGK

SEQ ID NO: 62186 - protein, 382 aa, Arabidopsis thaliana
MVLNLPQELLEEILCRVPATSLKQLRLTCKEWNRLFNDRTFSRKHFDKAPKQFLITVLEERCRLSSLSINLHSGFPSEEFTGELSPIDYHSNSSQVIIMKIFHCDGLFVCTILKDTRIVVWNPCTGQKKWIQTGENLDENGQDFVLGYYQDNKSSDKSYKILSYKGYNYGDQEFKIYDIKSNTWRNLDVTPIPGNYFTCSDYRVSLKGNTYWFAYDLKDEQLGLISFDYTTERFERLWLPFQCDISDHDYSLSVVGEEKLSVVLQLKDAPRREIWITNKMDDETKEMSWRKLFEVEVGTRYYMWSGRPFLVDEEKKIVVCCEKCQKKCQPVITVSMVEADSNATRVYFPVVTMTSYWPHFVDYVPSLIQIQQSEANEKELNS

SEQ ID NO: 62187 - protein, 326 aa, Crocosphaera watsonii WH 8501
MKNILVTGAAGFIGFYVCQDILNKGDNIFGIDNLNNYYDVNLKKHRLQQLKNYDKFSFYQINIANTNDLVKLFNNNNFDYVIHLAAQAGVRYSLENPYAYVDSNLVGFVNILEGCRHSKIKHLVYASSSSVYGANKKIPFSTKDNVDFPISLYAATKKANELMAYTYSHLYQIPTTGLRFFTVYGPWGRPDMAYFLFTKAIMEGSPIKVFNHGKMKRDFTYIDDIVEGIVRVSDKIPQGSELNNNVPAKVYNIGNNQPVQLMTFIEVLEKCIGKKAIKEFLPMQPGDVPMTYADIDDLIKDVGFSPRTSIEEGLDKFVKWYNSYYS

SEQ ID NO: 62188 - protein, 559 aa, Zea mays
MGSSGFSWTLPDHPKLPKGKPVAVVVLDGWGEANPDQYNCIHVAQTPVMDSLKNGAPEKWRLVKAHGTAVGLPSDDDMGNSEVGHNALGAGRIFAQGAKLVDQALASGKIYDGDGFNYIKESFESGTLHLIGLLSDGGVHSRLDQLQLLLKGVSERGAKKIRVHILTDGRDVLDGSSIGFVETLENDLLELRAKGVDAQIASGGGRMYVTMDRYENDWDVVKRGWDAQVLGEAPYKFKSALEAVKTLRAQPKANDQYLPPFVIVDDSGNAVGPVLDGDAVVTINFRADRMVMLAKALEYADFDNFDRVRVPKIRYAGMLQYDGELKLPSRYLVSPPEIDRTSGEYLVKNGIRTFACSETVKFGHVTFFWNGNRSGYFDATKEEYVEVPSDSGITFNVAPNMKALEIAEKARDALLSGKFDQVRVNLPNGDMVGHTGDIEATVVACKAADEAVKIILDAVEQVGGIYLVTADHGNAEDMVKRNKSGKPLLDKNDRIQILTSHTLQPVPVAIGGPGLHPGVKFRNDIQTPGLANVAATVMNLHGFEAPADYEQTLIEVADN

SEQ ID NO: 62189 - protein, 98 aa, Vitis vinifera
MAVYKVKLITPEGAKEFECPDDVYVLDHAEEIGIDLPYSCRAGSCSSCAGRVVEGTVDQSDGSFLEDEQMEEGWVLTCVAYPQSDLVIETHKEEELTA

SEQ ID NO: 62190 - protein, 284 aa, Corynebacterium diphtheriae
MWKFATRLGLESVDTIAATNPREAIAAVAAGQADYACVAIENSVDGPVTPTFDALATIDGVRIFHELDLPIAFAIMQRTGAPLRRFATHPVAYQQVKTWLAANAPAAEFVPASSNAEAARMAKENIVDFAAAPARAAEVYGLDIIADGVADVTGARTRFVLVGHADTPTARTGHDRTSVVFTLKNEPGSLVGALSEFAMRGVDLTRIESRPIEEGLGTYRFHVDINGHIDDLNVAEALRALYPRCNALKFIGSWPAISGQPVTAVDPTVAQAASAWVEAARNGA

SEQ ID NO: 62191 - protein, 450 aa, Picea sitchensis
MRSRKTVMNKVGKYEIGRTIGEGTFAKVKFAQNTETGESVAMKVLDKGAILRHKMVDQIKREICVMKLVRHPNIVHLHEVLASRTKIYIILEFVTGGELFDKIVHQQRLSENESRKYFQQLIDAVDYCHSKGVYHRDLKPENLLLDSQGNLKISDFGLSALPQQLREDGLLHTTCGTPNYVAPEVLSHKGYDGALADVWSCGVILYVLMAGFLPFDEDDLTSLYRKINEADFSCPTWFSPGAKSLISRILDPDPQTRIKVSGIREDDWFRKNYVPVRLYEDDDVNLDDVQAVFDDSEDQYVSEQREAKELGPSMMNAFELITLSQGLNLSALFETQQDHVKRQTRFISRKPAKVIISKIESAVESMGFKIQVSNYKMRIEGLTLNKTGHISVALEVFEVAPSLYMVDVRKAAGDTLEYHRFYKALCAQLEDIVWKPINDSAIGIPDQNAG

SEQ ID NO: 62192 - protein, 295 aa, Methanosarcina mazei Go1
MPVKVHGVILMNIEEWEEYRYVEAGIKESITLIEDPGLKKMVEHVCHSGGKRIRPIILLLVSEICSGSYSRSLNAALAVEMMHSASLIHDDLLDQGLVRRNLPSAPEKFGPSGALLCGDYLIAKSIAFISPYGEKVIQDFGKAGMDMAEGEVLDLKLEDESFGENDYFKCIYKKTASLFAISASIGAYTGGAEEELAERFSHFGNALGTAYQIVDDILEFLEVVEGKESKFTSETLPHIYMKSTSKEEALKKSIDCVKLHVAAAKETLETFRECPARDKLFQITDYITVDMLENL

SEQ ID NO: 62193 - protein, 399 aa, Phytophthora infestans
MLRLGRSAASEVSSIRNSLQLQLEQRGARPMQCAYQTQSHSNPEGAKRGRSPMSLAVMGAAALSVGLELQTDGIAQARAAMEPGTQLQRHKWQLFDQIGAGAFGVVRLGMHEESGEVAAVKIVPLENPNDQRSYPALEREIAALKLVKALGGHNSIVDLRDVYVEGRKLFLVTELARGGELFEQIVAYGSFPELKARDVAREMASALSFMHRHGLVHKDVKPENILMSARVVDHNSGVYRKSNRHESSSLVKLADFGSAGPASVNTNLEDIGTAAYLPPEVLNSGMCTSACDMWALGCVLYIMLSGSHPFDLDGMSADSVVEHRVKSEPVTFDFSAWDNVSPHAKDLISKLLVKDPTLRLTADQMLQHPWMNASAEAAAAGLRRPSPLLAGQPIPRGPA

SEQ ID NO: 62194 - protein, 249 aa, Oryza sativa Japonica Group
MLRRNTRLRREYLYRKSLEGKERQHYEKKRRLRAALREPKILLTTSRNPSAPLTQFVKELKVVFPNSQRMNRGGQVISEIVESCRSHDITDLVLVHEHRGQPDGLIVCHLPFGPTAYFGLLNVVTRHDIKDRKAMGKMSEAYPHLILDNFTTKTGERTANIVKHLFPVPKPDSKRIITFANRDDYISFRHHVYEKHGGPKSLDLKEVGPRFELRLYQIKRGTVDQAEAQNEFVLRPYMNTAKKQKSLGA

SEQ ID NO: 62195 - protein, 192 aa, Zea mays
MGGGSGSFLKVLVNNMDVLAGPLVSLAYPLYASVRAIETKSAVDDQQWLTYWVLYSFITLFELTFAPVLEWLPFWSYAKLFFNCWLVLPQFNGAAHVYEHFVRPMIVNQQVVNIWYIPKKDESSRPDDVISAAQRYIEQNGSKAFENLVNKFKSSNPRRSILEEVEVERRARIQLESEAREVNPFFNPEYQY

SEQ ID NO: 62196 - protein, 484 aa, Methanosarcina acetivorans C2A
MKRCDAIMRGVVKEQIENKNNYSNLGSVVSVRGSIVDIRFEKYLPPIYSLLRAGKGGRIAIEVLTQLDSHRVRGIALTPTEGLSRGTLVEDTGGPLKAPVGRGILSRMFDVFGNPIDHRAPPSNVRWRTIHQAPPPLIRRSTRSEIFETGIKVIDVLVPLERGGKAGLFGGAGVGKTVLLTEMIHNVVRQQKGVSIFCGIGERCREGEELYRDMKEAGVLPNTVMVFGQMNEPPGARFRVGHVALTMAEYFRDDEHRDVLLLIDNIFRFIQAGSEVSGLMGQMPSRLGYQPTMGTELSELEERISNTDAGAIMSIQAVYVPADDFTDPAAVHTFSHLSASIVLSRKRASEGLYPAIDPLQSNSKMSTPGIIGERHYRLAQEIRQTLAQYAELKDIISMLGLEQLSQEDRNVVARARRLERFLTQPFFTTEQFTGFKGKFVTLSDALDGCERILLDEFKDYPESDLYMIGTIDEAIAKKSSRDQT

SEQ ID NO: 62197 - protein, 220 aa, Zea mays
MASATGGSSSEMAVDHATGLGTVEKPRFDALMPSEMSGGRTQFRKVTVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAERY

SEQ ID NO: 62198 - protein, 437 aa, Pasteurella multocida subsp. multocida str. Pm70
MSARNNKIGVVQLTILTMVNMMGSGIIMLPTKLAEIGTISILSWLVTAVGSTALAYAFAQCGMFSKKSGGMGGYAEYAFGKAGNFMANYTYGVSLVIANTAIAISAVGYGSELLEVSLSPVAIAGWTIITLWLATSLNFGGARITGNISSFTIWGVIIPVVGLCIIGWKWFDADMYINAWNPHHVPTFEAIGVSISMTLWAFLGLESACANTDVVENPERNVPIAVLGGTLGAAAIYIVSTNVIAGIVPNMDLANSTAPFGLAFAHMFNETTGKIVMGLMVLSCFGSLLGWQFTIAQVFRSSAEEGYFPAFFKKVTSKDAPIIGMVTITVIQSLLSLMTISPSLNKQFNVLVDLAVVTNVIPYILSMAALMVLQKVEKVPAQKAKITTFVAFIGSVYSIYALYAAGQEPMLYGSIATFIGWTLYGFVSDKFDIKAKV

SEQ ID NO: 62199 - protein, 203 aa, Clostridium difficile 630
MKIRSSEITMSAVNKSQYPAEGIPEIALAGRSNVGKSSIINTLLNRRNFARTSQTPGKTRTINFYLINNEFYFVDLPGYGYAKIAKSEKEKWGGIMERYLESRQELCSIFLLVDIRHEPTADDKLMYEWIKHFGYNCVVIATKADKISRGQYQKHISIIRKKLQMESSEKVIPVSSLKKTGVEELWEEIVNQYNQHGYEITVD

SEQ ID NO: 62200 - protein, 334 aa, Pasteurella multocida subsp. multocida str. Pm70
MPLNLRHRHFLRLMDFTPTEIQFLLDLSANLKKAKYTGTEQPRLKGKNIALIFEKTSTRTRCSFEVAAYDQGANVTYIGPSGSQIGHKESMKDTARVLGRMYDGIQYRGYGQELVEILAQYSGVPVWNGLTDDFHPTQILADFLTMLEHGEGKRLNQMKMAYLGDARNNMGNSFVEGAALMGMDLRLVAPKAYWPEQKLLDEVAEMAKKTGAKITCTENVEEGVKGVDFLYTDIWVSMGEPEEAWEQRINLMKPYQVNKALLEKTGNPKVKFMHCLPAFHDENTTVGKEMAQKYGMNGLEVTDEVFESDASIVFDEAENRMHTIKAVMVATLGQ

SEQ ID NO: 62201 - protein, 121 aa, Oryza sativa
KKKKKKMSTVTRAYLDQKLALAKRCSREATLAGAKAAAVATVASAVPTLASVRMLPWAKANINPTGQALIICTAAGMAYFVAADKKILSLARKHSFEGAPEHLKNTSFQGTGRPHPAFFRP

SEQ ID NO: 62202 - protein, 508 aa, Candida glabrata CBS 138
MDSRLHRLINLEVTPGKDVRKTAIIGTIGPKTNNVDTLVALRKAGLNIVRMNFSHGSYEYHQSVIDNARKSEQVYPGRPLAIALDTKGPEIRTGTNVDDVDYPIPPNHEMIFTTDDKYAKACDDKIMYVDYKNITKVIQPGKVIYVDDGVLSFEVLEVVDDKTLKVKSLNAGKISSHKGVNLPGTDVDLPALSEKDKEDLRFGVKNGVHMIFASFIRTAQDVLTIREVLGEEGKDIKVIVKIENQQGVNNFDEILEVAHGVMVARGDLGIEIPAPQVLAVQKKLIAKCNLAGKPVICATQMLESMTFNPRPTRAEVSDVGNAILDGADCVMLSGETAKGNYPINAVTTMAETAIIAERAIAYMPLYDDLRNCTPKPTSTTETVAASAVAAVQEQGAKLILVLSTSGNTARLVSKYRPQCPIVLVTRNPRTARFSHLFRGVFPFVYEKEPLDDWSEDTHARLRFGVDMAKEYGFVKNGDAVISIQGFKGGVGHSNTMRVSIVGGEKEDI

SEQ ID NO: 62203 - protein, 663 aa, Pisum sativum
IDFIFNRFISSNISLFGNSTIDSQILTLTHHQSFSIGRALYPKKIPTKNSSYVYPFSTSFVFSMAPFEDTLPGHGLVFIFTPVKGIQGTSSAQHLGLFNLTNNGDSNNHVFGVEFDVFMNQEFEDINDNHVGIDINSLTSVVSHDAGFWRDDTRSGKDQFFKKLVLNNGENYQVWIDYEDSLINVTIAKLGMRKPVKPLLNVSLNLSEVFEDEMFVGFTSSTGQLVQSHKILAWSFSNTNFSFSDEIITIGLPSFVLPKDSIFESKRFVAGFSVGVFFIVCVLVLLVLFLVQEKRKREKKRSEMEDWEMEYWPHRMSYEEVKASTKGFSEENVIGIGGNGKVYRGVLRGGVVIAVKNISHENNGMREFLAEVSTLGRLKQRNLVGLRGWCKKNAGNFLLVYDYMENGSLDKRVFFDFDCDDESKMLSFEDRIRIIKDVAHAVLYLHEGWEVEVVHRDIKASNVLLDKDMNGKLGDFGLARLQNHGQVARTTKLVGTVGYMAPEVIKTGRASTHTDVYMFGILILEVICGRRPLEEGKPGLVEFVWKLLEQGELVCALDERLKAKGEFSLQELERVLHLGLLCAYPEPKSRPSMRQVVNVLEGRNEGGEESENVDSSLLQQLKSRDVLHEYSLYFSYASHPTFQDIPQFSSTSVTWSGSLVEGR

SEQ ID NO: 62204 - protein, 265 aa, Zea mays
  misc_feature (59)..(59): Xaa can be any naturally occurring amino acid
  misc_feature (230)..(230): Xaa can be any naturally occurring amino acid
  misc_feature (247)..(247): Xaa can be any naturally occurring amino acid
MASPSVFAGIAQGPEDPILGVTVAYNKDPSPVKVNLGVGAYRTEEVKPMVLNVVRRAEXDFNKLSAKLIFGADSPAIQENRVATVQCLSGTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLDKDAQSVRMFVADGGELLMAXSYAKNMGLYGKRVGALXIVCGSADIAVKVEKSLKL

SEQ ID NO: 62205 - protein, 340 aa, Coccidioides immitis RS
MDLRVGNKYRIGRKIGSGSFGDIYLGTNIISGEEIAIKLESVKAKHPQLEYEARVYKSIAGGVGIPFVRWFGTECDYNAMVMDLLGPSLEDLFNFCNRKFSLKTVLLLADQLISRIEYIHAKSFLHVSVFLPSGPLLSTTRDIKPDNFVMGIGKRGNQVNVIDFGLAKKYRDPKTHFHIPYRENKNLTGTARYASINTHLGVEQSRRDDVESLGYVLLYFCRGSLPWQGLKAATKKQKYDRIMEKKMTTPTEVLCRGFPNEFAIYLNYTRSLRFDDKPDYSYLRKIFRDLFIREGFQYDYVFDWTVYKYQKNAQAIAQAQGQNHPDVKPQEKLVFGPGLR

SEQ ID NO: 62206 - protein, 385 aa, Arabidopsis thaliana
MSDLPRDLLAEILSRVPLTSLRAVRLTCKKWNDLSKDRSFLKKQIVETKKKQLESKEIEVIMMRNFRVYLTSIDIHNNVDPSFTPKGTLISLSDDANHHQVDNVSRVFHCDGLLLCITKDLHYRLVVWNPYFGQTRWIQPRNSYHRKDNYALGYDEKKNHKILRLKDNYYAPRERICEFELYSFESNSWKVVLDVSPDWYIPSYNRGLSLKGNTYWYATEKHVNVDFLICFDFTTEKFGPRLPLPFNATESPTYEDVVTLSSVGEEQLAVLFQSEYTLMMEIWVTSKVESTEVLWNKLFLEVDLIAISSHFQFLAEAGSFFIDQKKNVVVVFDKDMDEATDRDMAYVVGKNGYFKKVDIGEEAYTSCFPLVCSYVPSSEQIRQLT

SEQ ID NO: 62207 - protein, 364 aa, Pisum sativum
IPKSIASSENTATMKEGRAEASMVMFGALDELFEKTGIRPKDVGVLVVNCSIFNPTPSLSAMIINHYKMRGNILSYNLGGMGCSAGIIAVDLARDILQSNPSNYAVVVSTEMVGFNWYQGKERSMLIPNCFFRMGCSAVLLSNRRRDYSRAKYRLEHIVRTHKGADDRSFRCVYQEEDDQKFKGIKISKDLIEIGGEALKTNITTLGPLVLPFSEQLIFFATLVWRNLFGGGKKSDKNSSSSSSSNKPYIPNYKLAFEHFCVHAASKAILDELQKNLELSDKNMEASRMTLHRFGNTSSSSIWYELAYMEAKEKVKRGDRVWQLAFGSGFKCNSAVWRSMGRVAKPTSRNPWLDCINAYPAQLN

SEQ ID NO: 62208 - protein, 319 aa, Oryza sativa Japonica Group
MAFMSMERSTWAFTFGILGNLISLMVFLSPLPTFYRVYRKKSTEGFQSTPYVVTLFSCMLWMYYAFVKSGAELLVTINGVGCVIETVYLAMYLAYAPKSARMLTAKMLLGLNIGLFGVIALVTLLLSRGELRVHVLGWICVAVSLSVFAAPLSIIRLVIRTKSVEFMPFSLSFFLVLSAVIWFLYGLLKKDVFVALPNVLGFVFGVAQMALYMAYRSKKPLVASSSSAVVAAGLEIKLPEHVKEVQAVAKGAVAAAPEGRISCGAEVHPIDDVMPSEVVEVKVDDEETNRTDEMAGDGDHAMVRTEQIIKPDMAIVVEV

SEQ ID NO: 62209 - protein, 545 aa, Pseudomonas putida KT2440
MATCGEVLVKLLEGYGVDHVFGIPGVHTVELYRGLAGSSIRHITPRHEQGAGFMADGYARTRGKPGVCFIITGPGMTNITTAMGQAYADSIPMLVISSVQSRDQLGGGRGKLHELPNQAALVSGVAAFSHTLMSAADLPQVLARAFAVFDSARPRPVHIEIPLDVLVEPADFLLPGRPVRGSRAGAAPQAVAQMAERLASARRPLILAGGGALAAGAALARLAEHLQAPVALTINAKGLLPASHPLQIGSTQSLPATRALVAEADVVLAIGTELAETDYDVTFKGGFEIPGRLLRIDIDPDQTVRNYLPELALVADAELAAEALLGAVQAQPQPVHESTWGVARVADLRKVLAADWDQPTLSQTRLLSAILERLPDAILVGDSTQPVYTGNLTLDMQQPRRWFNASTGYGTLGYALPAAMGAWLGSAEQAVERAPAVCLIGDGGLQFTLPELASAVEAQVPLIVLLWNNQGYEEIKKYMVNRAIEPVGVDIHTPDFIGVARALGAAAENVADIAQLQAALGQAVERKGPTLIQVDQNQWQAAVLG

SEQ ID NO: 62210 - protein, 542 aa, Aspergillus nidulans FGSC A4
MLTRLGRLETALLEKVRDQNRLYTEQGCRGIAVVGSSRPEHQTNHNHYHSGAFLHPLPLFTLSTFSSPPSSDSSSVSSPSLFLSIPSSSFSFLLSSTSLLFLPSNLPLPSISLQILAFLATSTFPRPPKPLWIRPDSRRFSRLRITFPHIDPLIVLLAPLSLLLRLLSHILPVSSSTTPLKLENMDTTDIHETPIADETMTDAVNVGDEGDLEVAPKTEEEYAQSMLTLRAIVSSKEAGVIIGKAGKNVADLRDETGVKAGVSKVVPGVHDRVLTVTGALSGTARAYALVAKGLLEGAPQMGMGGIVSNNGTHPIRLLISHNQMGTIIGRQGLKIKHIQDASGVRMVAQKEMLPQSTERIVEVQGTPEGIEKAIWEIGKCLIDDWQRGTGTILYNPAVRSSVGSGSIQHNGGNSDSYNSRPYNRTGNGADFSDQSGGYGRRSNPDTSNRGYPLVTEDGEEIQTQNISIPADMVGCIIGRGGTKITEIRRSSGARISIAKAPHDETGERMFTIMGSAQANEKALYLLYENLEAEKTRRSQLQE

SEQ ID NO: 62211 - protein, 220 aa, Alkaliphilus metalliredigens QYMF
MIQLAPSILSADFANLEQEIKKVEEAGCDMLHIDVMDGHFVPNITLGPPIIKSLKNKTKLPFDVHLMIENPDQYIAQFVEAGADIITVHSETCIHLHRTIQLIKGCGIKAAVALNPSTPLVMIENVLEELDMVLLMTVNPGFGGQKLIPNMLEKIARLKRMIDERGLKIDIQVDGGVNLENIKQIAEAGANIIVAGSAIFNSTDIPETVKRLKENASSNL

SEQ ID NO: 62212 - protein, 395 aa, Oryza sativa
  misc_feature (115)..(115): Xaa can be any naturally occurring amino acid
  misc_feature (130)..(130): Xaa can be any naturally occurring amino acid
MRSSESSRFVQELVLYAASAALSCLVLFAGLRQLDPNRAASQKALQHKKEIAKRLGRPLVSTTPYEDVIACDVINPDHIDVEFDSIGGLDHVKQALYELVILPLRRPELFTFGKXLLSPQKGVLLYGPPXGTGKTMLAKAIAKESGAVFINVRISNLMSKWFGDAQKLVSAVFSLAHKLQPAIIFIDEVDSFLGQRRTTDHEAMTNMKTEFMSLWDGFTTDQNARVMVLAATNRPSELDEAILRRFTQIFEIGIPVQSERSKILRVVLKGENVEPNINYDYIAGLCEGFTGSDILELCKQAAFYPIRELLNNEKDGRKADKPRPLRQSDLEKALSTSRKGKRAANGTSTGLQSPVWIRPSDSEDDQVQSAIFEISKLMSRIVQNSQSEPQEPSSP

SEQ ID NO: 62213 - protein, 449 aa, Nicotiana tabacum
MDNNSVGVPHNLPRGEMGGKQKNAQADGRNRRALGDIGNLVPAPAAEGKPKAAQISRPVTRSFCAQLLANAQEEKNKKPLAEVVNKDVPAKKKASDKEMKTVGGSPLSKRKAKKSGKTLTSTLTARSKAACGLSNRPKYEIEDIDVADADNHLAAVEYVEDIYNFYKLTEGESRVDDDYMNFQPDLNHKMRAILVDWLIEVHRKFELMPESLYLTITILDRFLSLKTVPRKELQLVGISSMLIACKYEEIWAPEVNDFIHISDNAYAREQILQMEKAILGKLEWYLTVPTPYVFLVRYIKAATPSDNQEMENMTFFFAELGLMNYKITISYRPSMLAASSVYAARSTLNKTPLWTQTLQHHTGYSEDQLMECAKILVSYHLDAAESKLKAIYRKFSSPDRGAVAFFPPARNLLPTTTTDAASLVLEEFYFLVWEAFLGSFYCCDLSSLD

SEQ ID NO: 62214 - protein, 648 aa, Alkaliphilus metalliredigens QYMF
MIGKTLGNRYEIIEKVGGGGMALVYKAKCTLLNRHVAVKVLRSEFTNDKDFIEKFKQESQAAASLSHPNIVNIYDVGQEDEIYYIVMEYVDGMTLKQLINEKGILNLREIINYTKQIANALQHAHQNHIIHRDIKPHNILMTKDNRAKVTDFGIALAATTSTITNAGSVIGSVHYFSPEQARGGYTDEKSDFYALGIVMYEMITGVVPFEGDSPITVALKQIQEKPAAPSTVNPDIPKGLENIILKLIEKEQSLRYGSAELLINDLDKLSRDPETIIYRDEDEEQDCPTQVIPMIKTEESSRNNIKNQTGGRVKKSKGPKKLVVAAAVLAAFIMAIVVTVGLFYAGDIFRNEDVKVPDFEGKEIGLVRDEVKELGLELTEDMRRSTEVAVGHVIQQNPSKGMTVRKGYTVKVTVSSGAEEVEVPDLFHEDVVDALLILEEQNLVSGDVLYDFSDLPIGTIMIQSPLPGARVKQGSAVNYTLSKGPEKMTYTMPKVVGEPLEVAKGIIRQTGLQVGTEDEDFSEQYEKGIVIRQSVPAETEVEENTIVNLVVSKGAEVIEPEEEDPVDVEPEETASTKTIEINLRNYTNMVTVEIRQLINGGEESIYFKEHNIAEEGSQLYVPIRESGTHRFQVYIDDEKQGAIIEIDF

SEQ ID NO: 62215 - protein, 299 aa, Xanthobacter autotrophicus Py2
MRATPALWRRPGSSDKVPARNNSVRPDSPMTDLNTDLNTDPNSQPGAGAPRTETHFGYRTVPLTEKQSLVDDVFHKVARRYDIMNDFMSGGLHRVWKDALVSKVRPPQGARPFELLDLAGGTGDVSFRVVKAGGAGTRATVADINAEMLAVGRERAEKRGLGDKVTFTEANAEALPFPDQSFDAVTIAFGIRNVPRIPLALTEMRRVLKPGGRAFVLEFSKVDVPLLDKIYEAYSFNVIPQLGKRVAGDAEPYQYLVESIRRFPNPDVFANMMREAGFSRVDFTRMTGGVVALHWGWRI

SEQ ID NO: 62216 - protein, 37 aa, Clostridium symbiosum
KFLGFEQAFKDSLTTLPMGGAKGGSDFDPNGKSDREV

SEQ ID NO: 62217 - protein, 175 aa, marine gamma proteobacterium HTCC2143
MIYSLDDVRVQLEGECFIADNATIVGNVSIGNNASVWFNVVIRGDSDKITIGDDTNIQDASVLHTDVGIPMTLGKGVTVGHKAMLHGCTVGDYTLVGINAVVLNGAKIGKHCLIGANTLVPENMEIPDGSLVVGSPAKIKRSLGEEQRKMLELSAQHYVDNGRRFAKGLKEDNRG

SEQ ID NO: 62218 - protein, 484 aa, Saccharomyces cerevisiae
MADKIERHTFKVFNQDFSVDKRFQLIKEIGHGAYGIVCSARFAEAAEDTTVAIKKLTNVFSKTLLCKRSLRELKLLRHFRGHKNITCLYDMDIVFYPDGSINGLYLYEELMECDMHQIIKSGQPLTDAHYQSFTYQILCGLKYIHSADVLHRDLKPGNLLVNADCQLKICDFGLARGYSENPVENSQFLTEYVATRWYRAPEIMLSYQGYTKAIDVWSAGCILAEFLGGKPIFKGKDYVNQLNQILQVLGTPPDETLRRIGSKNVQDYIHQLGFIPKVPFVNLYPNANSQALDLLEQMLAFDPQKRITVDEALEHPYLSIWHDPADEPVCSEKFEFSFESVNDMEDLKQMVIQEVQDFRLFVRQPLLEEQRQLQLQQQQQQQQQQQQQQQQPSDVDNGNAAASEENYPKQMATSNSVAPQQESFGIHSQNLPRHDADFPPRPQESMMEMRPATGNTADIPPQNDNGSLLDLEKELEFGLDRKYF

SEQ ID NO: 62219 - protein, 334 aa, Xylella fastidiosa Ann-1
MAIKVGINGFGRIGRNILRSAVQNFGSNIDIVAINDLLEPDYLAYMLQYDSVHGRFKGEIAIEGTALILNGKKIRLTAERDPGNLQWADAGAEIVIESTGLFLTQESAGKHLAAGAKKVIISAPSKDETPMFVYGVNHNSYNGEPIVSNASCTTNCLAPLAKVINDKWGITRGLMTTVHAATATQKTVDGPSNKDWRGGRGILENIIPSSTGAAKAVGKVIPSLNGKLTGMSFRVPTSDVSVVDLTVQLNTPATYKEICTEVKQQSEGPLRGILGYTEDKVVATDFRGETCTCVFDADAGIALDPTFIKLIAWYDNEWGYSNKCLEIAKVIAAK

SEQ ID NO: 62220 - protein, 433 aa, Cryptococcus neoformans var. neoformans B-3501A
MAALSDRQKDELHRAMLAYLHAAGMHNAYAALQHDAALADVDPRDRAVGLLEKKWTSVIRLQKKVIDLENRNAALLAELAAAARPAAPGPFLPRPPPRHTLASHRAPVTRLAFHPTWTLLASASEDATVKLWDWEAGDMERTLKGHTKAVMDVDFDPRGGLMATCSSDLTLKLWDTANQYTNVKTLHGHDHSVSSVRFMPDGETLVSASRDKTIRVWQVSSGYCIKTFSGHAEWVREAVPSEDGRWLVSASNDQTSRIWDFSTGETKMELRGHEHVVECAVFAPVNAYPAIRELAGLKPPAPRDTRAKSPGVYAATGSRDKTIKLWDALSGQCLRTLVGHDNWIRALVFHPSGKYLLSASDDKTIKVWDLANGRCTKTIEAHSHFVTSMTWGRAVGASGGIEKVNGDASSKEPRRINVLATGSVDQTIKVWTP

SEQ ID NO: 62221 - protein, 136 aa, Oryza sativa Japonica Group
MATDPRGRRPRHHAAVNEVLSTLAAANSTLADVQRRLDADFRAAYPDHANPVKLVARLKRIQEKELIDAMRTSLAVQRSAVQRLLASSGLPPMSEEDAATDANLNQIIDEWTAHVGPDTGDDKDEDTNQIFFAAVV

SEQ ID NO: 62222 - protein, 220 aa, Triticum aestivum
  misc_feature (103)..(103): Xaa can be any naturally occurring amino acid
  misc_feature (123)..(123): Xaa can be any naturally occurring amino acid
  misc_feature (155)..(155): Xaa can be any naturally occurring amino acid
VTCPSGVVQKSRFRTEAGIPGISSTHASGRAWTPSPSKRREMDLMKLMMSDYKVETVNDGMQEFLVEFRGPQESLYQGGVWKVRVELPDAYPYRSPSIGFFIXIYHPNVDELSGSVCLHAINXTWSPMLDLGNVFEVFLPQLLLYPNPPDPLNGXEAAALLMCDRPGYELKGNKFCEKYARPEDGGIPPKHNFQRQNLYEENNDDSRGQSPPTVPCQPPS

SEQ ID NO: 62223 - protein, 166 aa, Picea sitchensis
MRLQLSETVVKDSSKGMSAEWERFDFNKEAPLDDDTKLDHFGDDIGAKDDTGFLRNTGVTFGSSISQANREAKIQAAHEAAIFGALIHPSSNTSDLNHKVEKPLQSEQIEENTLGYLSKCKAEEDRGSKGNVLGNSVISEQVYAMQQGSWRDRARKLREQSQNQQS

SEQ ID NO: 62224 - protein, 345 aa, Bradyrhizobium japonicum USDA 110
MTGQLRLDDHLQRYSETAPHALAVATAVDAIAAAAIEIADLIGAGDLADASGLTTGRNSDGDVQRDLDVQADAILRRCLGKLSIAALASEEMREPQIGDRAARICVAIDPLDGSSNIDINMTVGTIFSILPAPDDLALAFHQRGSAQFAAGFVTYGPQTSLVLTLGDGVDIFTLDRKAGCFRLARSAIQISEAGEEFAINASNRRHWDPPVRAFIDECLAGVEGPANHDFNMRWVGSLVAEAYRILTRGGVFLYPSDARPGYGDGRLRLTYEAHPMAYIIEQAGGSASTGRERILDLSAQSLHQRVPLIMGSSNEVRRVEELHCDPLLVASISAPLFARRGFFRL

SEQ ID NO: 62225 - protein, 291 aa, Bradyrhizobium japonicum USDA 110
MSRKHPIISITGSSGAGTTSVKKTFEQIFFREKVNAVYIEGDAFHRYDRAEMRTQMAKEAERGNRHFSHFSPETNLFEELERAFRDYGETGTAVTRHYVHDAEESALHGTPPGTFTEWERLPENSDLLFYEGLHGAVVTDKVNVARYADLKIGVVPVINLEWIQKLHRDRSARGYSTEAVTDTILRRMPDYIHYICPQFTETDINFQRVPTVDTSNPFVARWIPTPDESMVVIRFKNPRGIDFPYLLSMLPHSWMSRANSIVCPGAKLDLAMQLILTPLIMQLIERKRNLK

SEQ ID NO: 62226 - protein, 343 aa, Physcomitrella patens subsp. patens
MGKQCNAMEVRVVGFVLVALIAVQLVAAEVVTPAFVWSDLRCFGKEDRSVKYKSQTPESLVSNIFQDLRRCTSTQGIDGEEAAPEMIVAFIGEELQSEDISRGQPSGVLKTLQGSVADARYSMAIPYVTVASGSLSVAESLLRNVPSELGTTVAIDEVAVSGSCSIGEHDVKRLTGVPAVQEWIVGRKLPRADKKTDLLVICYSPLLDWSVADKSLSEGEVLEKVLSSLKSSGTSNVVLYSSDPKASNEKHHGILERHLFESTGNATTDCDALCRSRAVILEGIFVAFTLITILVSGGAYRVGACIRLRTGCAQRWKFEDQHHEGVAVILSILRRQVIRAFIF

SEQ ID NO: 62227 - protein, 271 aa, Colwellia psychrerythraea 34H
MSPTDQNSQASDLSTTPQTSVEADNESTTHFGYKTIEKDDKISMVAGVFHSVAKQYDVMNDLMSFGIHRLWKRFTIDASGVRPGNKVLDLAGGTGDLTAKFSKLVGREGKVILADINSSMLNVGRDKLRDKGLVQNIEYVQANAEYLPFEENTFDIVTIAFGLRNVTDKDKALRSIYSVLKPGGRLLVLEFSKPEHELLNKAYDFYSFNILPKMGELVAKDGESYQYLAESIRMHPDQETLKDMMEKAGFEQTSFKNLTGGVVALHKGYKF

SEQ ID NO: 62228 - protein, 245 aa, Bradyrhizobium japonicum USDA 110
MTSEILIAPSILAADFARLGEEIAAIDAAGADWIHCDVMDGHFVPNISFGADVIKAIRPVTKKVFDVHLMIAPVDPYLDAFAKAGADVITVHAEAGPHLDRTLQAVRALGKKAGVSLCPATSEGAIEYVLDRIDLVLVMTVNPGFGGQSFLESQLEKIKRIRTVIGDRPIRLEVDGGITRENAAAVAAAGADTLVAGSAVFRGKSSADYAGNIAAIRVAAEAGRVSKLQDISVQPMRAGESARLR

SEQ ID NO: 62229 - protein, 358 aa, Candida glabrata CBS 138
MENKATLARNIGEKRVSPRSKVNGTGKSWRISYSPQRMDGVSSGRNVSKIPSPVRERLFLKNQERKPLGVSPLSNLSPNSLGRNSLEKSTYNNKLSLKDFEVGRKLGKGKFGKVYCVRHKKSGFICALKAIEKNEILQFNLLKQLKREVDIQLGMDHPNIIKLYAHFHDEKRVYLLMEHSINGELYKSLKNNGPFNDVLASHYIYQIADALHYMHKKRIIHRDVKPENVLIGFDNVVKLADFGWSILNPEGSKRKTLCGTIDYLSPEMITPREYDEQVDVWALGVLAYELVVGVPPFEENSKELTYKRILKCDLNFPESISKDAKDLISKLLVTDTTQRLSLTGVKTHPWILKNKPFW

SEQ ID NO: 62230 - protein, 364 aa, Lactobacillus plantarum
MKRYLVLEDGTIYPGTGFGATTATVGELVFNTGMSGYQESITDQSYNGEILMFTYPLIGNYGINRDDHESIKPTCKGVVVHEVARRASNWRNAQSLDDYLKQNAIPGIMDIDTRAVTKHIRTKGAMKATIVDNVLPDTVDRLKITELNRAVVAQSSTNNAYPNPATGPNVVVVDFGLKHSILRELAKRQCNLTVLPYNTTASEIMALNPDGVMLTNGPGDPKDVPGALEMIREVEKHVPLFGICLGHQLFALANGADTFKMKFGHRGFNHPVREIATGRIDFTSQNHGYAVDRDSLAQTDLLITHEEINDGTVEGLRHRDYAAFSVQYHPDAAPGPHDADHIFDEFIDLMAANQATQKGSQFNA

SEQ ID NO: 62231 - protein, 473 aa, Arabidopsis thaliana
MESDLGKLFIGGISWDTDEERLRDYFSNYGDVVEAVIMRDRATGRARGFGFIVFADPCVSERVIMDKHIIDGRTVEAKKAVPRDDQQVLKRHASPIHLMSPVHGGGGRTKKIFVGGLPSSITEEEFKNYFDQFGTIADVVVMYDHNTQRPRGFGFITFDSDDAVDRVLHKTFHELNGKLVEVKRAVPKEISPVSNIRSPLASGVNYGGGSNRMPANSYFNNFAPGPGFYNSLGPVGRRFSPVIGSGRNAVSAFGLGLNHDLSLNLNPSCDGTSSTFGYNRIPSNPYFNGASPNRYTSPIGHNRTESPYNSNNRDLWGNRTDTAGPGWNLNVSNGNNRGNWGLPSSSAVSNDNNGFGRNYGTSSGLSSSPFNGFEGSIGELYRGGSVYSDSTWQQQQLPSQSSHELDNLSRAYGYDIDNVGSDPSANDPETYNGSYNVGNRQTNRVAEFEQVLMTKKPTLLITVPKIMVCFLFC

SEQ ID NO: 62232 - protein, 504 aa, Paracoccus methylutens
MNTLHNPAAPAAVPFQTRSMLIGGAWQAAASGETITVENPARRSPIGEVPRARAEDVDRAVQAAAAAFPAWARIPARERGRLLAGIGEALEARLEELARTISAETGNALRTQARGEARMVADAFRYFGGLAGELKGLTIPLGEGVLSYTRREPIGVTGAIVPWNAPAQLAALKIAPAICAGNTIVLKAAEDAPLAVLLIAEICQQHLPPGVVNVVTGYGEECGAPLAGHPLVRKVSFTGSTGVGKAIMRAASDRLAPVSLELGGKSPSVVYEDADEDWVVDGIIASMRFTRQSQSCSAGSRLFLHADIFEPFLEKLVARTSALKIGDPLDEATDIGAIINERQFKKICGYVEEGLDRSEARLVMGGLPPREGPLSEGYFALPTIFADTSNEWRLAREEIFGPVLVAIPWRDEAEAIRMANDSHYGLAAYVWTRDIGRALRTAHAIEAGWVQVNQGGGQALGQSYGGVKESGIGREMSLEGMLDSFTETKSVNVSLTIPPPPPRA

SEQ ID NO: 62233 - protein, 517 aa, Moorella thermoacetica ATCC 39073
MEDITARLADLEVRRARVMAGGGEERVARQHAAGKLTARERLELLLDPGSFLELDQFVRHRATDFGMQDIETPGEGVVTGSGTINGRPVYVYAQDFTVMGGSLGEMHAAKICKVMDLALKTGVPVIGLNDSGGARIQEGVAALNGYGEIFRRNTHASGVIPQIAAIMGPCAGGAVYSPGLMDFIFMVDNTAQMFITGPQVIKAVTGEEVSAEELGGAVTHATRSGVAHFRTPTEEDCLHLIRTLLDYLPANNLEDPPFRPSSDPAERQNPNLAALVPVDPNKPYNVKEIIYGVVDDGLFLEIQGEYAANMVIGLARLAGYTIGIVANQPQYLAGCLDINAADKAARFVRFCDAFNIPLLTLVDTPGYLPGVEQEQGGIIRHGAKLLYAFAEATVPKLTLVLRKAYGGAYLAMCSRSLGADHVVAWPTAEIAVMGPEGAANIIFRQEISQADDPARVRQEKVAAYRDKFANPYVAAGLGLVDAVIDPALTRPHLIRNLLTLLSKRESRPGKKHGNFPV

SEQ ID NO: 62234 - protein, 302 aa, Paracoccus methylutens
MAKVGFLGLGRMGFPMARNLATAGHDVHVYDPSEEVGRKAAKAGLKTASRVDVAVEGADFVITMVPTGRHVLEIFLGDDGVLAKMAKGSMAIDSSTIDTADARRLHAAGRERGIAVLDAPVSGGVMGAEAGTLTFMVGGSAEDLERARPVLEAMGRRIFHAGEPGVGQAAKLCNNLLAGISMIAVSEAFALARHLGLDARKMQEISAVSTGGCFSLTNYPPVPGLVPNVPSSREYRNGFASQLMLKDLKLAQQAAIQSGTALPLGGLAAALYGMFCQAGHSELDYSAIIKLIEGDGVRTSDA

SEQ ID NO: 62235 - protein, 290 aa, Lactobacillus sakei subsp. sakei 23K
MADFKQLAARELPQFDAYLKRELAKIQEPTLQKSMTYSVMAGGKRLRPLLLFAVLESTGQSIDETAFRAAGALELIHSYSLIHDDLPAMDNDDLRRGQPTNHKVFGEAEAILAGDGLLTLAFEWLATLNVTAEQRIELVRLLAQAAGANGMVAGQIEDIEGEHKTLTLAQLQQVHHLKTGCLIEVAVAMGAVLAQLGEVETTALRGFAQQFGLAFQIQDDILDVTSTTAEMGKAVHKDAAEQKNTFPILLGMSGAQEALHTTCQQAQQQLAQVTTFDRTLLNSFLDYFNE

SEQ ID NO: 62236 - protein, 253 aa, delta proteobacterium MLMS-1
MKFRPCIDLHQGRVKQIVGSTLGGDEAGLAINFTSEQPPAYYARLYRRDNLSGGHVIMLGPGNEAAATEALAAWPGGLQVGGGITAANAASWLDKGAAAVIVTSYVFRDGLVLEDRLRELVKAVGKQRLVLDLSCRKRDGRYLVVTDRWQKFTEMVVDGASLDYFSRFCAEFLIHAVDVEGKCAGVAEDLLRLLGEQAPLPTTYAGGVATMADMHRIDQLGGGRLDATIGSALDIFGGSGVKYRDAVAFSQRR

SEQ ID NO: 62237 - protein, 427 aa, Mycobacterium smegmatis str. MC2 155
MPIIEQVGAREILDSRGNPTVEVEVALTDGTFARAAVPSGASTGEHEAVELRDGGSRYGGKGVEKAVEAVLDEIAPQVIGLSADDQRLVDQALLDLDGTPDKSRLGANAILGVSLAVSKAAAESAGLPLFRYIGGPNAHILPVPMMNILNGGAHADTGVDVQEFMVAPIGAPSFKEALRWGAEVYHSLKSVLKNQGLATGLGDEGGFAPDVAGTKAALDLISSAIEATGLKLGSDVALALDVAATEFYTEGSGYAFEKETRTAEQMAEFYAGLLDSYPLVSIEDPLSEDDWDGWVSLTAAIGDRIQLVGDDLFVTNPERLEDGIQRGAANALLVKVNQIGTLTETLDAVSLAHNSGYRTMMSHRSGETEDTTIADLAVAVGSGQIKTGAPARSERVAKYNQLLRIEETLGDAARYAGDLAFPRLEAK

SEQ ID NO: 62238 - protein, 467 aa, Burkholderia sp. 383
MKVRIAIVGTGYVGLVSGACFADLGHDVVCIDNNRGKIDALNEGRMPIYEPGLDAVVARNVERGTLRFSSDLAASVCDRDAVFIAVGTPTLPGTDQADLQYVEAAAREIASNLTGFAVVVTKSTVPVGTNRIVKQIVERCAPDGIDTAIASNPEFLREGSAIDDFMHPDRVVFGAEHPRAIEIMKAIYAPLEAMGHLVLATEIETAELVKYAANAFLAVKISYINEISDLCEAVGADVELVANGMGLDRRIGASFLKAGPGWGGSCFPKDTRALKATASEHAVPLRIVSAAIESNALRKEQILRRIEKACGGSIKDKRIAVLGLTFKGQTDDVRESPSIDVIQLLVGAGAHIRAYDPARPHEASRLLPQVFMEGSAIDAVRSADAVVVMTEWKAFEALDLADLADHMADPVMLDMRNLFSERLAVDSGFRRYERVGRSCGERTPADPAPEQQHANEDTRPQRGLLQD

SEQ ID NO: 62239 - protein, 74 aa, Clostridium symbiosum
SKYVDRVIAEVEKKYADEPEFVQTVEEVLSSLGPVVDAHPEYEEVALLERMVIPERVIEFRVVWEDDNGKVHVN

SEQ ID NO: 62240 - protein, 507 aa, Oryza sativa Japonica Group
MTQTPTPAAAAPAPAVAVSEAGLPEALAAALPPDPYEQLEAARLRQKLADKDRLAAELADRAASLEQALRDSDARLRAALDDNAKLAKERDSLAHTSKKLARDLAKLETFKRHLMQSLGDDNPPIQETVDIRTCEQSVAKASSWKDGVAHSRHHHPVSSLADGSTEIESVNQEGRTTRVDGKEFFRQARNRLSYEQFAAFLANIKELNAHRQSREETLQKADEIFGSENKDLFMSFQSLLSRSLSSGVKVYQMMDLSTTSVVAAKAYKYRAESLVKDYLLADCYVSYTAVLGGILMCKMVYDITHLISSLYYKGYGSLTKIQKLEWNNRGMSTVHAMFITLMSVYLVFFSNLFSDELDGPVTVRSSNLSNFTLGVSLGYFIADLAMLSWAYPSLGGMEYVLHHLLSIISLVYAIYSEEGQLYTYMVLISETTTPGINLRWFLDTVGMKRSKAYLVNGVTMFVAWLVKQMRTFSCILIFAVPTILLVMNTVWFVKILRGLKKTLAKRQ

SEQ ID NO: 62241 - protein, 574 aa, Yarrowia lipolytica CLIB122
DFLSELSSHTPQSLRRQVFSGRYNTSVGRGVLWRVYLQFDSLKLSDWKKDLETQRQRYDSFLSEFVNPSNCGGDRKMTFVDPLNNDIDDTDANDSETLEEIRKDVTRTFPEVDFFQQTHVQQSMTRILFVYAKLNPHLKYRQGMHELLGPLIYVLTMDGEVCGATEALSNVCSLQYIEHDSFALFEILMTNAASWYSTDTPSQIVLKSRLIQQKILRQSDPALTAKLEQHSIEPQIWGLRWIRLLFSREFDFPSVLELWDALFAASPKLDLVDYVCAVLLLRIREKIITCTDDTDILTCLFHYPTFAEEKMWSFVSNAVYLRNHVNREGGRYVSDQYSHLWREDNPLSESDTSRNGPSKLEDVFSTLSRNWGVDKIYNEVVRAANDVNTMGLRNTTQARLNDVIEGYVRQRTDGVSRDLERLSDLFDNTQDVHTQEYRDAVAELRALSKRLAIRDGVEMSDRPDKERHETPTVDPKQVSTTPHDPVVAGSRESHFETSSRSASDTPTRKSLAQSQFSWMLGDESPIGKVELEDTKFGPIPGSSSNKPVTSVSAKKKEVKKNVFELEERAVDGPL

SEQ ID NO: 62242 - protein, 294 aa, Physcomitrella patens subsp. patens
MSLQDIEELKANLSTYKEQLQQVKELLVLDPNNGEYQEMEKSLTEVLELTYDLLNEAQQAKEDATALEQEQEQIAATSTQRPPFHLSSTHTPLQVRSLALRVGTKVQAMWSGDGQWYKATVEAVTPGGYFVVYDEWGNKEEVLDEASVDPLLSAEQQANLTRLALKRKIEEAANVDVISKDLPPKLRIKPDDPEDVKAAKKKKIHAFKSKVRLEQMELTQNKNQNAWQQFQTTKGKSKKQVGFFTGRKRESIFKTPDDPKGKVGVTGSGKGTTEFHKREKHLHLKLGVDRDDYV

SEQ ID NO: 62243 - protein, 202 aa, Ustilago maydis 521
MSHAQDPTIGDDELATTATAGYKVGEKKSLAEYSQLDAEDESLARWKASLGIGASTSAVDPNAPKLSLHSLSLVSPTAPGGSISINLQQPKEQLAQIKQNPLSVKEGVEYSVKIRFSVGSDILSGLKYVQVVKRAGIKVDKMEEMIGSYGPRPEPYEKTFASSEAPSGMMARGNYSVRSRVVDDDNHVFADWEWAFKIAKDW

SEQ ID NO: 62244 - protein, 425 aa, Azoarcus sp. BH72
MVESNNQEGVDMSTSHIKVPAGGQKIVPGQPIPDNPIIPYIEGDGIGIDITPVMIKVIDAAVDKAYGGGRKIHWMEVFAGEKSTRLYGPDEWLPKETFDALKEYSVSIKGPMTTPVGGGIRSLNVALRQELDLYQCVRPVRYFNGVPSPLKDPSKVDMVIFRENTEDIYAGIEWAAESDSAKKVIRFLQEEMGVKKIRFPATSGIGIKPISREGTTRLVRAALRYAIDNDRRNLTIVHKGNIMKFTEGAFRDWAYEVAQKEFGAEPIDGGPWCRFKNPKTGREIVVKDAIADAFLQQILLRPAEYDVIACCNLNGDYISDALAAQVGGIGIAPGANISDQYACFEATHGTAPKYAGLDKVNPGSIILSAEMMLRHLGWTEAADLVIRSMEAAIGDKVVTYDFARLMEGAQEVSCSAFGDAMIARM

SEQ ID NO: 62245 - protein, 387 aa, Pseudomonas sp. 'TAC II 18'
MTVLKMTDLDLQGKRVLIREDLNVPVKDGVVTSDARILASLPTIKLALEKGAAVMVCSHLGRPTEGEFSAENSLKPVADYLSKALGREVPLVSDYLNGVDVKAGDIVLFENVRFNKGEKKNADELAKQYAALCDVFVMDAFGTAHRAEGPTHGVAKFAKVAAAGPLLAAELDALGKALGAPAKPMAAIVAGSKVSTKLDVLNSLSQICDLLIVGGGIASTFLAAAGHPVGKSLYEPDLLDTARAIAAKVNVPLPTDVVVAKEFAESAEATVKLIADVAADDMILDIGPQTAEHFAQLLKTSKTILWNGPVGVFEFDQFGNGTKVLAKAIADSAAFSIAGGGDTLAAIDKYGVADQISYISTGGGAFLEFVEGKVLPAVEVLESRAKA

SEQ ID NO: 62246 - protein, 388 aa, Gibberella zeae PH-1
MAAPQIPSQQWAQIFEKTAGRIWAQSHLFQSYPAIHSSCNTPVTFQALYSHLFLTAIEYKQIPVQKPGPDEVLVNVKFSGVCHTDLHAWQGDWPLDTKLPLVGGHEGAGVVVARGELVKDVKIGEKVGIKWLNGSCLSCSYCQNADESLCAEALLSGYTVDGSFQQYAIAKAIHVARIPEECDLEAISPILCAGITVYKGIKESGVKAGQSLAIVGAGGGLGSIAVQYAKAMGIHAIAIDGGEEKEKMCMSLGAQTFIDFTKTKNIVADVKATTNDGLGPHAALLVAAAEKPFQQATQYIRSKGTVVCIGLPAGAQFSAPVFDTVVRMIQIKGSYVGNRADTAEAIDFFRRGLIKVPFKTVGLSELNEVFKLMKAGQVAGRYVVDTSR

SEQ ID NO: 62247 - protein, 168 aa, Glycine max
MGEFTIQISNDLVNQLVDDAVPKKKTRKTRRKVARETEKPQSNETIKPDSAVTPGWPVQSPLFLPATLPVQPVHSELEGIQSVLQESERVLERLQKQEENMLQEVTQKAKDLHDKEYKLPNPKPEPCMAERLATLSCYKEHIKDPLKCASLVTGFADCLRRFGRLGDK

SEQ ID NO: 62248 - protein, 170 aa, Prochlorococcus marinus str. AS9601
MKKLEDLILTYKDFPKKGIEFKDVLEILQYPDIFQDIILKMSSNQFLKKAEAIISIDARGFIFGSAVALESSKPMIVARKPGKLPGQLLTREYDLEYGKNSLSIQVNALKKFNSFVIVDDLLATGGTVKSVSRLIRDQKKKILGLITVVELKSLKGKSKLDFPVHSIVTL

SEQ ID NO: 62249 - protein, 568 aa, Pseudomonas putida KT2440
MFLSRWLPGLANLLHYRREWFHADLQAGLSVAAIQIPIAIAYAQIVGLPPQYGLYACVLPMMVYALIGSSRQLMVGPDAATCAMIAGAVAPLAMGDPQRIVELSVIVTVLVGVMLIAAGLARAGFIASFFSRPILIGYLNGIGLSLIAGQLSKVVGFKIEGDGFILSLINFFQRLGEIHWVTLIIGLAALGLLIWLPRRYPRLPAALTVVALFMLLVGLFGLDRFGVAVLGPVPAGIPQLAWPHSNLAEMKSLLRDALGIATVSFCSAMLTARSFAARHGYAINANHEFVALGVSNLAAGVSQGFAISGADSRTAVNDMVGGKSQLVGIIAALVIALILLFFTAPMAWIPQAALGAVLLMAGWGLIDIKSLGHIRRLSRFEFWLCLLTTAGVLSLGVLPGIVFAVTLAILRLLYSIYQPTDAVLGWLPGTEGQVDIRKFKDARTVPGLVVYRFDDAILFFNADYFKMRLLEAVQSQDQPKAVLFDAEAVTSIDVSGIAALREVRDTLAAQGILFAIARARGTFLRMLVRSGMARDMEEKLLFGSVRAGIRAYRVWRNRNRSVQVTEQG

SEQ ID NO: 62250 - protein, 230 aa, Ustilago maydis 521
MAYVCLLVPHALCLTASLATLEEQHITLNAHLSYREPSREHRFSSANPTYAYLTTMPPKGAKASSSAATKSRTSASPSSSSSTQSPLSTLYNSYVDNTPKRLKVIDAFLVFLMLSGMIQFLYCALITNFPFNSFIAGFASTVGQFVLAASLRIQANPENGQTFPKVSPESCSDPGIESSILDRCVGILKWIHRDLEIRLPHVEEEVLDPILVLVLVQENHLYVCGSAEHE

SEQ ID NO: 62251 - protein, 217 aa, Zea mays
MAATRASPVLLLLLLTVQLSLLFRLPDSPSTLALALALAAEPDQQNAKQHRQPALLVQSTCNSTSFYDLCIAALAADPASSTADVPGLGGIAVSAAANNASGTAAFLGNASDAAATPQADRALLRACAGKYAAARDALVQARASLAEQAYDYAFVHVSAAGEYPAVCRTLFRRRQQQQRGASRTAYPAELAKREEALRRLCTIALDIISLLQNQETY

SEQ ID NO: 62252 - protein, 331 aa, Thermus thermophilus HB27
MKVGINGFGRIGRQVFRILHERGVEVALINDLTDNKTLAHLLKYDSTYGRFPGAVGYDEENLYVDGKAIRATAIKDPREIPWKQAGVGVVVESTGVFTDGEKARAHLEAGAKKVIITAPAKNEDITVVLGVNHEQYDPAKHHIISNASCTTNSLAPVMKVLEEAFGVEKALMTTVHSYTNDQRLLDLPHKDLRRARAAALNIIPTTTGAAKATALVLPSLKGRFDGMALRVPTPTGSISDITALLKREVTAEEVNAALKAAAEGPLKGILAYTEDEIVLRDIVMDPHSSIVDGKLTKAIGNLVKVFAWYDNEWGYANRVADLVELVLKKGV

SEQ ID NO: 62253 - protein, 390 aa, Thermus thermophilus HB27
MRTLLDLDPKGKRVLVRVDYNVPVQDGKVQDETRILESLPTLRHLLAGGASLVLLSHLGRPKGPDPRYSLAPVGEALRAHLPEARFAPFPPGSEEARREAEALRPGEVLLLENVRFEPGEEKNDPELSARYARLGEAFVLDAFGSAHRAHASVVGVARLLPAYAGFLMEKEVRALSRLLKDPERPYAVVLGGAKVSDKIGVIESLLPRIDRLLIGGAMAFTFLKALGGEVGKSLVEEDRLDLAKDLLGRAEALGVRVYLPEDVVAAERIEAGVETRVFPARAIPVPYMGLDIGPKTREAFARALEGARTVFWNGPMGVFEVPPFDEGTLAVGRAIAALEGAFTVVGGGDSVAAVNRLGLKDRFGHVSTGGGASLEFLEKGTLPGLEVLEG

SEQ ID NO: 62254 - protein, 678 aa, Pseudomonas aeruginosa PAO1
MQERIPDELTLPELTLRGLILGALITVVFTASNVYLGLKVGLTFASSIPAAVISMAVLRYFSGANILENNMVQTQASAAGTLSSIIFILPGLLMIGYWSGFPFWQTAAICSIGGILGVLYTIPLRRVMVVQSELPYPEGVAAAEILRVGSDGAEDEEDARAPRAAGNAPGLYDILGGGLVAALFSLWSSGFKVLAEGFSVWLSAGQAAFRLSTGFSLALVGAGYLMGITAGIAILIGVVISWGVAVPLLTVNSVPADGQSLSDLATQLWSSQVRFLGAGTIGVAALWTLATLFKPMVRGVWASLGAVRGNSQANSLRTELDMPAKWILLIAGILLVSLFVVFSHFLGAAAPDMASPQFWSLVAVCVVFAFFFGFLIAAACGYMAGLVGSSSSPISGIGIIAVILVSLLILGFGSIEGGLLDRQNGKLAIALALFTTSVVLAIAAISNDNLQDLKTGYLVGATPWRQQVALIVGCIVGALVIPPVLELLYSAYGFTGALPREGMDPGQALAAPQATLMTAIASGIFHDALNWNMILIGVALGIALILVDLLLRRTGKACLPVLAVGLGIYLPPTIGMTLVVGALISWLLENALKKRAAAAGVDEEAYAEEPKRRGVLLASGLIVGESLMGILLAGVIGATGEDAPLALAGAGFAGIAQWLGLVVFVAICVLFYRRVLAR

SEQ ID NO: 62255 - protein, 565 aa, Gibberella zeae PH-1
MKIPILWLASSLHYGLLSASPIFEELLSPKAGTKGAVVSEAQECSYIGRDLLARGGNAVDAMIGTTFCVGVIGMYHSGIGGGGFMLVRDKDGQYEAIDFRESAPAAAYEDMYQGNVNGSIYGGLSVGVPGEVRGFEYAHKKYGSLPWKTILQGAIKVARDGFIVNADMAKFIEKTTKGHQNLFTEDPSWAEDFAPNGRLIAEGETMTRKRYASTLQAIADHGADVFYTGPFAESMIKTIQDSNGTMTLDDLEDYQIISREVLHTDYKGYDVYGMSSPAGGAVSLNILNTMNGYSHQDADQNTTLHIYIEAMKFAYGARLKLGDPDFVDGISELEHEMLNHTTAEKIREKIDPWTTQDIEKYDPDGIYSSEGHGTSHVVTADRDGMAVSLTTTVNLIFGSLLMDNLTGVILNNEMNDFSIPGVPNEFGFAPAEANFVRPNKRPLSSCTPIIVSNKDGSLFAVIGAAGGSRIISATTQVAWRVLTSPSWSIEDAVREPRVHNQLMPNTLLVEKKFSSYDVPSLKERGHNITWVDEGLSSVQALVRDSDGVFEIAAEPRQKNSGGATL

SEQ ID NO: 62256 - protein, 154 aa, Glycine max
  misc_feature (93)..(93): Xaa can be any naturally occurring amino acid
  misc_feature (110)..(110): Xaa can be any naturally occurring amino acid
  misc_feature (120)..(120): Xaa can be any naturally occurring amino acid
  misc_feature (131)..(131): Xaa can be any naturally occurring amino acid
MASEQTFIMIKPDGVQRGLIGEVISRFEKKGFYLKGLKLQNVEKSFAEQHYADLSSKPFFAGLVEYIVSGPVVAMVWEGKSVVSTGRKIIGAXTTPLASEPGTIRGDFAXDIGRNVIHGXSDSVESARKEXSALWFPLEGHCKGEGAPSHTWIQ

SEQ ID NO: 62257 - protein, 437 aa, Triticum aestivum
  misc_feature (323)..(323): Xaa can be any naturally occurring amino acid
AYLGDTIEQVCTKKQAGTGPEFPGYRRPTRPVIGAIVSWNYPFHNVFNPMLAAVFSGNAAVIKVSEHASWSGCFYSRIIQAALLAVGAPDNLVHIVTGFAETGQALVSSVDKIIFVGSPGVGRMIMQKASETLIPVTLELGGKDAFIVCEDVDLPNVVQVAVRAALQSSGQNCAGAERFYVHKDIYPTFVSRVVKIIKSISVGPPLSGRYDMGAICMIEHSERLQNLVNDALDKGAEIAGRGSFGNLGEDAVDQFFPPTVLVNVDHTMKIMQEEAFGPILPIMKFSSDEEVIQLANDSKYGLGCAVFSGDQKRAIKIASQLHXVGVAAINDFASSYMCQSLPFGGVKDSGFGRFAGVEGLRACCLVKAVVEDRWWPYVKTMIPKPIQYPVSENGFAFQQLLVETLYGISVWDRLQSLVNLLKMISEQKSPITRRKSR

SEQ ID NO: 62258 - protein, 923 aa, Arabidopsis thaliana
METLNSDKGKLLSERRRRGNYERKSYKIEQGPHLNLSLTKSPELINKIESYLNGHCTCPHQQTENSSKRSTLPKSPEKLKAMNFPISTIRIGGWVVVAKNPDDIVAKFYFAKKKLIWEFLFGEPETNTLRLKRKIEIQWNDVSSFEESISSRDETGILKIELKKRPTFFIETNPQAGKHTQWKQLDHDFTGDHASNYRRHTLHFPPGVLQKNLEKLVTDSFWSKLYEVPFPVHESRYFDSGFENNSSRNSHSHTVGFNVNNGPQHHFSQGIGGVGVGEGNFSMANGGWQRNSYSPVNSLNYNTANEFFGMQATPPSSQVVNEHYNTQNDFTGSQFGYHMNQDEIQKILESQAYAVPDTQTKLMSSAMNNVPKYPQAGSCLESMLFWLVQVVSRTCGDLASGGNKSLAVRCKSGIFRLHSGGGRLSSSTDWLLQQRWLAPASHQSTIVAVMELENGPNKRYQYRWPISGFMSYLPKSQGAAAKKCGTMVMLGVLQLPCRLHHSLFYSSSQIASSRPQGVAKVVLKKGKTQLFKDGSPMVYSGAVDRIIGKPPPQTGDVVIVADGTENPIGWGLYNSVSMFCVRLMQLQHESTRDPSCALNIEKLLQTRIAEAVQLRKSLALPSANTNAYRLVNSEGDRLSGLIVDVFGDIAVVASSAAWLEKYRIEVESCLRSIDGINHINWRPSLDVLKEDGFDISSLKQTQSSTLPQRSMVVENGISYAISLEGQKTGFYTDQRENRHFISTISAGKRVLDLCCYSGGFALNAARGGATSVIGIDSSLPALELARENVILNNMDPEKVVFFKQDSTEFMKGALSREETWDIVILDPPKLAPRKKVLHNASGMYRNLNSLAMRLTRSGGLMMTCSCSGAMTQSGKFLGILQSAAAMSGRKITVVREAGAASDHPLDPSYPQGQYLSNLLLRVL

SEQ ID NO: 62259 - protein, 528 aa, Fusobacterium nucleatum subsp. vincentii ATCC 49256
MEQLEKLKEFRELGLSEKVLKVLSKKGYESPTPIQRLTIPALLKNDKDIIGQAQTGTGKTAAFSLPIIENFENLEHIQAIVLTPTRELALQVAEEMNSLSTSKKMKVIPVYGGQSIDIQRKLIKTGVDVVVGTPGRVIDLIERKLLKLNSLKYFILDEADEMLNMGFVEDIEKILTFTNEDKRMLFFSATMPDEIMKVAKNHMKEYEVLAVKSRELTTDLTEQIYFEVNERDKFEALCRIIDLTKEFYGIIFCRTKTDVNEIVGRLNDRGYDAEGLHGDIGQNYREVTLKRFKTKKINILVATDVAARGIDINDLSHVINYAIPQEVESYVHRIGRTGRAGKEGTAITFITPQEYRRLLQIQKAVKKEIKKEKLPDVKDVIQAKKFRIIDDIGQILIDNDYDKFKKLAKDLLKMEDAENIVASLLKLSYSDVLDESNYNEISPVKMEDTGKTRLFIAMGRKDGMTPKKLVEFIVKKAKVKQSYIKNAEVYEGFSFVSVPFKEAEIIVEAFAKNRKGKKPLIEKAKSKK

SEQ ID NO: 62260 - protein, 335 aa, Candida albicans SC5314
MSSIFPKLSFQEWYQVLYGLWPSNPQFTEKDISSNTLKDKVVVITGGNSGIGYETAKVLAGNTEARIYIWARNRQKSIEAIEKIKLEVAEKHSKDVGDRLQFIQIDLSDLNSIEPAVKEFLQREQRLDIIYHNAGVMESPSDQKTKQDYQMELGVNCIGPQLLQTLLDPLFIKTAEKNPPNLSRIVWVSSTAHMLSPIGGMYLRDPEFKSIDVELKTKYDQSKAINLIQARQWNIHHPGANAISLSLCPGYLKTGIQRHVTGLTKLAYNLFFHDQKMGVYTLLFAGLSPEITTKNKGDHVISFGKLGLIRPDLKDDENGKKVWDYLQDKIKSYVR

SEQ ID NO: 62261 - protein, 381 aa, Burkholderia pseudomallei K96243
MMRDAANFEPADSRVTRPAFWQALPERWTSDVEETLVCCHVRQETHDVKSFFFRSPQGRAFSFEPGQFVTLELDIDGETINRCYTISSSPARPHTISITVKRVPGGKVSNWLHDNLQPGAPLRVLGPAGEFTCARHPARKYLFLSAGSGITPLMSMSRAHHDLAEDRDIVFVHSARTPDDIIFARELDLIASTHANFRTAFVCERLGARTNWHGVTGFLSLPLLKLVAPDFMEREIFTCGPAPYMKAVRELLAEAGFDRSRYHEESFSFETLAQREAPADAPAGEDAAARGAQVRQYTIAFAKSHREIACGADQHVLDAARRAGVRLPASCTQGMCGTCKVKLVSGQVDMKHNGGIRQREIDQGMVLLCCSKPLSDLVVDK

SEQ ID NO: 62262 - protein, 362 aa, Bordetella parapertussis 12822
MSHNPFHMLKVASVARNTRDAVVVTFDLPPELAGDFRFRPGQYLTLRTRLDGEEVRRSYSICSAPGDGVLRVAIKKVDEGVFSNWANHELQPGQSLEVMPPAGNFTVDFDPDNARHYVAFAVGSGITPVFSLVKSALSAEPRSRFTLFFGNRASSSVLFREEIEDLKNLYMERFSLVYIMSRESQDIELFNGRLDGDKVDQLLTAWMRPGDIDYAFVCGPQTMIESVVEHLQARGMPKSHIKFELFGAPKGPRALRTGRDAPAAPGKGQCEVTVVQDGHSRTFFIDKNKDSVLDSALAQGVELPYSCKGGVCSTCRCKVVEGEVDMDANFALEDYEVARGFVLSCQSYPVSDRLVIDFDQET

SEQ ID NO: 62263 - protein, 560 aa, Bacillus anthracis str. A2012
  misc_feature (278)..(278): Xaa can be any naturally occurring amino acid
  misc_feature (293)..(293): Xaa can be any naturally occurring amino acid
MKFSSKQRKDVLNGVNKQELDVIVIGGGITGSGIALDGATRGLSTIVFEMQDFAAGTSSRSTKLVHGGLRYLKQLEVKMVAEVGKERAIVYENGPHVTTPEWMLLPFHTGGTFGSFSTSIGLRVYDFLAGVKRSERRKMFNREETLKKEPLVKQEGLKGGGYYVEYRTDDARLTIEVMKEAIEHGAKAVNYAKVDGFLYKDGKVCGVRVIDLLDGEVYEVYGKKIVNAAGPWVDTLREKDNSKKGKVLQLSKGVHLVIDQKRFPLGQAIYFDTPDKRXVFAIPRGGKTYVGTXDTFYDKDAAVPQMTTEDRTYIINAINYMFPSVKITEKDIESSWAGVRPLIYEEGKSASEISRKDEIWTSESGLITIAGGKLTGYRKMAEMVVDYVTNLLQKEGHSAYPKSSTKHMPISGGHVDGSKGLPAFIAKKAGEGTKYGLTTAQAEEFAKFYGSNVDVLFDLAKKHKDEAKEYNMPLDVLIPLVYAMDYEMTAKPVDFFVRRRGAVFFNIHWVYEWKEAVINYMAAKLGWSKEEQMKYTAELEKALTDAVIPVDQQEHAAALA

SEQ ID NO: 62264 - protein, 329 aa, Picea sitchensis
MEEHGQWRRALVDALAGAKAGGISRTVTSPLDVIKIRFQVQLEPTVRLLSPGGVLGVSKYTGIFQATKDILREEGMLGLWRGNVPALLMVMPYTAIQFSVLHKFKTFVAGSGKAEDHARLSPYLSYVSGGLAGSAATVGSYPFDLLRTLLASQGEPKVYPNLRSAFLEITRTKGIRGLYAGLSPTLVEIVPYAGLQFGSYDTFKRWIKTWNQANPRQTGSESEESLSSVQLFLCGLAAGTVAKIACHPLDVVKKRFQVEGLQRHPRYGARVEEKTYTGMWDAVRRILQAEGLAGLYKGIVPSVIKAAPAGAVTFVVYEYTSDWLDSIIK

SEQ ID NO: 62265 - protein, 518 aa, Callistephus chinensis
MTILPFIFYTCITALVLYVLLNLLTRNPNRLPPGPTPWPIVGNLPHLGMIPHHSLAALAQKYGPLMHLRLGFVDVVVAASASVAAQFLKTHDANFASRPPNSGAKHIAYNYQDLVFAPYGPRWRMLRKICSVHLFSTKALDDFRHVREEEVAILTRVLVHAGESAVKLGQLLNVCTTNALARVMLGRRVFADGSEGRGVDPKADEFKDMVVELMELAGEFNIGDFIPPLDCLDLQGITKKMKKLHARFDKFLNIILDDHKIEKGAAGRRHSDLLTTLISLKDVDAADDDEEGKLSDIEIKALLLNLFAAGTDTSSSTVEWAVAELIRHPELLKQAREEMDIVVGRDRLVTELDLSRLTFLQAIVKETFRLHPSTPLSLPRMASESCEVDGYYIPKGSTLLVNVWAIARDPKMWTNPLEFRPSRFLPGGEKPDADIKGNDFEVIPFGAGRRICAGMSLGMRMVQLLIATLVQTFDWELANGLDPEKLNMEEAYGLTLQRAEPLMVHPRPRLSPHVYESR

SEQ ID NO: 62266 - protein, 826 aa, Candida albicans SC5314
MTGVLEVVKSITSNEGFVSEVPHLYGGEEHHKVKSHEFDSNSINNTNYNSNVFVPAYDEREVTVKEWFQYIFANPLKMIADYLISLFPILKWILHYNIRWLYGDLVAGITVGVVLVPQSMSYAQLAGLEAQYGLYSSFVGVFIYSFFATSKDVSIGPVAVMSLQVSKVIAHVQDKFGDKYAAPEIATFLSLICGGIALGIGLLRLGFILEFISIPAVMGFMTGSAFNIITGQVPGLMGYNSKVNTRDSTYLVVVNTLKHLPDSTVDAAFGLIPLFILYLWKFSTDYAQKRYPRHKMYFFYFQQLRNAIVIIVATAISWGIVHPKKVAFNGPSSKFKPPIKTIGDVPSGLRHVGVMSIPDGIISAMASEIPVSTVILLLEHIAISKSFGRINDYKVVPDQEVIAIGVNNLIGTFFNAYPATGSFSRSALKAKCGVRTPLAGIFTGAVVLLALYALTKAFYYIPKATLSAVIIHAVSDLIANYKITWSFWKMSPIDCGIFLIAVILTVFVTIEAGIYFAIAASVVVLLVRVAIPHGQFLGKIQIAEVVNPIIEQTGSHDEHNASASDGTSYSSDLEIHQVLSEGTNYKSTDEAGKLKAKEDIKPVEGVTTSALQRNNPQVKFHTRWVPLNNENINAGIKVQPPPPGVLVFKPVETFTYPNASRQVDKVSDEAKRLTRRGKPFDYSKIGSRPWNDPGPLRWNLPWSKKEKVEEKVEDNRPILRIVHFDFSTVASIDVTAIQALVDLRKALNAYADREVEFHFSGILSPWIRRGLLNAGFGTYEDGLLSTNNYVNIAAGYKDLEDHVDEPYYAATGTNTPFFHLDIPNYS

SEQ ID NO: 62267 - protein, 442 aa, Rhizobium leguminosarum bv. viciae 3841
MRITMIGSGYVGLVSGVCFADFGHDVICVDKDLSKIEALREGRIPIYEPGLEQLVAENTSTGRLSFSTDVGESVRSADVVFIAVGTPSRRGDGHADLSYVYAAAREIATYVEGFTVIVTKSTVPVGTGDEVERIMRETNPAADVAVVSNPEFLREGAAIEDFKRPDRIVVGLNDDRARETMTEVYRPLYLNQAPLVFTTRRTSELIKYAANAFLAMKITFINEIADLCERVDANVQDVSRGIGLDGRIGSKFLHAGPGYGGSCFPKDTLALAKTAQDYDAPMRLIETTISINDNRKRAMGRKVISAVGGDIRGKKIAILGLTFKPNTDDMRDSPAIAVIQTLQDNGAQVVGYDPEGMENARKVIDNIDYASGPYEAAAGADALVIVTEWNQFRALDFSRLKQSMRTPILVDLRNIYRSDEVRKHGFTYTGIGTNLYQETTGA

SEQ ID NO: 62268 - protein, 429 aa, Mesorhizobium loti MAFF303099
MKDIMKNSAISERKNQSISRGVGMTTQIYADRAENSEIWDVEGRRYIDFSSGIAVVNTGHRHPRVIEAVKAQLDRFTHTCHQVVPYESYVRLAERLNAMLPGKFEKKTIFVTTGAEAVENAIKIARNATGRPAVIAFAGGFHGRTFMGMALTGKVVPYKVGFGAMPGDVYHAPFPVPLHGVSVADSLAALDRLFKADVDPARVAAIIVEPVQGEGGFYEAPREFLTALRKLCDQHGMLLIADEVQTGFARTGKMFAMDHHEVAADITTMAKSLAGGFPLSAVTGRAEIMDAPGPGGLGGTYGGSPIGVAAAHAVLDVIEDEKLCDRANTLGARLKQRLQSIRDDVPEIVDIRGLGFMNAVEFNDVKKGMPSAEIANAIRLKALDKGLILLTCGVYGNVIRFLAPITIQDEVMNEALDILESSIREVCAA

SEQ ID NO: 62269 - protein, 510 aa, Callistephus chinensis
MSILSLLVYFCISLLVIIALVNMFITRHTNRLPPGPAPWPVVGNLPHLGAIPHHTLAALATKYGPLVYLRLGFVHVVVASSPSVAAQFLKVHDLKFASRPPNSGAKHIAYNYQDMVFAPYGPQWTMFRKICKDHLFSSKALDDFRHVRQEEVAILARGLAGAGRSKVNLGQQLNMCTANTLARMMLDKRVFGNESGGDDPKANEFKEMATELMFLAGQFNIGDYIPVLDWLDLQGIVKKMKKLHTRFDKFLDVILDEHKVIASGHIDMLSTLISLKDDTSVDGRKPSDIEIKALLLELFVAGTDTSSNTVEWAIAELIRQPHLLKRAQEEMDSVVGQNRLVTEMDLSQLTFLQAIVKEAFRLHPSTPLSLPRIASESCEVDGYYIPKGSTLLVNIWAIGRHPEVWTDPLEFRPTRFLPGGEKPGIVVKVNDFEVLPFGAGRRICAGMSLALRTVQLLMGTLVQAFDWELANGIKPEKLNMDEAFGLSVQRAEPLVVHPRPRLPPHVYKSG

SEQ ID NO: 62270 - protein, 511 aa, Lycianthes rantonnei
MVLLLISELCASAIIFIIVHIIISKLIATGWGRRQRLPPGPMGWPVIGALPLLGTMPHVALAKMAKKYGPIMYLKVGTCGMVVASTPNAAKAFLKTLDINFSNRPPNAGATHLAYDAQDMVFAHYGPRWKLLRKLSNLHMLGGKALEDWANVRANELGHMLKSMFDASRVGGRVVVADMLTFAMANMIGQVILSKRVFVEKGAEVNKFKDMVVELMTVAGYFNIGDFIPQLAWMDLQGIEKGMKCLHKKFDDLLTKMFDEHKATTNERKGKPDFLDVVMANRDNSEGERLSTNNIKALLLNLFTAGTDTSSSAIEWALAEMMKNPQILKKVQQEMDQIIGKNRRLIESDIPNLPYLRAVCKETFRKHPSTPLNLPRISNEPCMVDGYYIPKNIRLSVNIWAIGRDPDVWENPLEFNPERFLSGKNVKIDPRGNDFELIPFGAGRRICAGTRMGIVMVEYILGTLVHSFDWKFSNDVKEINMEESFGLALQKAVPLEAMVTPRLPFDVYYTN

SEQ ID NO: 62271 - protein, 750 aa, Ustilago maydis 521
MPSLVSSPGTSTMQTDNVHEPSSAFATPPTQSTSSFASGSNTPSHQIRLNGQSSGIGESPAPHSSRPYHSSSHASQSNGAGTGKDKKWKQMFKFGSIGRKASGNASNDRSWHTDSAESSMHKNGDYFEHVQYTGSQPGSTSFQPISGSTVVNDPASFSNDSYSSEDRNASGSIGDAMTTSASSKLQPPADISDTDSSHPRFTSRLMRRVSSAPDTNKLFKNGQNATQKPNEAASSTKNGYLSPDGAGGQHAQFVSEGGAPFTPSKELANAAFFSNSPVRMDSNATSFSYKDFEKGRSVSAKGSSTPKSGRIVFPGTGRSKSSNGKDKKSQLPPPSSSANLAALAGTASVNRGPGSFRRTYSSNSIKVKEVEVGPNSFSKVKMLGKGDVGKVYLVREKKTDKLYAMKVLSKKEMIKRNKIKRVMAEQEILAASNHPFIVTLYHSFQSEDYLYLCMEYCMGGEFFRALQTRPGKCLPEEDAKFYAAEVIAALEYLHLMGFIYRDLKPENILLHQSGHVMLSDFDLSARATQRGGAPAMIRQATPNSAPLVDTRSCIADLRTNSFVGTEEYIAPEVIKGCGHTSAVDWWTLGILIYEMIFATTPFKGSTRNETFSNVLRNEVQFPDSIPISSFGKSLIRKLLIKDELKRMGSQSGASEVKQHKWFSNISWGLLRNSTPPIVPAYSNGVDAVNFRNVRESRSLNLDDQGNDTRAKPAVIKAVAGQKNVGDEEGDAVVSNPFSGFSSVTLKHDDY

SEQ ID NO: 62272 - protein, 414 aa, Thermus thermophilus HB27
MDLDAFTLFERHINPGLAGLLRFTGLDRVESHAEGPYVWDTQGKRYLDFLGLYGTLNLGHRHPKVVEAVKRQLDRMPMSVRVLVSEPTARLAAKLAEITPEGLEMVFFGNSGAEAVEAAIKLARAYTGKPGIVTTQGGFHGKTMGALSLTPKPEYQDPARPLLPGVKVVPYGDLKALEAAIDEDTAAVIVEPIQGEGGIRVPPEGYLRGVRELTREKGVLMIADEVQTGLGRTGRLFGVDWEGVAPDLMTLAKALGGGVMPIGACVGRREVFEVFKNNPLFHSSTFGGNPLAAAAALAAIEVTLEEDLPGRALELGRHLMEGLKALKEEHPHLIEDVRGRGLMVGVEFTDADIGALVVAEMAERGVLTAFGLNNPKVVRLEPPLIIGKEHVDEALAVFAEALKATEKALEGLLG

SEQ ID NO: 62273 - protein, 513 aa, Matthiola incana
MTTLILTILLATFLSLFIFFLLRRNRNRNHRLPPGPNPWPIVGNLPHMGPKPHQTLAAMVTTYGPILHLRLGFVNVVVAASKSVAEQFLKIHDANFASRPPNSGAKHIAYNYQDLVFAPYGQRWRMLRKISSVHLFSAKALEDFKHVRQEEIGRLTREVARADTKPVNLGQLVNMCVVNALGREMIGRRLFGDGADHKAEEFRSMVTEMMALAGVFNVGDFVPALDWLDLQGVAGKMKRLHKRFDAFLSSILKEHEINNGGDQKHTDMLTTLISLKGTDFDGDGASITDTEIKALLLNMFTAGTDTSASTVDWAIAELIRHPHIMKRTQEELDAVVGRNRPINESDLSRLPYLQAVIKENFRLHPPTPLSLPHIAAESCEINGYHIPKGSTLLTNIWAIARDPEQWSDPLAFRPERFLPGGEKFGVDVKGSDFELIPFGAGRRICAGLSLGLRTIQLLTATLVHGFEWELAGGVTPEKLNMEETYGITVQRAVPLIVHPKPRLALNVYGVGSG

SEQ ID NO: 62274 - protein, 290 aa, Nicotiana tabacum
MGSLRAILKNPEDLYPLVKLKLAARHAEKQIPPSPHWGFCYSMLHKVSRSFALVIQQLPVELRDAVCIFYLVLRALDTVEDDTSIPTDVKVPILISFHQHVYDREWHFSCGTKEYKVLMDQFHHVSTAFLELRKHYQQAIEDITMRMGAGMAKFICKEVETTDDYDEYCHYEAGLVGLGLSKLFHASGKEDLASDSLSNSMGLFLQKTNIIRDYLEDINEVPKCRMFWPREIWSKYVNKLEELKYEDNSAKAVQCLNDMVTNALSHVEDCLTYMSALRDPSIFRFCAIPQ

SEQ ID NO: 62275 - protein, 562 aa, Zea mays
MHLTVMSLSAAVANGAAAYRYDTIQPVARLRFCGLRRKAHRLHSPRYSRHLVAARRSVVVAATAGNGAAASGTFDYDLVIIGAGVGGHGAALHAVEKGLKTAIIEGDVVGGTCVNRGCVPSKALLAVSGRMRELQDEHHMKSLGLQVSSPGYDRQVVADHANNLASKIRSNLTNSMKALGVDILTGIGTIVGKQKVRYGKVGFPDNEITARNIIIATGSVPFVPKGIEIDGKTVFTSDHALKLESVPEWIAIVGSGYIGLEFSDVYTALGSEVTFVEALDQLMPGFDPEIAKLAQRILISPRKIDYHTGVFASKITPAKDGKPVLIELIDAKTKEHKETLEVDAALIATGRAPFTKGLGLENINVVTQQGFVPVDERMQVMDATGNVVPNLYCIGDANGKLMLAHAASAQGISVVEQISGRDNILNHLSIPAACFTHPEISMVGLTEPQAREKADKEGFEISVVKTSFKANTKALAENEGDGLAKMIYRPDTGEILGVHILGLHAADLIHEASNAIALGTHVQDIKFAVHAHPTLSEVLDELFKAAKVNTAGSHSMNEPVAV

SEQ ID NO: 62276 - protein, 648 aa, Candida glabrata CBS 138
MVDGGKTLVEALKNPLLSSSRLIKLLRADSKVPTVDAAIKLIETHGPIHESFHTPRHVDKGAHFAYSIPQNRTGYSPLLVNEKALKDMNIIRDQELTKILDGETLYYDESRAIFPYSTNYAGFQFGQFAGQLGDGRVVNLFDLKDKSGEWQTLQIKGSGLTPFSRFADGKAVLRSSIREYIISESLHAIGIPSTRSLQLTLLPTTKAQRGGTVEPCANYCRFAPTWLRLGHFDIYRWKFDIQSMAKLSDYVIEEVFHNNIEQEDLNEYTIDYFPDEPGQPNPECTAIDSKSTTKYDLMFRKIVNLNAECVAYWQAYGFLNGVLNTDNTSILGLSIDFGPFSFMDQFDPQYTPNHDDSMRRYCFANQPGIVWWNLLQFGQAISVLLGSGKYNLPTVLKAKDIGDIDKGTQRQLLDRVNSLIHLCGNEYKYRFTSKYVELMAKRLGVDVDAVIPEGDKQTRAKHINIFLKETIEPLLEVLQYTKVDYNNFFYKLEEYNGSQHVNNDSLDDFMGLNPHYVRLFFSAEEFALLGRYYCGEHTMNSDVKAALEYLQKIKQWTTTLGKLPRSNAKHVNPKFIPRSWMFEEVIDDLTLQLRDGHKPDLSALQKLSNMSTNPYDPAQWDQTRPDLQERWLQEQHPSKLMKQASCSS

SEQ ID NO: 62277 - protein, 706 aa, Desulfitobacterium hafniense DCB-2
MKVKYFSKKISIVLALLVMFSSLPNVPVSADPNPLNAVIPKYQEERQFGFSAGGLHTVWFDTSHGGDVTASGNNDYGQLGDGTTISRSLPVTINNLYSRVADISAGGTHNLALIDDQTVRAWGNNQKGQLGIGSDINSLIPVEVPGLSEIIAISSGFDFSLALKNDGTVYSFGSNEFNQLGDSSVGSRNTPAQIPGLDSIVAIAAGGTHALALHMDGSVYAWGSNERGELGDGGSASGYQPVKIASLSNITAISAGLRHCLALGADGSVYAWGDNSLGQLGDPKISDYSNVPIKVQGIKAAFRIAAGYNSSFIIAQQNATYGFGDNSANQINSSAVENLSSPTLLNIKASFISPGWGHTVSRGFLGNDNGVDNWSWGYNQFGQTGNGLTEHVLNPTAPYSGTNRQPVFFRISGANRFKTAVAISIEGWDYGAATVVLARADNFPDALAGTPLAYGLNAPILLTDSARLSNDTKDELDRLAPQNIIILGQEGAISSSIEKDLQKHYKVTRVGGQDRYETAAAIAQYMHDHHLILGNKAVIAYGENFPDALAVSSVAAHAHMPILLTKKDVLADAAGEALKRLGINETFIVGGTGVVGTAVESSLPLPTRYSGNDRYATAIAIANGMGTDPYLVYLATGTNFPDALAGSVLAARSNSPIILVNSSSGAEAAAQWFWWNSRDIKQSYVLGGSGAVPDSVIESIYSRIGY

SEQ ID NO: 62278 - protein, 300 aa, Oryza sativa Indica Group
MLPYATAAEAEAAVGRGLTWAEAAWFRYSASIPDYCLYCHNVPILLLVYTLAPLPLALLELRRHLPLPHKLQPGVRHPPAAFLRCYAATARVLLLAVGPVQLASFPAVRAVGIRTGLPLPSAGETAAQVAVYLLVEDYLGYWIHRLLHTPWAYHHIHRVHHEFTAPMGYAAPYAHWAEILILGFPAFAGPAIVPCHMTTFWLWFVLRHLEAIHIHSGFKLPFDPTKYIPLYGGVEYHDYHHFVGGHSQSNFSSVFTFCDYIYGTDRGYRYHKASLSKLKEMAGNHVEKGDENGFGNGKQD

SEQ ID NO: 62279 - protein, 976 aa, Kluyveromyces lactis NRRL Y-1140
MDPFMVSCYMMTSQKRLVEPSMRLEFNDVDDEHQAIMPQSILRSLSLEDGSNSDMSSKSTAPSSGSEESFVYDHIYKGIKGFLSRRPSFNGHGNSNNNPNKNKTSQLGGPLTYALSSNLRLESTDSGFGSFSADPLDLPLLKVTRRKRVRYTFHIDQNTISWNNGKKLIYVDTIKDIRSGDMATNYMDMYNVPCPSRDLWCTIIYSVNKNRLKALHVIAEDAAVFKSFYETTVNLVNSRRKLMEDIAVPNNEQFANIHWQTSVSTKKEDQDKDTLSFADVKRLCNRYHIYCSDNYLYALFIKADTNNNSLLNFPEFQDFVKYLKARPEIEIIWNQMKNKDTKVVDFQSFYQFICDVQGEVISQTNAYKIFKKYCTADELLDVEGLLKFLTKQPFLQLFEEDYSRPLNEYFISSSHNTYLMGKQVVDEVSVEAYTRALQQGCRCIEIDIWQGDHGPVVCHGLFTQSIPLEDVVKTIRKYAFITSPYPLIVSLEIHCKKDYQLMITKIMKEILGDLIFVIPPNTSLLSPEQLKNRIILKSKKTHAVESEIISGSTSSYTSSSSHESLSETNDMRLIKKRGLQKSTTSSTSPNTTTVPVTTKRNNKSLLLSTKIMISDKVHEISGIHGVRFRNFSLPESKTTTHCFSLSEKKFINLDKDETQKLAINKHNRRHLMRIYPHMLRYKSSNFNPIRFWKEGVQMVATNWQTYDLGQQLNHAMFQVSLDRNSIWHSGYVLKPAHLRKEIHKMKDIPVIMERLKREKIHIHLDVISGQMLSLQNCKILAPFVEIELITDNTMESLHLTNCLQPMGYTSNNSTHATGITSMSNASNGTFANITSTSTKRVDSNGSSGKTEPLCESNGTTVISGLSAEDGILSTPSAPPAVSVPVLSSPQLFSTKCFRDNGFSPVWNASFECTLTNTTFNFVRFTVKNSTQTIATTCVRLNYLKQGYRHLPLYNIKGEKFIFSTLFIRYKEELLKW

SEQ ID NO: 62280 - protein, 294 aa, Oryza sativa Indica Group
MEQYEKEEKIGEGTYGVVYKARDKVTNETIALKKIRLEQEDEGVPSTAIREISLLKEMHHRNIVRLHDVIHSEKRIGLVFEYLDLDLKKFMDSCPEFAKNPTLIKSYLYQILRGVAYCHSHRVLHRDLKPQNLLIDRRTNTLKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQALATIVPTLDPAGLDLLSKMLRYEPNKRITARQALEHEYFKDLEMER

SEQ ID NO: 62281 - protein, 394 aa, Lactobacillus plantarum WCFS1
MDFLGILCLLILATTLAGHFAHRAGIPAVIGEILVGVILGPALLNWVHLTTLVQTFSDIGVVVLMFIGGLESNLALLRKYLRPAIIVAIIGVIFPVVIMGLASRFFQFSWFESLFIGVIFSATSVSISVEVLKEFKVLDTKEGATILGAAVADDIIGVILLSIMIAMMGGQSGVAQTNLGIVLLEQVGFFIGVFIVIKWVAPYLMRLSDHLLMAASPTIMAIIICLALAWLAELVGLSGAIGAFFAGVAIAQTDYQHVVDVSIEPVGYTTFIPLFFVSVGLNMTFKGVWQSLPFIVVMTVLGVLTKLWGCGLGAKLNGFSRHSNYLVGAGMISRGEMALITAQIGFSAHLLSNDYYSDIILVIIVVTMIAPFVLKNAIHRAGQVTATHSIIEEH

SEQ ID NO: 62282 - protein, 357 aa, delta proteobacterium MLMS-1
MKKIAVLPGDGIGPEVMREAIKVLEAAQRKFDFTLSYDYADVGGCAIDRHGRALPHATLELCRQSDAILFGSVGGPKWESLPPEQQPERAALLPLRKEFELFCNLRPARVFPSLAAASPLKPEIVGNGFDLLVVRELTGGIYFGQPKGREGSGPEEKAFDTMIYSRREIDRIARRAFEAARLRRGIVTSVDKANVLTTMVLWREVVKEVAADYPDVTLNHIYVDNAAMQLIRNPHQFDVLLCGNMFGDIISDECAMITGSMGLLASASLNESGFGLYEPAGGSAPDITGLGIANPIAQILSAAMMLRYSFQLGQAADTIERAVAKALATDILTPDIAADPSQAVSTEEMGTAIANGL

SEQ ID NO: 62283 - protein, 363 aa, Glycine max
MGGSSDTKLLQDLLLYAASAALSCLVLFAGLRHLDPNREASKKALEHKKEIAKRLGRPLIQTNPYEDVIACDVINPDHINVEFNSIGGLETIKQALFELVILPLKRPDLFSHGKLLGPQKGVLLYGPPGTGKTMLAKAIAKESRAVFINVRISNLMSKWFGDAQKLVAAVFSLAYKLQPAIIFIDEVDSFLGQRRGTDHEAMLNMKTEFMALWDGFTTDQNAQVMVLAATNRPSELDEAILRRLPQAFEIGIPDQRERAEILKVVLKGERVEDNIDFGHIAGLCEGYTGSDLFDLCKKAAYFPIRELLDEEKKGKQSHAPRPLSQLDFEKALATSKKTKVAASEYGGFSLQSPSRWTVPGESE

SEQ ID NO: 62284 - protein, 370 aa, Xanthobacter autotrophicus Py2
MTTVVDGLGLGRGAGEMAVERALAELRAGRGMRVAANGTAVLVIGAEAFDAGTAAALTAAGARDARLVLPAPRLLKLGAPRAQAGSVSLPTLDVERVAALALRVEARVDAPVAPANAFDHAALELLGLALVLPAAVVCVVPEAAVAGLLAVDAADVMAYRAGQVARLAIVGRAPVPLEGAPETEFVVFRGGEGLRDQVAIVVGRPDLSAPVAVRLHSACLTGDLFGSLKCDCGDQLRDSVRRMAEGEGGILLYLDQEGRGNGISNKMRAYALQAQGYDTYDADAALGFDLDQRRFDFAAEMLRQLGAKAVRVFTNNPQKIAALKAAGLDVVSDQRVLGRPTAENVRYLASKRDRAGHYIDFDALAARAPD

SEQ ID NO: 62285 - protein, 231 aa, Alkaliphilus metalliredigens QYMF
MSIEARLNTTLDRIKEAAVRGEQKHEEVRLIAVTKTVDIDVMQQLIDLGVRDMGENKVQELTRKYEALGNKVKWHMIGHLQRNKVKYIIDKVDFIHSLDSYALALEIEKQAGKINRVIECLIQVNISGEESKYGLTPKATEGLLEKIKDLSHVQIVGLMTMAPYVDNPEETRMYFRDLKILSSTLEKKYGPTATMKYLSMGMTNDFQIAIEEGSNLVRVGTAILGERNYGK

SEQ ID NO: 62286 - protein, 330 aa, Xanthobacter autotrophicus Py2
MNRPLSPNSWQYRELNAKTPGLSHLSDALISLVEAGEPVVAGSADLQYSNGLNKFAARYPDRYIQFGISEQNMVTAAAGLATTGLKPYVATFASFLGLLCCEQIRMDVAYCAQPVRLIGHHTGISLGFYGTSHHATEDIATMRAIADLTVVSPADGPQLAAAIKASADYPEPIYFRIGRGREPDVYPLDTPFTFGKAIEHLVGEEITIIACGMTVHPALEAARTLNAQGHSVGVIDMPTVKPLDRAAILAAAGRSKVLMSVEEHNVLGGLGSAIAEVLTDEGTGVRLVRHGIHDEYSLIAPPTHLYAHYRLDAAGIAEVAREAMGLRKAA

SEQ ID NO: 62287 - protein, 363 aa, Aspergillus nidulans FGSC A4
MDLRVGNKYRIGRKIGSGSFGDIYLGAFEIAIKLESVKAKHPQLEYEARVYKSLAGGVGIPFVRWFGTECDYNAMVIDLLGPSLEDLFNFCNRKFSLKTVLLLADQLISRIEYIHAKSFIHRDIKPDNFLMGIGKRGNQVNVIDFGLAKKYRDPKTHFHIPYRENKNLTGTARYASINTHLGVEQSRRDDMESLGYVMLYFCRGTLPWQGLKAATKKQKYDRIMEKKMTTPTEVLCRGFPNEFSIYLNYTRSLRFDDKPDYSYLRKIFRDLFVRESFQYDYVFDWTKDKEAEEQARRQGATMPLTTSGAAKPGAISSQRRKIMERGALDNTPDTNRAVGGSDRIHRGFPQLVGSVDFQVYVRR

SEQ ID NO: 62288 - protein, 286 aa, Hordeum vulgare subsp. vulgare
MAKDIEAAPQGGEFSSKDYSDPPPAPIVDFEELTKWSLYRAVIAEFVATLLFLYITVATVIGYKHQSDPTVNTTDAACSGVGTLGIAWAFGGMIFVLVYCTAGVSGGHINPAVTFGLFLARKVSLIRALLYIIAQCLGAICGVGLVKGFQSSYYVRYGGGANELSAGYSKGTGLAAEIIGTFVLVYTVFSATDPKRNARDSHIPVLAPLPIGFAVFMVHLATIPITGTGINPARSLGAAVIYNTDKAWDDQWIFWVGPLIGAAIAAAYHQYVLRASAAKLGSYRSN

SEQ ID NO: 62289 - protein, 492 aa, Glycine max
MDTILSTTLFLMLTCSIMHVLRSLHARIRRKSNYNLPPGPSLLTIIRNSVQLYKKPQQTMAKLAKTYGPIMRFTIGQSTTIVISSIEATKEILQTHESLFSDRTNPDITTSYNHNRYSLVFLPVSPLWQELRKICHGNLFSAKTLDASTDLRRMKMKELLTDIRQRSLNGEVVDIGRAAFMACINFLSYTFLSLDFVPSVGDGEYKHIVGTLLKATGTPNLVDYFPVLRVFDPQGIRRHTTNYIDKLFDVFDPMIDERMRRRGEKGYATSHDMLDILLDISDQSSEKIHRKQIKHLFLDLFVAGTDTTAYGLERTMTELMHNPEAMRKAKKEIAETIGVGKPVEESDVARLPYLQSVIKESLRMHPPAPLLLPRRAKTDVQVCGYTVPQGTQILINEWAIGRNPAIWEDAHRFSPERFLDSDIDVKGRHFKLTPFGSGRRICPGSPLAVRMLHNMLGSLINNFDWKLENNIDPIDMDLDQSLRAIPVLVNAN

SEQ ID NO: 62290 - protein, 363 aa, Shigella flexneri 2a str. 301
MSKNYHIAVLPGDGIGPEVMTQALKVLNAVRNRFAMRITTSHYDVGGAAIDNHGQPLPPATVEGCEQADAVLFGSVGGPKWEHLPPDQQPERGALLPLRKHFKLFSNLRPAKLYQGLEAFCPLRADIAANGFDIQCVRELTGGIYFGQPKGREGSGQYEKAFDTEVYHRFEIERIARIAFESARKRRHKVTSIDKANVLQSSILWREIVNEIATEYPDVELAHMYIDNATMQLIKDPSQFDVLLCSNLFGDILSDECAMITGSMGMLPSASLNEQGFGLYEPAGGSAPDIAGKNIANPIAQILSLALLLRYSLDADDAASAIERAINRALEEGIRTGDLARGAAAVSTDEMGDIIARYVAEGV

SEQ ID NO: 62291 - protein, 437 aa, Hordeum vulgare subsp. vulgare
MGKKSHICCFSLLLLLFAGLASGHQVLFQGFNWESWKQSGGWYNMMLGKVDDIAAAGVTHVWLPPPSHSVAAEGYMPGRLYDIDASKYGNAAELKSLIGALHGNGVQAIADIVINHRCADYKDSRGIYCIYEGGTSDSRLDWGPHMICRDDTKYSDGTANLDTGADYADAPDIDHLNHRVQSELKEWLLWLKSDLGFDAWRLDFARGYSAEMAKVYIDGTSPSLAVAEIWDGMVPGGDGKPNYDQDAHRQNLVNWVDKVGGAASAGMVFDFTTKGILNVAVEGELWRLIDPQGKAPGVMGWWPAKAVTFIDNHDTGSTQAKWPFPSDKIMQGYAYILTHSGIPCIFYDHFFNLGFKDEIAALVAIRKRNGITATSALKILMHDGDAYVAEIDSKVVVKIGSRYDVGAVIPAGFVTSAHGKDYAVWEKIAAAATLQRS

SEQ ID NO: 62292 - protein, 1283 aa, Arabidopsis thaliana
MDTSAVQLPFRDYSLQPAPRYINARCHICSVTGAIYNGYFCNDPIVWMHKECVELPSEINHLFHPQHPLLLTYEEGWWSCFCALCGETKPAKYFYSCSTCKIKVDLTCGMNPPPPAIEHPICHDHPLVFLKKRQEKTPCEVCKNRILGSSYSCLGCELYFHVGCIHLSKEVNHPCHSDHPLMLVESESLTDNDKKTCFLCGQQPHGILYHCSICNFTLCIGCIKSPPPLVVENVKTHKHPLTFFPRGVYCTCNVCGVKGLILSYMCLQCGFAVHCSCVDLPQVININRHDHRISFTQHLGPGYLNCGVCRRSVCQFNGAYSCLVCPNYAVHSRCATRYDIWDGVELEGKAENIEDIAPFKVVGDDLIRHFSHSKHSLRLHKNNIIYDDSTRCEACGHPVEFGRIYNCEECCFILHEKCANLPMKKRLVFSTLPFLLLGPGNDVCKVLDCKLCGMFFTGFEYKSQERRQSDIDVHCGSLTEPFVHDGHLHPLYFDQKQKELPCNACQKTIRDYMLCCADCDFNLCLWCASLPKKIRHSNDEHILTLCCGEEANGKYWCDICEAELDPSKWFYTCFGCGGTLHVECVLGDFSRLMPGCTIDYRVYTVEVVFNNHNTRPMCSRCHSRCKVSVILKFREGAVKLPIHEHPIFPSARIVFSTCKGCGVEDFVYGGYVCNDSDCKARFHKECAEAPSEISHSFHQQHPLFLTNGLGDLPCDLCGQKRLEAAGYSCPTCEFKLDLTCGINPSPPAIEHPICHDHPLVFLKKREEKAPCEVCKDSIGGPSYSCLGCDLYFHVDCVHLSKEVNHPCHPSHPLKLIASESLTDNAEKICLLCEQQPENMLYYCSVCNFTSCLGCTKRPPPLFIEHTKTHKHQLTLFLNGISYQGSALTYNSRAYMCLPCGFVVNGNGINLPQVININRHDHRISYTHQLGPGYLNCGVCREIVDRDCGAYACVVCSNYAVHWECAVHDNVWDGVELEGTSEITEDIAPFKVMGDNLISHFSHEQHTLRLHKEGIIHDAYALCEACTYPIGFDPIYSCEECHFILHEKCANLPMKKRLVFATTPFKLVGASSRVRDVIDCGYCGECSTGFKYASQRGWEIDVHCGSLSEPFVHNGHLHPLYFDSKENHSCNACHKVTVHMLCCNACDFDLCLSCASLPLKIRHRNDEHPLTLSCGETANGKYWCDICETELDPSKWFYTSFDCGVTLHVECVLGDFSRLMPGRMVDTVGGKKFYVVLNNHNTRPLCSMCRSRCKVSVILKACDEDNVYICSRSCFSDMVSARSC

SEQ ID NO: 62293 - protein, 175 aa, Vitis vinifera
MKESSRKQGAASPCAACKLLRRRCAQDCVFAPYFPADEPQKFANVHKVFGASNVNKMLQELPVEQRGDAVSSMVYEANARVRDPVYGCVGAISSLQQQIDLLQTQLALAQAEVVHLRVRQAASLSTTRHPISPSNSTASPSPSSNFMPPSHTKPFFEMDMVVDHDSLGESVWYPS

SEQ ID NO: 62294 - protein, 535 aa, Polaromonas sp. JS666
MTILDTNLNPRSADFQANADAMRALVDDLHVQIAKAAAGGGDAARAKHTARGKLLPRERVQMLLDPGTPFLELAPLAAHGMYHGDAPCAGLIAGIGRVSGVDCMIVCNDATVKGGTYYPLTVKKHLRAQEIAQQNCLPCVYLVDSGGANLPNQDEVFPDRDHFGRIFYNQANMSAQGIAQIAVVMGSCTAGGAYVPAMSDESIIVKNQGTIFLGGPPLVKAATGEVVSAEDLGGGDVHTRLSGVADHLAQNDMHALALARASVKNLNKNKASAQTVQASIAPKFMAKELYGVIPVDTRKPFDVREIIARIVDGSEFDEFKARYGATLVCGFAHIEGMPVGIIANNGILFSESALKATHFIELCCQRKIPLVFLQNITGFMVGRKYENEGIARNGAKMVTAVATAAVPKFTIIIGGSFGAGNYGMCGRAYSPRFLWMWPNARISVMGGDQAAGVLATVKRDGIEAKGGAWSPEEEEAFKAPIRQQYEHQGHPYYATARLWDDGVIDPADTRRVLALGLSAARNAPIPETKFGLFRM

SEQ ID NO: 62295 - protein, 437 aa, Hordeum vulgare subsp. vulgare
MGKNGNLCCFSLLLLLLAGLASGHQVLFQGFNWESWKQSGGWYNMMMGKVDDIAAAGVTHVWLPPPSHSVSNEGYMPGRLYDIDASKYGNAAELKSLIGALHGKGVQAITDIVINHRCADYKDNRGIYCIFEGGTSDGRLDWGPHMICRDDTKYADGTANLDTGADFAAAPDIDHLNDRVQRELKEWLLWLKSDLGFDAWRLDFARGYSPEMAKVYIDGTSPSLAVAEVWDNMATGGDGKPNYDQDAHRQNLVNWVDKVGGAASAGMVFDFTTKGILNAAVEGELWRLIDPQGKAPGVMGWWPAKAVTFVDNHDTGSTQAMWPFPSDKVMQGYAYILTHPGTPCIFYDHFFNWGFKDEIAALVAIRKRNGITATSALEILMHEGDAYVAEIDGKVVVKIGTRYDVGAVIPAGFATSAHGKDYAVWEKTAAAATLQRS

SEQ ID NO: 62296 - protein, 987 aa, Rhizobium leguminosarum bv. viciae 3841
MALVFTPAGGLSRTLIVKSEPCLPMKFGTSGLRGLSVDLKGRASALYATAFGKYLLQTGKARAGDVILIGRDFRDSSPEISGNCAGALAALGFRIFDCGTVPTPALALYGLESNAAGLMVTGSHIPADRNGIKFYRPDGEIDKSDEAAITALAAEIERTGETVTQAPAETEEHEAICRQLFFERNAALLPQGALSGLKIGVYQHSSVARDLLVDVLAHYGAEITALGRSESFIPVDTEAVSDETITLMKRWVSEHKFDAIVSTDGDGDRPLVADETGTPLRGDLLGLVAANFLGAGTVVTPVTSNSGIEAAGSFAVRRTRVGSPFVISGMEEAVAAGKDHVMGFEANGGLLTATAFDINGRNVRALPTRDCFIPMLAILSLAATRKQPLSAVAASYHLPFAAADRLENFPVETSAALMQYLRATDENLSAFLQPIGEVATKSDIDGLRVTLKDGRIIHFRPSGNAPEMRCYVEAESETAALDLLTAGLTRIRDWAETPAKHATNTLFSRNPPMTQKIVPVIMAGGKGTRLWPLSRATAPKQFIQFVGDKTLFQETLDRVSNPDLYEAAIVVTNEEFRFLVAEQARALTIPLAAVLLEPVARNTAAAVAAAATLAGELFGKNTIIQMLASDHEILADETYFDCIRIARDAAADGKLVTFGITPTEPATGYGYIEIGDALKNGAHKVKRFIEKPALEKAEQMLADGGFYWNSGIFMFPVTELIAELQEYAPDVLKAASKAVSKASRDLDFTRLDADHFAKSPDISIDYAIMEKTSKAAVVPSPFKWSDMGSWDAVWKSGTRDDNGNVAAANTTVVNTRNSLVMTHGVHLAVQGMEDVAVIASEDAVYVGPLKDSQNVGQLVKMLASSSATAKFAETHPTSYRPWGGYTSIFNGDRFQVKRIFVTPGKKLSLQKHHHRSEHWIVVKGTAEVTVGENVRMLRENESVYIPLGEVHRLANPGKILLELIEVQTGSYLGEDDIIRIVDEFGRT

SEQ ID NO: 62297 - protein, 441 aa, Physcomitrella patens subsp. patens
MRSKGLGNKIDDSWKPPPGDPFCQLNDEVLLNILRRLSPAPHHALVCKRWMRLHGTLRQAIKVQDWTFLESGRICQRFPNLTDVDLSLACIVTPQEPTGSAILLTHQGLTVQLNYDAVDPPSIERCIEEQQLSPAKLDRGLKLLADAYPGLQRLCVVDTEETGIASIAKNCPLLQELDLYQCTDETLRAIADCENLQIVRLIGSVTGFYHCTFTDIGLTIMSHTFRRLVRLELSGCEASYEGISAIGKCCVMLEELTLSNKGFYEGWVAALSFLACLKTLRLEGCKQIDRNPGPHDRLGRCSAIERLHLERCDLRDRAGFSALLAVCAVVRELEFKDCWGLDDDTLALTVSCKRVRLLSLEGCSLVTTAGVDSVVQSFKDLNRLRVTFCDNIRDSELSPALCDRFLTLKEFSWRPDTKSVLAAGLAGTGVGQKGGRFFKKS

SEQ ID NO: 62298 - protein, 253 aa, Medicago sativa
MGANVNLVFRKELPLRGFDDEMRAVVARNLEGRGINLHPRTNLTQLIKTEDGIKVTTDHGEELIADVVLFATGRAPNSKRLNLEKAGVEVDKTGAIVVNEYSCTNIPSIWAVGDVTNRMNLTPVALMEASHFANTVFGGKTQKPDYRDIPYAVFSIPPLSVVGLSEEEAVEQTNGDLLVFTSTFNPMKNTISGRQEKTVMKIVVDAQTDKVLGASMCGPDAPEIVQGIAIALKCGATKAQFDSTVGIHPSAAE

SEQ ID NO: 62299 - protein, 338 aa, Rhizobium leguminosarum bv. viciae 3841
MRYFITGTAGFIGFHLARRLLQEGHDVTGFDGLTPYYNVKLKEMRHAALSQFPAFKPVIAMLEDRPALEAAVLAAKPDILIHLAAQAGVRYSLENPEAYLRSNVEGSWNILEIARRVEIRHLMLASTSSIYGANATVPFRETDRADEPLTIYAATKKSMELMAHSYAHLHKIPTTAFRFFTVYGPWGRPDMALFKFTKNMLAGQPIEIYGEGNMSRDFTYIDDLIEAIVRLSAVVPSEENRLENTAVETLSRQAPFRVVNIGGGQPVSLMDFVETVEKALGRPAIRKMLAMQKGDVPRTFAAPDLLVALTGYKPDTTLDVGVKAFVDWYLDVRSELDA

SEQ ID NO: 62300 - protein, 160 aa, Corynebacterium efficiens YS-314
MTEQIIPRVGIASDAHQIEAGKPCWIACLLFDGVDGCEGHSDGDVVAHAIVDALLSASGLGDLGSFVGVGRPEYDGVSGTQLLIEVRELLITRGFTIGNVAAQLVGQTPKFGPRREEAQQVISDILGAPCFLSATTTDHMGFTGRGEGRAALATAVVWTG

SEQ ID NO: 62301 - protein, 403 aa, Thermus thermophilus HB27
MAGAVADLFLFGASVLLLLSILLSRVSQRLGIPALLFFLALGMLAGSDGPGGIYFDDARLAQGLGVMALAFILFSGGLDTEWGKVRPVLLPGVVLATLGVALTALLVGFFASLILGFSPLQGLLLGAIVSSTDAAAVFSVLRSQGVRLKERLKALLELESGINDPMAILLTVGLTSLLLGAAQPKDLVWIGLKQLGLGLVLGYILGRGITWAWDQWGFQYRGLGLLLSFSLVLFSYGLTAVLGGSGFAAVYVAGLVVGQLSLRRKEELLLFHEGVAWIMQVLMFLVLGLLVFPSRLPEVAPKGALLALFLMFVARPLAAALCLFPFRWSWQEVLLVGWVGLRGAVPIVLATYPLLAGLPGAATLFNLVFFIVLFSVALQGPTLGFVARRLGLEEDKPADARPS

SEQ ID NO: 62302 - protein, 334 aa, delta proteobacterium MLMS-1
MGIKVAINGFGRIGRSIFRAIELDPTFKEIEIVAINDLTPPATLAHLLKYDSVMGIYPHEVKAGDGEIRVDDHPVRVYNQRDPKELPWGELGVEYVIEATGLFTDSDKAQAHLDAGAKKVVISAPAKGQVKTIVMGVNEEDYDPATDHIVSNASCTTNCLAPVAKVIVERFGIKSGLMTTVHAYTGDQRLLDFPHNDLRRARAAAMSMIPTKTGAAAAVALVLPELKGKFDGLAVRVPTPNVSLVDVVMELEQETTVTEVNEALKQATNRYLGYSEEPLVSIDYQGDPRSSVVDAISTKVLGSTVKILSWYDNEWGYSNRVLDLILHMEENRTL

SEQ ID NO: 62303 - protein, 449 aa, Pseudomonas aeruginosa PAO1
MTFASLGLLDPLLKALEGLGHGTPTPIQAQAIPPALKGRDLLAAAQTGTGKTAGFALPLLQRLTLEGPQVAANSVRALVLVPTRELAEQVHASVRDYGQHLPLRTAVAYGGVSINPQMMKLRKGVDILVATPGRLLDLYRQNAVKFAQLQALVLDEADRMLDLGFARELDELFAALPRKRQTLLFSATFSDAIRTLARELLRDPLSIEVSPRNTAAKSVRQWLVPVDKKRKAELFCHLLQANRWRQALVFAKTRKSVEELVGLLQRQGIAADSIHGDKPQPARLRALQRFKAGEVDLLVATDVAARGLDIEEMPLVVNFDLPIVAEDYVHRIGRTGRAGASGQAVSLVCADEVELLAAIETLIGQTLQRREEPDFEPEHRVPQTAPGGVVLKKPKKPKKPKAAESVGKPGKIHLGSWFDSSAPTVKAVRKAPGFGAGAAGKPKKRPSGK

SEQ ID NO: 62304 - protein, 240 aa, Brassica napus
MATAGSSLTIASSFSEHRTQIHSSNRSNLPLQYSLSYKANSRSRGRRLGLVVSSVSSPKVELRTGPDDLISSLLSKVANSDGGVTLTPEQHKEVAQVAGELQKYCVSEPVKCPLIFGDWDVVYCSRPTSPGGGYRSVIGRLFFRTKEMIQGIDSPDTVRNRVSFTALGFLDGDVSLTGKLNVLDSEWVQVIFEPPELKVGSLEFKYGFESEVKLRITYVDEKLRLGIGSRGSLFVFRRRQ

SEQ ID NO: 62305 - protein, 2144 aa, Saccharomyces cerevisiae
MPVLKSDNFDPLEEAYEGGTIQNYNDEHHLHKSWANVIPDKRGLYDPDYEHDACGVGFVANKHGEQSHKIVTDARYLLVNMTHRGAVSSDGNGDGAGILLGIPHEFMKREFKLDLDLDIPEMGKYAVGNVFFKKNEKNNKKNLIKCQKIFEDLAASFNLSVLGWRTSRRFYYLGDVALSREPTILQPLLVPLYDEKQPEFNETKFRTQLYLLRKEASLQIGLENWFYVCSLNNTTIVYKGQLTPAQVYNYYPDLTNAHFKSHMALVHSRFSTNTFPSWDRAQPLRWLAHNGEINTLRGNKNWMRSREGVMNSATFKDELDKLYPIIEEGGSDSAALDNVLELLTINGTLSLPEAVMMMVPEAYHKDMDSDLKAWYDWAACLMEPWDGPALLTFTDGRYCGAILDRNGLRPCRYYITSDDRVICASEVGVIPIENSLVVQKGKLKPGDLIPSDTQLGEMVDTKKLKSQISKRQDFKSWLSKVIKLDDLLSKTANLVPKEFISQDSLSLKVQSDPRLLANGYTFEQVTFLLTPMALTGKEALGSMGNDAPLACLNENPVLLYDYFRQLFAQVTNPPIDPIREANVMSLECYVGPQGNLLEMHSSQCDRLLLKSPILHWNEFQALKNIEAAYPSWSVAEIDITFDKSEGLLGYTDTIDKITKLASEAIDDGKKILIITDRKMGANRVSISSLIAISCIHHHLIRNKQRSQVALILETGEAREIHHFCVLLGYGCDGVYPYLAMETLVRMNREGLLRNVNNDNDTLEEGQILENYKHAIDAGILKVMSKMGISTLASYKGAQIFEALGLDNSIVDLCFTGTSSRIRGVTFEYLAQDAFSLHERGYPSRQTISKSVNLPESGEYHFRDGGYKHVNEPTAIASLQDTVRNKNDVSWQLYVKKEMEAIRDCTLRGLLELDFENSVSIPLEQVEPWTEIARRFASGAMSYGSISMEAHSTLAIAMNRLGAKSNCGEGGEDAERSAVQENGDTMRSAIKQVASARFGVTSYYLSDADEIQIKIAQGAKPGEGGELPAHKVSKDIAKTRHSTPNVGLISPPPHHDIYSIEDLKQLIYDLKCANPRAGISVKLVSEVGVGIVASGVAKAKADHILVSGHDGGTGAARWTSVKYAGLPWELGLAETHQTLVLNDLRRNVVVQTDGQLRTGFDIAVAVLLGAESFTLATVPLIAMGCVMLRRCHLNSCAVGIATQDPYLRSKFKGQPEHVINFFYYLIQDLRQIMAKLGFRTIDEMVGHSEKLKKRDDVNAKAINIDLSPILTPAHVIRPGVPTKFTKKQDHKLHTRLDNKLIDEAEVTLDRGLPVNIDASIINTDRALGSTLSYRVSKKFGEDGLPKDTVVVNIEGSAGQSFGAFLASGITFILNGDANDYVGKGLSGGIIVIKPPKDSKFKSDENVIVGNTCFYGATSGTAFISGSAGERFGVRNSGATIVVERIKGNNAFEYMTGGRAIVLSQMESLNAFSGATGGIAYCLTSDYDDFVGKINKDTVELESLCDPVEIAFVKNLIQEHWNYTQSDLAARILGNFNHYLKDFVKVIPTDYKKVLLKEKAEAAKAKAKATSEYLKKFRSNQEVDDEVNTLLIANQKAKEQEKKKSITISNKATLKEPKVVDLEDAVPDSKQLEKNSERIEKTRGFMIHKRRHETHRDPRTRVNDWKEFTNPITKKDAKYQTARCMDCGTPFCLSDTGCPLSNIIPKFNELLFKNQWKLALDKLLETNNFPEFTGRVCPAPCEGACTLGIIEDPLGIKSVERIIIDNAFKEGWIKPCPPSTRTGFTVGVIGSGPAGLACADMLNRAGHTVTVYERSDRCGGLLMYGIPNMKLDKAIVQRRIDLLSAEGIDFVTNTEIGKTISMDELKNKHNAVVYAIGSTIPRDLPIKGRELKNIDFAMQLLESNTKALLNKDLEIIREKIQGKKVIVVGGGDTGNDCLGTSVRHGAASVLNFELLPEPPVERAKDNPWPQWPRVMRVDYGHAEVKEHYGRDPREYCILSKEFIGNDEGEVTAIRTVRVEWKKSQSGVWQMVEIPNSEEIFEADIILLSMGFVGPELINGNDNEVKKTRRGTIATLDDSSYSIDGGKTFACGDCRRGQSLIVWAIQEGRKCAASVDKFLMDGTTYLPSNGGIVQRDYKLLKELASQV

SEQ ID NO: 62306 - protein, 340 aa, Erwinia carotovora subsp. atroseptica SCRI1043
MSTMNTLICQEPKKLVWKKREIPIPGEGEALIKIKSVGICGTDIHAWGGNQPFFSYPRVLGHEICGEVVDTGKNVDRFKKGQQVTVIPYVACQQCPACKSGRTNCCEKISVIGVHQDGGFSEYLAVPTTNLLLAEGIDPQAAALIEPYAISAHAVRRAKVLQGEQVLVVGAGPIGLGAAAIAKAEGAHVVVADTSAARREHVIAHLGLSVVDPSAEDFEAQLRAEFGGSLAEKVIDATGNQHAMNNTINLIRHGGSIVFVGLFKGDLQFSDPEFHKKETTMMGSRNATPEDFAKVGHLMSEGKLTAEMMLTHRYPFSTLADIYERDVINNRELIKGVITF

SEQ ID NO: 62307 - protein, 404 aa, Moorella thermoacetica ATCC 39073
MTIAHGFEARRFITPVVRDLPPSGIRRFFELVASTKGVISLGVGEPDFVTPWHIREACVQSLERGYTMYTSNYGLPELRRAIADYLAWRFGLTYDPMKQIMVTIGASEAVDLALRTVLNPGDEVLIPEPCYVSYQPITQLAGGIPVPIPTTMTDGFALTAARLEHYITPRSKVLILCFPNNPTGAVLSREEMQAIARLVEKYNLLVISDEIYAELRYEGQPLSFASLPGMQERTILVSGFSKAFAMTGWRIGYVAAHPDFLAAMVKIHQYTILCAPVMGQMAALEALRHGRQDVERMVEQYDQRRRLVYSRLREMGLDCFEPRGAFYIFPSIAATGLDSVTFAEELLKEEKVAVVPGTAFGASGEGFIRCSYAASLADLTEAMNRMERFVARRLAFNQRAVAQA

SEQ ID NO: 62308 - protein, 400 aa, Arabidopsis thaliana
MNNLDEIKIESKTCLNDQEQEVKIDNMHMSDQDKNKIEIKNKSGLGEKWPEPIVRVQSLAESNLTSLPDRYIKPPSQRPQTTIIDHQPEVADINIPIIDLDSLFSGNEDDKKRISEACREWGFFQVINHGVKPELMDAARETWKSFFNLPVEAKEVYSNSPRTYEGYGSRLGVEKGAILDWNDYYYLHFLPLALKDFNKWPSLPSNIREMNDEYGKELVKLGGRLMTILSSNLGLRAEQLQEAFGGEDVGACLRVNYYPKCPQPELALGLSPHSDPGGMTILLPDDQVVGLQVRHGDTWITVNPLRHAFIVNIGDQIQILSNSKYKSVEHRVIVNSEKERVSLAFFYNPKSDIPIQPMQQLVTSTMPPLYPPMTFDQYRLFIRTQGPRGKSHVESHISPR

SEQ ID NO: 62309 - protein, 430 aa, Xanthomonas campestris pv. vesicatoria str. 85-10
MTTIAKILAREILDSRGNPTLEAEVTLDDGSFGRAAVPSGASTGTKEAVELRDGDKTRYLGKGVRHAVDNVNGTIAETLKNFDAADQQGLDRRLIDLDGTENKGRLGANALLGVSLAAAHAVAASRKQPLWQYLSTITESDVALPVPMMNIINGGAHADNNVDFQEFMVLPVGCSSFSEALRAGTEIFHSLKSVLKGHGLSTAVGDEGGFAPDFRSNVEALDTILEAIGKAGYTAGEDILLGLDVASSEFYDNGKYNLVGENKRLTSEQFVDFLADWVAQYPIISIEDGLAEDDWAGWKLLTERVGKKVQLVGDDLFVTNPKIFKQGIDSGTANAILIKVNQIGTLTETLEAIAMAHAAHYASIVSHRSGETEDTTIADIAVATTATQIKTGSLCRSDRVAKYNQLLRIEQALGSGARYAGRDAFVSLKR

SEQ ID NO: 62310 - protein, 1394 aa, Photobacterium profundum SS9
MPRTIKRQSMINVTIDGQKFPVNAQQTLLEAAADCNIEIPSLCGLNKNGEKVPCELCVVDVAGQGIQRACEILPVENMIVTTVSEELSSLRQTALNRILSDHYADCEAPCQTACPAGVDIQSYLYHISQDDHVKAVEVIKRTLPMPLSIGRVCPAFCETECRRGLVDEPIAIRQLKRHAADIDLAAQENYVPPKKASKGMSIAVVGSGPGGLTCGYYLTNEGYDVTVFESMPEAGGWLRYGIPEYRLPKAILAKEIELMCRNGMQVLTSKKLGDDFTLTQLTEDYDAVCLAVGASQAVEMNYTGSDLNGCYLGVDYLKDYVTEGCYITGKKVAVIGGGNTAIDCARTAVRDGADTTLIYRRTRDEMPAEDYEIVEAEHEGVKFHFLTNPVENIADANGHVCEIKLEKMALGEADASGRRRPEPTGKYFTEAFDTVIAAVSQKPDLSFMDKEELDLPLTRWNTQDANPNTMHSGLGNVFSIGDFRRGPATAIEAVADGRIAAEAIDRFFDGDMENIPVKLFNSQKERKLKQVAPEQFVEIKKVMRSVMPELSTKERELSFSEVETGFNNDEAMREAARCLECGCQANTDCKLRDYATEYDVAETELTNESCQKFHVDDSSEFIVFDANRCISCGQCVEACNEKAVHGTLSFAKNADGSSASRPECRPGFDKGYSMGDSNCVQCGACVQVCPTGALVDKRDKSQGRIEMLKPVETICTYCGVGCKLTMYVDESLNQIRYVQGVKDSPVNQGMLCVKGRFGFDFVNSKERLTTPLIRKNGELQPASWEEAISLVADKFNAIKADRGGNALAGFSSAKTTNEDNFAFQKFIRRELETNNVDHCARLCHASTVTGLEASIGSGAMTNDIPSIKFSDVVFIIGSDTTAAHPIIASHIKQAIRTGKTRLIVADPKRIDIADHSDLYVAHRPGTDVMLMNGIMQQIIKNDWHDKTYINERTEGFEALKAEVMLDSYAPDKVELVTGVKAQDVIKIAQMIGTANRTAVYYSMGITQHTTGHDNVRSVANLQMLCGNIGIEGGGINPLRGQSNVQGACDMGALPNNFPGYQKVQVPEIHAKFAKAWNKPNLPKEDGLTLTEIIDAACHDQVKGLYVMGENPVLSDPNQAHVIEGLEKLDFLVVQDIFLTETAQYADVVLPSCSFAEKSGHFTNTERRVQRISPAVNPPGEAKEDWWIIQSIANAMGSDWAYQSVKDITEEITQLTPQYAGIHWDRVGRDGLQWPCNDNAPDGTRVMHTSQFTRGKGEMAAIPFRYAAELPDAEYPLILTTGRLLEQFHTGSMTRKTKGLDNLAGPRAMISVVDAERLGVRNGEMLKVSTRRGSIETPAFVTKRMQEGVVFVPFHFAEAPANRLTTTATDPHAKIPEFKVAAVKIEKVRVLVETC

SEQ ID NO: 62311 - protein, 337 aa, Lotus japonicus
MASSSAAAPGSADSTAARRNTKRPKYSKFTQQELPACKPILTPRAVISAFLLVSVVFVPIGVASLIASRKVVEIVHRYESSCLKGVDNKIAYIQSSADKTCKITLKVDKHMKSPIYVYYQLDNFYQNHRRYVKSRSDQQLRDPKEESSTSACKPEDIANGRAIVPCGLIAWSLFNDTYSFSYKNKSLTVNKKGIAWKSDREHKFGKNVLPKNFQNGSIIGGAHLNESIALSEQEDLIVWMRTAALPTFRKLYGKIEVDLDEGENISVKLQNNYNTYSFNGKKKLVLSTTSWLGGKNDFLGIAYLTVGGLCFFLALAFTHCIFRQAKATGRSLIFVME

SEQ ID NO: 62312 - protein, 161 aa, Zea mays
  misc_feature (135)..(135): Xaa can be any naturally occurring amino acid
IAGMSCAHTLTLAGWEVLVLEKTTSPPTGSPTGAGLGLNPLSLRIIQSWLPQPQLLHNTTVPLTIDQNQATNSEKNVSCTLTRDESFNFKAAHWADLHGLLYDALPPYVFLWGHLSLSFHVADDKGSVMIKAKVXKTGEVIEIVGDLLVAADGCLSSSARN

SEQ ID NO: 62313 - protein, 402 aa, Picea sitchensis
MLTAAMSFCCLDSFWKRKTSKDQAPHNEIGDVISSIPDVKVYPYAELKIATNIFHLDNKIGSGGFGSVYKGTLKDGTVVAVKQLSAQSKQGVKEFLTEIATISDVQHENLVKLHGCCAEEEHRILVYEYLEKNSIAQALLDNTRMDMDWTMRAKICMGTARGLSYLHEELVPHIVHRDIKASNVLLDRDLNPKIADFGLAKLFPDNVTHISTRVAGTIGYLAPEYAMRGQLTKKADIYSFGVLVLEIISGRSNTKSTFPLEEQFLLEWTWQLREESRLLDIVDPRLEEYPKEEVLRFIKVALLCTQAASNFRPSMSQVVAMLSKEININENLLSRPGFISDFKNLKVSAGTSRPPARTNLNAFHNAQVTAMHRGVSSSSTTTGNSTSVVSSSPATITQLEPR

SEQ ID NO: 62314 - protein, 356 aa, Thermoanaerobacter tengcongensis MB4
MKGYLKLEDGSIFEGELISKNKKGYGEVVFTTGMTGYQEAITDPSYAGQIVVMTYPLIGNYGINKYDFQSEKPHIRGFVVREYCDKPSNFQSEESLLSYLDNHNIPVLSGIDTRALTKKLRENGTMRGIITYNPEDNIEFDQTNLLEEVSTKKPYRIAGIGPKLAFIDLGTKKGILKMLNSVGFDIYVFPYNASYDDVMQINPDAIFLSNGPGDPKDAVDAIELTKHFIGMKPVLGICLGHQIIALALGCNTVKMKFGHRGANQPVKDLLTNKDYITSQNHGYAVEEESIDKDKITVTHINLNDGTVEGIMHKFLPVFSVQYHPEACPGPRDSTDIFDKFMDIVMVYKRRFYFAEV

SEQ ID NO: 62315 - protein, 131 aa, Triticum aestivum
MSVATAHHLRPSPPAARDRLPGCAARASFRPLRRRGVAAGATAGGEATAAVSAVAATAKRDPRDCRVRRHTISVFVGDESGMINRIAGVFARRGYNIESLAVGLNKDKALFTIVVSGTDRVLKQVIEQLNK

SEQ ID NO: 62316 - protein, 226 aa, Bordetella parapertussis 12822
MLTQQELKQQAADAALELVEQVAGPDVIIGVGTGSTADLFIDGLARFKGRLRGTVASSERSAARLAGHGLAVLDLNDVQSMPIYVDGADEIDPNLHMIKGGGGALTREKIVASVARRYICIADESKLVERLGRFPLPVEVIPMARNAVARGLSRLGGQPALREGFVTDNGNIILDVAGLSIADAPGLEKTINDIPGVVTCGLFALAGADVALLATQDGIRRLERRG

SEQ ID NO: 62317 - protein, 268 aa, Blastopirellula marina DSM 3645
MSIPVSELIQQLWDTFRQMNPQAGQIVDLLAQRGDPLQNDHIAFRTFNDPRIGVARLAEPFLADGYVVGDEYHFAEKKLYAQHFEHADPSHPKIFISELLLEKFDLPLRQTVDKLIEQIDLTAIDADHPLCIAGRPWHVSYEVWKSLRDQSEYAAWMAAHGYCANHFTVFVNALKSVSSLKELNALLVAQGFQLNREGGEIKGSPSVFLEQSSTTAPEIEVEFTDGVHAAPGCYFEFAQRYPLPNGKLFSGFVAKSADKIFQSTDSRS

SEQ ID NO: 62318 - protein, 278 aa, Pseudomonas aeruginosa PAO1
MPRKVFSSQAYRHKVVLVSGGCSGIGRALALRFARAGARLAILDLDQAALDSLVQHLRDHLGGEALGLRCDVADADAVERAVALAVERFGGIDVLVNNAGITHRGTFAETGLGVFRKVMAVNFFGAVHCTRAALPSLLERRGQIVVLGSLTGFAPLLYRSAYNASKHALHGLFDTLRMELEGTGVSVTLACPGFTATDLRKNALVGDGSVTRQPVQVLGSQVASPVEVAEAIFQGAARRRRLLVLSNVNWRARLLARFFPRLFEKLLVPRLSGLKPQP

SEQ ID NO: 62319 - protein, 408 aa, Kluyveromyces lactis NRRL Y-1140
MTEVEEPEQPTTINEEYDLWVSNVPMMYDFVSETRLTWPSLTVQWLPTEMQPREVDGQQLLRQELLIGTLTTDNEPNYLKIAAIDLPENVTSSKPSVSDDAKENELSHRQSKIKIVRKFKHEQEVTRARYMPQSPNIIATLNGAGIVYIFDRNIKEKDHGAIASFSYHKENGYGLAFNPTVSGQLLSASDDGTVALWDVTSTANKSPSQTFDVHTDIVNDCKWHEFQSSLFGTVSEDNTLIIHDTNSDRAIQKLSVSSAFNTLAFSKRSENLLAAAGTDSNVYLYDLRRLQKPLHSMAGHEDSVTSLEFSPHQDGLLTSSGSDRRIIMWDLFNIGAEQQPDDAYDGVPELFMMHGGHRSPVNEFSHNSNVPWLMCSVEEENVLQIWKPANKIVRPPQPPADFDITTLE

SEQ ID NO: 62320 - protein, 534 aa, Desulfococcus oleovorans Hxd3
MSFFKSNIFKLCIALSMGVIVLVLPRPEGTRFKISGDPDQRVLQSVESAFTLVAEKSSKTAYVVEARNPGTPEATAGFLRAAVDGLAVAGVADAEAPAMTVDYVDGLSPKAKRFLAMLAVLVFLFIVEPVPLEITAICIGVFLVIAGVSDVKDAWAPYMHPVVLFIMCCLIFAISLDKAGITRRMGYFIIKRAGTSVTKFTFIIATGLGLASGVMHDAAACAIGIVTMIPMMKAAGIEPHSNTAKFMMISLPFACSAGGMSTLIGGGRCMVSAAFLKEYTGIEITFFEWIKYCLPAGIITVPIAVLIVYFVFRPNPKYKLPQLEKAIGPLTPLEIKTLVIIGLTFATWLTKGLHGIDYSITGMLGVSALVVAGILKWEDIHENLEWGTALFIFGGGISLGLAMGYSGAADYFANLFFPLVEGKGWFVLFAGVAVFGALVTNVMANVAAAALILPIVIPMALMEGVDPTVLALCLGTATSFALLLVIGCPPNAIAYSYRYFKSSDLTKVGLVATPILLAALILVAATWWKILGLV

SEQ ID NO: 62321 - protein, 1487 aa, Moorella thermoacetica ATCC 39073
MSAKKETTPAVGAVLVLGGGIAGMQSALDLANAGYLVHMVTESSSIGGHMAQLDKTFPTNECAMCLLGPRMTDTSNHPNIRLHTCATLEKVEGEKGNFTVQIREKPRYVNIQECTACGDCEQACPVSIPNEYNQEMGTRKAIHKMFPQAVPNKYLITKRGTPPCRSTCPAGTNVQGYVALISQGKFAEALEVVHRRMPFAGICGRICHHPCETECNRGRYDDPIAIATLKRAAYDYGWEAEASREKERRPELPSRKEKVAIIGAGPAGLTAAQDLALAGYQVTIYDALNQPGGMLRGGIPRYRLPMEVVDRETQRILNLGIKFVPNTVVGKDINLKDLQKEYNAVIIAVGLQQSRMLKLDGSELEGILPGVNFLREAALGGRPEVGEKVVVIGGGNVAIDVARTARRLGAREVHLACLESREEMPAHPWEVEEALEEGIILHPSWGPKRFLGAKGRVTGIELMQCTRVFDEEHRFNPQYNPEVTQTLTADTIIMAIGQAADLSLLGEKSPVATNRGLIKADPLTLATSVPGVFACGDIVRGPASVVEAVASGHEAAESVKRYLQGEDLATGRSLEKEPHLDPPPNVVPFPGRRQAQAMAPVEERVKDFREVYQGFTPEEAIAEAKRCLNCGICSECLQCEAVCKKKAIEHWQQEKVTKLKVGSIVLAPGFELFDATLAGEYGYGYYANVLTSLEFERLLSATGPTESHVLRPSDQRPPKKVAFIQCVGSRDCEREGSPYCSAICCMYSTKEALIAREHDANIEPTIFYLDIRAYGKNFDRYVESAKAGGVRYVRAMISRVEEDPQTKNLIIQYYTDGRVQREEFDLVVLAVGVKPPIDAEKIAAATGIELNPYGFAKTQPFEPVATTRDGIYVAGVFQGPRDIPETVVNASAAAACAGAAMAPGRNTMITPKEYPPERDVSREEPRVGVFICHCGINIAGVVDVKAVVEAAAKLPGVVHAEDNLYTCSQDTLKKIKDAIQEYRLNRVVVASCTIRTHQPLFREALREAGLNQFYFEMANIRDQCSWVHRNEPANATLKAIDLVRMAVAKVKRHEALHLQPVPVIQKALIIGGGVAGLTAALNVAEQGFEAYIVEREAELGGQVRNLRTTLEGEDLQALLRDLITRVQANPRIQVFTRARIEDFGGHQGHFTTTISLGEPGREHVRRTQTLEHGVVIVATGSQEIKTDAYLLGQDERVITNTRLEQALADGHWDQEKNKQVVFIQCVGSRDQEHPYCSRTCCAQTIKNALAIKRRNPEAQVYVLYRDIRTYAFMEDYYRQAREAGVLFIAYDPGDPPRVRQREIGLLEVMVKDPDSGKELVLWPDQLVLATGAVAPDGVEELASLLKLPLNEDRFYVETHAKLAPIDFPTAGIFLCGAGHAPKLAAEAIAQAEGAVARACTILARENLMVGGVVAVVDENKCAACLTCVRVCPFNVPRINERNVAEINAVQCMGCGTCAGECPAKAIQLQFYKDDQLLAKVAGLFGEV

SEQ ID NO: 62322 - protein, 166 aa, Xanthomonas campestris pv. vesicatoria str. 85-10
MSFNFRIGQGYDVHAFGPGDHVMLGGVRVAHSHGVLAHSDGDVVLHALCDAMLGALALGDIGQHFPPSDARWKDADSAQFLQHCDGLLRERGWRVGNADITVICERPKVGPHAVAMRERIAGLLAIELDAVSVKATTSEQLGFTGRGEGIAAQAAVLLGRTAVPHQ

SEQ ID NO: 62323 - protein, 250 aa, Thermus thermophilus HB27
MRRVLVAGNWKMHKTPSEARVWFAELKRLLPPLQSEAAVLPAFPILPVAKEVLAETQVGYGAQDVSAHKEGAYTGEVSARMLSDLGCRYAIVGHSERRRYHGETDALVAEKAKRLLEEGITPILCVGEPLEVREKGEAVPYTLRQLRGSLEGVEPPGPEALVIAYEPVWAIGTGKNATPEDAEAMHQEIRKALSERYGEAFASRVRILYGGSVNPKNFADLLSMPNVDGGLVGGASLELESFLALLRIAG

SEQ ID NO: 62324 - protein, 518 aa, Coxiella burnetii RSA 493
MMKRSVGAPALLFAAIGGIVGSGWLFGPYFASRLVGPSAILAWAVGGGLMMLIALTFAELGSSFPFTGGSVRYLQLSHGPLVGFTMAWIAWISSIAVAPVETLALLHYASNYLPWLMHNVDGQSVLTLPGLITAGFLLAFLCVINSIGVRYLTKTNAIIVGAKLAVPIFTAIVLLFFDFHATNFSSHGFATQGIKGILTALPAAGVIFSFIGYSPVIQLAGEAKNPQRSIPIAIIGALIICIVLYILLQVAFIGALNPASLQHGWQALSFKGDAGPFAGIAMTLGMVWFAKLLYLDAAISPFGTALIYTASTARLGFAMSEGGYLPSSLRKLNRLGVPHRMILLNFVIGLFLFLPFPTWQHMMSFLVSLLVFAYAVGPLSLVVLRKTLPDHARPFRLPMAKTISFLAFYICNLIVYWSGWDVVFKMIIAILVGYVLLGSYLLFKHDKSFNWQWRRFWWMVCYIAGLALISHYGSFGGNHLIPFGWDFIVIASFSASIFGLALYCGVEVRKGEISAAVV

SEQ ID NO: 62325 - protein, 636 aa, Prochlorococcus marinus str. MIT 9312
MYNYFYVMLLSELSHPNELHGLTVSQLEEIACQIRERHLQVVSTSGGHLGPGLGVVELTLALYQTLDLDSDRVVWDVGHQGYPHKLITGRFSQFDSLRQQNGVAGYLKRSESKFDHFGAGHASTSISAALGMAIARDRKGENHKCVAVIGDGALTGGMALEAINHAGHLPNTPLVVVLNDNDMSISPPVGALSSYLNKVRLSPPLQFLSDSVQESVKNIPLIGKDIPEELKNIKGSVRRLAVPKVGAVFEELGFTYMGPIDGHDIENLINTFNAAHRLKKPVLVHIVTTKGKGYPYAEADQVGYHAQSAFDLTTGKSIPSKKPKPVSYSKIFGQTLLKICEQDSKVIGITAAMATGTGLDILQKNIPEQYVDVGIAEQHAVTLAAGMSCDGLKPVVAIYSTFLQRAFDQLIHDVGIQNLPVSFVLDRAGIVGADGPTHQGQYDISYMRSIPNFVLMAPKDESELQRMLITSINHKGPTALRIPRGSGLGVAVMDEGWEPLNIGEAEILEEGNDILIIAYGSMVASAIETAEILKGMNINTCIVNARFVKPLDKNLIIPLASRIQKVVTMEEGTLIGGFGSAIVELFNDNEVNIPVYRIGIPDVLVDHASPDQSKEKLGLMPDQMADKIIQKFKLNN

SEQ ID NO: 62326 - protein, 869 aa, Desulfococcus oleovorans Hxd3
MNFIKKHPTLIFGLLLTLAFLFITLVRVEFFDTLGLKLYDTVMKVKGRPDPSDTIVIVDIDDESIEKLGRWPWPRSLIARGIDKINEGDPSVIGLNIIYSEPEENAGLMEIDFLETRFRENFLPPLQEVATAAPQPARNAGPPLQETLDQVQSGFLEELDLARKRLDRDSILAASLTRSGRVVLPIFFKDTLVPDSGQPEEAEETLKDQAIGNVRIPPGAACPQATEAVLPIPVFRRAAAGMGHINVAPDHDGTYRRERMLYEYRGLFVPSYALVLAARYAGVSPNNIGADIGMSVSFKKIEIPVTPYSELLIGFHTAPDAFRHYSFFDVLNDKIPLRVFTNKIVLVSLSAKGLATPLSTPVAPSTTFGDFTAHVLWSVLNQQFIRQFPGTRLIELAAVLFLGLLITLVLPRLKAAISGGLFFVLLALLLGGFAWAFLSRGVWLDVIYPVLLLVIGYTGIVSIRYFLTEAGKEKVEGESAETNRMLGISFQSQGMLDMAFDKFRKVPMDDQMKDLLYNLALDYERKRQLNKAAAVYGYIEEYDNKFKDIVERKKKLLVASETMVFGAGFLGGGGAGDGMVSTDPSIRPTLGRYEILKQLGKGAMGVVYLGQDPRINRTTAIKTVRFSDEFDEEEAAEMKKKFFREAESAGTLSHPNIVTIYDAGDEQDLAYIAMEYLEGDSLEKFQKKESLIPMRRLIGYIADIAEGLDYAHRQGIVHRDIKPANVMLLKNGKVKITDFGIARITASSQTKTGIVKGTPYYMSPEQISGKKVDGRSDIFSLGVMTFQLLTGTVPFKGSSPAALMHKILNSPHPDPRTINPRIPKPLTAILNKALEKDPAKRYQTAGQMAAHLRTLGEKMDAAMAKKTQA

SEQ ID NO: 62327 - protein, 89 aa, Populus trichocarpa
MASGGAAAGGGGKVSFKVTLTSDPKLPFKVFSVPEAAPFTAVLKFAAEEFKVPPQTSAIITNDGVGINPQQSAAASCPISIFRLPFSAL

SEQ ID NO: 62328 - protein, 470 aa, Erwinia carotovora subsp. atroseptica SCRI1043
MSANNSRLIKLLVILCIAGGLWLLPVPDGVKPDAWHLMAIFIATVVGLILSPYPLGAMAMFSLTTVAILGLLSIKDVLAGFSDPTIWMIACAFFISRGFIKTGFGRRIGLLFISKLGNSSLGLAYGLVFTDLMFAPAMPSTSARCGGIITPLFRSIAEAYDSTPEKGTQRRIGAFLVQSIFQCNAVTSAMFMTSMAGNPMVAKLASQFGIHISWTDWALATLLPGFLSLALIPYLIYRFYPPELKKTSEMRAIAVERLREMGKMTRNEWVVLGVFLGLVTFWVLGSTLNIDATLTALAGLSVLLLSRALTWDDVVSEKEAWHTVVWFAVLMTLAGQLNKMGLIAWLGGLAGNAVSGMHWLPMLGLLLLVYYYSHYLMASAIAHISAMYAIFVSIALAAGAPPMLTVLVFGIFSNLFMSTTHYSSGPAPILFGTGYVPLGTWWKIGFLVSLVIIPIWLGVGGMWWKLLGFW

SEQ ID NO: 62329 - protein, 733 aa, Saccharomyces cerevisiae YJM789
MSKNQSVSASEDEKEILNNNAEGHKPQRLFDQEPDLTEEALTKFENLDDCIYANKRIGTFKNNDFMECDCYEEFSDGVNHACDEDSDCINRLTLIECVNDLCSSCGNDCQNQRFQKKQYAPIAIFKTKHKGYGVRAEQDIEANQFIYEYKGEVIEEMEFRDRLIDYDQRHFKHFYFMMLQNGEFIDATIKGSLARFCNHSCSPNAYVNKWVVKDKLRMGIFAQRKILKGEEITFDYNVDRYGAQAQKCYCEEPNCIGFLGGKTQTDAASLLPQNIADALGVTVSMEKKWLKLKKLSGEPIIKNENENINIEFLQSLEVQPIDSPVDVTKIMSVLLQQDNKIIASKLLKRLFTIDDDSLRHQAIKLHGYTCFSKMLKLFITEQPQVDGKGNETEEDDIKFIKGILDFLLELPKTTRNGIESSQIDNVVKTLPAKFPFLKPNCDELLEKWSKFETYKRITKKDINVAASKMIDLRRVRLPPGWEIIHENGRPLYYNAEQKTKLHYPPSGSSKVFSSRSNTQVNSPSSSGIPKTPGALDSKKHKLSDEEYERKKQKRLEYERIALERAKQEELESLKQKLKLENERKSVLEDIIAEANKQKELQKEEAKKLVEAKEAKRLKRKTVSQSQRLEHNWNKFFASFVPNLIKKNPQSKQFDHENIKQCAKDIVKILTTKELKKDSSRAPPDDLTKEKRHKVKEFINSYMDKIILKKKQKKALALSSASTRMSSPPPSTSS

SEQ ID NO: 62330 - protein, 223 aa, Populus trichocarpa
MSVHNSSSVVFLTKSPSPAALLSPSCRLNMIDSRDNYFRTRNCKLIMHSIIAGSSGNGSGGSGPAGAGGGDGGVKKKGVPNSNYVVPLDNSLASAYTSCITRPLSEILRDLNKRIPDNIIKPPNSSSTLIPWFHANRMLSFYAPGWCGEIRDVIFAENGSVTVVYRVTIRGSDGEAHRESSGTVSSSDVAIEDPVAAAEEIAFCRACARFGLGLYLYHEEQML

SEQ ID NO: 62331 - protein, 294 aa, Corynebacterium efficiens YS-314
MVTMSTLRAPLVPGEPTPIRKVPAHIERPEYVWKDEVLEAIGEPYVQTPEVIEAMRKTSRIAANALKVAGAAVAPGVTTDEIDRIAHEYMCDHGAYPSDLGYRGFTKSVCVSLNEIVCHGIPDTTVIQDGDIVNIDVTAYKHGVHGDCNATFLSGNVSEEHRLLVERTEEALMRSIRAAKPGREINIIGRVIESYAKRFGYNVVRDFTGHGIGPTFHNGLIVLHYDSTQYRDLLVPGMTLTIEPMINLGSLDYEIWDDGWTVQNKDRKFTAQFEHTIVITEDGNEILTLPDENI

SEQ ID NO: 62332 - protein, 486 aa, Bacillus cereus ATCC 10987
MITTEIKRVKNHINGEWVESTGTEVEAVPNPATGKIIAYVPLSPKEDVEKAVEAAKAAYETWSKVPVPNRSRQLYKYLQLLQENKEELAKIITLENGKTLTDATGEVQRGIEAVELATSTPNLMMGQALPNIASGIDGSIWRYPIGVVAGITPFNFPMMIPLWMFPLAIACGNTFVLKTSERTPLLAERLVELFYEAGFPKGVLNLVQGGKDVVNSILENKDIQAVSFVGSEPVARYVYETGTKHGKRVQALAGAKNHAIVMPDCNLEKTVQGVIGSAFASSGERCMACSVVAVVDEIADEFIDVLVAETKKLKVGDGFHEDNYVGPLIRESHKERVLGYINSGVADGATLLVDGRKIKEEVGDGYFVGATIFDGVNQEMKIWQDEIFAPVLSIVRVKDLEEGIKLTNQSKFANGAVIYTSNGKHAQTFRDNIDAGMIGVNVNVPAPMAFFAFAGNKASFFGDLGTNGTDGVQFYTRKKVVTERWF

SEQ ID NO: 62333 - protein, 652 aa, Chlamydomonas reinhardtii
MQTQRPLASPGRQASIPARRAYSLRPPLTQRQLPIARAEPPQTEEIKLFGIIPTAPRSSKLGENLEDRIQSGEFTDSGSTKEKLTRPLRQALAKEPLVGRSAARFLADLGRQWRAEASKRMPEARGDIREIVGQPVFVPLYKLFLVYGKIFRLSFGPKSFVIISDPAYAKQILLTNADKYSKGLLSEILDFVMGTGLIPADGEIWKARRRAVVPALHRKYVMSMVDMFGDCAAHGASATLDKYAASGTSLDMENFFSRLGLDIIGKAVFNYDFDSLAHDDPVIQAVYTLLREAEHRSTAPIAYWNIPGIQFVVPRQKRCQEALVLVNECLDGLIDKCKKLVEEEDAVFGEEFLSERDPSILHFLLASGDEISSKQLRDDLMTMLIAGHETTAAVLTWTLYLLSQHPEAAAAIRKEVDELLGDRKPGVEDLRALKMTTRVINEAMRLYPQPPVLIRRALQDDHFDQFTVPAGSDLFISVWNLHRSPKLWDEPDKFKPERFGPLDSPIPNEVTENFAYLPFGGGRRKCIGDQFALFEAVVALAMLMRRYEFNLDESKGTVGMTTGATIHTTNGLNMFVRRRDPLTVPPTSSSVAETVSTGYAFACGPAVMPVASAEVVAAPATAAGGGCPFHTAAGAAVPAATMSLRPTGPPSA

SEQ ID NO: 62334 - protein, 363 aa, Arabidopsis thaliana
MLSDLPKDVAEEVLSKFPVTSLRRVRFTCKKLNTLSKDMSFTRKHIDKEEAKKKQSKEFHVVMMLDFRVSLFSLNLLNPNPIERLGQLVSLDGGAQVDISNIFHCEGFLLCTTKDISRVVVWNPCVGQTIWIKPRNSFNKWDRYALGYDVMKNHKVLRFVDDGEYGRRHLLCEFEIYSFESDSWEVLDVNPDWEIDFVHRGLSIDGNSYWFARDKVVPYGGQDPSYFLLCFDFTTERFRPPLPLPFQPYFGDTVALSSVGDNQIAVLCQRSSSPYTLKIWISSKVEPNAVSWNKLFLKVDMKPLTGNSFSYSGGSFFVDEEKKMAVVLDKNIGGGFDPTRNIAYIIGKEGYFKKVDLGESRHL

SEQ ID NO: 62335 - protein, 377 aa, Physcomitrella patens subsp. patens
MLAGDDDGEADFQDSSMDVIRRRLGHLQQRHTVLREKLTNANPPQRSLVARLQEEFENEPEGKCLEAEEWNDSVIKELQKRIYDSDAALSMEDDQEMNEPFEGRMGVYSGKEDAENLTLLVNHKVIRGVKGRHIAIRFDTTFEEKKFESYYCVLKSSSPMDKLHVIEHSIPFFLPVRELEKQHLGNSPKLFIDYIGNVLQAYVSRREQVRLLVNKLKKRRGELIGELYHSLSYTLIEIMLKQPQWQVGMSLAYHNLDSELPTQSTITTWPLTTDLISQAVIKPGRAVQKNSTAFRLPKAEAFLRTMPLPQGCEELLADLRDTLGLSPPPEQATEAPPPPTVALIEAEMVAPTKPVMQIQMDDLVEDPPMDMPQVTPR

SEQ ID NO: 62336 - protein, 491 aa, Oryza sativa Japonica Group
MFPSSVNMREQNNIIIISIAMTILLLVVFFCRMLGNMAGKNKRKKQPKLPPGPATMPVLGNIHQILMNKPVFRWIHRLLDEMDTEILCLRLGSVHVIAIASPEMAREALRRNDAVLTSRPVSFAWRAFSFGYKNTVGSTGDQWKKMRRMLASEILSSAMERRMLGQRVEEADHLVNYIYRNCNNGTVDIRHVTRHFCGNIIRKLVFGRRHFAFGAGNIGPGRDEEAHIDALFTALDYLGAFSISDYFPSLVLNGLMSTFRRLHDPIIMERMEEWRAPRRNGDERREVADFLDVLISLDDAQGKPLLSLDEVKAETLEIILNSVDNPSNAVEWALAEMVNNPKVMKKAVDELDMVVGKERLVEESDIHSLTYLKACIREAFRIHPYHPFNPSHVAIANITIAGFMIPKGSHIILSRIGLGRNPRARDNPLEFRPERHLKNTDNVVLAEPELRFLSFSAGRRGCPAVSLGTSITMMLWAEKLNTDVIKKHICN

SEQ ID NO: 62337 - protein, 364 aa, Blastopirellula marina DSM 3645
MSKKKSVKRPTPTALQREVDQLDRELAALIQQRADLIQVATELKAAGNTVDGLIDDDQRIESLAQKSRGALPPQEIRSIFREIFSGCRNVAARLKVAFLGPEYSYSHQAAIERFGQSAELVPVATIAAVFEEISRGTCQFGLVPVENSSDGRVTDTLDMFAKQPLKICGEVQLRIHHCLLAKCDRAAIREVYSKPQALSQCRNWLAKHLPQARVCEITSTAAAAQLATQQAGVAAIASRAAGVNYGLNFAAENIEDNPRNVTRFAVIGNESGKKTGDDKTAMMFQTEHKPGALADAMNIFKRNRLNLTWIESFPVSGGDQEYLFFVEMEGHESELKIRRTIAALEKKTIRFEVLGSFRKMTPTD

SEQ ID NO: 62338 - protein, 266 aa, Coccidioides immitis RS
MTSSPVLSLFSLQGKTALVTGGTRGIGQAMAQALAEAGADIILVQRDESNTTTRDAIVQKTGRKVTIHVAELSDREAVAQVIPSIVKCGQHVDILLNCAGIQRRHPAEKFPDGDWDEVLQVNLTSVFTLCREFGAYLLSRDASTFQSDRRGAIINVASLLSFQGGITVTAYAASKGGVAQLTKALSNEWASRGISVNAIAPGYIDTEMNTALINDAARNDGIMARIPAGRWGKPEDFKGVVVFLASEASAYVSGEIICVDGGWMGR

SEQ ID NO: 62339 - protein, 482 aa, delta proteobacterium MLMS-1
MSQLSEIGGLDAATLQQKDRALLWHPFTQMHDYAQRDLLLIDRGRGVRLYDHHGREYFDTISSWWCIVHGHCHPLIQEYIGRQLKRLDQIQLAGTGHEPAILLAEKLVALTPPRLSKVFYSDNGSTACEVAVKISLQYWQQSGHPERRGLVALERGYHGDTIGTMSLGGVPEFHQAFGHLMFPSHRVPPPNCYRCPAGMPAPELMEGGLAVEAGPEMEKLRCDCQCLAPLEQLLAAQGEQLAAFILEPRIMAAGGMIVYPAQWLRRAAELTRRHGVHLILDEVASGFGRTGRMFALESAGVEPDFLCLSKGLTGGALPLAATLTSDEIYNAFYDDYAAGKTFFHGHTFSGNPLAAAAALGSLAVFAEEQTIAGLPAKVAHLRQAMQRFKDLPWVGDLRCLGMIAALELVQDKERKIPFGPDQRVGWPIYLAGLEEGLLLRPLGNIIYLWLPLSVTTAEIDEICQRMWRVLSNPVNIRGVGKE

SEQ ID NO: 62340 - protein, 486 aa, Leptospira interrogans serovar Lai str. 56601
MKSESSVFRKTKIICTIGPATSDKKMIQALAEAGMNVARLNMSHGNHDFHRSIIRNIKSLNKDVLKNPIAILLDTQGPEIRTGDLQVDHLDLKVGETFTFHIIPGEESEEQSVFVNYKDIVKDLKVGDPVTVDNGLINLVVEEINDSALKCKVLDGGRLGSRKHINLPGIRVNLPSITPKDHKDILFGLEEDVDFIALSFVRSVEDINQLKQIIEENDGHAQIIAKIEDQEAVRNMKEIVEAADGVMVARGDLGVEVPIEELPILQRAIIKECALKGKRVIVATHLLESMIHNPSPTRAEVTDVANAIYEEADAIMLSGETAAGKFPIRCVEMMDKIAQRVEKTGGVDYVKDKIPQDKKEQMARAAAKLADSLKCPAIIVITRRGTTALNVAGFHPHYPLIYAFTNMTTVRRKLWLTRGVIPHRIDFSKDPEKTIRLAIETLKKTGRIEDGDQVVILSDIIAGEDRVETIQIREVKTYFNVEVEKL

SEQ ID NO: 62341 - protein, 239 aa, Blastopirellula marina DSM 3645
MNSTRAEGIALVEGIAKGLAADCSVEVAVCPPALYLDAIVAAAGDSPIGVGAQNIYFEASGAFTGEISAAMLKDIGCQYVILGHSERRHVFGESSSLINKKVHAALAAGLVPIVCVGELLEERETGKTADVVAEQFYGSLAGVSAEQMESIVLAYEPVWAIGTGKVATPEQAEAVHADLRKVIEARYNSAVAEKVRIQYGGSVKPDNAAELLSQPNIDGALVGGAALKADSFLGIIAGA

SEQ ID NO: 62342 - protein, 368 aa, Cryptococcus neoformans var. neoformans B-3501A
MSIPAMAQQPYMSHSPPPLQHPKPTHIAYPPPEPPHTPAQSTDSSPYSQAQRISQDGYLRYSSPPAGEPLASSSGFSSYAPPPTGQQPVQSRQTYGQAGTPGVQGVHGYGVPGYAWPGMNDATAQMGMQFGKSAVAAGQEYMEKNFTRYLPLQLIKISFSVTNSYVLNKLRLILFPWRHKPWSRQSRRSTDNGAVEGWQAPRDDINAPDLYIPTMALVTYTLLCALASGLQSRFHPEVLGLSLSKALAVVITEFCAIKLGCYLLDVRGSGASGVELVGYGGYKFVGIIATIVVSLLGLGKMITLGVFIYTFAANAFFLLRSLKYVLLPDASVSSSVTTLSHSQRSRRVQFLFFVAVAQVLWMGWLSRV

SEQ ID NO: 62343 - protein, 481 aa, Oryza sativa
  misc_feature (437)..(437): Xaa can be any naturally occurring amino acid
MVQGCRCEVVDACVREVRLASPYRIHQIFRFTTPRRLALAHRGDTYKARDEGQCHWGDKAGSATRREGGESEGGERRRRRLMASPAVVAFAVAVAVAALAAFCGTDPLRTGSMVDFPGFVPHVVELPDASEMPPHADTRERLRGAEIRFRGEVQGPESVAFDPLGRGPYTGVADGRVVRWDGARWVYFAHSSPNWTAELCGHKASPLDYLKDEHICGRALGLRFDRRTGDLYIADAYFGLLKVGPDGGLATPLATEAEGVRFNFTNDLDLDDDGNVYFTDSSIHYQRRHFMQWVFSGDPSGRLLKYDPNTKKATVLHRNIQFPNGVSMSKDGLFFVFCEGSRGRLSRYWLKGEKAGTVDLFAILPGFPDNVRTNDKGEFWVAIHCRRSIYARMVSRNVRLRKFLLSLPIPAKYHYLMQIGGKLHALIIKYNPEGEVXLDILEDTTGQVVRAVSEVEEKDGKLWIGSVLMPFIAVFDYANAS

SEQ ID NO: 62344 - protein, 610 aa, Desulfococcus oleovorans Hxd3
MIKAVNISKSFGAEILFDDISFDINKGERVGLVGRNGHGKTTLLRIIAGSEAPDSGAVAAPKGYRVGYVTQHIHFSKPTIIEEACTGLPRQFIHDTWRAEKILSGLGFSKTDMDRHPADFSGGFQVRLNLAKVICSEPDLLLLDEPTNYLDIVSIRWLSGFLRQWSGEVLLITHDRSFMDGVITHTLGIHRKRVRKMSGATDKYYDQIFKEEEIHEKTRVNEAKKRKEAELFISRFRAKARLAGLVQSRIKALEKQEVKDPLEKLKNLDFSFNHAPTPAKVLLQAESLSFAYAGGQPLVDGLSFAVNKTDRICVIGKNGRGKTTLLRLIAGELASARGRITAHPSTKTGYFAQTNKMDLNDALTVEEEIMNAGCKRQQARNICGLMMFEGDHALKPIGVLSGGEKSRVLLGRILAAPSNLLLLDEPTNHLDMESCEAFLEAVEEFPGAVIIVTHNEMFLHSLANRLIVFQAGGAELFEGTYQDFLDRVGWKEETPRSGGRKPERPNEEGLSKKDLRKKKADLLAQRAAVITPIRKRMAAVEKTIEKDEAAIGRLNADMVAASHTGDREAIARLSKAYHDTSEKVSRLYEELEALTTDLEKKSRELGIQDA

SEQ ID NO: 62345 - protein, 174 aa, Pseudomonas putida KT2440
MKYRLGDLRVESHPTSWAAPNATLIGNVRLQAHSSVWFGAVLRGDNELIDIGEGSNVQDGTVMHTDMGSPLTLGKGVTVGHNAMLHGCTVGDFSLVGINAVILNGARIGKHCIIGANALIAEGKEIPDGSLVMGSPGKVVRELTEQQKRMLEASAAHYVHNAQRYARDLVVDDE

SEQ ID NO: 62346 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 62347 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLK

SEQ ID NO: 62348 - protein, 180 aa, Streptococcus thermophilus LMG 18311
MFKKENLPNLLTLARIILIPIFLLMTSLASSNVMHIAAAVVFAIASITDYLDGYLARKWHVVTNFGKFADPLADKMLVMSAFIMLVGINQAPAWVISVIICRELAVTGLRLLLVENGGTVLAAAMPGKIKTVTQMLSIILLLCHVHFVGTIMLYVALFFTIYSGYDYFKGAGFLFKDTFK

SEQ ID NO: 62349 - protein, 131 aa, Clostridium difficile
EVKYKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 62350 - protein, 606 aa, Physcomitrella patens subsp. patens
MQSLYAASAATTPACQPQKKILGIEATTFKKVIPLGLMFFCILFNYTILRDTKDVLVVTAKGSSAEIIPFLKTWVNLPMAIGFMVIYTKLSNVLSKENLFYSCIFPFIAFFGAFAFFMYPIVDILHPTAFADWALEKFGTRFLGPIAIIRNWTFCLFYVMAELWGSVVVSVLFWGFANQITTVDEAKQFYPLFGLGANVALVFSGRTVKYFSQLRTKLPPGVDGWGYSLKGMMGLVVILGLVIVAIYWWTNKYVVNDPALPKVEVRKKKSKPKMGMVESAKFLLTSRYIRDLATLVVAYGISINLVEVTWKSKLKAQFPSPNDYSSFMGDFSTYTGVATFIMMLLSRYIFRKYGWGVAAAITPTVLLVTGVAFFGLVLFSTPLTPMLAGLGMTPLLAAVYVGALQNIFSKSAKYSLFDPCKEMAYIPLDEETKLKGKAAIDVVCNPLGKSGGALIQQFLILGFGSLATSTPYLGAILLLIVLLWLGAARSLDAQFTPLVQKDLKGKLLEGKLSAISAAVLGQNKPKKEVTYRFVSVLNEQGFLEGRYVPIVDGQAETLAKAPETPASETSAQTSESSPLLGSSNGDGSAAQSGETDVPSSETAPLK

SEQ ID NO: 62351 - protein, 409 aa, Corynebacterium efficiens YS-314
MVECVKGRPNVLAIVLAGGEGKRLFPLTEDRAKPAVPFGGTYRLIDFVLSNLVNAGYLKIAVLTQYKSHSLDRHISVSWNVSGPTGQYIASVPAQQRLGKRWFTGSADAILQSLNLISDEKPDYVIVFGADHVYRMDPSQMVDEHIKSGKSVSVAGIRVPRHEATAFGCIQSDDEGNITEFLEKPADPPGTPDDPDVTFASMGNYVFTTEALVRALKDDSENEDSEHDMGGDIIPYFVDRGDAHVYDFSRNIVPGATERDKGYWRDVGTIDAFYECHMDLISVHPIFNLYNKEWPIHTTVEGNLPPAKFVQGGIAQSSMVAPGSIISAGTVRNSVLSTDVIVEEGATVEGAVLMPGVRIGKGAVVRHAILDKNVVVRDGELIGVDHDRDSQRFKVSAGGVVTVGKNQVV

SEQ ID NO: 62352 - protein, 355 aa, Helicobacter hepaticus ATCC 51449
MYHKRIKEAIEAIKQGEMIIIMDDEDRENEGDLVMAGIFSSPQKINFMAQEARGLICVSITQELAQKLDLPPMVQKNDSNHETAFTISIDAKEAKTGISAFERDMTIRLMCESNTKPSDFVRPGHIFPLIAKEGGVLVRTGHTEASVDICRLAGVAPISVICEIMKKDGTMAGRGDKFLLDFASQHHLKILYVSDIIQYRLNFENLLREITRESAVFMGVECEKITFIDHLEREHIVFGFPHKGSSSNEPKPLIRFHNVRSDLELLQNAQEWNALLKSIECLKEKGGYLVFLNTHSEYANSSKTCGDIKDFGIGAQILKRLGIEDFVLLSSCGGSKGEYNALSGFNLHLVEKIEV

SEQ ID NO: 62353 - protein, 453 aa, Rhizobium leguminosarum bv. viciae 3841
MERLETGIHAGRLSPAEYDANFSDLHPRLDNHEALVAADRCYFCYDAPCMTACPTSIDIPLFIRQISTGNPIGSAKTIFDQNILGGMCARVCPTEELCEQACVRNTAEERPVEIGRLQRYATDAAMQADKQFYARAEPTGKTIAVIGAGPAGLAAAHRLAVNGHSVVIFDAREKSGGLNEYGIATYKTVDDFAQKEVDYVLSIGGIEVRHGQRLGRDFSLSDLQAQYDGVFLGIGLAGVNALRIEGENLAGVDDAVDFIAALRQAEDKSDIAIGRRVVVLGGGMTAIDAAVQAKLLGAEEVTICYRRGKEHMNASEFEQDLASSKGVIIRHWLAPKSILSQDGKVAAIEVEYTKILDGRLVGTGETGVIAADQIFKAIGQSFDASGLGSLRMESGRIAVDGEGHTSLDGVWAGGDCVFGGDDLTVSAVAHGRDAAESIHRALTAAAAPAVAVA

SEQ ID NO: 62354 - protein, 458 aa, Pseudomonas syringae pv. phaseolicola 1448A
MTSQDGLKRGLSARHIRFMALGSAIGTGLFYGSASAIQQAGPAVLLAYLIGGAAVYMVMRALGEMAVHDPVSGSFSHYATRYMGPLAGFVLGWTYAFEMIIVCLADVTAFGIYMGFWFPEVPRWIWVLGIVFLIGALNLCNVKVFGETEFWLSILKVSAIVAMIVAGFGIMIFGIGSSTSGTEIGISNLWAHGGFMPNGVTGLIASFAVVMFAFGGIEIIGITAGEAKDPQRSLPQAINAVPLRILLFYVLTLFVLMCIYPWPQIGTQGSPFVQIFDNLGIASAATILNIVVISAAVSAINSDIFGAGRMMYGLARDGQAPASFARLSRHGVPWMTVLVMGIALLGGVLLNYLIPKDVFLLIASLATFATVWVWLMILLTQVAMRRSMNRDEAAQLKFAVPFWPYGPAAAIVFMLFIFGVLGYFPDNRAALIVGAIWIVLLLIAYGLWVKPKALNNPH

SEQ ID NO: 62355 - protein, 1366 aa, Physcomitrella patens subsp. patens
MRPRAMKKKRMREIGSSSGDGRKARIDECGDEGHMREARNNPVVPSSVSSSRPLKSCLVPWNRARTYLPQLMARVGLANTIHAESRGGLLCRSFSVVLLPPRSSRQQQPTPVELTLAVSPAPSPSPPWWRPTQLDAVMLWSTTLWDSGVRRILGCPAVDRDGAGQCNVKLWSEFEDCNYSRRTVLTFRLGVAAVFRLTLCQWHMNSIPGRRRAVFLSSLARFKAGATGEIVKLKSRLVVLTELILIASLFHLVGIETIVSSNGAGRSDLVEAISFVLGVRSFQLQGMVQRAGLDDREHGKSRGKIAFVKLVYCTASGEEIKFGRAITSSGTSEYRINNIPVTWEIYNNTMQGLDILGEVDSDGSREFREPSSVSQPASAPDELKKIHKELETQKARKEEKLIPIDQKRKMFAAERKQKMEQKESEAEKQLRLQAELGDIDCALMNLCVSVSWSHIGVDVRECHDVVGRLILASDGYASLIVAELFVIFSQDKRAAEVRMEMEWLASAGNEMASSDFEALDSEYESLREQGRWMEDEALKVEASRKAAIEAADSWKASNQPSSRPESLPHMLNRDNAVSGASIATKAVDFTSSKSRPNDVKDVKGRKKVTDVPVISISSKGTYNDHRIEELNREYRELVEYQSQNRDGNGAEVSLELESKHSENGYSQVNRSGRGSRYSGPDAEGKNGSEMHAAADESAWIDGSARDAHASRRLEDYDDQMCGSETGEDELDPDKDSLSKAECLAEELYRDAMELHDRLVAEAEMNTAVGMCGVDGKGHSWIAETKETCGAVMYANGHVQNGKCGMVDKDGELTSAGSSESMSLSFSQTSQSSDTPASALGQTERLHGMKLELSEKGGSAQANGGSRNGGDHAMTSLVEFRGGENGVSPRSTMEKEIARLRGSNVRKQLKIDSLQKWKVYYKLEVEDRARKLAQMEERYRRELKKRERAVKKTVKAHAKEIAEREAKREGMEEKLREEIKELNRVVEELSEQLYEMEEHLASRGIQYKPSLNENTGPSSKTLLSAVIGVKEAAHTFSRTFMSHLKQHLTKARDLDEQICLESEVIVARPSDYKFLVQSFILRRMFLDFDSECFNIESCMSEIFNIEEHSKACFQEYLKHRTVSETVTLLTDNRSHSAFLREFCFKKFLHIVSESTEEAFFGDFNHSDDICAGRHPSSRFYESFLKLAVSVWLLHRLAFSFQPPARMLSVRKGAQFNPTYMESAVPGISNGEVAEGEGGALPFEALVGLMVHPGFRCGSSIIPAQIRLVYFSECGLDERVRNHCPRMGRTAEGLPCIPITASTGEVPRISDAARSAGSWMAGALIPPSNWAWLQCVEVSALQAPHRIGDSCRLDELTYGCIVDCCVVV

SEQ ID NO: 62356 - protein, 523 aa, Arabidopsis thaliana
  misc_feature (450)..(450): Xaa can be any naturally occurring amino acid
MEQKMESASDLGKLFIGGISWDTDEERLQEYFGKYGDLVEAVIMRDRTTGRARGFGFIVFADPSVAERVIMDKHIIDGRTVEAKKAVPRDDQQVLKRHASPMHLISPSHGGNGGGARTKKIFVGGLPSSITEAEFKNYFDQFGTIADVVVMYDHNTQRPRGFGFITFDSEESVDMVLHKTFHELNGKMVEVKRAVPKELSSTTPNRSPLIGYGNNYGVVPNRSSANSYFNSFPPGYNNNNLGSAGRFSPIGSGRNAFSSFGLGLNQELNLNSNFDGNTLGYSRIPGNQYFNSASPNRYNSPIGYNRGDSAYNPSNRDLWGNRSDSSGPGWNLGVSVGNNRGNWGLSSVVSDNNGYGRSYGAGSGLSGLSFAGNTNGFDGSIGELYRGSSVYSDSTWQQSMPHHQSSNELDGLSRSYGFGIDNVGSDPSANASEGYSGNYNVGNRQTHRGXKHRKKSTKRSENCRSRRTAISVAEFEELLFRYQVEKETNFLHHSEFLVLFFSSLASQTQKREVYFYFKNSYIR

SEQ ID NO: 62357 - protein, 300 aa, Bordetella parapertussis 12822
MSRRPAGAARGSDAIGIARAVAGPAALTATQSPAMAARTAYLGPAGSWTHQACLDLYGADGLVPLSREALFAAYADGKVERACVPVATSVVGLTPYMEDVLALPRVVVVAEYPKMLGYSLLARPGTRREDIKEVHAHPVAFEEVRPWLEREMPGARRVPAASGGAAAQAVAASATQDKASFGPRVGASVYQLVSLADGIEEGPHNVTRWWVLGRDMPAPTGKDKTSLLACIPDARLAPLLADFAQAGVPILTIYERPARKTLDAHRYVVEVAGHVRDDALAGLLARQGELRVLGSYPRRY

SEQ ID NO: 62358 - protein, 254 aa, Candida glabrata CBS 138
MVASSLMIALVLVILTTLLIAFQVKKTLVSGHKSSQSSSYVKKVPTIIIAGPSYSGKTSLFHKLTSDETNAKLLTVMSQEPSFALKYKGTMTTLADYPGHVKLAYKLKNGIIDLKGNLKGILFVLDSTIDPKNITETAEYLTEILLILEKIREPIDILIACNKNESFTARQPLKIKEALENEITRIFERKKKSLGNIERDIGDVDEINENLDLSFDISKGFKFDYLEGNVEVLAGSVHKNKITTWQEWVGSHLV

SEQ ID NO: 62359 - protein, 247 aa, Candida glabrata CBS 138
MPKLVLVRHGQSEWNEKNLFTGWVDVRLSAKGEQEAARAGELLKEKNVHPDILYTSKLSRAIQTANIALSKADRLWIPVKRSWRLNERHYGALQGKDKAETLETYGEEKFNTWRRSFDVPPPVIEADSPYSQKNDERYRDVDPNVLPQTESLALVIDRLLPYWEDVIAKDLLAGKTVMIAAHGNSLRGLVKHLEGISDADIAKLNIPTGIPLVFELDENLKPSKPSYYLDPEAAAAGAAAVAAQGKK

SEQ ID NO: 62360 - protein, 392 aa, Azoarcus sp. BH72
MKYGEFDSASLMYITNRPEILFERGEGSWLYDAQGKAYLDFVQGWAVNCLGHSPAEVRDAIVAQAGKLINPSPAFYNGPMIELAGLLTAHCSLDRVFFANTGAEANEGAIKLARKWGRLHRNGAYQIITFEHSFHGRTLATMSASGKAGWDTLFAPQVPGFPKARLNDLESVKALIGPETVAVMLEPVQGEGGVIPAAPEFLQALRALTREHGILLIVDEVQSGMGRTGRLFAHQHAGIEPDIMTLGKGIGGGVPLSALLATEAVSCFEAGDQGGTYNGNPLMTAAGIAVMRRLTAPGFLDEVLARGDYLAARLRELVAKRHLVGERGSGLLRALVLDSDRAPAIVKAALEGAPTGLLLNAPRPNLLRFMPSLTVSEAEIDQMVEMLDALLG

SEQ ID NO: 62361 - protein, 619 aa, Azoarcus sp. BH72
MSPYPHLERIGSPADLRATERRELAQVASELRAFLIESVSKTGGHLSSNLGTVELTIALHYVFNTPDDRIVWDVGHQTYGHKILTGRREAMSGLRHWGGISGFPRRCESEYDTFGTAHSSTSISAALGMAVAARDRGEDRRAIAVIGDGAMSAGMAFEALNNAGDMDANLLVILNDNEMSISPPVGALTKILARLMSGSTYNAARRVGEKVLGTVPPMAELARKVEEYAKGMIAPGTLFEEFGFHYYGPIDGHDLDALIPTLQNIRKLKGPQFLHVITKKGQGYKLAEADPILYHGVSKFDHTAGIQTGKSGGKLTYTQVFSDWLCDIAAADPRIVGITPAMREGSGLVEFAQRFPDRYYDVGIAEQHALTFAAGLACEGLKPVVAIYSTFLQRAYDQLIHDIALQNLPVVLAIDRGGLVGADGATHHGAFDLSFLACVPNLVVMAPADENECRQMLYTAVCHDGPTAVRYPRGGGSGVVPLEPMTALPIGKGEIRRHGTRIAVLAFGSMLGVALEVGEALDASVANMRFVKPLDEALIAELAANHALLVTVEENAVIGGAGSEVARFVDTLPQRPRVLRLGLPDRFIDHGDQAQLLASVGLDKTGILAAIEAVYPHNS

SEQ ID NO: 62362 - protein, 165 aa, Paracoccidioides brasiliensis
MNYGLPRLGVIITGKGPQRDMYLSRIANLMAEGKLNKVVIKSAWLSLQDYAQLLASASLGVCLHTSTSGVDLPMKVVDMFGAGLPVVGWSRYESWPELVTEGINGLGFGSPDELLAHLLDLFGDGGKKLAVLRQGALQESERRWDDEWDAVAGKLFDLDSLPNDT

SEQ ID NO: 62363 - protein, 291 aa, Archaeoglobus fulgidus DSM 4304
MDDEVREKLIEAGKILKQAVNEAAEKIAPGVKILEVAEFVENRIIELGAKPAFPANISINSDAAHFTPKKNDERTFKEGDVVKLDVGAHIDGYIADMAVTVDLGDNTELVKAAKEALEAAMEVVRAGVSVSEIGKAIEDAITNYGFKPIVNLTGHGLLPYLNHAPPSIYNYATEKGVTLEEGMVVAIEPFATNGVGKVGERGECEIYSLLNPRPVRMKMAREILKEVEENYKTLPFAKRWLKKAPDIIISKLAREGVLRAYPVLTEVSGGLVSQWEHTLIVEDGGATITTK

SEQ ID NO: 62364 - protein, 337 aa, Lactobacillus plantarum WCFS1
MTATPFWSQIAAQAKADGRPFFTMAPMEAVSNTVFRQVISHAAAPDTFFSEFVYAKSITNPNTKFPVHGRLYVAAAESQKPVVQLWGNEAADFASATAELRDRGFEAVDINMGCPDGTVIKNHGGSDLIRNPQWAEDVIAAAKTSGLAVSAKTRLGYSKVAEYHDWIATLLSQHVAVLTVHLRTKQEMSKVPAHFEVIDDLIKMRDAIAPETLLQINGDVADYQAGVALAKAHPGLDGIMIGRGVFANPFAFESQPQSHDLHELLGLLNMQLDLFDDFATRYDVPRFPSLKRFFKIYARPELGATDLRNTMMDAKSTDDVRKILAAYQAKMRVTNHS

SEQ ID NO: 62365 - protein, 322 aa, Triticum aestivum
MDPGSEVSFEFVPVIRQYRSGRVERLLPVDAVPPSVDAATGVASRDVVFDPATGVWARLYLPARPPDGAGDRLPIMVYLHGGGLVGGSAADGPEHAFLNRLCARARVLVVSVEYRLAPEHPVPACYDDAWAALRWAAEGADPWLRDRGDRGRMFVVGYSAGGNVAHNVALRAGSEAGALPRGARVRGIGLLHPYFLSAEKADGETEQSWLRGKLEELWPFACGGRTAGLDDPRVNPVADGAPSLRRLGCDRVLVCVAEDELRLRGKAYHDGLLGSGWAEGDVELLDSIGEDHQFFLREPPSATALVLMDRLAALLAAGANQQ

SEQ ID NO: 62366 - protein, 450 aa, Nostoc sp. ATCC 53789
MINTAKSSLLPGPTTPSWWNLLQWLNNPCEFLEECRARYGDTFTFKAIGFEPLVLISNPKDIKEIFDKHKYFDSGKAKANDLAGFFLGNNSVTLLDGSSHKRQRKLLMPAFHGQNISNYGELICHATKQVTSNWQPGQRLIIYKEVKEITLRAMLTVLLGSDKTERYQQLKLIVNQIVSTITNPFASSSLFFNVFRRDWGSWSAWGNLLRCQRQIANIISAEIKERRENCNNYNNDILSMLMAARDENGGKMTDEELQDELMTLIFSGYETTSAAITWAYYWIHYLPEIRAKLLQELDELGDNPDPTEISKLPYLNAVCAETLRIYPVGLTTFPRIVKSPIEIGGHQFEVGTCLYPCIYLIHHREELYPNSKQFKPERFLDNKFLNYEYFPFGGGNRTCIGMAFAQFKMKLVLANILRNWQLELVGKPPLKPVRDIFSIYPQGGLKMVVL

SEQ ID NO: 62367 - protein, 253 aa, Chromobacterium violaceum ATCC 12472
MEDRELDDEALLRYSRHILLPEIDIAGQRRLLAARALIVGAGGLGSPAALYLASAGVGRITIVDDDAVELSNLQRQIAHDTASLGQGKAASAARRMLALNPTIEARPLAERLSGQRLMDEVAAHDLVLDCSDNFATRHAVNRACVAARVPLVSGAAVRFSGQLAVFDSRDAASPCYHCLFPDEGEASDGPCATFGVLSPLVGAIGSLQAVEAVKLLAGVPPALGKLTLYDALDGSFKQIRVPRDPACAVCGGA

SEQ ID NO: 62368 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCRVQVEKALENVLK

SEQ ID NO: 62369 - protein, 97 aa, Brassica napus
MNGKESVTFFFFLALLILPFVLLPATAAPGRVGGMGVYCGSRCRGRCSKAGFRDRCIKYCGICCRQCKCVPSGTFGNKHQCPCYRDMLSSKGKPKCP

SEQ ID NO: 62370 - protein, 131 aa, Clostridium difficile
EIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLE

SEQ ID NO: 62371 - protein, 439 aa, Burkholderia sp. 383
MPDTMSTLAQPAAHAPHRVRTSRLATASMIGTSLEWYDFTIYNTLAALVFNHLFFPSVDPLAGTILAFSTYAVGYVSRPLGGFVFGNLGDRIGRRAVLMLTLVLMGVTTALMGALPTYAQAGILSPILLVALRFVQGVALGGEWAGAVLLSVEHGDQKRRGLSASWTQIGPSFGTLLGTGCIALVTLSTTSGDFLSWGWRVPFAASALLVVFGFWLRRGVDETPQFEQLAESHATAEVPVADVLKVHWKRLLIAGGSRIGSDVLYALIVVFTLTYVTTVLHLSRPVALTAVMIGTACNALAVPFFGALSDRFGRRPVYLAGALAGIVWAFAFFTLLDSARPGAIVAAVAIGLVIHAVMYGPQGAFVTEQFPTRVRYAGSSLAYTLAGIVGGGFAPLVIAALFRQTGTTTAVSLYVAAALVVTSIALLVARETAHQPLAD

SEQ ID NO: 62372 - protein, 131 aa, Clostridium difficile
EVKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKIQVEKALENVLK

SEQ ID NO: 62373 - protein, 540 aa, Streptococcus thermophilus LMG 18311
MLTVSDVSLRFSDRKLFDDVNIAFKPGNTYGLIGANGAGKSTFLKILAGDIEPTTGHISLGPDERLSVLRQNHFDYEDERVIDVVIMGNERLYDIMKEKDAIYMKEDFSDEDGVRAAELEGLFAELGGWEAESEASQLLQNLNISEDLHYQNMSELANGDKVKVLLAKALFGKPDVLLLDEPTNGLDIQSISWLEDFLIDFENTVIVVSHDRHFLNKVCTHMADLDFGKIKLYVGNYDFWKQSSELAARLQADRNAKAEEKIKELQEFVARFSANASKSKQATSRKKMLDKIELEEIVPSSRKYPFIKFKAEREIGNDLLTVENLTVKMDGETILDNISFILRPGDKTAIIGQNDIQTTALIRALADDIDYEGTIKWGVTTSRSYLPKDNSKDFASGESILEWLRQFAEKGEDDDTFLRGFLGRMLFSGDEVNKSVSVLSGGEKVRVMLSKLMLLKSNVLLLDDPTNHLDLESISSLNDGIRDFKESVIFASHDHEFIQTIANHIVVISKNGVIDRIDETYDEFLENEEVQAKVKALWAD

SEQ ID NO: 62374 - protein, 418 aa, Zea mays
MEDDGDDDTCKAGEPSGRSPSPGEIQPLRDVPPALHQGITELRGWKVLGTAARSLRTTLPVSTLLGAIAAFHYGGGADQVPADVTITHALLWSAIVMESGLLPTVIRHASPRIKRLFTWLRTWPDQVAQYNLMGYAARSRKHSWLMKLAACLRCRDMVDHLWTMEPCKGASSAREITGLVHAHVARAWMEDHIADADSFRAFNDYRGQWTLNNSSSLPSTVVLMSSVSRPFDESVLVWHLATDFCFHFLHGDPSRVNATARRCIEVSNYMAYLLFVKPEMLMPGARRNLFKDACRELVGLLQEDRPDAPRGRGMRGLARRVVQQLKRDDDDVLASVRGLTHKLLNLLNKDDDGVLGSGGVGVVRLACCVAKDLMNSHSGNEEKIWTVIQGVWVEMLCFTASRCKGYLHAKSLGTGGEC

SEQ ID NO: 62375 - protein, 264 aa, Corynebacterium efficiens YS-314
MGFRSKKRVIAAKTPGELDAMQAAGEIVGRALQAVKAEARVGMTTHDLDQIAETVIREAGAIPTFLGYQGFPASICTSVNEVIVHGIPSKDVVLEDGDLVSVDCGATFEGWVGDSAWSFGIGELDDDVIALNNATEWVLMEGLQAMVPGNRLTDVSNALERATRRAEQKFGVHLGIVDGYGGHGIGRTMHEDPYLANEGKPNRGPMIQEGSVLAIEPMLTLGTTDSAVLEDDWTVVTLDGSYAAHWEHTVAATAAGPRILTPRR

SEQ ID NO: 62376 - protein, 480 aa, Glycine max
MLKICCIGAGYVGGPTMAVIALKCPSIEVAVVDISKSRIAAWNSDQLPIYEPGLDDVVKQCRGKNLFFSTDVEKHVYEADIVFVSVNTPTKTRGLGAGKAADLTYWESAARMIADVSKSDKIVVEKSTVPVKTAEAIEKILTHNGKGIKFQILSNPEFLAEGTAIQDLFNPDRVLIGGRETPEGQKAIQTLKNVYAHWVPEKKILTTNLWSAELSKLAANAFLAQRISSVNAMSALCEATGANVTQVSYAVGTDTRIGPKFLNASVGFGGSCFQKDILNLVYICECNGLPEVAEYWKQVIKVNDYQKSRFVNRVVSSMFNTVATKKIAILGFAFKKDTGDTRETPAIDVCKGLLGDKARLSIYDPQVTEDQIQRDLWMNKFDWDHPIHLQPTSPTTEKKVSVVWDAYEATKDADGVCILTEWDEFKSLDYQKVYDNMRKPAFVFDGRNIVDVEKLREIGFIVYSIGKPLDPWLKDMPAVA

SEQ ID NO: 62377 - protein, 387 aa, Physcomitrella patens subsp. patens
MWGPMVGSHSSVAAPARARPPRGSRRRRRRSAWDSTLALSLFLSVSLTLGVLCCGAASSSVREGGQTNAQTVVCMHGGWGWLGWFLAFSALPRRRRRVECPGGLFFEGSLLRLTAAFADVGYHQGDFVFSFWILWLVSSFSMLRGGDCPGPSSHDERMAEYEENFAAGPVPSEEPQKRMEDTEVALQKVLHDWVGNINTKPVSIIARLRTVVRLHKLPSNVNHFTLADAVSWTRQGRPWRGLLIAVVALASLLALTGMVAVALLFISSTLNAALASFLVTVSTVGFIMAFFFSSITVFYVGALGFGGLTIGSIAFFSVWAVIILSGWAAIAWIVWQGLRKAFQLGRHLVFLAGSSLSSSPATQELQRVWVTFKSSLPLFKAQKIAMD

SEQ ID NO: 62378 - protein, 406 aa, Pseudomonas syringae pv. phaseolicola 1448A
MAIEIKAPSFPESVADGTISKWYKKEGDAVKRDEMLVDIETDKVVLEVLAEADGVMGSITKEEGAIVLSNEVLGTLNDGATASAATAPAAAPASAPAAAPAAAGEEDPIAAPAARQLAEENGINLASVKGTGKDGRITKEDVVAAVEAKKSAPAAAPAAKPAAAAAPVVAAGDRTEKRVPMTRVRATVAKRLVEAQSNMAMLTTFNEVDMTEVMALRSKYKDLFEKSHNGVRLGFMSFFVKAATEALKRFPAVNASIDGSDIVYHGYADVGVAVSSDRGLVVPVLRNAEHMSLAEIEGGIATFGKKARDGKLSIDEMTGGTFTITNGGTFGSMMSTPIVNPPQAAILGMHNILQRPMAVNGQVVIRPMMYLALSYDHRLIDGKEAVTFLVTIKNLLEDPARLLLDI

SEQ ID NO: 62379 - protein, 154 aa, Glycine max
PRVRKRKKCSNKKCAKGPRPPRAASLDAADQKLIREITELAMLKRARIERMKALKKMKVAKASSSSSSSMLATVFTVVFCIVILLQGMSSGKSSVTSFQGSPVPAGLMEGGLIDVQHQLNPSSSDPNAPSLEPHKIVQQVTGLDLPAKLRRGAG

SEQ ID NO: 62380 - protein, 300 aa, Azoarcus sp. BH72
MTALSPQDFAAWMGAIQQRTEAALAGVLPEPTIAPERLHEAMRYAVLGGGKRVRPLLVHAAGAIGGAQPERLDRIACAVELIHAYSLVHDDMPCMDDDVLRRGKPTVHVEYDDATALLVGDALQTLAFQVLASAPVTDMPTRQLGMIGLLAMASGSRGMAGGQAIDLAAVGRQLDLRELEFMHIHKTGALIRCSVLLGAQAGTVDGETLERLDRYAKLTGLLFQVVDDILDAEADTATLGKTAGKDADHDKPTYVSLLGVADARRLAQDMLAEALAALEPLGARAGHLAALANYIVHRPF

SEQ ID NO: 62381 - protein, 458 aa, Triticum aestivum
MPTITHYVLDPFLETGSLPNLQKLVPKPPPAAPLPPEKSSEKPIPVPVAPARTTTLPALYSTPESTPLPDSPSSFPGTWSPYLINHKRRGPGLIKTSSQGDVGSEGSLPKFPEGLPALPKRSEAFQVQESEFRFTQESDGVVNNGVEETLDEQNEGVQKGKVTLFGQDEQDQPEFEFQHESPDVLMRPVNVGRLVNVARLVNNGMPRNGENDAFLEPQDSQSVTSNSEAEDAGGQGWWKPSSPYGTSAGTPGAEFYDAFEEISSDGATRSSRCVDDEYREMRLSMLTEIEGRKQAEEVAETWQKEWKKLSHHLSLIALSLPSPTVAENDDDTSADPGAELCQQITVSQLVAAAIARGIARVEVESEMESVISAKNFEIARLSDRVQYYEAANREMSQRNQEAIEMSRQQRNKRKMRQKWFWGSVGIAVTLGTAAIAWSYMPASQSQAGDSNSTNTNSD

SEQ ID NO: 62382 - protein, 333 aa, Pseudomonas syringae pv. phaseolicola 1448A
MTLRIAINGFGRIGRNVLRALYTQGYRQDLQVVAINDLGDSEMNAHLLRFDTVHGPFSGTVECDKDSLTVNGDRISVSAIRNPAELPWKAQDIDVVFECTGLFTSRDKAAAHLTAGARKVIISAPASGADATIVYGVNHDTLRQSHQIISSASCTTNCLAPVAQVLHRELGIENGLMTTIHAYTNDQNLIDVYHTDPYRARSATQSMIPSKTGAAEAVGLVLPELAGKLTGMAVRVPVINVSLVDLTVTLKRETTVDEVNALLKEASQHSKVLGYNALPLVSHDFNHNPLSSIFDANHTKVSGKLLKVLSWYDNEWAFSNRMLDNCLALHNAE

SEQ ID NO: 62383 - protein, 218 aa, Vibrio vulnificus YJ016
MTQDEMKKAAGWAALKYVEKGSIVGVGTGSTVNHFIDALGTMSEEIKGAVSSSVASTEKLEALGIKIFDCNEVASLDIYVDGADEINADREMIKGGGAALTREKIVAAIADKFICIVDGTKAVDVLGTFPLPVEVIPMARSYVARQLVKLGGDPCYREGVITDNGNVILDVYGMKITNPKQLEDQINAIPGVVTVGLFAHRGADVVITGTPEGAKIEE

SEQ ID NO: 62384 - protein, 230 aa, Corynebacterium efficiens YS-314
MAKASLDKDPFDVASMFDDVGDKYDLTNTVLSFGQDRVWRRRTRERLDLKPGEKVLDLAAGTAVSTVELAKSGAWCVACDFSQGMLAAGKHRNVPMVVGDGMTLPFADNSFDAVTISYGLRNIHDFRAGLREMARVTKPGGRLTVAEFSTPVIPVFGTLYKEYLMRLLPKVARVVSSNPEAYIYLAESIRAWPDQEDLAREINANGWSDCGWQNLTFGIVAMHSAIKPGN

SEQ ID NO: 62385 - protein, 208 aa, Zea mays
  misc_feature (72)..(72): Xaa can be any naturally occurring amino acid
TSTLPSINSLARWFGEPVRAAILQTEAFLTNAKGYPCLSKRHQSLLTGFFKHSVQVIIYGRSNHNVFPVSEXVLSGDESYAEDSRVRHALTPYLEYIAYLYQKMDPLPEQERIEINYRDFLQSPLQPLMDNLEAQTYETFEKDVVKYTQPENFQSKMFGEQDAEKVKSCNDKAKKMFPKVPSKISFNIVLSQLLKTMMISRNCCLPSL

SEQ ID NO: 62386 - protein, 174 aa, Setosphaeria turcica
MGNQQSGLLDNIASGSNFDREEVDRLRKRFMKLDKDNSGTIERDEFLALPQISSNPLATRMIAIFDEDGGGDVDFQEFVSGLSAFSSKGNKEEKLRFAFRVYDIDRDGYISNGELFIVLKMMVGSNLKDQQLQQIVDKTIMEADLDRDGKISFEEFTKMVENTDVSMSMTLDQF

SEQ ID NO: 62387 - protein, 107 aa, Triticum aestivum
  misc_feature (38)..(38): Xaa can be any naturally occurring amino acid
  misc_feature (45)..(45): Xaa can be any naturally occurring amino acid
  misc_feature (59)..(59): Xaa can be any naturally occurring amino acid
SRRNVCLDTEEATVSAEFAQNIASMADVFVREAFGAGXRPHSSNXGVIKILKPSVSGFXLQKEHVYLDGAVSSRKRPFAAIVGGSKVSSKIGVIESLSEKCDIILLG

SEQ ID NO: 62388 - protein, 295 aa, Physcomitrella patens subsp. patens
MRSLLSAIVRPYLTKNPTAVAALDLIRKHDGGPVCYDHFAFRTFGVDGCGIDAMSQVFLDLGYKVRDELRFPAKKLRALWFSPPDHLLDMDGSEADGPLPRIFISEIIVNQLSSETQEIIRRYTSKSGSISKHAATASVLNSLTWPTPHLSDYHALAKESEYAAWTLVNGYALNHTTVSVHRLGSLRNIEKLNDFLQENGIKLNSEGGILKVSPDGGLQQSSSVADTVTFTFAGGEVEQVPASYIEFAERLVLPIHSDLDADQIHEWHRRDGFEVGNADKIFESTSSDQTGMRNR

SEQ ID NO: 62389 - protein, 377 aa, Arabidopsis thaliana
MTTTTTTTMSTLPMVLVDEILSRVPITSLRSLRSTCKRWEAQSKTNLVGGKATARKSSYLGFILIGNKICSMKLDLNGGDDFVDTSVNQISAFDDFEISQLFHCDGLLLCVSNKHYYSNTVMVCNMYLGETRLIEHCCLLEGFDNFGSYAFGYDSSKNRNHKIFRKKLVSGGYEIYSFKSDSWKDLNVDLGESTELCELGSVSLKGNAYFSVITKHEEEELWENNLLCFDFTTESFGKFLSLPFDNVTAEEEFGIMVLSCVRDEHLAVLYQLDTLGIWISTEIEPNKVSWREFLQVDLYTLDGFPDAFTAGRFIVDEEKQVVVVFNEATEIDLNHGNAFIFGRDGYFTSFNVGDTPPQDFTSYVPSLASLQIEKTGG

SEQ ID NO: 62390 - protein, 293 aa, Populus tremula x Populus alba
MDPDSRDPPIEYREGYALSGKIMLSAILILFFVIIVMVLLHLYARWYLTRARQRQVRRVRNRRTHLVFYVDSPQNPNNVTSHVTRGLEETVKNSLPVFVYPRKTHQDSIECAVCLSEFEENERGRVLPKCNHSFHTECIDMWFHSHSTCPLCRSPVEPVAENPVPEGSNFGISEAGSGLCTSCQHEEDHLGSASTSSFNGGRKPVGLIGVTIDVPRRNGNFEDESNTESPSASHSFRSPMSRMLSFKRMLSRERRGTVSPTVANSVSCGGGSGTTEFDIEQGRDESMPQQTRC

SEQ ID NO: 62391 - protein, 342 aa, Streptococcus pyogenes MGAS10394
MIALDGTPNKGKLGANAILGVSIAVARAAADYLEVPLYTYLGGFNTKVLPTPMMNIINGGSHSDAPIAFQEFMIMPVGAPTFKEGLRWGAEVFHALKKILKERGLVTAVGDEGGFAPKFEGTEDGVETILKAIEAAGYEAGENGIMIGFDCASSEFYDKERKVYDYTKFEGEGAAVRTSAEQVDYLEELVNKYPIITIEDGMDENDWDGWKVLTERLGKRVQLVGDDFFVTNTEYLARGIKENAANSILIKVNQIGTLTETFEAIEMAKEAGYTAVVSHRSGETEDSTIADIAVATNAGQIKTGSLSRTDRIAKYNQLLRIEDQLGEVAQYKGIKSFYNLKK

SEQ ID NO: 62392 - protein, 424 aa, Methanothermobacter thermautotrophicus str. Delta H
MKPNLRRELGLFDAVNLVVGTIVGADIYIVAAYGAGSLGPASILAWLLAGLMALIIALVFSEASAMLPRTGGPYVYAGEALGRFTGFITGWSLWVSSWVAIAVFPLAFIYYLEYFIPLDPPAEAVIKVLFILSLTIINIAGVGRAGKVNDILTILKVAPVLLFAVLGAIHLALNPGLLVSNYTPAAPMGLGALGTVTVLVFWAYVGFELVTVPADEVRDPERTIPLSITLGMIFVTLFYILTNAVILGLVPWRVLASSTAPLTVAGYSLMGGIGALILTAGAVFSIAGSEEAGMLTTARLLFAMSEDGFLPGFLSRVHRRFGTPHMSILVQNLTALLAALTGTVSGLIELSVVTLLLPYAVTCISLAILRRRDGSGIPLKSVLGVLVCIYLLMNTTPSTTAWGLLLILSGAPLYLIFGFKRLRR

SEQ ID NO: 62393 - protein, 436 aa, Desulfitobacterium hafniense DCB-2
MNHKTAPVEIREKVSFHPSEINKALMELNELSALNGIVLLSTCNRLEIYAATPEVELGVSVIKKFLARHGKLREEDINQYLYVHTLYDSVRHLFRVVAGLDSMVMGETQILGQVAEAYEKSSQLNLSNKIIHAIFQNALAVGKRVRSETQIDQHPTSVSYTAVELAKQTFGDVQGKSILILGAGEMSALTAKHLVASGADTVLVSNRSMQRAQALAEEFSGRAIPYEELDTALAEADIVISATAAAHFVIKPERMRRVMEQRRQRALLLIDIAVPRDIHPNVGELEGVTLFDIDDLRGVVDSHQKAREEAALQAGRILEEEMGRFVKWHNSLYVVPTIVALQRRGEEVREIMLKSALNKLGPIDEKQEKIIRSMANSIVTHLLHAPIANLKEAANTSQGHLYTEILQNLFDLDGNELSPHAGWSVHHAASHHSNQG

SEQ ID NO: 62394 - protein, 441 aa, Oryza sativa Japonica Group
MSFDNFVQITGDARAVRKALFAVSTIIYKCPSKETIPLETSVSDLPPSIIVPSELPVYPSSNFYSPSDAAISSGHPSLSILGSTPHVPELTVSADAHSRLPIYQSVLPVIPAYNTPKCSGELVLRVLCPAGKIGLVIGKGGVTIKSIRKESGARIDVDDSKNDREESIITITSNEATDDAKSAAVEAVLLLQSKINDDNEGKMNLRLLVPGKVIGCLIGKGGSIVNDMRSKTKAAIYISKGEKPRKASSSDELVEVFGEVENLRDALVQIVLRLRDDVLRDSVDRQNSEKDGKLTVATTDPLYASSYPLPALLPYRQQITPLGYDHRGDIERGLEVYPHSSLYGYSSLQAIDDGYSAVSSYASKGYGGRPPHMEMTIPASGLSKVMGKHGTNLDNIIKISGAHIEIIESKSSRHGHVARISGTTEQKQSAENLIKAFIMST

SEQ ID NO: 62395 - protein, 323 aa, Erwinia carotovora subsp. atroseptica SCRI1043
MVRERIIIDTDPGVDDAIAIWLALASPELDVLGITVVAGNVPLEATLPNACNVVGLTGRTDVPIFAGASRPLIRDQVFGKYAHIGKFSSEWVPQSTLSPEQEHAVDFLVRMTRQAAADNNPITICSLGPMTNLALALCFHPDVARGIKQIVSMSGAFTAMGNRVPWADFNVYADPHAAEIVFSSGVPVVIMPLDVTFQALIQTEQVDVIERSAGAPGKAMAALLLMFDRNEVERFGREGGPIHDATVIAWLLKPELFKSKYARIGVEVSGKTAGYVFADFYHKLGEPANALVMREIDEQGFLGLIADRLRHYDVDTLNGSGGR

SEQ ID NO: 62396 - protein, 317 aa, Erwinia carotovora subsp. atroseptica SCRI1043
MSALPIIIDCDPGIDDAIALLSAFVAPELDIRGICTVCGNQALEKTVRNALQIVELGQRTDIPVFAGCHRPLLREPIHGQFHGESGLGQTVLPEPQKQAEAQHAVSFIIAQCRQAIADGTPITLCTLGPLTNVAMALRMAPEIADGIARIVMMGGAYREAGNRSLTSEFNMIADPQAAKVVFDSSIALVALPLDVTHQVILTPELVARFVALSGRISVPLGEMMAFWDRNDIRRYGSRGGPLHDPLVIAWVLAPHCFTTEKASVYIEQESELCMGQTVADWYGKTDRQPNVDVVTGVDAKQVVELFADLLSRYREGV

SEQ ID NO: 62397 - protein, 108 aa, Nostoc punctiforme PCC 73102
MVRNLSADVYGMTTAPTITPERSSQVTRKTYPNYKVIVLNDDFNTFQHVAECLMKYIPGMSGDRAWDLTNQVHYEGQAIVWVGPQEPAELYHQQLRRAGLTMAPLEAA

SEQ ID NO: 62398 - protein, 500 aa, Burkholderia sp. 383
MSTTNFVAVSDTVRTFVARDFGLFIDGEMQPAHAAARLDVYDPATGERLATVADADERDVDRAVASAKHAFDTRVWSGLRPADRERILLKLADLIERDAETLAQLETLNQGKSIHVSRAIEVGASVEYVRYMAGWATKITGQTLDVSIPFPPGARYTAYTRKEPVGVVAAIVPWNFPLMIAVWKLIPALAAGCTIVLKPSPETPLTALRLAELALEAGVPPGVFNVVTGGRVCGAALASHPSIAKISFTGSTATGKLVGAAAVQNMTRFSLELGGKNPIVMLDDIDVAQALDGVAAGAFFNQGQVCAAASRIYVHRSKFAQLADGLAGVAQSMKLGAGLDTTAQINPLVSAHHRDKVVQHIEGARRAGLTFLAGGTPADDLPGYYVKPAVIADPHPDSAIVRDEVFGPVIVVVPFDDAADAVRLANASPYGLAASIWSNDLKRVMNLVPQIEAGTVWVNCHIPLDPSMPFGGYKQSGIGREFGQYAIEGFTETKSVCIAH

SEQ ID NO: 62399 - protein, 446 aa, Burkholderia sp. 383
MSYNEAKFWHPMVHPNEMKQRKPIRIVRGDGCYVFDEEGRKLVDGVAGLWNVNVGHNRQEVKDAIVRQLDELEYFQLFDGISHPRAEELSKKVIDMLEPEGMRRVLYSSGGSDSIETALKIARQYWKVRGQADRTKFISLKQGYHGTHFGGASVNGNTVFRRNYEPNLPGCFHVETPWLYRNPFTQDPEELGRICAEMLEREIQFQSPDTVAAFIAEPIQGAGGVIVPPANYWPLVREVCDRYGVLLIADEVVTGFGRSGSMFGSRGWGVRPDIMCLAKGISSGYVPLGATVVNARIEDAFAANADFGGAIMHGYTYAGHPVACAAAIASLDIVVKEDLPANAAKQGAYLLEALKPFAERFAAVGEVRGKGLMLALDLVANKDTREPIDPLSGYANAVAEVARENGVLVRPVGTKIILSPPLVIQREQLDRIVDALAAGFEAVPFA

SEQ ID NO: 62400 - protein, 539 aa, Populus trichocarpa
MAYASHLFKHSKKLRNHQHADLVRWLSNDSHLSGGKRNDAWAVMEKRRYSSAAANSTAMSFGASKKDVSRTFMKVGSPIAGPLFMKDFACSQVHWKRGFSSDSGLPPHQEIGMPSLSPTMTEGNIARWLKKEGDKISTGEVLCEVETDKATVEMECMEEGYLAKILKGDGAKEIKLGEVIAITVEDEEDIAKFKDYNPSASGSGATSANEASAPTPPASHKEEVEKPASLPEPKISKPSAAPDGDRTFASPLARKLAEDHNVPLSSIKGTGPDGNIVKADIEDYLASRGKEAPATKPVAKDTSAPALDYVDIPHSQIRKVTASRLLLSKQTIPHYYLTVDTCVDKLMGLRSQLNLIQETSGGKRISVNDLVIKAAALALRKVPQCNSSWTDSYIRQYNNVNINVAVQTDNGLYVPVIRDADKKGLSKIADEVKNLAQKAKENSLKPEDYEGGTFTVSNLGGPFGIKQFCAIINPPQSGILAIGSAEKRVIPGSGPDDFKFASFMSVTLSCDHRVIDGAIGAEWLKAFKGYIENPESMLL

SEQ ID NO: 62401 - protein, 1171 aa, Staphylococcus aureus
MINRDNKKAITKKGMISNRLNKFSIRKYTVGTASILVGTTLIFGLGNQEAKAAENTSTENAKQDEASASDNKEVVSETENNSTQKNDLTNPIKKETNTDSHQEAKEAPTTSSTQQQQNNATTSTETKPQNIEKENVKPSTDKTATEDTSVILEEKKAPNNTNNDVTTKPSTSEIQTTPTTPQESTNIENSQPQPTPSKVDNQVTDTTNPKEPVNVSKEELKNNPEKLKELVRNDSNTDRSTKPVATAPTSVAPKRVNAKIRFAVAQPAAVASNNVNDLITVTKQMITEGIKDDGVIQAHDGEHIIYTSDFKIDNAVKAGDTMTVKYDKETIPSDITDDFTPVDITDPSGEVIAKGTFDLNTKTITYKFTDYVDRYENVNAKLELNSYIDKKEVPNETNLNLTFATADKETSKNVKVEYQKPIVKDESNIQSIFSHLDTTKHEVEQTIYVNPLKLNAKNTNVTIKSGGVADNGDYYTGDGSTIIDSNTEIKVYKVASGQQLPQSNKIYDYSQYEDVTNSVTINKNYGTNMANINFGDIDSAYIVKVVSKYTPGAEDDLAVQQGVRMTTTNKYNYSSYAGYTILFYQLLTLVVVTVSVKPEEKLYKIGDYVWEDVDKVGVQGTDSKEKPMANVLVTLTYPDGTTKSVRTDANGHYEFGGLKDGETYTVKFETPAGYLPTKENGTTDGEKDSNGSSVTVKINGKDDMSLDTGFYKEPKYNLGDYVWEDTNKDGIQDANEPGIKDVKVTLKDSTGKVIGTTTTDASGKYKFTDLDNGNYTVEFETPAGYTPTVKNTTAEDKDSNGLTTTGVIKDADNWTLDSGFYKTPKYSLGDYVWYDSNKDGKQDSTEKGIKDVTVTLQNEKGEVIGTTKTDENGKYHFDNLDSGKYKVIFEKPAGLTQTGTNTTEDDKDADGGEVDVTITDHDDFTLDNGYFEEDTSDSDSDSDSDSDSDSDSDSDSDSDSDSDSDSESDSDSDSDSDSDSDSDSDSDSDSESDSDSESDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDAGKHTPVKPMSATKDHHNKAKALPETGSENNGSNNATLFGGLFAALGSLLLFGRRKKQNK

SEQ ID NO: 62402 - protein, 339 aa, Streptococcus pneumoniae R6
MQEKILVTGGAGFIGTHTVIELIQAGHQVVVVDNLVNSNRKSLEVVERITGVEIPFYEADIRDTDTLRDIFKQEEPTGVIHFAGLKAVGESTRIPLAYYDNNIAGTVSLLKAMEENNCKNIIFSSSATVYGDPHTVPILEDFPLSVTNPYGRTKLMLEEILTDIYKADSEWNVVLLRYFNPIGAHESGDLGENPNGIPNNLLPYVTQVAVGKLEQVQVFGDDYDTEDGTGVRDYIHVVDLAKGHVAALKKIQKGSGLNVYNLGTGKGYSVLEIIQNMEKAVGCPIPYRIVERRPGDIAACYSDPAKAKAELGWEAELDITQMCEDAWRWQSKHPNGFED

SEQ ID NO: 62403 - protein, 219 aa, Physcomitrella patens subsp. patens
MRTRWGCWCQLALVVGVWLLLTQQALGIRFVIDKKECFQHEVPNDGDQVLVSYVVIKSESAWTFDHASVGVDLIVEAPAGYQVHSSKSKVEDKFNFIAVRRGLYKFCFYNRNYVHENVDFDVHVGHHITDIDVQLVKDEHIDPLIWQIERLEESLYSIQFEQHWLLAQTDRQEIVNDAMSKRLIYKAILEALALVGCSVVQVVLLRRLFEKKLGQSSRV

SEQ ID NO: 62404 - protein, 2214 aa, Saccharomyces cerevisiae YJM789
MATIAPTAPITPPMESTGDRLVTLELKDGTVLQGYSFGAEKSAAGELVFQTGMVGYPESVTDPSYEGQILVITYPLVGNYGVPDMHLRDELVEELPRYFESNRIHIAGLVISHYTDEYSHYLAKSSLGKWLQNEGIPAVYGVDTRSLTKHLRDAGSMLGRLSLEKSGSDRTISRSSSWRSAFDVPEWVDPNVQNLVSKVSIDEPKLYVPPADNKHIELQTGPDGKVLRILAIDVGMKYNQIRCFIKRGVELKVVPWNYDFTKEDYDGLFISNGPGDPSVLDDLSQRLSNVLEAKKTPVFGICLGHQLIARAAGASTLKLKFGNRGHNIPCTSTISGRCYITSQNHGFAVDVDTLTSGWKPLFVNANDDSNEGIYHSELPYFSVQFHPESTPGPRDTEFLFDVFIQAVKEFKYTQVLKPIAFPGGLLEDNVKAHPRIEAKKVLVLGSGGLSIGQAGEFDYSGSQAIKALKEEGIYTILINPNIATIQTSKGLADKVYFVPVTAEFVRKVILHERPDAIYVTFGGQTALSVGIAMKDEFEALGVKVLGTPIDTIITTEDRELFSNAIDEINEKCAKSQAANSVDEALAAVKEIGFPVIVRAAYALGGLGSGFANNEKELVDLCNVAFSSSPQVLVEKSMKGWKEVEYEVVRDAFDNCITVCNMENFDPLGIHTGDSIVVAPSQTLSDEDYNMLRTTAVNVIRHLGVVGECNIQYALNPVSKDYCIIEVNARLSRSSALASKATGYPLAYTAAKLGLNIPLNEVKNSVTKSTCACFEPSLDYCVVKMPRWDLKKFTRVSTELSSSMKSVGEVMSIGRTFEEAIQKAIRSTEYANLGFNETDLDIDIDYELNNPTDMRVFAIANAFAKKGYSVDKVWEMTRIDKWFLNKLHDLVQFAEKISSFGTKEELPSLVLRQAKQLGFDDRQIARFLDSNEVAIRRLRKEYGITPFVKQIDTVAAEFPAYTNYLYMTYNADSHDLSFDDHGVMVLGSGVYRIGSSVEFDWCAVTAVRTLRANNIKTIMVNYNPETVSTDYDEADRLYFETINLERVLDIYEIENSSGVVVSMGGQTSNNIAMTLHRENVKILGTSPDMIDSAENRYKFSRMLDQIGVDQPAWKELTSMDEAESFAEKVGYPVLVRPSYVLSGAAMNTVYSKNDLESYLNQAVEVSRDYPVVITKYIENAKEIEMDAVARNGELVMHVVSEHVENAGVHSGDATLIVPPQDLAPETVDRIVVATAKIGKALKITGPYNIQFIAKDNEIKVIECNVRASRSFPFISKVVGVNLIELATKAIMGLPLTPYPVEKLPDDYVAVKVPQFSFPRLAGADPVLGVEMASTGEVATFGHSKYEAYLKSLLATGFKLPKKNILLSIGSYKEKQELLSSVQKLYNMGYKLFATSGTADFLSEHGIAVQYLEVLNKDDDDQKSEYSLTQHLANNEIDLYINLPSANRFRRPASYVSKGYKTRRLAVDYSVPLVTNVKCAKLLIEAISRNITLDVSERDAQTSHRTITLPGLINIATYVPNASHVIKGPAELKETTRLFLESGFTYCQLMPRSISGPVITDVASLKAANSVSQDSSYTDFSFTIAGTAHNAHSVTQSASKVTALFLPLRELKNKITAVAELLNQWPTEKQVIAEAKTADLASVLLLTSLQNRSIHITGVSNKEDLALIMTVKAKDPRVTCDVNIYSLFIAQDDYPEAVFLPTKEDQEFFWNNLDSIDAFSVGALPVALANVTGNKVDVGMGIKDSLPLLLAAVEEGKLTIDDIVLRLHDNPAKIFNIPTQDSVVEIDLDYSFRRNKRWSPFNKDMNGGIERVVYNGETLVLSGELVSPGAKGKCIVNPSPASITASAELQSTSTKRRFSITEEAIADNLDAAEDAIPEQPLEQKLMSSRPPRELVAPGAIQSLIRSNNPFRGRHILSIKQFKRSDFHVLFAVAQELRAAVAREGVLDLMKGHVITTIFFEPSTRTCSSFIAAMERLGGRIVNVNPLVSSVKKGETLQDTIRTLACYSDAIVMRHSEEMSVHIAAKYSPVPIINGGNGSREHPTQAFLDLFTIREEIGTVNGITVTFMGDLKHGRTVHSLCRLLMHYQVRINLVSPPELRLPEGLREELRKAGLLGVESIELTPHIISKTDVLYCTRVQEERFNSPEEYARLKDTYIVDNKILAHAKENMAIMHPLPRVNEIKEEVDYDHRAAYFRQMKYGLFVRMALLAMVMGVDM

SEQ ID NO: 62405 - protein, 444 aa, Burkholderia xenovorans LB400
MKENLMPSMGKTAPVFLSAPALRGRVVEARGVIARVVGVSLRIGEKVRLVRPDTLEAQYGEVVGFTHDGALVMPLAGLNGLSDITEVQGCGSAWGTFDAAGLLGRVVDGLGNPLDGGPVPRPLASAAAQAGEGTLNPLERPVIATPFATGVRAIDGLLTCGVGQRTGIFAPAGGGKSTIMGMIANGASTDAIVVALIGERGREVAEFIHDHLERRRASTIVIAATSDRPAAERIKAAELASQVAVGLRASGRNVLLLFDSLTRYARALRELGLAVGEPPLRGGFPPSVFAQLPRLIEAAGVTAQGSITAFYTVLADEADLSDPVAEEARSLLDGHIQLSSKLGAAGHYPAIDILRSRSRLMTRVAAAVHQADANRVRDWLARYEDVELLLQIGEYQRGNDADTDQAIDRRAAIVSFLRQRYDTRCGWDDTRRQLHALCDGDRRA

SEQ ID NO: 62406 - protein, 182 aa, Aspergillus oryzae
MFAARRLTAGVPRVFSQRALFHNTAPAFVQKGDSIPNLDVLVEDSPGNKVNLASELKGKGVIVGVPAAFSPACSSSHVPGYINHPKLKEAGQVFVVSVNDPFVMKAWATSLDPSGKSGIRFLGDPTGKFSEALDVTFDSSSIFGNHRSKRYALLVENGKVKEAFVEPDNTGLDVSAAEKVLA

SEQ ID NO: 62407 - protein, 668 aa, Saccharomyces cerevisiae YJM789
MEDKFANLSLHEKTGKSSIQLNEQTGSDNGSAVKRTSSTSSHYNNINADLHARVKAFQEQRALKRSASVGSNQSEQDKGSSQSPKHIQQIVNKPLPPLPVAGSSKVSQRMSSQVVQASSKSTLKNVLDNQETQNITDVNINIDTTKITATTIGVNTGLPATDITPSVSNTASATHKAQLLNPNRRAPRRPLSTQHPTRPNVAPHKAPAIINTPKQSLSARRGLKLPPGGMSLKMPTKTAQQPQQFAPSPSNKKHIETLSNSKVVEGKRSNPGSLINGVQSTSTSSSIEGPHDTVGTTPRTGNSNNSSNSGSSGGGGLFANFSKYVDIKSGSLNFAGKLSLSSKGIDFSNGSSSRITLDELEFLDELGHGNYGNVSKVLHKPTNVIMATKEVRLELDEAKFRQILMELEVLHKCNSPYIVDFYGAFFIEGAVYMCMEYMDGGSLDKIYDESSEIGGIDEPQLAFIANAVIHGLKELKEQHNIIHRDVKPTNILCSANQGTVKLCDFGVSGNLVASLAKTNIGCQSYMAPERIKSLNPDRATYTVQSDIWSLGLSILEMALGRYPYPPETYDNIFSQLSAIVDGPPPRLPSDKFSSDAQDFVSLCLQKIPERRPTYAALTEHPWLVKYRNQDVHMSEYITERLERRNKILRERGENGLSKNVPALHMGGL

SEQ ID NO: 62408 - protein, 464 aa, Pseudomonas syringae pv. phaseolicola 1448A
MRISVFGSGYVGLVQATVLAEVGHDVVCMDIDQAKIDQLRQGQVHIYEPGLANLVRDNLDHERLHFTTDERLAVEHAEVLFIAVGTPSRADGSADLGGFFAVGEAIARHRCEPLIIVEKSTVPVGSGDALRGHIDKVLRQAGRLLQFDIVSNPEFLKEGSAVNDCRRPDRIVIGCENEAVRKVMRELYAPFNRNHDRIMFMDLRSAELTKYAANCMLATKISFINQIAELAEHLGADVESVRLGIGADSRIGYDFIYPGCGYGGSCFGKDIRALIHSAREAHCSNDLLSVVEAINERQKNKLFERVNAFYQGDLRGKTFALWGLAFKPNTDDMRDAPSRMLMEALWEAGASVRAFDPEAMQETQRIYGHRKDLILMGTPESVLNDADALIICTEWQQFKAPDFELIQQRLNAPIIFDGRNLYDTERLATRGFHYFPIGRGESCDLPIPQKRWTPYDQLTSSQAI

SEQ ID NO: 62409 - protein, 729 aa, Salmonella enterica subsp. enterica serovar Paratyphi B str.
MLYKGDTLYLDWLEDGIAELVFDAPGSVNKLDTATVASLGQALEVLEKQHDLKGLLLRSNKAAFIVGADITEFLSLFLVPEEQLSQWLHFANSVFNRLEDLPVPTLAAVNGYALGGGCECVLATDYRLATPDLRIGLPETKLGIMPGFGGSVRLPRMLGADSALEIIAAGKDVGAEHALKIGLVDGVVKQEKLIEGAIAVLRQAITGDLDWRAKRQPKLEPLKLSKIEAAMSFTIAKGMVAQTAGKHYPAPMTAVKTIEAAARFGREEALNLENKSFVPLAHTNEARALVGIFLNDQYVKGKAKKLTKDIETPKQAAVLGAGIMGGGIAYQSAWKGVPVIMKDINDKSLNLGMTEAAKLLNKQLERGKIDGLKLAGVISTIHPTLDYAGFDRVDVVVEAVVENPKVKKAVLAETEQKVRPETVLASNTSTIPIGELASALERPENFCGMHFFNPVHRMPLVEIIRGEKSSDETIAKVVAWASKMGKTPIVVNDCPGFFVNRVLFPYFAGFSQLLRDGADFRKVDKVMEKQFGWPMGPAYLLDVVGIDTAHHAQAVMAAGFPQRMQKEYRDAIDALFDASRFGQKNGLGFWRYKEDSKGKPKKEEDAAVDDLLASVSQPKRDFSDDEIIARMMIPMINEVVRCLEEGIIASPAEADMALVYGLGFPPFHGGAFRWLDTQGSAKYLDMAQQYQHLGPLYEVPEGLRNKARHNEPYYPPVEPARPVGSLKTA

SEQ ID NO: 62410 - protein, 405 aa, Glycine max
MEGSKENCVPRIPLIPSSNLQGPRMKPLLHHRLPLGNISQNVNMPHSQVNKLDLSRKCTAHTIQHHFPQETKKQNLLAPNPSCKLDCDIVDIDDDDGDGSDDAVPVFVKHTEAMLDEIDKIEEVEMEDVEEEPVLDIDACDRKDPLAVVEYIDDIYSFYKDIENSSCVSPNYMTSQLDINERMRAILIDWLIEVHYKFELLEETLFLTVNLIDRFLERQAVIRNKLQLVGVTAMLIACKYEEVTVPTVEDFILITDKAYTRNEVLDMEKLMMNILQFKLSMPTPYMFMRRFLKAAHSDKKLELLSFFLVELCLVECKMLKFSPSLLAAAAIYTAQCSLYQFKQWTKTTEWYTDYSEEKLLECSRLMVTFHQKAGSGKLTGVYRKYNTWKYGCAAKIEPALFLLDN

SEQ ID NO: 62411 - protein, 78 aa, Streptomyces coelicolor A3(2)
MRTATLGPAQRAESLAAMAERELDVLVVGAGVVGAGTALDAVTRGLSVGLVEARDWASGTSSRSSKLIHGGLRYLQML

SEQ ID NO: 62412 - protein, 326 aa, Lactobacillus plantarum WCFS1
MSEQYFDPKLKIFALNSNKPLAEKIADAVGVKLGKTSVDRFSDGEIRINIEESIRGDQVYIIQSTSAPVNDNLMELLIMIDALRRASAKTINVVIPYYGYARQDRKARSREPITAKLVANMLETAGATRILALDLHAAQIQGFFDIPLDHLMGAPLLADYFLNHHLDENAVVVSPDHGGVTRARKLAEFLKAPIAIIDKRRPRANVAEVMNIIGDVKGKRAIMIDDMIDTAGTITLGAQALVDAGATEVYASCTHPVLSGPAIERIEKSPIKKLVVTDSIELPAAKRIDKIEQVSVGQLMGQAIKFIHENKPVSPLFKNRFHNEEN

SEQ ID NO: 62413 - protein, 120 aa, Brassica napus
MDESAGSSSSWAAISSSNIGFQLLKKQGWKEGTGLGVAEQGILVPVQAELKNNKRGLGAPAEKPTKRKAVKATDSGNEEEVSKQSKKLSKKMRKLMEHEKQLQEKEFERAFFREFWPDNV

SEQ ID NO: 62414 - protein, 170 aa, Cenarchaeum symbiosum
MDLEAMLASYPDFPKKGVLFKDIGPILRDPAALAWAADELLRRYPPADFDVIAGIESRGFILATIMSARSGKGMVMIRKPGKLPGKTVKLAYKTEYGEDILEAQHGSVKSGERVIICDDLLATGGTAAAAASLVEQVGGKVAGLAFIVELAKLCGADKIAGYNRKSLVVY

SEQ ID NO: 62415 - protein, 298 aa, Streptomyces sp. WA46
MIDVAVAEPGPGQVRIEVRAVGVNPFDHKMYSGAFGTDPANLPMRLGAEAAGVVTAVGADATGPAGPIQIGDEVIAYRAPGAYAAELIVPASSVVPKPAALSWEQAGGLMVTGVTAVHVLEAIGLREKDSVLIHGAAGGVGLMAVQLAVERGATVLGTASPAKHDVLRDLGAIPIAYGPGLADRVRAAAPQGVHAAADLVGTDEAVDVSVELVADRSRIASVAGFERGARAGIKLLGGGPGADPGTEIRTAARLQLTEAAEAGRLRVLIAASHPLREAAAAHRQIMTGHTTGKIVLVP

SEQ ID NO: 62416 - protein, 399 aa, Fusobacterium nucleatum subsp. vincentii ATCC 49256
MIYKIEDVLKDIKNGIPLIIVDDENRENEGDLFVAAEKATYESVNLMATYARGLTCTPMSTEYAVRLGLDPMTARNTDAKCTSFTVSVDAKEGTTTGISIADRLTTIKKLADINSVPSDFTRPGHIFPLIAKDRGVLEREGHTEATVDLCKICGLAPVAVICEILKDDGTMARVPDLEIFAKKHNLKIITIADLIKYRKKTEQLMKIDVVANMPTDSGTFKIVGFDNLIDGKEHIALVKGEVAGKENVTVRIHSECFTGDILGSLRCDCGSQLKTAMRRIDRLGEGIVLYLRQEGRGIGLLNKLRAYNLQEEGMDTLDANLHLGFGADMRDYAVAAQMLKALGVKSIKLLTNNPLKINGLEEYGMPVVEREEIEIEANKINKIYLKTKKERMGHLLKIK

SEQ ID NO: 62417 - protein, 211 aa, Ehrlichia chaffeensis str. Arkansas
MGIIVSENSSFISPVEHIIEDSKQGKMFILIDDEQRENEGDLVVLAEKVTSGVINFMITHGSGIVCLSITEDLMHKLGLEFIPKRHVNCNSASFATSIDARYGITTGVSAHDRAHTILTVVNKNVTEDDFVTPGHIFPIVSKKGGVLERSGHTEASVEIARIAGLAPVAVVCELMNPDGTMSRMPDIIEFSQRYNIKVTSIDKLIQYVKAN

SEQ ID NO: 62418 - protein, 569 aa, Moorella thermoacetica ATCC 39073
MLLKGIAISPGKVIGRAHRLIEHANNYSRSFLTSEVEKEKELARLAQAFNQAKEQLASLIDKTKREIGLQEAKIFEAHLLLLSDPLLGEKIRTKIQVEGKDAVWAVSEATEEIAQEFASLEDEYFRERAVDIRDIGRRLIACLGNGLEEVSDEATNTIIVAEELTPSQTASFSRRTVAGIITEKGGPTSHTAVVARSLGIPAVSGVTNLLDLVKDGDFVFIDGNNGVIHLNPDVEEIKNLPTNGQNNWREKRCIRNALAKAITRDGHEIEVATNLRNFEEAELALAYGAEGVGLFRTEFLYMNRQEPPGEEEQFLIYRDVLLALKDKPVIVRTLDIGGDKHLPYLEQDKEDNPFLGLRGIRLCLKHKDLFKTQLKALLRASSYGNLKLMFPMVTTLEEIRQAKTLLEEAREELQVAGIETSINIPIGIMIEVPAAALMADILASEVDFFSIGTNDLTQYTLAVDRDNEKVAVLYDAYHPAVLKFIYQVVDAAHRKGKWVGLCGELGGDSLAAPLLVGLGLDEISMSPVFIPAMKERIRALSYEEGRELVRRLLELPGAKEVREVLVKTS

SEQ ID NO: 62419 - protein, 388 aa, Moorella thermoacetica ATCC 39073
MTDKQILLLPGPTPVPPQVALAMARPAINHRGPEFKALWAEVTSGLKDVFQTRAEVVILTASGTGGMEAAVANLISPGEKVLVVTIGAFGERFVQICRAFNVEAEVVAFPYGQAADPEVIAERLAADTGHEIKAILVQHNETSTGVLNDIQAISRARGDHPALLIVDSISGLAAADLPMDAWHIDVVIAGSQKAFMLPPGLTMLAVGERAWQAAEKCSNQRFYLDIKKARNSGLKGQTPFTPAVPLLYGLQESLRLLKAETLAGSYARHALMRDMVRAGVRALGLKLLADEAIASPAVTAVCVPEGMKPADIINPLRERFGVVVAGGQGAVKDQVFRIGHLGYVSFNAILAGLAALEAVLADAGVPVTRGAAVAAASTILSESEAVDK

SEQ ID NO: 62420 - protein, 524 aa, Mycobacterium avium subsp. paratuberculosis K-10
MTEMAPAPIQHTTAEKLAELYLRLELAKEPGGEKAAAKRDKKGIPSARARIHALVDPGTFLETGALAKTPNDPNALYGDGCVTGHAMIDGRPVGVFSHDQTVFQGTVGEMFGRKVARLMEWCAMVGCPIIGIQDSGGARIQDAVTSLAWYAELGRRHEALSGLVPQISLIFGKCAGGAVYSPIQDDLLVSVRDQGYFFVTGPDVIREVTGEEVTLDELGGSDAQARYGNIHHVVNTEAEAFQYVREYLSFLPSNCFDQPPIVNPGLEPEITPTDLELDSIVPDSDNMSYDMHEILLRIFDDGDFLEVAAQHGPAIITGYARVDGHPVGVIANQPMHLSGSIDNEASDKAARFIRFCDAFNIPLVFVVDTPGFLPGAEEEKRGIIKRGGRFLYSVVEADVPKVTITVRKSYGGAYAVMGSRQLTADFNFAWPTARIAVIGAEGAAQLLMKRFPDPTTPEAQQIKKDFIEGYNLNMAIPWTAAERGFIDAVIDPHETRLLLRKSLKLLRDKQLWFRVARKHGLIPV

SEQ ID NO: 62421 - protein, 347 aa, Zea mays
MGNSDAASPASAAAARDSKKKRGSRSAAKLKQSKRDTRREQFLSRGQGNKDAKSAASPTGAVSGSPILASPHPPLPRRRADSRSRGSDPEDRDEAIAAGLEADGSGLDSPGSDKRQSGDCPQRKGFPGNGGGPSLSSGSSVWSSSRSVSDAEEDTGGPEDESEVFDDWEMAADALYVDDSSCNQSSGPTPTLPQAPTTAEPSHAAKPEPIQSKTRAWAPDDIFRPQSLPSISKQTSFPTSIGNRWQDMGMSAAQQGILSLPLSCPICCDDLDLTDSSFCPCPCGFHMCLFCHNRILVEDGRCPGCRKQYNTVSAAEGGGGGGSRATVGTGREMEKRLSRSCSMGPSY

SEQ ID NO: 62422 - protein, 1008 aa, Oryza sativa
MDLSRVGEKLLSSVRSARSLGLLPPTPPPPASRPEVPNHFLPPPPSSISHSVYPVLDPIEVPARAAAAAAAARAIAGLPPHEKISLPSNSEDLVSIYGSNPQGHAVDELEEVFFQEEFDPIKYILQSIPAEGDSSYFDKQSTLRLAQLDKIAERLSHHVMGHHEEMDIPVISIFLNFPKITCSVLCYQKCIYTDFLLRKSQITDNKFWPVKGMQLVMELEQDLKVANVICMNGRRHVSSSKNEVSRDLVVNVKSKKKQALLDVLPILTELRNAQDMQMELESFVEKENYFQAFQLLPEYLQILENYSGLSSVQEMGRGIEAWLARTIQKLDTHLLGVCQTFHEESYLTVIDAYALMGDIGGMAEKMQSFFLQEVLSQTHYVLKEMLEEVSRFTYSDLCAQVPEPKLRPCLLRTFQSLFSLMCSYYTIMSFCPGVKSIESEGENSLTGRNNTSQSADESLGDSVVFSTSTYQFLKNYEDLTIFILAGEAFCGFEASEFRQKLKGICLNYSVAFHRQNIYALKMVLERESWTIMSAEASRIISLAGLTGDGAALISPTSRISTLPIHGSTMSDTGKEKNGFAAWTKIENPFFYKVENGTTESPKSNMMFNSVDNSSAHGSTNNGNGNKAPLDEENEDLLADFIDEDSQLPSRLAKTKIVKGNSSHWKDGDISSQTGSSLSLLRCDFFTGIRMMDKYARLMQKLEIVNVELFKGICQLFGIFYHYIYETFGNQDRGQSGKSLPDHQSFRLRVALSKITQDSDQWIKPQSISYSPSSPVSMDVMPTAPPSSMFTLYGLKERCAAAETISLVARVLNRSRAHLHSVLSQSNTSILEEFFGTMVDSVPDLAEHIHRTSARMLLHINGYPDKIANAKWEVKELGMEHNGYVDLLLGEFKHYKTRLDHGGISKELQDLLLEYGIDSIAEVLVEGLSRVLINGLLHIVSANVRPKLQIVDTFIKAYYLPETEYVHWARSHPEYSKSQVVGLVNLVATMKGWKRKTRLETIERIEAGP

SEQ ID NO: 62423 - protein, 207 aa, Triticum aestivum
  misc_feature (114)..(114): Xaa can be any naturally occurring amino acid
MGSVGTGLLKGLRRVLEKQRKPVDLCRTSRAWSSTVSFSDIDEKDDMGDDGDLKDSRRELEPQSVDPKKGWGFRGVHRAIICGKVGQAPVQKILRNGRTITIFTIGTGGMFDQXRVIGSVDTPKPAQWHRIAVHSEHLGAYAVQKLVKNSAVYIEGEIETRVYNDGIDGQVRNIPEICIRGDGKIRLVKSGESAASISLDELRDELF

SEQ ID NO: 62424 - protein, 421 aa, Zea mays
MASFSGHLHRPLSAMAVAAFAAVSSHELPDKLSHHRLPDASTGTDALASLPLTRSDVPAAPSASALSGAQLLPRDLHSLRLLKAPFASVPVMQTVYQYANFAKTSGQADAMPAIPSSPSDVLYRWHLPDPRVYADFPDKSQTVVVLLGWLGSRQKHLKRYADWYTSRGFHVVTFTLPMSDILSYNLGGKAEKNVEMLSEHIADWVREESGKKIIFHTFSNTGWLWYVMGVILENFAQHDPSAVDKIKACVVDSAPVAAPDPQVWALGFSAALMKKRSVTTKGLGSDDSRSDVLVVESNKELKLGATEAVILSALESFFDVVLNYPKINRRLCDVMELLSWKQPKCPQLYIYSSADRVIPAKSVEAFIDGQRKAGHEVRACDFVSSPHVDHYRSNPGLYSSQLANFLEDCVLAKRCEGACTS

SEQ ID NO: 62425 - protein, 544 aa, Staphylococcus aureus subsp. aureus MRSA252
MKGIELLNNPFLNKGTAFTNEERKQLGLEGLLPANVRTLEQQAEQCYEQFKAKQTDFEKRLFLMAIFNRNRTLFYKLTSEHLVEFMPIIYDPVIAQSIEQYNENFSRPQDAVFLSVDRQDQIEQELRNVANGRDIRLIVVTDAEGILGIGDWGVDGVDIAIGKLIVYTAAAGINPAQVLPVSLDVGTNNEQLLNDELYLGNRHKRVDDETYYTFVDKFVSAVRKEYPNALLHWEDFGRGHAKNILDKYEDTLPTFNDDIQGTGIVTLAGVLGALNISKVDYTNQTFLVYGGGTAGMGITNILKDELIKQDVSEDKANQHFYIMDKQGLLFDDMDDLTEAQQVFAKNRNEFSNTVNWKNLKEVIENIKPTVLIGTSTQTGAFTEDAVKEMLKHTERPMIFPLSNPTKLAEATAQDLLKWTNGKALIGTGIPYNDIEYNGVNYSIGQANNALMYPGLGLGLIASKAKKVNQQILSAASHALGGMVNPDEPGAAVLPPVEKIHQCSRAIAKAVAQSVIDQGLNAETIDDIDEAIEAEIWYPEYKSYI

SEQ ID NO: 62426 - protein, 507 aa, Dechloromonas aromatica RCB
MSEINTLAGENAIIIAADAVPEITFADLGLAPELLRAVLDEGYTKPTPIQAQAIPLVISGKDIMGGAQTGTGKTAAFTLPILQRILPFASSSPSPAKHPVRALILAPTRELAMQVFESVKTYSKHTPIRAMCAYGGVDIRPQIAELKKGVEILVATPGRLLDHVENKSVSFNSVQALVLDEADRMLDMGFVPDVTRILNMLPAQRQSLLFSATFSEEIKKLADTMLKSPILIEVARRNQVSDTITHRVHPVSEYGKRGLLTKLLKSGEIRQCIVFCRTKQGCSRLTRELQRAGIKADAIHGDKSQLERIKALEAFKGGETDALIATDVAARGLDVDDLPYVINYELPHTPEDYVHRIGRTGRAGKKGNAISLVSAHEVCYLVDIEKLIKRPIEQVEVAGFEPEPEYEYPPGNKRKRSAAPPAKAPVAHRPERPERSERSERPDRGDRDRRPPRRNPMIAADGFDFSKPYEDNSPRGEVPDSPQAPSKVDPHKPKRVVAALLGGLGRK

SEQ ID NO: 62427 - protein, 325 aa, Ralstonia eutropha JMP134
MSQILTKLQPVRRPRPAIRLGRPRLLIVGCGDVGTRCLRILSARMRIFAVTSQPERRAELRAAGAVPLVANLDRPATLARLRGLASRVLDLAPPPGTGEGDPRTRALLATLRRTAWRRSRVHAGEPVILPDRQGTRPAFVYASTSGVYGDRAGARVAEFARVRPETARARRRVAAEQAVRKFGRSGGWRTSIVRIPGIYAEDRLPVARLKRGTPALAPQDDVYTSHIHADDLARTMIAALFRGRAQRIVHASDDTELRMADYFDLVADRRGLPRPPRITRQQAREVIDPTLLSFMSESRRLDNRRLKRELRLRLRYPTVASFFDA

SEQ ID NO: 62428 - protein, 354 aa, Ralstonia eutropha JMP134
MAYQVTVMPSGHKFEVADDETILGAALRHSIGLPYGCKNGACGSCKGRVLEGSIVQGDHAPAALTAQEKTEGRALFCCANASSDITIECREVHGAGDIPIKKVPCRVTSLERLADDVIAIKLQLPATERMQYLAGQYVEFLLRDGKRRSYSIATPPHEDGPIELHIRHMPGGAFTDYVFGAKEGAPAMKERDILRFEGPLGSFFLREESTAPMILLASGTGFAPIKAIVEHAAYTGITRPMTLYWGGRRPKDLYMHALCEQWARDLPNFKYVPVISDALPEDNWSGRTGFVHQAVIADHPDLSGHEVYACGAPVMINAARGDFTKQCKLHEDAFFADSFTSEADMHPAGSAPAA

SEQ ID NO: 62429 - protein, 352 aa, Bacillus sp. SG-1
MLTEQQVRDLLYKMKDPFLHKTLEETNGLLEVSIKEEKNHVSVKVAIAKTGTAEQMKMQQEIVKVLKENGAETVGIRFADLSPEELEKHRGSQPEGGESGNLLSPGSKTTFIAIASGKGGVGKSTVSVNLAVSLARAGKKVGLVDADIYGFSVPDMMGIVNRPVVRGEKIIPVERFGVKVISMGFFVEDNAPVIWRGPMLGKMLNNFFGEVEWGDLDYLLLDLPPGTGDVALDIHTMLPQCKEIIVTTPHPTAAFVAARAGAMALSTDHEILGVVENMSYFESKTTGEREYVFGRGGGEKLAEELRTNLLGQLPLQQPDWNEDDFAPSVYDEEHRIGKVYGDIAHKVIDLLS

SEQ ID NO: 62430 - protein, 441 aa, Moorella thermoacetica ATCC 39073
MFVVAAGLNHRTAPVAIREQLAFARHGLPPALCRLKEEAGVEGCVILSTCNRTEVYIACNQEEAGLKAAKNFLGRSCKLALADLEGYLYTLNTHHAVRHLFRVAAGLDSMILGEDQVLAQVAEAYQVARETGTTNNVLNTLWQQAIYAGKRVRTETRIDANTVSVSYAAVELARQVFHDELDGRTVLVIGAGKMSTLAARYLKDKGVTTVLVSNRSYDRAVALAATIGGQAVRLDALEDYLPRADIVISCTAASHYILHRDQVARAVAARPGVPLMLIDIAVPRDIEPAAGDLPGVKLYDIDDLQQVVLANLEERKKAARQAEGIIAAEAEAFFQWLGSLYVVPTIVALKEKAEAIKNAEVRRACNRLGQLTTREQKIITSMATTIVNQLLHDAIVNLKAAALTPRGHLYVEALQELFELRVDHTLPGPDMAVSVEGGRKY

SEQ ID NO: 62431 - protein, 475 aa, Xanthomonas campestris pv. vesicatoria str. 85-10
MSSVSIDGAPDAGENTRFIILISCVATIGGFLFGFDSGVINGTVDGLKQTFQSTAAETGFEVASMLLGCAIGAFFAGRLADRWGRRAVLIISAALFLLSAIGAGASHSSGFFIFARVMGGFAVGAASVISPAYIAEVASARYRGRLATMQQIAIISGLFCAFLSNYLLANAAGASTEPLWAGQAAWRWMFWMQAVPSILFLLLLLVIPESPRYLVVKGRREQALVVLKRLYGNAAAQTKLGEISASMAADQHKPKFSDLINKATGKIRPIVWIGIGLAVFQQLVGINVVFYYGAVLWQAVGFSEQDALLINVLSGGLSIGACLVTVMLVDKIGRKPLLWIGSAGMAVSLALVTYAFATASLDPNGKLAMSDAMGMLALVAANVYVVFFNASWGPVMWVMLGEMFPNQIRGSGLAIAGAAQWTSNFAITVSFPILLGSIGLAGAYGIYTVAAFISVFFVLKYVYETKGKELEQMEG

SEQ ID NO: 62432 - protein, 607 aa, Solanum lycopersicum
MAGTAKRHHTGEEGGAGSSDDVFEPSIDKFPVDVISCILEKLDLESVCSAACVSQTLSSAAAQVFTSLSSLDLSGHYLDEETLEQVARRVQGAKSLTIDCLQLKNGTSIFNILGEHIEELSLLKCSRVSYHILSAIRERCPNLRSLLIEFAGSEDPQLFENKLAEMLQKLTLLEVLSIKIRGTYFDVFDIRPLELFLPKSLRKLKLQQTEGDKFVHWLEKIRDIPWFNLQSLSLVLDVISDSLLRTVVNSLPLLVELDLEDRPFMDPTIEDLTNVGLQRVQSCKHLITLAIVRSSMNYRTAFRRVNNMGMFLLSEGCGRLESVKLGGFANVTDAGFSTILNSCRKLKKLEVLNSCLLSDLAFHNMRGVARSLIELRLLSCRLLTSEALEGLSLLSKLEVLDTSGCRSIGNPCLFVISRVTTLTKLNLAEADITDKGLALLGMGNLGITQLCIRGCKRVTDKGIERLFCAEGKIGKTLSLLDVSRMPGITDAAIFTIASAAKALTDLSLRYCFHVTDAGVKMLLDRPNHKVSLLQKLDLYKCRGLSGDWIMSSFCGLRWLGVGGTLLVNKRDDFSTICNVRPWLVVCFDGCEFGCHDGWQFHRIIIHH

SEQ ID NO: 62433 - protein, 610 aa, Medicago truncatula
MAPKEDEAHKVAEIAIGSIGRGYDISSDIRLKFCKGDSIHSRLIEIDEDNDLREVVLPGGVSLPNVSKLIKCDKGERTRFRSDVLSFQQMTEQFNQELSLTGKIPSGLFNSMFEFSGSWQKDAAHTKTLAFDGVLITLYTVALEKSQMLLCDHVKKAVPSSWDPPALARFIDTFGTHVIVGMKMGGKDVIYLKQQHSSTLQPADVQKKLKEMADKRFLDANGQYSSASDQVFPNEKFGIRMQRLTFANISPSSSYSHKEDIVSFCKRRGGSDDKNLSHNQWLQTVQLEPDVISMSFIPITSLLNGVPGSGFLSHAINLYLRYKPPIEELHQFLEFQLPRQWAPVFSDLPLGPQWKQRSSASLQFSFMGPRLYVNTIPVDVGKRPVTGLRLYLEGKKSNRLAIHMQHLSSLPKIFQLEDDSNENFRRKSYDKRFYEKVQWKNFSHVCTAPVESEEELSVVTGAQLQVENYGFKNILFLRLKFSTVLGAKEVKHPEWDGSPGLGAKSGLISTLISQHFTGAFQKPPPRPADVNINSAVYPGGPPVPVQAPKLLKFVDTTEMTRGPQETPGYWVVTGARLLVEKGKISLRVKYSLLTMILPDDDDDDDMLDDQ

SEQ ID NO: 62434 - protein, 117 aa, Glycine max
MAGNQDQFEIKFRLTDGSDIGPKSFPAATSIATLKESVLAQWPKDKENGPKTIKDVKLISAGKILENNRTVGECQSPLCDTPDTVTTMHVVVQHPATEKEKKAANKATQNKCMCVIL

SEQ ID NO: 62435 - protein, 454 aa, Aspergillus oryzae
MPYPPIAQHDGVPHGTASRPAHSLSLRASTSLRDTSNGLWDILNDLWHPESNPHGYVTLGAGHNALMQEQLLHRVNSNFDLPGRHLLLNDTITGSVRLKTAIARFLTRYLSPSKALKPSQIIATNGVSSATEHCSWALCDPGEGMLVGRPYYRDFSRDICLRPGAKLVPVSFDEMDPVGVSAVSKYEEAIVSSREQGCTIRAIMLCNPHNPLGRCYPPSFLVGLMKLCQKHGVHLISDEIYALSVWRHGQDGATTIEDFTSVLSINYDGVIDPKLVHVLWGISKDFGANGVRLGVIISQNNGDLLESIRGVGQFSSISGFADYVTTSILEDEEFVDRYIEESREKLAAAYNYVVIFLDNHGIPHARGSNAGFFVWCDLLTAYLKAQPNRPSDDSDSAKWNRSRELAEKLALHKVHLGVGDDFGSEQPGWFRITFSQHRVQLDEGLKRIVKALHS

SEQ ID NO: 62436 - protein, 319 aa, Physcomitrella patens subsp. patens
MSSQVFVPAANEKTFASFMTDFLMGGVSAAVSKTAAAPIERVKLLIQNQDEMLKSGRLSHPYKGIGECFSRTVKDEGMMSLWRGNTANVIRYFPTQALNFAFKDYFKSLFGYKKDKDGYWKWFAGNLASGGAAGASSLLFVYSLDYARTRLANDAKSSKKGGGERQFNGLVDVYKKTLATDGIAGLYRGFAISCAGIIVYRGLYFGIYDSLKPVVLVGNLEGNFLASFLLGWGITIGAGLASYPIDTVRRRMMMTSGEAVKYNGSMDAFKQILAKEGAKSLFKGAGANILRAVAGAGVLSGYDQLQILLLGKAYSGGSG

SEQ ID NO: 62437 - protein, 104 aa, Cryptococcus neoformans var. neoformans JEC21
MVKAIESYDEWKTLTSGSDVVVVDYWATWCGPCKMISPHFAKLEGKFPNVKFAKVDVEEQEDIAKEAQIKAMPTFVAYKDGKVIETVTGAVPAKINALLDKVAA

SEQ ID NO: 62438 - protein, 143 aa, Salmonella enterica subsp. enterica serovar Typhi
EFWDWVGGRYSLWSAIGLSIILSVGFDNFVELLSGAHAMDKHFSTTPAEKNLPILLALIGIWYNNFFGAETEAILPYDQYMHRFAAYFQQGNMESNGKYVDRNGNAVDYQTGPIIWGEPGTNGQHAFYQLIHQGTKMVPCDFI

SEQ ID NO: 62439 - protein, 606 aa, Myxococcus xanthus DK 1622
MTPAQAPLTLLRIPGDSPEALDTFWLREVFQGDRVPQLTLRAVLLGSGIGAITCATNLYAGLKMAVAFPVAITAALLAHTAHGAMRRVAPGVAGAPLSPLETCSAQAVASSAGYATGGALVSVQGAWLLTTGSHPPAWALLAWTFLLSALGVLFAVPLKRKLVDHEQLPFATGTAAAATIRALHTTGASSRPRLSMLGLGGGIAALVTLVRDGLGRLPYVFPFPGTLSGMSLERLGFGFEMSLLPLGAGALLGLRLTASWFLGALLIHGVVAPRVFASGLLLPDGDFLAWSLWPGTAALTTASLLHFALEGRVLGRALKGLFKRPSVAPHPVDALQVPGRWLLAGLVVLTPATLAVAKVGFGVPLPHAALAVALSFVLCLIACRVTGETDVTPVGPLGQVTQMTYGVLLPRNVEANLATAGITVNAASSAADLLSDAKTGHLLGAHPRRVFLAQLVGCAVGAAAVVPLFFLLVPDRSALGGERFPAPAATVTASIAQVLASGFSGLEPGTRAALGWAALAAAVLTLTERLLPERVRHWVPSPLGMGLACLLPASTALGFFLGGVAAALARRANPGVQEGRVVTLAAGLIAGEGLMGVVIVLSQALW

SEQ ID NO: 62440 - protein, 239 aa, Physcomitrella patens subsp. patens
MGDANLIYSLVSRGTTVLAEYTSFAGNFSQIAMQCLVKLPAANNKHTYVMDRHTFNFLVQDGFTYLVVAEEDFGRQIPFAFLDRVKDDFKHRYQGGKADLAVSHSLDAEFGPRLKEHMDFCERNPEEIRKMSKIKSQVAEVKGIMMENIDKVLVRNEKIDLLVDRTSHLQSDAHNFQRQGKKIRYKLWCQNYRLKLLVLVLIIIVAFIIYLSICRGFVCYNPGVPGTPPAPGTPPGQGL

SEQ ID NO: 62441 - protein, 210 aa, Salmonella enterica subsp. enterica serovar Paratyphi B str.
MTNLNYQQTHFVMSAPDIRHLPSDRGIEVAFAGRSNAGKSSALNTLTNQKSLARTSKTPGRTQLINLFEVVDGKRLVDLPGYGYAEVPEEMKRKWQRALGEYLEKRQSLQGLVVLMDIRHPLKDLDQQMIQWAVESNIQVLVLLTKADKLASGARKAQLNMVREAVLAFNGDVQVEAFSSLKKQGVDKLRQKLDSWFSELAPVEEIQDGE

SEQ ID NO: 62442 - protein, 766 aa, Zea mays
MAAAAIPSKLATQVLIPVAAAVGIAFAVVQWVLVSKVRVTPERRADGGAVKSGPSDYLIEEEEGLNDHNVVVKCAEIQTAISEGATSFLFTEYKYVGLFMGIFAILIFLFLGSVEGFSTKSQPCHYIKDQTCKPALANAIFSTIAFVLGAVTSLVSGFLGMKIATYANARTTLEARKGVGKAFITAFRAGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVDEIEPALKKQLIISTIVMTIGIALISWLGLPYTFTIFNFGVQKTVQSWQLFLCVAVGLWAGLVIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNNIPGLMEGTTKPDYATCVKISTDASIKEMIPPGALVMLTPLIVGILFGVETLSGVLAGALVSGVQIAISASNTGGAWDNAKKYIEAGVSEHARTLGPKGSDPHKAAVIGDTIGDPLKDTSGPSLNILIKLMAVESLVFAPFFAAHGGILFKWL

SEQ ID NO: 62443 - protein, 739 aa, Mesorhizobium loti MAFF303099
MSYINFTLDTDADGIALVTWNMPDRSMNVFTEEVMGELDKIIDQVVADAGIKGAVITSGKDSFSGGADLTMLQKMLAVFAREKTKDPEKAAKLLFDNAGRMGGLWRKLETSGKPWVSAINGTCMGGAFELSLACHGRVAADSDKVKMALPEVKVGIFPGAGGTQRVPRLTDQQQALQMLTSGQNLSPQKAKAMGLIHEIAEPAKLVETAKAMIRNGLKAVQPWDEKGFKLPGGQIYSPAGFNLWPPAIAILRRETYGNYPAAAAILKCVYEGLLVPFDTALRIEQRYFTEIMQTKEAAAMIRSLFVSLQELNKGARRPAGVPETKFKKIGILGAGFMGAGIAYVTAKAGIPVVLLDRDMESAEKGKAHSDSLVSDQVKKGRAKPEEKDQLLSLITPTADYADLAGCDLVVEAVFEDSAVKKAATEQAEAVLKSSAIFASNTSTIPITALAKNSARPKNFVGIHFFSPVDKMMLVEIILGKKTGDKALATAIDFVRAIRKTPIVVNDTRGFYVNRCVLRYMSEAYKMLIEGVPAPMIENAAKAAGMPVGPLALTDETAIDLAQKIMKQTIRDLGDKAVDPEQMALINTMVDDHGRFGRKNGKGFYDYPAKPAKKKLWPGLKDLYPQLAAEKVDYEELQQRLLVTIALEAARVMEEGIVIDPREADVGSILAFGFAPYTGGALSYIDGIGAKEFVKIAKGLQKKYGVEFKAPKLLLDMAEKGETFYQRFDPYAKGDVKQAA

SEQ ID NO: 62444 - protein, 506 aa, Halomonas salina
MIYANPGSPESVVSFDARYGNYIGGEFVPPVKGQYFDNVSPVNGKPFCEIPRSTAEDIDKALDAAHAAAPAWGKTSAAERGNILLRIADRIEQNLELLAVAETWDNGKAVRETLNADLPLAVDHFRYFAGCIRAQEGTAADIDANTVAYHFHEPLGVVGQIIPWNFPILMAVWKLAPALAAGNCVVLKPAEQTPASILKLMELVGDLLPPGVVNVVNGYGAEAGQALATSTRIAKIAFTGSTPVGSHILKCAAENIIPSTVELGGKSPNIYFADIMDAEPEFIDKAAEGLVLAFFNQGEVCTCPSRALIQEDIYDAFMAKVMEKVATITRGNPLDTDVKVGAQASQEQFDKIMSYMEVAREEGAEFLTGGDKEHFDPAYDSGYYIQPTLLKGHNKMRVFQEEIFGPVVAVTTFKDEEEALAIANDTEFGLGAGVWSRDINVAFRMGRGIQAGRVWTNCYHQYPAHAAFGGYKKSGVGRETHKVALEHYQQTKNLLVSYDTNPLGFF

SEQ ID NO: 62445 - protein, 320 aa, Heliophilum fasciatum
MSFQLFREIQADLARVEKELSNYMDTDHPTLTAASGHLLYAGGKRLRPAFVLLAGRFHNYSFERLLPLAVTMEMIHMATLVHDDVIDESETRRGTPTVRARWGNRVSMHAGDHLFARSLLLIAEMNNPIIARVLAETSVEMCEGEIQQMATAFDVEQNFRDYLYRIKRKTALLLSASCQLGAVAVDAPPYMIRALKWYGYHLGMAFQVTDDILDLEADEAKLGKPIGSDLRQGIMTLPVLEAIAQVQDPKLKTLLAKQEKSEREVQEAIRIIKQTDAIARSHRVAQLYLAKAKAELSRLPNIPARDSMAMIADFIGRRSY

SEQ ID NO: 62446 - protein, 505 aa, Staphylococcus aureus subsp. aureus MRSA252
MAKKPTALIILDGFANRESEHGNAVKLANKPNFDRYYNKYPTTQIEASGLDVGLPEGQMGNSEVGHMNIGAGRIVYQSLTRINKSIEDGDFFENDVLNNAIAHVNSHDSALHIFGLLSDGGVHSHYKHLFALLELAKKQGVEKVYVHAFLDGRDVDQKSALKYIEETEAKFNELGIGQFASVSGRYYAMDRDKRWEREEKAYNAIRNFDAPTYATAKEGVEASYNEGLTDEFVVPFIVEDQNDGVNDGDAVIFYNFRPDRAAQLSEIFANRAFEGFKVEQVKDLFYATFTKYNDNIDAAIVFEKVDLNNTIGEIAQNNNLTQLRIAETEKYPHVTYFMSGGRNEEFKGERRRLIDSPKVATYDLKPEMSAYEVKDALLEELNKGDLDLIILNFANPDMVGHSGMLEPTIKAIEAVDECLGEVVDKILDMDGYAIITADHGNSDQVLTDDDQPMTTHTTNPVPVIVTKEGVTLRETGRLGDLAPTLLDLLNVEQPEDMTGESLIKH

SEQ ID NO: 62447 - protein, 492 aa, Prunus persica
MGSSSATSNRLLLSKIATSEGHGENPPYFDGWKAYDRNPFHPTKNPEGVIQMGLAENQLSFDLIEDWIKKNPKASICTPEGVEEFKNVAIFQDYHGFPEFRKAVAMFMSKARGGRVTFDPNRVVMSGGATGANELVMFCLADPGDAFLVPSPYYPAFYRDLGWRTGVQIVPVDCDSSNNFQITKEALAAAYEKAQKNNINVKGLIITNPSNPLGTTLDRDTLESLVEFINQKNIHLVCDEIYAATVFSSPTFTCISEVIQNMNCNPNLIHIVYSLSKDMGLPGLRVGIVYSYNDDVVNIGRKMSSFGLVSSQTQHMLASMLLDEEFVARFLETSSKRLAKRHGVFTKGLEEVGINCLKSNAGLFCWMDLRRLLKDQTFDGEMVLWRVIVNEVGLNVSPGSSFKCVEPGWFRVCFANMDDETVEVALKRIRTFVRQGKKAQDQAVQVKSPKRWKSNLRLSFSSSSTRRFDQDSVNVLSPHMMSPHSPLVRAKT

SEQ ID NO: 62448 - protein, 156 aa, Pediococcus parvulus
DTIENYSDLFIQSQNAVFLSIDDPDSMKASLKNAADGRDIRLIVVTDAEGILGIGDWGTNGVDISVGKLMVYTAAAGIDPSQVMPVVLDVGTNNQDLLKNPMYLGNRHERITGDRYYKFVDQFVNTAEDLFPKLYLHFEDFGRDNAANILNKYKDQ

SEQ ID NO: 62449 - protein, 1192 aa, Solanum lycopersicum
MSHKRCHEYFSLNGVLKNVVFMIILLSSSFLVVVSNARKLAENDQVGRLLAFKKSSVESDPNGFLNEWTLSSSSPCTWNGISCSNGQVVELNLSSVGLSGLLHLTDLMALPTLLRVNFSGNHFYGNLSSIASSCSFEFLDLSANNFSEVLVLEPLLKSCDNIKYLNVSGNSIKGVVLKFGPSLLQLDLSSNTISDFGILSYALSNCQNLNLLNFSSNKIAGKLKSSISSCKSLSVLDLSRNNLTGELNDLDLGTCQNLTVLNLSFNNLTSVEFPPSLANCQSLNTLNIAHNSIRMEIPVELLVKLKSLKRLVLAHNQFFDKIPSELGQSCSTLEELDLSGNRLTGELPSTFKLCSSLFSLNLGNNELSGDFLNTVISSLTNLRYLYLPFNNITGYVPKSLVNCTKLQVLDLSSNAFIGNVPSEFCFAASGFPLETMLLASNYLTGTVPKQLGHCRNLRKIDLSFNNLVGSIPLEIWNLPNLSELVMWANNLTGEIPEGICINGGNLQTLILNNNFISGTLPQSISKCTNLVWVSLSSNRLSGEIPQGIGNLANLAILQLGNNSLTGPIPRGLGSCRNLIWLDLNSNALTGSIPLELADQAGHVNPGMASGKQFAFVRNEGGTECRGAGGLVEFEGIREERLAILPMVHFCPSTRIYSGRTMYTFTSNGSMIYLDLSYNSLSGTIPDNLGSLSFLQVLNLGHNNFTGTIPFNFGGLKIVGVLDLSHNSLQGFIPPSLGGLSFLSDLDVSNNNLSGTIPSGGQLTTFPASRYENNSGLCGVPLPPCGSGNGHHSSSIYHHGNKKPTTIGMVVGIMVSFICIILLVIALYKIKKTQNEEEKRDKYIDSLPTSGSSSWKLSTVPEPLSINVATFEKPLRKLTFGHLLEATNGFSSESMIGSGGFGEVYKAQLRDGSTVAIKKLVHVTGQGDREFMAEMETIGKIKHRNLVPLLGYCKIGEERLLVYEYMKWGSLESVLHDGGKGGMFLDWPARKKIAIGSARGLAFLHHSCIPHIIHRDMKSSNVLLDENFEARVSDFGMARLVNALDTHLSVSTLAGTPGYVPPEYYQSFRCTAKGDVYSYGVILLELLSGKRPIDPRVFGDDNNLVGWAKQLHNDKQSHEILDPELITNLSGDAELYHYLKVAFECLDEKSYKRPTMIQVMTKFKEVQTDSESDILDGISVKGSILEESQEREP

SEQ ID NO: 62450 - protein, 446 aa, Brassica rapa
MKGVIPHYHHSYTFFFVILVLFPHAFSTNTLSSNEALTISSNKTLVSPGDVFELGFFKTATKNSQDGSTDRWYLGIWYKTTSDKRTYVWVANRDNPLHNSIGTLKISHASLVLLDQSDTTVWSTNLTGVAHLPVTAELLANGNFVLRDSKTNDLDRFMWQSFDYPVDTLLPEMKIGRKHKSSEKEKILTSWKSPTDPSSGDYSLILETEGFLHEFYLFKNEFKVYRTGPWNGVRFNGIPKKMQNWSYIDNSFIDNNEEVAYTFKVHNNNNMIHSRFRMSSTGYLQVITWTKTVPQRNMFWSFPEDTCDLYKVCGPYAYCDMHTSPTCNCIKGFVPKNAGRWDLRDMSGGCVRSSKLSCGEGDGFLRMSQMKLPETSEALVEKRIGLKECREKCVRDCNCTGYANMDIMNGGSGCVTWTGELVDMRKYDAGGQDLYVKVAEASLVPS

SEQ ID NO: 62451 - protein, 504 aa, Xanthomonas campestris pv. vesicatoria str. 85-10
MTQTNGFDALHAHAQRLRGAAIPALLAAEPQRPTQYARQVGPLYFNFARQKYDRAALDALFAIARERDLAGAFQRLFRGEQVNVTEQRAALHTALRGDLTDAPVASEAYATAAEVRQRMGALIQQLEATEVTDIVSVGIGGSDLGPRLVADALRPVSGARFRVHFVSNVDGAAMQRTLATLDPARTAGILISKTFGTQETLLNGSILHAWLGGSERLYAVSANPERAAKAFDIAPGRVLPMWDWVGGRYSLWSAVGFPIALAIGFERFEQLLEGAAQFDAHVLNTPLEENVAVLHGLTAVWNRNLLGSATHAVMTYDQRLALLPSYLQQLVMESLGKRVKLDGSAVDSDTVSVWWGGAGTDVQHSFFQALHQGTSVVPADFIGTVHNDDPYAENHVALMANVLAQTEALANGQDSSDPHRSYPGGRPSTVILLDALTPQALGGLISMYEHSVYVQSVMWGINAFDQFGVELGKQLASQLLPALKGEAADVADPVTRELLSKLRG

SEQ ID NO: 62452 - protein, 390 aa, Burkholderia vietnamiensis G4
MNAPSDMPTAPVFPSRLPNVGTTIFTVMSALAAEKGAVNLGQGFPDFDCDPRIVDAVAAAMRNGHNQYPPMAGVASLRDAIADKIEHLYGRRYDAATEITVTAGATQALLTAILCAVHPGDEVIVIEPTYDSYLPSIELAGGKPVFVTLDAPDYAIPFDRLAAAITPKTRMILINTPHNPTGTVWREADLRRLEEIVRGTNVLILSDEVYEHMVYDGARHESVARYPELAARSFIVSSFGKTFHVTGWKIGYVAAPAALTAEFRKVHQFNVFTVNTPMQVGIADYLRDPAPYLTLPDFYQKKRDFFRAGLERTRFKLLPCTGTYFQCVDYSAISDVSEAEFAKWLTAEIGVAAIPVSAFYHAPHESGVVRFCFAKQESTLASALERLARL

SEQ ID NO: 62453 - protein, 214 aa, Zea mays
  misc_feature (90)..(90): Xaa can be any naturally occurring amino acid
  misc_feature (191)..(192): Xaa can be any naturally occurring amino acid
  misc_feature (200)..(200): Xaa can be any naturally occurring amino acid
MSAFVGKYADELIKTAKYIATPGKGILAADESTGTIGKRFSSINVENIESNRQALRELLFTSPGALPCLSGVILFEETLYQKTSDGKPFXVEFLQENGVIPGIKVDKGVVDLAGTNGETTTQGLDSLGARCQEYYKAGARFAKWRTVLKIGATEPSELSIQRTPKGLARYAIICQEKRLVPIVEPEVLTDXXHDIKKCAXVTETVLLPCTGLND

SEQ ID NO: 62454 - protein, 674 aa, Erwinia carotovora subsp. atroseptica SCRI1043
MNRFVIASTQDCMGCHACEIACVISHNDEQYPDSTAVFQPRIKAFNTPTLRAAVTCRHCEDAPCASVCPTQALIKKDNSIQLVQEKCIGCKSCVLACPFGAMSMVTNPMDNSAIAHKCDLCADRPEGQACVEACPTQALQLISEHTLTARRQEKQQLMALRSAAHWQRETPVLKTLTTHPLNKRKNWPRRDAEKKPLTQRTSTFDEIYHGFSVQQTEDQADRCLSCGKRAVCEWTCPLHNNIPELLSLAKQGRIFEAVELSHQTSSLPEICGRVCPQDRLCEGACTLGKEYGAITIGNIERYITDTAMAMGWSPDMTRVVPSGKRAAIVGAGPAGLACADVLARNGVQAVVFDRHPEIGGLLTFGIPSFKLDKDVLIHRRKVFSTMGIEFQLNTEVGKDISLAQLLDDYDTVFLGVGTYRSMKANIDNEDAPGVFDALPFLIANTKHVMGLPELDDEPYISMAGKRVVVLGGGDTAMDCLRTSVRQGAISVTCAYRRDEANMPGSKKEVKNSREEGVDFMFNVQPQKICLNEQGEVCGISLVRTELGEPDASGRRRPRPIPSSEFVQPAEAVITAFGFQSHSMPWLEDADIGLDNWGHITAPLDSQTPCQTNHPRIFAGGDAVRGADLVVTAIADGRKAALGMIETMGLTAVTGAIPAHPQRPEMNATREELRS

SEQ ID NO: 62455 - protein, 273 aa, Myxococcus xanthus DK 1622
MPESPRRIAFQGEPGAYGEEALRALHGADVEAVPCLTFRAVFEAVAEGRVHGGVVPVESSLGGPVAETVDLLLEHDVPATGELSLRIRHCLLAPPGLSLDDVQQALSHPQALAQCAGYLRRRGISPLPEANTAIAARKVAEEKPPHTAAIASRMSADLYGLAVLEEGVEDSPDNFTRFIALGTAPERTWTRRKTALAFTVENGPGALFRVMSAFSSRGLNVARLESRPQRRAWEYVWCLDVDGALEDPRVREAVAAAQAACVTLRVLGSYGVV

SEQ ID NO: 62456 - protein, 688 aa, Zea mays
MDAQSQAAFSGQKKMLPPPPGIFQDREELIEHVRDFGASQGYVVTIKKSRKDRRVILGCDRGGIYRNRRKIDEKIVEHACGVATLQMGEFVPNASNGIDTFCIREPLGVCAGICPSNFPAMIPLWMFPIAVTCGNTFVLKPCEKNPGASTILAALVKEAGLPDGVLNIVHGTDDIVNYICDDEDIKAISVVGSNTAGIHIYARAAAGGKRIQSTIGGKNHAIIMSDASIDATLNALVAEGFGAAGQGCMGLSTAVFVGGSMPWDEELKLRAKALKVNVGSDPGADVGPVISKEVKDKINRLVQCSVDAGARLLLDGRNIVVPGYENGNFIGPTIICDVASNMECYKIRMVAQQWRDLPSVGVSSGLHLSSETDMTSRGVSSGLHPSSERDSLYHRVSPAVSQESEGNSPNHTMLLSTSERDLSNPTITSPPPTADGELPNHGASLVLPPTSEMDMENQDMSRTMSQGRKRDISSQGVSSITPYQSERVYTQQSQWKESSAPSERIYIPITSHRNNNAAPTVQRSDTAIGLTQERAYMPTSHKNDGLVPVSNRNRSISPASDQIYMMATTHLNDTMGQRIQRTDAPIFPTSERIYVPATPHRSDHMGSTSQRNDVALRPGSESLYMPATSRRNDNIASASHQADSMPQNSESMYMAPIVQRMYAQNTIISMDDYPNQGPTMTLPTSHRI

SEQ ID NO: 62457 - protein, 122 aa, Picea sitchensis
MDELVVHKGGCHCGRVRWQAQAPVDIVASKCNCSDCSMRGPIPFVVPECNFQLQEESREWLTTYTFGTHTAKHIFCKVCGITSYYIQRSNPGGAGVALNVNCVDPGTIKYVEIKHFDGKNWG

SEQ ID NO: 62458 - protein, 78 aa, Zea mays
MGRLGIDEELVELLGHYSPIPVTYAGGVSTMDDLERIKKAGKSRVDVTIGSALDIFGGDLPYKDVVLWHRKQSMVGQV

SEQ ID NO: 62459 - protein, 795 aa, Candida albicans SC5314
MVQLALFTNNNHNNNSNSNTPNTLNDDTQYDSTTMNTEDTPIIPDKTDKLNGSDSRSSSRNRTRSISFTRFLFNSNNNNNNNKDHTEQSRCPSNETSDNSVGSPEQQNSGFNKLKKMFKTNSSLTQEDGKNSGRTRSASTPLTPPKVKKETSVPVITTTKAPNKEETTTTKIHSPPESPVVQSNPYFQYQGVPAHTNTSQNPQIETAPGRSDMSVALRHNDSVFSLNENGVLEPPEIHYSELSSSSEDNSDPSSPALPKTPMRDLVEKDELHLKPIEDERDLAIPASPFQRALRRVASAPLVHRLLNEKSPEDANNNNNNNNTGNNLGGPFSTSTQTSPKKDEPFDINKHIGEVKITGRPRTYTQDRTYSNAATRIVDVQVGPNSFEKVRLLGKGDVGKVFLVREKSSNKLYAMKILNKKEMIERNKIKRALAEQEILATSNHPFIVTLYHSFQSKDHLYLCMEYCMGGEFFRALQTRDTKTICEADAKFYAAEVTAALEYLHLMGFIYRDLKPENILLHQSGHIMLSDFDLSKQSERAKNPEISFHKSGMHLSSAGSSNHHNGPAIDTKACIDGFRTNSFVGTEEYIAPEVIRGKGHTSAVDWWTLGIFLYEMLFGTTPFKGQDRKKTFANVLKKDVKFSDTQQSISSNCRNLIKKLLIKDEEKRLGSKTGASEIKNHAFFKDTQWALLRHQKPPMIPVLTKSTSTSNSNKKYEKPMEDTEEIDDVTSISKSINEQIDDPFSQFNSVTLRYGGEFEDLNQSPMYNPDSSAYTSVAYTMTSNNENSFRQKSFLKR

SEQ ID NO: 62460 - protein, 272 aa, Blastopirellula marina DSM 3645
MARRQLRDQRAIVTGASSGIGRELTRQLLAAGAKVVATARREDRLQELAAEVAAPQQLVIVPGDICDGALRTALVSAADEHFGGLDLLINNAGIGALGPFADGSPERLRQVMEVNFFAPVELIRAALPALRRGRSPAICNISSILAHRAVPAKSEYCASKFAIHGFSDALRSELASEGIDVILVSPSTTESEFSSAVIEKSGRQPAKGKGAMTSADVAKSAIKAVQSGKHEVILSLGGKGLVWLDRLAPTWADWLVTRFGFDGSAGRQSKKS

SEQ ID NO: 62461 - protein, 160 aa, Glycine max
  misc_feature (31)..(31): Xaa can be any naturally occurring amino acid
MQGGFQSFLSHGNVIRNAVLQRVRMVNPLFXPIVSSRFESVTPARIEEHGFESTTISDILNDKGKGADGSWLWCTTDDTVYDAVKSMTQNNVGALVVVKSDANKAIAGIITERDYLRKIIVQGRSSKSTKVGDIMTEENKLITVTPDTKVLQAMQLMTGM

SEQ ID NO: 62462 - protein, 462 aa, Magnaporthe grisea 70-15
MSSFVPQDFSWTSIPTELLAAELARRDDVDTKPKCGSKERGHYDTALHVFALGLILLLSTCACAFPLLTNRSGGGRRQTKIVFICQHFGTGVLIATAFVHLLPTAFLSLTDPCLPHVFSKGYTAMAGLVAMTAALVVVSVESYLTTRGGLTHSHSHHHVWDEDDEEGEDGNKTQGINGASSSGGMAARRERRPSNIMLDDIGASEGLMAGASPLPESTPVVASTNGRKHLNGNANDPQERNKHVYQPRDSSSSSRESLDLELNLDELDPVPEHDAQPPAPPSQQRDRMLGQTPAPPPDEQKRLLLQCLLLEAGILFHSVFIGMALSVATGPAFVVFLVAISFHQSFEGLALGSRIAAIHFPRSSLRPWLMVLAYGTTTPIGQAIGLLVHNMYDPRSQAGLLMVGFMNAISAGLLLFAGLVQLLAEDFLSEKSYRVLHGRRRTEAFLAVFGGAGLMAVVGAFA

SEQ ID NO: 62463 - protein, 307 aa, Lactobacillus plantarum WCFS1
MADVTVIGSNMIDLTTYIGRMPVEGETIEAPEFNIGYGGKGANQAIAAARLGSDVNFITMVGNDGFGQEQLANYQKNGIRTDGIGIGHQNSGVAPIFVDPSSDNRILIIKGANKELTPAVLDEKQALIKNSKLIVLQQEISLETNYHAIDLAQQFGVPVLLNPAPANKNLNIDYVSKVVFFTPNETELATLTGLPTNNLDEIKVAACDLISRGVENLIITLGHKGALWVTENHAEIVPGMKVKAVDTTGAGDSFIGSFAHYFAQGEAIPDALQHANQYAAMTVMKKGTQKSYPTAAELSDLLAAAVD

SEQ ID NO: 62464 - protein, 115 aa, Campylobacter upsaliensis RM3195
MLSEEEKRIIIDKGTEAPFSGEYNDFFEEGVYLCKQCGAKLYESTHKFKSHCGWPSFDDEINGAIKKEPDKDGVRTEILCANCDAHLGHIFKNEGFTPKNVRHCVNSLSLKFVKK

SEQ ID NO: 62465 - protein, 385 aa, Dechloromonas aromatica RCB
MDTPIRIDSRFPNMGTTIFTVMSRLAAECGAVNLSQGFPDFQAEPALFDAMHRHMLAGRNQYAPMAGLPELRQAIADKVAALYGTRFDVESEVTVTAGATQAIFTAIAAFVRPGDEVLVFEPVYDSYVPAIETVGGTAVYAQLKFPDYTPDWAQVAGLISPKTRMIIVNSPHNPTGSLLTAADLDKLAELVRGTDIVILSDEVYEHILFDGEQHASLCGHPELAVRTIVVSSFGKTYHITGWKIGYVVGPAALMAEFRKVHQFNVFTVHAPSQLAIAEYMQDASRHLGLAAFYQEKRDFFRQLMAATPFELLPCRGTYFQLARYDRISDLPDRAFAEWMAREVGVAVIPVSVFNADGRDDKVVRFCFAKREETLRAAAERLCKAL

SEQ ID NO: 62466 - protein, 290 aa, Triticum turgidum
MEGKEEDVRLGANRYSERQPIGTAAQGGGDDNDYKEPPPAPLFEPGELKSWSFYRAGIAEFIATFLFLYVTVLTVMGVSRSPSKCATVGIQGIAWSFGGMIFALVYCTAGISGGHINPAVTFGLFLARKLSLTRAIFYIIMQCLGAICGAGVVKGFQQGLYMGNGGGANVVASGYTKGDGLGAEIIGTFVLVYTVFSATDAKRNARDSHVPILAPLPIGFAVFLVHLATIPITGTGINPARSLGAAIIYNRNNAWNDQWIFWVGPFVGAALAAVYHQVIIRAIPFNKSRS

SEQ ID NO: 62467 - protein, 470 aa, Helicobacter pylori J99
MKIKNVLLSGGSGKRLWPLSRSLYPKQFLKLFDHKSLFELSFKRNASLVDETLIVCNEKHYFLALEEIKNEIKNKSVGFLLESLSKNTANAIALSALMSDKEDLLIVTPSDHLIKDFQAYENAIKKAINLAQKGFLVTFGISIEKPNTEFGYIESPNGLDVKRFIEKPSLEKAIEFQKSGGFYFNSGMFVFQAGVFLDELKKHAPTILKGCERAFESLENTHFFEQKIARLSEKSMQDLEDMSIDIALMQQSHKIKMVELNAKWSDLGNFNALFEEAANGTKENVSLNQTPIFAKESTNNLVFSHKVSALLGVEDLAIIDTKDALLVAHKDKAKDLKALVSEIETHNQELLQTHTKVYRPWGSYEVLHESGCYKVKILEVKPNARLSLQKHFHRSEHWVVISGMASVELDHQSFELQANESTYIPKNTLHRLANYGKIPLIIIEVQVGEYVGEDDIVRVDDDFNRQNQNA

SEQ ID NO: 62468 - protein, 113 aa, Zea mays
  misc_feature (85)..(85): Xaa can be any naturally occurring amino acid
MAEKEAAATWGGGDKLILRGLQFHGFHGVLQEEKTLGQKFAVDIDAWMDLAAAGESDCIADTVSYTDIYSIAKDVVEGTPRNLLXESEAHSIAEATLLKFPQVSAVRAKVGKP

SEQ ID NO: 62469 - protein, 391 aa, Streptococcus criceti
MKFETSHLLKKLPKQFFADLVTKVNAKIAQGADVINLGQGNPDRPTYDFIVKALQDSAAKPASHKYSLFRGNPPFKEAAADFYKANYQVDLDSQTEICVLGGSKIGLVELPWALMNPGELLLLPDPGYPDYLSAVALGQVDCETYPLLAENDFLPDLTAIPEESARRAKFIYINYPNNPTGAVATPAFYESLVDWAKKYEVGVVSDFAYGALGYQGYKNPSFLSTPGAKDVGIELYTFSKTFNMAGWRLAFAAGNADMIEALNLIQDHLFVSIFPAIQDAGVAALSDPRAKEAIAALNQRYDQRREAFVQAAAQIGWQAFPSKGSFYAWMPVPEGFNSQNFADLLLEEAHVAVAPGIGFGQEGDSYVRIGLLVEPDHLAQAVERIGQLDLF

SEQ ID NO: 62470 - protein, 283 aa, Zea mays
MGSDAGAGARKRRDSAVNGLAKDVPPVNGMMMPKEEPATAPPRLLTLPTVLTIGRVAAVPLLISTMLEAHGGDKLLVMHGVSASVFKASPRRPGGGPTPCLALCFKNTAFYMEGPWAATATTGIFLAAAVTDWLDGYIARKMQLGTPFGAFLDPVADKLMVAATLVLLCTKPLETSLLNDGPWLLTVPSIAIIGREITMSAVREWAASQNSEALEAVAVNNLGKWKTATQMTALTLLLASRDPSVPAQGALVAPGVALLYISAGLAIWSLVVYMRKIWRTLLK

SEQ ID NO: 62471 - protein, 258 aa, Chromobacterium violaceum ATCC 12472
MDHSADLDRRFGGIARLYGDDALAGFRRAHVCVVGVGGVGSWAVEALARSAIGKLTLIDLDNVAESNTNRQLPALDPLYGMAKVTALAERVKAINPACEVTEIEDFVTEENMDAMLGQGYDYIVDCIDSLKVKTAMAAWCARKRQRFIVSGGAGGQMDPSQIKLADLSEVTQDPLLSKLRYNLRRHHGFARDGKKMGVPCVYSTEQLVYPQAQACDAGEARGPQGLSCAGFGAGMVVTASFGLFAASRVLTDLAKTKK

SEQ ID NO: 62472 - protein, 211 aa, Phaeosphaeria nodorum
MNDPQLNNLLKWGIQNSDASRNDPSTAPQPLSEVDKEALQQLIAGVRGPSDADLMQDSFQVIENNEATAEAKHQAFENFEQLIQGIDNANNMEALGLWTKLIKQLESEDPVIRKWAAWCCSTAVQNNVRSQERLLVLKNAIPTLVRLATSDPDKTARKKATSALSSAVRNFQPGLDAVLEHMPAEHKPKEALDANDMASVDILINKLRESI

SEQ ID NO: 62473 - protein, 327 aa, Ehrlichia ruminantium
MKISILGAGSFGTAIAIALSAHGISVNLWGRDHRNITHINTYRKNLKYLPTYHLPDNIYATSNIDEVLSDNNTCIILTIPTQQLRTICTQIQHKQHMCKNTPILICSKGIEITSLKFPSEIAEEILQYNPIFILSGPSFAKEIAEHLPCSIVLAGDNKELGESLIETISNDVLKIIYHQDIIGVQIGAALKNIIAIACGIIAGKNLGNNAVATVITKGMNEIKTLYIAKNHSIDLHTLIGPSCLGDLILTCTTEHSRNMAFGLEIGKGRNINTLIDHNLKLVEGTSTVKPLISLAKKLNVELPICISIYNLLHENISLDKAISNILS

SEQ ID NO: 62474 - protein, 285 aa, Spinacia oleracea
MEGKDEDVRLGANKYGEKQGLGTVAQDRDYKEPPPAPLFEPGELTSWSFYRAGIAEFIATFLFLYISILTVMGYSRADNKCKTVGIQGIAWAFGGMIFALVYCTAGISGGHINPAVTFGLFLARKLSLTRAVFYMIMQCLGAICGAGVVKGFQPGPYQVGGGGSNYVHHGYTKGSGLGAEIVGTFVLVYTVFSATDAKRSARDSHVPILAPLPIGFAVFLVHLATIPITGTGINPARSLGTAIIYNKQINNWNDHWIFWVGPFIGAALAAVYHTVVIRAIPFKSK

SEQ ID NO: 62475 - protein, 398 aa, Mycobacterium avium subsp. paratuberculosis K-10
MAYDVARVRGLHPSLGDGWVHFDAPAGMLIPDSVATTVSTAFRRSGPTTVGAHPSAQRSAAILEAARAAVADLFNAEPAGVVLGADRAILLSALAEASSSRAGLGYEVIVSRLDDEANIAPWLRAAHRYGAKVKWAEIDIETGELPTWQWEGLIGKSTRLVAVASASATLGTVTDLRAMTKLVHDVGGLVVVDHSAAAPYRLLDVKETDADVVAVNAAAWGGPPIGAMVFRDPALLNSFSSISADPKATGAARLEIGAHQFGLLAGVVASIEYLASLDESARGTRRERLAVSMQSATSYLNRIYDYLMVSLRSLPLVMVIGRPEVRIPVVSFALHGVPAERVVQRLADNGILAVTNESSRALDVLGVNDVGGAVTVGLAHYSTTAEVDQLVRALASLG

SEQ ID NO: 62476 - protein, 391 aa, Actinobacillus pleuropneumoniae serovar 1 str. 4074
MSVIKMADLDLAGKRLFIRADLNVPVKDGKVTSDARIRATIPTLKLALQKGAKVMVTSHLGRPTEGVFEEANSLQPVVDYLNASDLGVPVRLVRDYLDGVEVAENEIVVLENVRINKGEKKNDPELAKKYAALCDVFVMDAFGTAHRAEGSTYGVAEYAPVACAGPLLAAELDALGKALKEPQRPMLAIVGGSKVSTKLTVLDSLSKIADQLIVGGGIANTFIAAEGHPVGKSLYEADLIPEAKRLAAATNIPVPVDVRVGTEFSEIAPATEKAVSEVQADESIFDIGDKSAEELANIIKSAKTILWNGPVGVFEFPNFRKGTEVISNAIAEATANGAFSIAGGGDTLAAIDLFGIADKISYISTGGGAFLEFVEGKVLPAVEILEKRANG

SEQ ID NO: 62477 - protein, 305 aa, Chlamydomonas reinhardtii
MLAPNSIGPARGSAVSTSATSTPVASTSNAGAIRFRPCIDIHKGKVKQIVGSTLKDLPDSGSSGAAELKTNFVSDKPSSWYSELYRRDGLAGGHVIMLGADDASKQTALEALRAWPGGLHMGGGVTCDNAMQYLDAGASHVIVTSYVFREGRLEEERLKQLVKLVGKQRLVLDLSCRQRDGKYWVVTDRWQKFSTLSLSEETLAELAASCDEFLVHGVDVEGMQLGIDEELVRVLGEWSPIPVTYAGGARTLEDLERVRAAGGGRVDITVGSALDIFGGKLAYDDVVAWHQRQQQQQQQQAAAKH

SEQ ID NO: 62478 - protein, 130 aa, Zea mays
MATVSAAVVTTIVARAAIARTNALGLPALRARSERVRCSYAKDAKNAAPVSTKGAGASLLAAAGAVTASAGPALALVDERMSTEGTGLSLGLSNNLLGWILLGVFGLIWSLYTIYTSDLDEDEESGGLSL

SEQ ID NO: 62479 - protein, 626 aa, Ostreococcus tauri
MTSTTTCAYPTFDDALRATTSSAQTWTRDLDVDPDWERNAPNRRSREVRSGHYVPVTPERLEAPRGRLASASCAREIGFALSGEDLNNPRSTFVRYFSGDVEGIDGGIGGMKTWATPYALSIMGSRMTSNCPFGNGNGYGDGRAISVGEMINPVTGARHELQLKGGGRTPFCRGADGRAVLRSSIREFLASEAMHALGVDTTRALCLIESERGSTARRPWYSSRSDEEYAKRVPSEDDPRLRSYSPEQRKDIIDQLKREKRDPDIMIEEPCAITTRVAPSFMRIGHIDLFSRRATASGATALQKEQLEKIVRHAAFREFPETIEQHGDDTAAMTRAMLEKSGAKIAKMVAGWLRVGFAQGNFNADNCLVGGRTMDYGPFGFMDRYDPGFAKWTGSGEHFAFMAQPDAGITNFAVLAVSCAPLLKGGSKEAQDIVRDAQPVFARAVDDTFRTKLGFASESSMDVARELFRAEDGLERLMYEDRADWTMTWRQLAECAEVSDANDDAALLAPLLSRCFYGGGIMCDGRKTKWLSFIRRWRTALEASGTSLADAAKAMRAANPKYVLREHLLVEAYTKASSGDFSMVNELFALTQHPYGGDGDTAEFDAKYYVKAPEEALTSGGTAFMS

SEQ ID NO: 62480 - protein, 292 aa, Triticum aestivum
MEGKEEDVRLGANRYSEHQPIGTAAQGGGADKKDYKEPPPAPFFEAGELTSWSFYRAGIAEFLATFLFLYISVLTVMGVVGNPSGSKCGTVGIQGIAWSFGGMIFVLVYCTAGISGGHINPAVTFGLFLARKLSLTRAVFYIVMQCLGAICGAGVVKGFQTTLYQGNGGGANSVAPGYTKGDGLGAEIVGTFVLVYTVFSATDAKRSARDSHVPILAPLPIGFAVFLVHLATIPITGTGINPARSLGAAIIYNKKQAWDDHWIFWVGPFIGAALAAIYHVVVIRAIPFKSRD

SEQ ID NO: 62481 - protein, 266 aa, Oryza sativa Indica Group
MAMGSSDGDVLYARCLVTLYLLSPLNVFALWFMSAPYGKLSRPGWGPTVPAALAWCLMESPTLWLPPLVLSTTTTSLSTPTLRVTILPAALYMLHYVHRTLVHPIRLLRLRRAPVPMPILIIMFGFGFNLLNAYIQARSWALDAVPPATAAPLTVARCLVGLALFVWGMWTNIAADRELLRLKEAGKGYQIPKDGLFDVVTCPNYFGETVEWLGYALVAWTPAAWAFFLYTCVNLGPRARDQRQWYIGKFGDKYPASRKAFVPYIY

SEQ ID NO: 62482 - protein, 438 aa, Mycobacterium tuberculosis H37Rv
MPRRSPADPAAALAPRRTTLPGGLRVVTEFLPAVHSASVGVWVGVGSRDEGATVAGAAHFLEHLLFKSTPTRSAVDIAQAMDAVGGELNAFTAKEHTCYYAHVLGSDLPLAVDLVADVVLNGRCAADDVEVERDVVLEEIAMRDDDPEDALADMFLAALFGDHPVGRPVIGSAQSVSVMTRAQLQSFHLRRYTPERMVVAAAGNVDHDGLVALVREHFGSRLVRGRRPVAPRKGTGRVNGSPRLTLVSRDAEQTHVSLGIRTPGRGWEHRWALSVLHTALGGGLSSRLFQEVRETRGLAYSVYSALDLFADSGALSVYAACLPERFADVMRVTADVLESVARDGITEAECGIAKGSLRGGLVLGLEDSSSRMSRLGRSELNYGKHRSIEHTLRQIEQVTVEEVNAVARHLLSRRYGAAVLGPHGSKRSLPQQLRAMVG

SEQ ID NO: 62483 - protein, 611 aa, Campylobacter upsaliensis RM3195
MTKLAHTNLELCVLSEEELKTLADNLRRKIIEVVSQNGGHLSSNLGVVELSIAMHYVFDSAKDPFIFDVSHQSYAHKLLSGREERFHTLRTFGGLSGYTKDEEGDYFIAGHSSTSISLAIGACKAIRLKKEERTPVVLIGDGALSAGMVYEALNELGDRKYPCVIILNDNEMSISKPIGAISKYLSQAMATQFYQKFKKRVEKMLDFLPDSATYMAKRFEEGFKLITPGLLFEELGLEYIGPVDGHNINEMINALKQAKMMQKPCIIHAQTIKGKGYMLAEGKHAKWHGVGAFDIHSGESLKKSNSKSSATEIFSQNLLHLAQKYENIVGVTAAMPSGTGLDLLIEAYPERFWDVAIAEQHAVTSMAAMAKEGFKPFIAIYSTFLQRAYDQVIHDCAIMNLNVVFAMDRAGIVGEDGETHQGVFDVSFLSAVPNLTLIAPRDSKMMEKCMEYAYFHQGPLAFRYPRGSFILEEEFTPCELSLAKSQWLIKNTSKVAFLGFGQGVGKAWKVLQNLGNDFANLIDLIFIKPLDELLLKELASQTKIWFVFSENVKIGGVASLLREFVGQYDLNVKIMSFEYEDAFITHGNLNEVEVSLNLDVKKLSQKILDII

SEQ ID NO: 62484 - protein, 198 aa, Archaeoglobus fulgidus DSM 4304
MTEDWVPKTKLGRLVADGKIKTMDEALASNLPLKEPEIVDILLPDLEDDVLEISMVQRMTDSGRRTKFRVTAVVGNRNGYVGIGTGKASQVAPAIQKAINNAKLNIFKVQRGCGSWECGCGGDHSLPFKVTGTSGSVRVTLIPGPKGLGIVAGDVAKRVIELAGVKDVWSFTKGQTKTTVNFAKATYEALKKTMYVKR

SEQ ID NO: 62485 - protein, 196 aa, Triticum aestivum
GIRKNPGCPLPSQLYTYIVQPLPPPLMALSATSFAPFQGFKFTAGLPVSHRSNGGSLGGVSNGGRIRCMQVWPTEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFNPPGCEESGKA

SEQ ID NO: 62486 - protein, 330 aa, Helicobacter pylori J99
MKRMLAEFEKIQAILMAFPHEFGDWAYCIEEARESFLHIIQTIAKHAKVLVCVHTNDTIGYETLKNLPGVEIARIDTNDTWARDFGAISVENHGVLECLDFGFNGWGLKYPSNLDNQVNFKLKHLGFLKHPLKTMPYILEGGSIESDGAGSILTNTQCLLEKNRNPHLNQNGIETMLKKELGAKQVLWYSYGYLKGDDTDSHTDTLARFLNKDTIVYSACEDENDEHYTALKKMQEELKTFKKLDGTPYKLIPLEIPKAVYNENQQRLPATYVNFLLCNNALIVPTYNDPNDTLILETLRQHTPLEVIGVDCNTLIKQHGSLHCVTMQLY

SEQ ID NO: 62487 - protein, 421 aa, Corynebacterium efficiens
MALVVQKYGGSSLESAERIRNVAERIVATKKAGNDVVVVCSAMGDTTDELLDLAAAVNPVPPAREMDMLLTAGERISNALVAMAIESLGAEAQSFTGSQAGVLTTERHGNARIVDVTPGRVREALDEGKICIVAGFQGVNKETRDVTTLGRGGSDTTAVALAAALGADVCEIYSDVDGVYTADPRIVPNAQKLERLSFEEMLELAAVGSKILVLRSVEYARAFNVPMRVRSSYSNDPGTLIAGSMEDIPMEEAVLTGVATDKSEAKVTVLGIPDKPGEAAKVFRALADAEINIDMVLQNVSSVEDGTTDITFTCPRSDGPRAMELLKKMQQQGDWTNVLYDDQVGKVSLVGAGMKSHPGVTAEFMEALRDVNVNVELISTSEIRISVLIREDDLDKSAKALHEKFQLGGDEEATVYAGTGR

SEQ ID NO: 62488 - protein, 370 aa, Cryptococcus neoformans var. neoformans JEC21
MPSATVIRYAIQGARKPTPNVIIPFKPTNIAKSRQLPPPHLLTLADLSPEQISSLIANAAALKFVSKNVHTTAIPKRLDRRTVALIFNKRSTRTRVASETSVEALGGHPMFLGKDDIQLGVNETLEDTAKVVGSMTDGIMARVAGHEEIETLAQYSPVPVINALSDLYHPTQILADLLTLCEIYAPVPPPTEIVSGQAYSSILSYYQSALNPTKILQGKKVAWVGDTNNITNELLVTLPRFGMHFSVAAPKGYDKFDERVWSRLAESKTESLVTLTNSPAEALRDADVVVTDTWISMGQETEKAARLEAFKGYQITNKMVSEAGAKEDWKFMHCLPRKKEEVDDEVFYGPRSVVFPEAENRKWTIMAVFE

SEQ ID NO: 62489 - protein, 223 aa, Streptococcus pneumoniae R6
MNVKENTELVFREVAEASLSAHRESGSVSVIAVIKYVDVPTAEALLPLGVHHIGENRVDKFLEKYEALKDRDVTWHLIGTLQRRKVKDVIQYVDYFHALDSVKLAGEIQKRSDRVIKCFLQVNISKEESKHGFSREELLEILPELARLDKIEYVGLMTMAPFEASSEQLKEIFKAAQDLQREIQEKQIPNMPMTELSMGMSRDYKEAIQFGSTFVRIGTSFFK

SEQ ID NO: 62490 - protein, 439 aa, Chlamydia trachomatis
MKLAVQHFSHSSEIDIRVWESLENRIFYHQANFSDAEGYSVLKAYLEQLDQQYGTQGNRLFYLSTPPDYFQEIIRNLNRHQLFYHEQGAQQPWSRLIIEKPFGVNLETARELQQCIDANIDEESVYRIDHYLGKETVQNILTIRFANTLFESCWNSQYIDHVQISVSESIGIGSRGNFFEKSGMLRDMVQNHLTQLLCLLTMEPPSEFFSEEIKKEKIKILKKILPIREEDAVRGQYGEGIVQDVSVLGYREEENVDPNSSVETYVALKLFIDNPRWKGVPFYLQAGKRLPKRTTDIAVIFKKSSYNLFNAENCPLCPLENDLLIIRIQPDEGVALQFNCKVPGTNKLVRPVKMDFRYDSYFNTVTPEAYERLLCDCILGDRTLFTSNEEVLASWELFSPLLEKWSQVRPIFPNYMAGSLRPQEADELLSRDGKAWRPY

SEQ ID NO: 62491 - protein, 340 aa, Oryza sativa Japonica Group
MSVLTYVLDNIGSSCSRSHSLSEAETAENAKIKLLFQTGFDEAELRSYTSVIHANVYQTIKILYEGAKELSQVESDSSKYVISPDNQETYLRGSILQLPDCAQYFMENLDRLAEADYVPTKGLKFNIREEKLLFYHYYAVYITKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDIFEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 62492 - protein, 798 aa, Cryptococcus neoformans var. neoformans JEC21
MFRGRSYMPGRRALVFTTATTVAVGSAYYALRPTPLHLDSQHVPLTKRRPGPLWAPPSREQMLEHLRTSGIYIHRTEEGGPEPGAVLRKDEAESEGDDVFDLLIVGGGATGAGTALDAASRGLKVACVEREDFSSGTSSKSTKLVHGGVRYLQKAIFELDYEQWKLVKEALRERRIFLETAPHLSHMLPILLPIYTWWQLPYYYAGCKLYDFLAGKENMESAYWMGKGKALEAFPMLKKDGLVGGVVYYDGQHNDSRMNISLVMTAVQHGAVVANYVEVTELHKKPDPSRGGQERICAATLKDRRTGETWKVRTRGVINATGPFSDGLRKLDEPTTQDIVAPSAGVHITLPNYYGPKTMGLLDPATSDGRVIFFLPWQGNVIAGTTDSPTKVSQNPIPDEKEIQWILDEVRNYLSPDVKVRRGDILSAWSGIRPLVKDPNSKNTESLVRNHMINTSKGGLLTIAGGKWTTYRAMAEETVDVAVKEFNLKPNGPSQTNHIKLVGGHAWSKTMYIKLIQQFGLETEVANHLSESYGDRAWTVASMAKPTGESWPFHGVRLSKLYPYIEAECRYACRCEYAQTAVDFIARRTRLSFLNVQATVETLPRVLEIMGEELGWDMKRKEQEFDDAMEFLKSMGLPQHTKLKLSDVEKSHGHIGPLGLAQKEEVALYQRAQFTPDEVSHLRTQFERFDFDHDQRITRADLIHAMTGMGYDASVELADSILREVDFGRKGEIDFQDYLDIAAGLKELQLENAFTHLTQLDSSRKEAGARDIGDHAHESSERREKRRKIPVERSGGGA

SEQ ID NO: 62493 - protein, 416 aa, Listeria monocytogenes str. 4b F2365
MAVEKITMPKLGESVTEGTISSWLVKPGDTVEKYDAIAEVLTDKVTAEIPSSFSGTIKEILAEEDETLEVGEVICTIETADAGSSEPVAEVEETETKAPEKQETKQVKLADAPASGRFSPAVLRIAGENNIDLSTVEGTGKGGRITRKDLLQVIENGPVAKREEMKSAPQEKAAMPTPPVRSAAGDKEIPINGVRKAIAKHMSVSKQEIPHAWMMVEVDATGLVRYRNAVKDSFKKEEGYSLTYFAFFIKAVAQALKEFPQLNSTWAGDKIIEHANINISIAIAAGDLLYVPVIKNADEKSIKGIAREISELAGKARNGKLSQADMEGGTFTVNSTGSFGSVQSMGIINHPQAAILQVESIVKRPVIIDDMIAVRDMVNLCLSIDHRILDGLLAGKFLQAIKANVEKISKENTALY

SEQ ID NO: 62494 - protein, 588 aa, Vibrio cholerae O1 biovar eltor str. N16961
MSIYNPTSKSVSFSRFTSTLPINRPNMNNDKRPLYISYAGPALLSTPLLNKGSAFSAEERASFNLEGLLPEATETIQEQVVRAYQQYRGFESDMDKHIYLRNIQDTNETLFYRLVQNHISEMMPIIYTPTVGAACENFSNIYRRGRGLFISYANRDRIDDLLNNAANHNVKVIVVTDGERILGLGDQGIGGMGIPIGKLSLYTACGGISPAYTLPVVLDVGTNNPQRLADPMYMGWRHPRITGPDYDNFVEEFMQAVQRRWPDALIQFEDFAQKNAMPLLERYKNRVCCFNDDIQGTAAVTVGSLLAACKAAGSQLSQQRITFLGAGSAGCGIAEAIIAQMVSEGISDEQARSQVYMVDRWGLLEEGMPNLLDFQQRLVQKKANTQHWTTENNGYSLHDVIRNAKPTVLVGVSGAPGLFSEEIIKEMHQHCPRPIVFPLSNPTSRVEALPSDIIRWTNGEALVATGSPFDPVLHEGKTYPIVQCNNSYIFPGIGLGVLAANARRVTDEMLMESSRALASCSPLAINGHGPLLPPLESIHSVSKKIAFAVAKKAIEQGVAPEVTDEALEASIEQHFWQPVYRRYKRTAF

SEQ ID NO: 62495 - protein, 592 aa, Aspergillus oryzae
MGSSLVPSLWQLLRAKEFCNREEMLHCGYVMSILSVQSNEADTIWSIAAALNITEPSSTGIGGDMFCLFYDVKTKRVHSLNGSGRYPANATLEKIRKDLNVGPNDAGTIPMKSVHAVTTPGAAAGWVDTIEKFGSGKLSLEQILLPAIELGENGFPVSELSSFFWREGEDLLRQASPNAHEMLKPDQKAKDGVRSPLPGEILKNPTLAQTFRSLAANGKKGFYEGRVAEELVKVVQDLGGYLTLEDLKSHAEIGTQETEAISLKFTGQSIAEKQTAGTDGEDNQGVEIWEHPPNGQGIVALMALGILEELEKMGKIPKFTEAQHNSAEYLHAVIESLRIAFADASWWVTDPDVEKVPTSELISPAYLAERAKLFNPDKATDILDHGSPAHNHCDTVYFAVTDKEGNGISFINSNYAGFGSGIIPKGCGFTLQNRGANFSLVPGHPNALAPRKRPYHTIIPAMITNVSDGSLHSVYGVMGGFMQPQGHVQVLLNMLAFNYHPQAALDSPRICIAAGSPELGKPVDRSVYVEEGISDEAVEGLKRLGHQVKVLKGWERGMFGRGQIIRCHYDDGQLVYSAGSDQRGDGMAIPVL

SEQ ID NO: 62496 - protein, 668 aa, Cryptococcus neoformans var. neoformans JEC21
MFRGRSYMPGRRAFAVTTTTTLAVGSAYLYFRPQPVRLEDASSVYDVKRPANLSWKPPTRDQMLSHLATSGIYVNRTQESGPEIGEIKGEKKEEDDDDVFDLLIVGGGATGAGTALDAVSRGLKVACVERDDFSSGTSSKSTKLVHGGVRYLQKAIFELDYEQWKLVKEALRERRIFLDTAPHLSHMLPILLPIYTWWQLPYYYAGCKLYDVLAGKENMESAYWVGKGKALEAFPTLKKEGLVGGVVYYDGQHNDSRMNISIMMTAVQHGAVVANYTEVTELHKKADPLRNGQERIYAATVKDNLTGKTMKVRCRGVINATGPFSDGIRQLDEPSVQNIVAPSAGVHISLPNYFGSKTMGLLDPATSDGRVIFFLPWQGVIIAGTTDSPTSLSQNPIPDEKEIQWILDEVDHYLSPDVKARREDILAAWSGIRPLVKDPNSKNTESLVRNHIINTSKGGLMTIAGGKWTTYRAMAEETVDAAVKEFDLKPNGPTRTHHLKLIGGHAWSKVMYIKLLQEYGLETEVAKHLSESYGDRAWTVASFANPTGESWPKHGVRFYRRYPYIEAECRYACRCEYAQTAVDFLARRIRLSFLDIHATVVALPRVIDIMSDELGWDAKRRAEELESTIKFLQSMGLGSKSDRDYAHELSERRGERRQIPIERSAGGA

SEQ ID NO: 62497 - protein, 337 aa, Picea sitchensis
MGTYLSCPKTDKVSEDGENGQIKYGASNMQGWRASMEDAHAAVLDFDSCTSFFGVYDGHGGKVVARFCAKYLHHVVKSEADRNGDLCESLQTAFLRMDEMMKGQRGQRELAILGDKENKDTTSDGITRSTPRNVEIRNEVEDDDWTSDEAHEDFSGPTSGSTACVSLIQKNKLIVANAGDSRCVLSRKGQAYNLSRDHKPDLENEKERIIQAGGFIHAGRVNGSLNLARAIGDMELKQNKFLPPEKQIITACPDINVVELCEDDEFLVLACDGVWDVMSSQEAVDFIREHINVEKNLSAVCEKVLDKCLAPNTTLGEGCDNMTIIVVQLKQTLKQVL

SEQ ID NO: 62498 - protein, 237 aa, Campylobacter upsaliensis RM3195
MQKQEKIIEMFNQIAPTYDKANRILSFGVDVSWRKKACKRVLELCEENTLDIVDVACGTGDMIEIWQESVQKAHKSIRHIRGIDPSSQMLREARKKFKNVEFIEAGAQDLPLESESVDILSISYGIRNVVERQRALGEFARVLKRDGILLVLEFTKRERGGFIAFFRDFYLKNILPSLGGFISKNKEAYAYLPNSIEEFLSKEEFSIELQSVGLKNVDFKSFSFGVSSMFIARKNDR

SEQ ID NO: 62499 - protein, 279 aa, Zea mays
RFKLTFYSHNPTPEAAETERACGLHASRRPPPPMADLRPPEPGTNGSSAGVVAALPAVEAVAAAETAMAATGGPQPPAPPYSKRRRRPSVRLGDIDAPPPRRNHKPPSSSHPRPPRRAHPDDLDPHAHSRRGPKPPAQRRPRTAWIPAAPASAGPAEGYDDDEERYYDDEDQSDSAAAAAARARVSGSRDASGDESDGVADWGLPNGRLPSATGYGGVKAWLDGLGLSRYAPVFEIHEVDDEVLPMLTLEDLKDMGIGAVGSRRKMYAAILKLRSDNAS

SEQ ID NO: 62500 - protein, 510 aa, Oryza sativa Japonica Group
MICRSLLLLRSNAASKASNIVKHVAATGCLPKYSSEAPARYFSSEPSLQVDSTEENGFKGHGMLAPFTAGWQSTDLHPLVIDRSEGSYVYDINGKKYIDALAGLWSTALGGNEPRLIKAATDQLNKLPFYHSFWNRTTKPSLDLANEILSMFTAREMGKIFFTNSGSEANDSQVKLVWYYNNALGRPNKKKFIARSKSYHGSTLVSASLSGLPALHQKFDLPAPFVLHTDCPHYWRFHLPDETEEEFATRLATNLENLILKEGPETIAAFIAEPVMGAGGVIPPPKTYFEKIQAVLKKYDILLIADEVITAFGRLGTMFGCDMYDIKPDLVSIAKALSSAYMPIGAILVSPEITDVIYSQSNKLGSFAHGFTYSGHPVSCAVAIEALKIYKERNIIEHVQKIAPRFQEGIKAFSGSPIVGEIRGLGLILGTEFVDNKSPNDPFPAEWGVGSLFGAECEKRGMLIRVAGDNIMLSPPLIMTPDEVEEIICKYGDALKATEERIAELKAKRG

SEQ ID NO: 62501 - protein, 350 aa, Gibberella zeae PH-1
MDKFNTLPSSFMTQTLFVAKYLILPIILIFILSRVINNRSVSKSSLPLPANDEIVRLRVYPIKSCRGFDVKSTKLLRTGLDLDRNWMFVTAEKREFITIRTNSNMTLITTAWDTVTDMLTVALNGYSFEIPAHPTTQWLEKNTELTKAGIWGEQTDAWEYSAMLTKPISEFLKIDVRLVYKGPTPRVLRGSGTPERLGRTEATKFADMMPVLVASMASMNELNDCLAHAGEDKIEIDRFRPNIIIRGSVPWVEDGWKTLQIGEGEHRLDLDVVCRCLRCQVPNVHPITAEKHPRQPWNQMMKYRRIDAGLKFKPSFGMLCAPSVEGHLEVGMKFQVKAMTNDHFFISPMK

SEQ ID NO: 62502 - protein, 98 aa, Oryza sativa
VTNELGLKQVPQDPSIAANGMTAIYFPDGISAPDIIPRLVERGIIVAGGLHKDIKDKYFRVGHMGITATDTETRHDLEKVKDALRNVFKDAGYVNSTA

SEQ ID NO: 62503 - protein, 179 aa, Triticum aestivum
  misc_feature (143)..(143): Xaa can be any naturally occurring amino acid
MAAAATAVRFHTAAARRAAPRRPARFAVRADAAQAATALTQDDLKRLAAVRAVEQVQSGMVLGLGTGSTAAFAVAEIGALLANGKLSGIVGVPTSKRTFEQAMSLGIPLSTLDDHPVIDLAIDGADEVDPDLNLVKGRGGALXLREKMVQSCTKESLLLAVGGNEHYLTGPREGSGPWP

SEQ ID NO: 62504 - protein, 320 aa, Gibberella zeae PH-1
MSASYWQSTQCRFWTFTKEQLATMRQKLEEDNAELVRMFPLPQQRHLNIYFNQRLIRLAKRLTIRQQSMATAQVYMKRFYSKVEIRRTNPYLVIATAIYLACKIEESPQHIRLIVTEARQMWGDLVAIDTSKLGECEFFMISEMRSQLIVYQPYRTVVALRSELGLQEDEVQLARSVINDHFMTDLPLLYPPHVIAMVAMLLALVLRPNNSGPGQNPSGAAAAAGLAAAQQALMRAQGQQTSGGGATDAATAEPKERQQQARVSRVQKFAKWLVDSNVEIASMVDATQEIISFYECYEHYNDKLTREQINRFVKARGLDK

SEQ ID NO: 62505 - protein, 416 aa, Ralstonia eutropha JMP134
MYQHIKVPAGEKITVNQDFSLNVPDTPIIPYIEGDGTGLDITPVMIKVVDAAVEKAYAGKRKISWMEIYAGEKSTKVYGPDVWLPDETLDVLKEYVVSIKGPLTTPVGGGIRSLNVALRQQLDLYVCLRPVRYFKGVPSPVREPEKTDMVIFRENSEDIYAGIEWEAESPQAQKLIAFLQNEMGVKKIRFPETSGIGVKPVSKQGTQRLVRKAIQYAIDNDKPSVTLVHKGNIMKFTEGGFRDWGYELAQKEFGAELVDGGPWCKFKNSKTGRDIVIKDAIADAFLQQILLRPAEYSVIATLNLNGDYISDALAAQVGGIGIAPGANLSDSVAMFEATHGTAPKYAGKDYVNPGSEILSAEMMLRHMGWTEAADLIIASMEKSILSKKVTYDFARLLEGATQVSCSGFGQVMIENM

SEQ ID NO: 62506 - protein, 430 aa, Zea mays
MDHPLKGALLARLYSTEPSLQRDDSDLKDGNGFKGHDMLAPFTAGWQTTDLHPLVIEKSEGSYVYDANGKKYLDSLAGLWCTALGGNEPRLVEAATAQLNKLPFYHSFWNRTTKPSLDLAKDLLETFTATKMAKVFFTNSGSEANDTQVKLVWYYNNALGRPNKKKFIARAKSLPALHQKFDLPAPFVLHTDCPHYWRYHLEGETEEEFSTRLANNLENLILKEGPETIAAFIAEPVMGAGGVIPPPATYFEKIQAVVKKYDILFIADEVICAFGRLGTMFGCDKYNIKPDLVSLAKALSSAYMPIGAVMVSPEVSEVIYSQSNKLGSFSHGFTYSGHPVSCAVAIEALKLYKERNIVEKVKTISPRFQDGLKSFSDSPIVGEIRGDNIMMSPPFIITPQEVDELISKYGKALKATEERVKELKSQQKKH

SEQ ID NO: 62507 - protein, 185 aa, Blastopirellula marina DSM 3645
MKAMDDKQLAKTSKFLSLVLRHQPDKIGIELDEQGWVEVATLLAAIRRESRPLTLAQLQEVVTRNDKQRFMFSSDGLRIRAVQGHSIEVELGYEAAAPPEYLLHGTPEQSVAIILETGLKKMKRHHVHLHHDRQTASAVGQRRGKPVLLQIAAGRMHADGYSFYVTPNQVWLTDEVPPAYLSILE

SEQ ID NO: 62508 - protein, 137 aa, Campylobacter upsaliensis RM3195
MEKTLSIIKPDAVKKGVIGKILDRFESNGLRIAAMKKLQLSKEQAEGFYAVHKERPFFKDLVEFMISGPVVVSVLEGENAVLKNRELMGATNPKEAKAGTIRADFAENIDANAVHGSDSLENAKIEIDFFFKPNEIC

SEQ ID NO: 62509 - protein, 198 aa, Campylobacter upsaliensis RM3195
MIVTKKALDFTAPAVLGNNEIVNDFNLYKNIGSKGAVVFFYPKDFTFVCPSEIIAFDKRYDEFKKRGIEVIGISGDNEFSHFAWKNTPINQGGIGQVKFPLVADLTKQIARNFDVLFAEAVALRGSFLLDADGTVRHAVINDLPLGRNIDEMLRMVDTMLFTNEHGEVCPAGWNKGDEGMKADPKGVAEYLNKNENKL

SEQ ID NO: 62510 - protein, 96 aa, Zea mays
TADHGNAEYMSDESGNPWTAHTTNPVPFILVEGEGRKIPGHGGEVKLREGGKLADIAPTILDILQLPVPAEMTGKTLIDQPLVEIKANRTPVNLSR

SEQ ID NO: 62511 - protein, 387 aa, Streptococcus pyogenes MGAS10394
MNKLYIDSFVEKKLTAGVQLLDEKDFSNIKEKNQLVQLVTKSNRPIGTAYISKQNKGIGWYLGPEKIDLSISYFVSLFSVAKAKRQDFAQSDETNAYRLFNQEGDGFGGVTIDLYKDFAVFSWYNAFVYDKKEMIMEAFQQVFPEVKGAYEKCRFKGPDTETAHLYGELAQETFSILENGIAYQVFLNEGLMTGIFLDQHDVRRALVDGLAMGKSLLNLFSYTAAFSVAAAMGGAIETTSVDLAKRSRELSLAHFEHNQLNLASHHFVVMDVFEYFKYAKRKKLIFNVIVIDPPSFARNKKQTFSVSRDYHKLITEALDILSPKGTIIASTNAANMTVSQFKKQIIKGFGSRRPESMTLQQLPSDFTINKADERSNYLKVFTIKVRE

SEQ ID NO: 62512 - protein, 307 aa, Ralstonia eutropha JMP134
MSSTPIKHYLQFSDLTPDEYEYLLDRARILKAKFKNYETWHPLHDRTLAMIFEKNSTRTRLSFEAGIHQLGGHAVFLNTRDSQLGRGEPIEDAAQVISRMVDIIMIRTFGQDIIERFAAHSRVPVINGLTNEYHPCQVLADVFTYIEQRGSIRGKTVAWIGDANNMAYTWIQAAERLGFTFHFSAPPGYQLDPALVPASAAGQLKVFEDPLAACKGASLVTTDVWTSMGFEAENEARKRAFQNWMVTTAMMDRAEPDALFMHCLPAHRGEEVEAAVIDGPKSVVWDEAENRLHVQKALMEYLLCGRY

SEQ ID NO: 62513 - protein, 251 aa, Burkholderia vietnamiensis G4
MSKQRTKRVIGNWKMHGRLAGNQALLNEVVQGADAVVAGTSIGVCVPFPYLAQVQAVLGGSRVAFGAQDVSAHEQGAYTGEVAAAMVAEFGAQYAIVGHSERRAYHGERNETVAAKAQRALAAGLTPVVCVGETLDEREAGTTEQVVGAQLDAVLAVLTADEAARIVVAYEPVWAIGTGKSATSAQAQDVHAVLRARLAAKGAAHVSVLYGGSVKPDNAEELFAQPDIDGGLIGGASLKAEDFLAICRAAR

SEQ ID NO: 62514 - protein, 425 aa, Pseudomonas putida GB-1
MAFLALGINHKTASVDVRERVAFTPEQLVDALQQLCRLTSSREAAILSTCNRSELYIEQDHLSADAVLQWLADYHRLSLDELRASAYVHEEHDAVKHMMRVASGLDSLVLGEPQILGQMKSAYAVAREAGTVGPLLGRLFQATFSAAKQVRTDTAIGENPVSVAFAAVSLAKQIFADLGRSQALLIGAGETITLVARHLHEQGVRRIVVANRTLERASILAEQFGAHAVLLADIPQELANSDIVISSTASQLPILGKGAVESALKQRRHKPIFMVDIAVPRDIETEVGELDDVYLYTVDDLHDVVAENLKSRQGAAQAAEELVTVGAEDFMLRLRELAAVDVLKAYRQQSERLRDEELQKAQRLLANGGNPEDVLAQLARGLTNKLLHAPSVQLKKLSAEGRVDALAMAQELFALNEGSTDKSPQ

SEQ ID NO: 62515 - protein, 184 aa, Oryza rufipogon
FGSVYRGRLSIKGTVTEAAVKQLDRNGMRGNREFLVEVLMLSLLAEHPNLVTLLGYCTDGDHRILVYEYMARGSLEDHLLDLPPGAAALDWTTRMRIAQGAARGLEHLHDAARPPVIYRDFKASNILLDSSFQARLSDFGLAKVGPVGDKTHVSTRVMGTYGYCAPEYALTGKLTTCSDVYSFG

SEQ ID NO: 62516 - protein, 337 aa, Streptomyces avermitilis
MTAGPREAPARRPARRPAPIRKVTHPQEDTVAPVRHLISIDDLSDTDLYSLVLRGAAFSAGTAGRPAPLAGDVVGIYFRKTSTRTRTAFSSGALRLGAQIIAYGPDDLQLNTGETSEDTGRVMSGMLDVLVARTAGDPAEMRAWAAQDRMAVVNAMSADEHPTQALTDLTTLQGHFGGIEGLRVLYVGEGNNTASALALALTRYPGVSLELRTPPGYGLAPYYRERAADQAGRHGATFRERHDMDDLPADQDAVYTSRWQTTGTSKPDPDWREIFAPFQVSAALWETSPKAVFLHDLPAHRGDEVTAEVLDGPASIAFAQAENKMHSAMAVLEWCRP

SEQ ID NO: 62517 - protein, 316 aa, Brassica napus
MVEPYETRNNNNGEAYQMVRYQSYNHHNPTIPSLPLLDLRVFYVRISNFKVDDSTPEVLTITHVPLDPDSLLEINGVRMSIHSEGVSSQLRRDRVDKKSEEATFISTDNIRLSGSVKFEVCDKEELVLSGTLEMSGSNGFTGESAKHSVKRWGMNCEAEITAGSGFLKEKHIGCSELSSSPLPSIEVYVTGCFSGTPIILTKTLQLGFRKKHSRTSALDSIPEYESGESQKGSSSELDFQVTEYGSYKQEYEGEYGDMYMGREYADGEDGEMSWFNAGVRVGVGIGLGVCVGLGIGVGLLVRTYQSTTRNFRRRLI

SEQ ID NO: 62518 - protein, 331 aa, Azoarcus sp. EbN1
MARVVRFHEFGAPEVLKIEDLEVGEPGPGEMRIRVQVIGLNRAEAAFRAGQYIEKAQLPARLGYEAAGTVDALGQGVGGFEIGEAVCVIPEFSMNRYGVYAEQAIVPAAAVVKRPPGLSTAEAAAVWMPYLTAYGALIDVVRLGQGDAVVITAASSSVGLAAIQIANSVGAVPIAVTRTEAKRAELQAAGAAHVIVSQAQDIAAEVMRITGGDGARMVFDPVGGPSILPLVSALACQGTLVLYGNLSGEAHQTPFPFGLAVGRGLSLRGYLVFEIIHDPARLARAEAFIREGLRSGVLKPKIDRTFSLEKIVEAHRYLEGNQQLGKVVVTV

SEQ ID NO: 62519 - protein, 332 aa, Nostoc punctiforme PCC 73102
MSSGKPTILVTGGAGYIGSHTVLALKQAGYNVVILDNLVYGHRDLVEKILQVELVVGDTGDRALLDHLFKTRDIAAVMHFSAYAYVGESVTDPAKYYRNNVVGTLTLLEAMLTASVKKFVFSSTCATYGVPEFVPIPENHPQNPINPYGATKLMVERILSDFDVAYGFQSVRFRYFNAAGANPNGLLGEDHNPETHLIPLVLMTALGKRKSISIFGTDYPTPDGTCIRDYIHVNDLADAHILGLEYLLKGGDSEVFNLGNGSGFSVREVIAAAEQVTGTSIPVEEHDRRPGDPPILIGTSEKARTILGWQPQYPSIEDIVAHAWQWHQKRHK

SEQ ID NO: 62520 - protein, 448 aa, Aspergillus oryzae
MVASNIPPLEFTPVEDIPGRVSTLRKTFLEHKTRDLEFRLVQLRKLYWAVKDHEQEIADASALDLGKPRFETEVAESGWLQNDLVFVTRNLHKWAKDEKAEDIDLTFKFMNPKIRKDPLGCVLVIGAFNYPFQLTLGPVIGAIAAGNTVVIKPSENAPNSAVVIQRIIEAALDPSCYTVIQGGIPETQALLAERWDKIFFTGGATVGRIIAKAAAPHLTPVVLELGGINPAIITKSANPRLVARRLLWGKLMNSGQICTSQNYLLVDKDLVPAVIEEFKKAYNEFYPQGAKASPDYSRIINEGAFRRIKSMLDNTKGKILMGGTMDEKERFIEPTLVLVDSVDDSMLTQESFGPLIPILPVDNLEQAVDIANGIQATPLGLYPFGSKADTEKILSSTRSGGVSVNDAALHIPTLPFGGVGESGHGAYRGKASFDVFVHRRPITSTPSS

SEQ ID NO: 62521 - protein, 538 aa, Oryza sativa
  misc_feature (450)..(450): Xaa can be any naturally occurring amino acid
MLRAALLRSGSGLRRPPMAAPLSTAAAASWLSDSASSPPRVRLLIGGEFVESRADEHVDVTNPATQEVVSRIPLTTADEFRAAVDAARTAFPGWRNTPVTTRQRIMLKYQELIRANMDKLAENITTEQGKTLKDAWGDVFRGLEVVEHACGMGTLQMGEYVSNVSNGIDTFSIREPLGVCAGICPFNFPAMIPLWMFPIAVTCGNTFVLKPSEKDPGAAMMLAELAMEAGLPKGVLNIVHGTHDVVNNICDDEDIKAVSFVGSNIAGMHIYSRASAKGKRVQSNMGAKNHAIILPDADRDATLNALIAAGFGAAGQRCMALSTAVFVGGSEPWEDELVKRASSLVVNSGMASDADLGPVISKQAKERICKLIQSGADNGARVLLDGRDIVVPNFENGNFVGPTLLADVKSEMECYKEEIFGPVLLLMKAESLDDAIQIVNRNKYGKPCPXGASIFTTSGVSARKFQTDIEAGQVGINVPIPVPLPFFSFTGSKASFAGDLNFYGKAGVQFFTQIKTVTQQWKESPAQRVSLSMPTSQK

SEQ ID NO: 62522 - protein, 505 aa, Solanum melongena
MDVPCPWYSLLIPLFVFIFLLIHHCFFTTSKKQNMLLLPSPRKLPIIGNLHQLGSLPHRSLHKLSQKYGPVMLLHFGSKPVIVASSVDAARDIMKTHDVVWASRPKSSIVDRLSYGSKDVGFSPFGEYWRRAKSITVLHLLSNTRVQSYRNVRAEETANMIGKIRQGCDSSVINLGEHLCSLTNNIISRVALGRTYDEKESGIEHIIEQFVELLGIFNVGDYIPRLEWVNKFTGLDAKVKKVAKELDMFLEIVIEEHIIRKKKEEYTSTGEAKDFVDVLLEIQNGNETDFPLQRDSLKAILLDSFAAGTDTTFATLDWTMAELLRQPRALKTLQDEVRGLAQGKSEITEDDLKNMQYLRAVIKESLRLHPTQESLLVPRESMEDVNLLGYYHIPARTQAIINAWAIGRDPLSWENPEEYQPERFLNSDADVKGLNFKLLPFGAGRRGCPGSSFAIAVIELALARLVHKFDFALPEGIKPEDLDMTETIGITTRRKLPLLVVATPC

SEQ ID NO: 62523 - protein, 507 aa, Solanum melongena
MDVPCLWYSLLILLLLFIFLLIHHCFTTSKTQNMFLPPSPRKLPIIGNLHQLGSHPHRSLRKLSQKYGPVMLLHLGSKPVIVASSVDAARDILKTHDHVWATRPKYSIADSLLYGSKDVGFSPFGEYWWQVRSIVVLHLLSNKRVQSYRDVREEETANMIEKIRQGCDASVINLGEHLCFLTNNITSRVALGRTYDERESGIDAKDILEQFLQLLDTFNVGDYIPWLKWVNKITGLDTKVEKIAKKLDTFLDSVIEEHIIRNKKEEYAITDEAKDFVDVLLEIQNGKETDFPLQRDSLKAILLDAFAAGTDTIYTNLDWTMADVLRQPRAMKTLQNEVRGLAQGKSEITEDDLKNMQYLRAVIKESLRLHPPNSLLVPRESMEDVKLLGYYHIPARTQALINVWAIGRDPLSWENPEEFCPERFLNNDIDMKGLKFELLPFGSGRRGCPGSSFAIAVIELALARLVHKFNFALPKGTKPEDLDMTECTGIATRRKSPLPVVATPFSG

SEQ ID NO: 62524 - protein, 605 aa, Oryza sativa Indica Group
MELALVGNPSNGVAKPSCNSVGSLPVVSSNAVIHPPVTSAAGATLGRHLARRLVQIGATDVFAVPGDFNLTLLDYLIAEPGLKLIGCCNELNAGYAADGYARARGVGACAVTFTVGGLSVLNAIAGAYSENLPVICIVGGPNSNDYGTNRILHHTIGLPDFSQELRCFQTITCYQAVINNLDDAHEQIDTAIATALRESKPVYISVGCNLAGLSHPTFSREPVPLFISPRLSNKANLEYAVEAAADFLNKAVKPVMVGGPKIRVAKAKKAFAGIAESSGYPIAVMPSAKGLVPEHHPRFIGTYWGAVSTTFCAEIVESADAYLFAGPIFNDYSSVGYSLLLKREKAVIVQPDRVVVGNGPAFGCILMTEFLDALAKRLDRNTTAYDNYRRIFIPDREPPNGQPDEPLRVNILFKHIKEMLSGDTAVIAETGDSWFNCQKLRLPEGCGYEFQMQYGSIGWSVGATLGYAQAAKDKRVISCIGDGSFQMTAQDVSTMLRCGQKSIIFLINNGGYTIEVEIHDGPYNVIKNWDYTGLIDAIHNSDGNCWTKKVRTEEELIEAIATATGAKKDCLCFIEIIVHKDDTSKELLEWGSRVSAANSRPPNPQ

SEQ ID NO: 62525 - protein, 467 aa, Solanum melongena
FGNMFDLAGSAPYKKIACLKEKYGPILWLKIGSSMNTMVIQTANSASELFRNHDVSFSDRPIVDVNLAHNYYKGSMALAPYGNYWRFSRRICTVEMFVHKRINETTNIRQESVDKMLRLDEEKASSSGGGGEGIEVTRYMFLASFNMVGNMIFSKDLVTDPESKQGSEFFNAMIGIMEWAGVPNISDIFPCLKMFDVQGLRKKMERDMGKGKEITKKFIEERIEERKKGEKNRSIKDLLDVLIDFEGSGKDEPDKLSEDEITVIILEMFLAGTETTSSSVEWALTELLRHPQAMAKVKLEILQVIGPNKKFEECDIDSLPYMQAVLKEQLRLHPPLPLLIPRKAIQDTKFMGYDIPKGTQVLVNAWAIGRDPEYWDNPFEFKPERFLESKVDVKGQNYELIPFGAGRRMCVGLPLGHRMMHFTFGSLLHEFDWELPHNVSPKSINMEESMGITARKKQPLKVIPKKA

SEQ ID NO: 62526 - protein, 505 aa, Solanum melongena
MEWEWSYVFFSAIIILPAFILFFSQKNTTKSSYKFPPGPPGLPIFGNMFELGTEPYKKMAVLRQKYGPVLWLKLGSTYTMVVQTAQASEELFKNHDISFANRVIPDVNQAHSYYQGSLAIAPYGPFWRFQRRICTIEMFVHKKISETEPVRRKCVDNMLKWIEKEANSAEKGSGIEVTRFVFLASFNMLGNLILSKDLADLESEEASEFFIAMKRINEWSGIANVSDIFPFLKKFDLQSLRKKMARDMGKAVEIMSMFLKEREEERKKGTEKGKDFLDVLLEFQGTGKDEPAKLSEHEIKIFVLEMFLAGTETTSSSVEWALTELLRHPEAMAKVKTEISQAIEPNRKFEDSDIENLPYMQAVLKESLRLHPPLPFLIPRETIQDTKFMGYDVPKDTQVLVNAWAIGRDPECWDDPMSFKPERFLGSKIDVKGQHYGLIPFGAGRRMCVGLPLGHRMMHFALGSLLREFEWELPDGVSPKSINMDGSMGVTARKRDSLKVIPKKA

SEQ ID NO: 62527 - protein, 574 aa, Brassica juncea
SMSVIVWWLATMVMVAVHSASAGVVELNWEVEYKLGWPDCKEGIVIAINGEFPGPTINAVAGDTVIVHVTNKLSTEGVVIHWHGIRQNGTPWADGAAGVTQCPINPGETLTYNFIVDKAGTHFYHGHYGMQRSAGLYGMMIVRSPKETLQYDGEFNLLLSDWWHQSSHAQELYLSSRPMRWIGEPQSLLINGRGQFNCSLAAYFNKGGLKECKFKENDECAPSILRVEPNKVYRLRIASTTALASLNFAVEGHQLEVVEADGNYIAPFTVDDIDLYSGETYSVLLRTHNPTPSRNYWISVGVRGRKPNTTQALTVLHYAGAPEFEHLPHPPPVTPRWDDYDRSKSFTNKIFAAKGYPPPPEKSDEQLFLLNTQNLMDKYTKWAINNVSLSVPATPYIGTIRYGLKTLNYQKPPGKEIMRDYDITKPPVNPNTTKGSGIYNLQSGRVVDVILQNANVLKGRGSEIHPWHLHGHDFWVLGYGEGKFRLGVDEKTYNLKNPPLRNTVALYPYGWTALRFLTDNPGVWFFHCHIEPHLHMGMGVVFAEGVDKIAKMNIPDQVLGCGSTREFLMNRGRH

SEQ ID NO: 62528 - protein, 1083 aa, Magnaporthe grisea 70-15
MATSDDQTVPIPEPQGLPLLGNIGAIDNEFPLGSLLSMASKYGEIWRMRFPGRSLVFVSTQALVNEVCDEKRFYKSINPTLKEVRGGTHDGLFTAYPDEENWGIAHRILMPAFGPLSIRSMYDEMHDIASQLALKWARYGSNSPIMVTDDFTRLTLDTLALCSMGFRFNSYYSTEMHPFIDAMADFLVECGTRGRRPPLPSIFYRTQDQKFDSDIEILRKTAREVLEARKAGEGADRRDLLHAMLSGVDSKTGKKMTDESIMDNLITFLIAGHETTSGLLSFVFYELMKHPEFYEKAQREVDEVCGKGPITVEHMSKLPYLNAVLRETLRVHATIPNITVAAREDDVLGGKYKVSKDEVIVLLLAKSQVDPRVWGKDADEFVPERMLDENFERITKEFPNSWKPFGNGMRACIGRPFAWQEALLVMAMLLQNFNFVLAPNYQYALKQTLTLKPKDLYMRAILRDGLNPTTLERRLQGLSQGDSASTKQASGAGAGAAPADATGVPLTVLYGSNSGTCEALARRIATDAPSHGFYAATVDCMDSAKGKLPTDQAVVIITASYEGQPPDNAGHFVAWLEGSDKAAKPCKDVSYAVFGCGHKDWAQTFHRVPRLVDDSLQELGASRLVEPGLSDVSTGAVFSDFESWEDDKLWPALAARYQVNSEAAAAENGAEASVKVHVSNPRINTLRQDVKEARVIEAKVLTSRPESTSEGGRQFKRHLEIELPEGMEYSAGDYLAVLPVNPIDTVLRTLHRFGLARDAHVTIEMASSQSTALPTNTSVPAFELLSSYVELSQPATKRDAASDEETKSQLGKLSGDDFADEVGAKRVSVLDLLERFPAIDLPIGSFLSMMPPMRVRQYSISSSPLVNPSRVTLSFSVLDAPSLSGQGRHIGVASNYLSSLNAGDSLHVSVRPSHAAFSLPSDQERTPLICAAAGTGLAPFRGFAQERAAMISAGRKLAPALLYFGCRDPDFDDLYRDEFDEWEKLGAVEVRRTYSRKPEASDGCKHVQDRIVADADRLLGLWMEGAKLYVCGSRGVSQSVMDAMTRIKMDKDRELHGKETTVEEARQYFDDLRNVRYATDVFD

SEQ ID NO: 62529 - protein, 499 aa, Solanum melongena
IFTAFSLLFSLFIFLLTRKPKSKTPNLPPGPPGWPIVGNLFQVAGSGKQFFEYIRDLKPKYGSIFTLKMGSRTMIIVASAELAHEALIQKGQIFASRPRENPTRTIFSCNKFSVNAAVYGPVWRSLRRNMVQNMLSPSRLKEFREFREIAMDKLIERIRVDAKENNDVVWALKNARFAVFYILVAMCFGVEMDNEEMIERVDQMMKDVLIVLDPRIDDFLPILRLFVGYKQRKRVNEVRKRQIETLVPLIEKRRSVVQNPGSDKTAASFSYLDTLFDVKVEGRKSGPTNAELVTLCSEFLNGGTDTTATALEWGIGRLMENPTIQNQLYQEIKTIVGDKKVDENDIEKMPYLNAVVKELLRKHPPTYFTLTHSVTEPVKLAGYDIPMDTNVEFFVHGISHDPNVWSDPEKFDPDRFLSGREDADITGVKEVKMMPFGVGRRICPGLGMATVHVNLMLARMVQEFEWFAYPGNNKVDFSEKLEFTVVMKNPLRAKVKLRI

SEQ ID NO: 62530 - protein, 511 aa, Solanum melongena
MDFFSTSSLSSYYHLIFTILAFVISSIIYFLSKKAESKKLKLPPGPPGWPVVGNLLQVARSGKPFFQIMRELRQKYGPIFTLRMGTRTMIILSNADLVHEALILKGQVFATRPRENPTRTVFSCDKFTVNAAVYGPVWRSLRKNMVQNGLSSIRLKEFRAVRKSAMDKMIEKIRAEADANEGVVWVLKNARFAVFCILLAMCFGVEMDEKTIEKIDQMMKSVLIALDPRLDDYLPILSPFFSKQRKHAMDVRKQQIKTIVPFIEQRKKILESPEIDKTAASFSYLDTLFDLKIEGRNSTPTYPELVTLCSEFLNGGTDTTATAIEWAIGRLIENPNIQSQLYEEIKKTVGENKIDEKDIEKMPYLNAVVKELLRKHPPTYMSLTHAVTEPAKLGGYDIPTGVNVEIFLPGISDDPNLWSEPEKFDPDRFYLGKEDADITGVSGVKMIPFGMGRRICPGLNMATVHVSLMLARLVQEFEWADPENTRVDFTEKLEFTVVMKNTLRAKIKPRM

SEQ ID NO: 62531 - protein, 574 aa, Brassica juncea
WWIVAVAILAHTASASVREYHWEVEYKFGFPDCKEGMVMAINGKFPGPTIHALAGDTIVVHLTNKLATEGLVIHWHGIRQLGSPWADGAAGVTQCAITPGETFTYRFTVEKPGTHFYHGHYGMQRSAGLYGSLIIDAAKGKREPLRYDGEFNLLLSDWWHESILSQELGLSAKPMRWIGEAQSILINGRGQFNCSLAAQFSNATAQFSNTSLPMCKFKKGDQCAPQRLHVQPNKTYRIRLASTTGLASLNFAVQGHKLMVVEADGNYITPFATSEIDIYSGESYSVLLTTDQDPSQNYWISVGVRGRKPKTPPALTVLHYVTAPSSQPHSSPPPETPRWNDFDRSKSFSRKILAAMGSPPPPRKFKKRLILLNTQNTIDGATKWALNNVSLVVPATPYLGSGKYRLRRGFDRKSPPTTFPVDYDIMNPPRNRNTTKGNGIYVFPFNVTVDVILQNANGLDANASEIHPWHLHGHDFWVLGYGEGKFRPGVDEKTYNLKNPPLKNTVALFPYGWTALRFVTDNPGVWFFHCHIEPHLHMGMGVVFAEGLNRIGKIPDEALGCGLTKQFLMNRNNP

SEQ ID NO: 62532 - protein, 573 aa, Brassica juncea
WIVAVAILAHTASASVREYHWEVEYKFGFPDCKEGMVMAINGKFPGPTIHALAGDTIVVHLTNKLTTEGLVIHWHGIRQLGSPWADGAAGVTQCAITPGETFTYRFTVEKPGTHFYHGHYGMQRSAGLYGSLIIDAAKGKREPLRYDGEFNLLLSDWWHESILSQELGLSAKPMRWIGEAQSILINGRGQFNCSLAAQFSNATAQFSNTSLPMCKFKKGDQCAPQRLHVQPNKTYRIRLASTTGLASLNFAVQGHKLMVVEADGNYITPFATSDIDIYSGESYSVLLTTDQDPSQNYWISVGVRGRKPKTPPALTVLHYVTAPSSQPPSSPPPETPRWNDFDRSKSFSRKILAAMGSPPPPRKFKKRLILLNTQNTIDGATKWALNIVSLVVPATPYLGSVKYRLRRGFDRKSPPTTFPVDYDIMNPPRNRNTTKGNGIYVFPFNVTVDVILQNANGLDANASEIHPWHLHGHDFWVLGYGEGKFRPGVDEKTYNLKNPPLKNTVALFPYGWTALRFVTDNPGVWFFHCHIEPHLHMGMGVVFAEGLNRIGKIPDEALGCGLTKQFLMNRNNP

SEQ ID NO: 62533 - protein, 245 aa, Glycine max
MDRYQRVEKPKAESPINENEIRVTSQGRTRNYITYATTLLQEKGSSEIVLKAMGRAINKTVMIAELIKRRIVGLHQNTQIGSTDITDTWEPLEEGLLPLETTRHVSMITITLSKKELDTSSTGYQPPLPVDQVKPLNEYDEEGEGSPRIRGRGRGRGRGRGRGFYNGGMEYGDGWDGGRGYGGRGRGRARGHAFRGRGRGRGYGVQPVGYYDYGEYDAPPPPRGRGRGRGRGRGRGRGRDQVPAA

SEQ ID NO: 62534 - protein, 589 aa, Oryza sativa Indica Group
MASKAMPRAPPAAPNLQSLKLCSQNDSSLETTSPSKRSALVPGRSAESSKPNSEVVQKEQKSTQHQNESIDLTGSNDPAEVKAEGNLVPKRLADEEKGVVEDGIANGSLKSSSALGKEHGIASASGSARLVGRSETGERGFSSSRCRPSTSSDVSDESACSSISSVTKPHKANDSRWEAIQMIRTRDGILGLSHFKLLKKLGCGDIGSVYLSELNGTKSYFAMKVMDKASLASRKKLLRAQTEKEILQCLDHPFLPTLYTHFETDKFSCLVMEFCPGGDLHTLRQRQRGKYFPEQAVKFYVAEILLAMEYLHMLGIIYRDLKPENVLVREDGHIMLSDFDLSLRCAVSPTLIRSSNPDAEALRKNNQAYCVQPACVEPSCMIQPSCATPTTCFGPRFFSKSKKDRKPKPEVVNQVSPWPELIAEPSDARSMSFVGTHEYLAPEIIKGEGHGSAVDWWTFGIFLYELLFGKTPFKGSGNRATLFNVIGQPLRFPEYPVVSFSARDLIRGLLVKEPQQRLGCKRGATEIKQHPFFEGVNWALIRCASPPEVPRPVEIERPPKQPVSTSEPAAAPSDAAQKSSDSYLEFDFF

SEQ ID NO: 62535 - protein, 391 aa, Saccharophagus degradans 2-40
MAVIQMKDLDLKGKRVLIRQDLNVPLQDGEITSDVRIQASLPTIKAAVDAGAKVMLMSHLGRPTEGEYADEFSLKPVAARLTKLLGKEVGLVKNWQEGVAVAEGEVVLLENVRFNVGEKKDDETLAKAYAALCDVFVMDAFGTAHRAQASTHGVAKFAPVACAGPLLSGELSALEKALANPARPMVAVVGGSKVSTKLTVLDALSKIVDVMVVGGGISNTFVAAAGNEVGNSLYEKDLIPEAQRLCAETEVIYAHDVRVTKEGFSDWNHNSVTEVKVPADIQADEEIIDYGPETAQKVAAILKDAKTIIWNGPCGVFEFDAFAKGTEVVARAIAESEGFSIAGGGDTLAAIDKFGLADGVSYISTGGGAFLEYVEGKPLPAVVMLEERAKG

SEQ ID NO: 62536 - protein, 518 aa, Schizophyllum commune
MRVSLIIALVYVPISLALGPVGNLPIVNKEIAPDGFSRPTVLANGKFPGELIKGTKGNTFKINVQDQLNDTRMLRSTTIHWHGFFQKNSNWADGPAGVTQCPIATGDSFVYEFGVPDQAGTFWYHSHLSTQYCDGLRGAMVVYDPADPHRSRYDVDDDNTVITLADWYHALAPTIIGVGTPDSTLINGKGRYNGGSLTNLTRINVVRGLRYRLRIVSLSCDPSFTFAIHGHNMTIIEADGVNTQPLVVDSLEVFAGQRYSVVVHANQRIGNYWIRANPSFGTIGFAGGLNSAVLHYIGASSSEPAEVDTEPVSSSPFVETALRPLENPGAPGLPQQGGADVNINLAIDLTLDPFQFTVNGAPFIPPSLPVLLQVMSGARTAQELLPEGSVYTLPPNQTVEISIPGGSAGAPHPFHLHGHTFDVVRSAGSTDYNYANPIRRDVVNTGLAGDNTTIRFRTDNSGPWILHCHIDWHLDIGLAVVMAEDTDGMAQSVQPTAYSDLCPKYDALSDEELGGLVD

SEQ ID NO: 62537 - protein, 453 aa, Streptococcus pyogenes MGAS10394
MIKMVIPYDYIVIGGGSAGIASANRAAMHGAKVLLAEGKEIGGTCVNLGCVPKKVMWYGAQVADILGTYAKDYGFDFKEKAFDFKQLKANRQAYIDRIHASYERGFEQNGVDRIYDYAVFKDAHTVEIAGQLYTAPHILIATGGHPVFPDIEGAQYGISSDGFFALDEVPKRTAVVGAGYIAVELAGVLHALGSKTDLFIRHDRPLRSFDKTIVDVLVDEMAVNGPRLHTHAEVAKVVKNTDESLTLYLKDGQEVEVDQLIWAIGRKPNLEVFSLDKTGVTLNDKGYIETDAYENTSVKGIYAVGDVNGKLALTPVAVAAGRRLSERLFNSKTDEKLDYQNVATVIFSHPVIGSVGLSEEAAVKQYGQEAVKTYQSRFTSMFTAITNHRQPCLMKLVTVGDTEKIVGLHGIGYGVDEMIQGFVVAIKMGATKADFDNTVAIHPTGSEEFVTMR

SEQ ID NO: 62538 - protein, 129 aa, Brassica napus
  misc_feature (21)..(21): Xaa can be any naturally occurring amino acid
  misc_feature (110)..(110): Xaa can be any naturally occurring amino acid
MESAALSRIGLACLAVMGQNXVALNIADKGFPISVYNRTTSKVDETLDRASEEGKLPVSGQYSPRDFVLSIQRPKSVIILVKAGAPVDQTISVLSEYMEPRDCIIGGGYXWFQNTERPIREAYKKGLLY

SEQ ID NO: 62539 - protein, 380 aa, Streptococcus pyogenes MGAS10394
MIYFDNAATTIPYGEALKTYQEVATKIYGNPSSLHQLGTNASRILEASRKQIAGLLGVKSEEIFFTSGGTESANWAIKGIAFEKTAFGKHIIISAIEHPAVSESVKWLLTQGFEVSYAPVTTQGVVDVNALAELIRPDTILISIMAVNNEMGAIQPIRAISNLLANQPTITFHVDAVQAIGKIPLCDYMTNRVDLASFSGHKFHSVRGVGFLYKKAGKRLNPLLSGGGQEQELRSTTENVAGIASMAKALRIVTEKQVSVLPKLTAMRDVIYKALSAYPDVTVFSAQEGFAPNILTFGIRGVRGEVIVHAFEKYEIYISTTSACSSKAGKPAGSLVAMGIPVKTAQTAVRISLDDDNDMGQVEQFLTIFKQIYDKTQKVR

SEQ ID NO: 62540 - protein, 396 aa, Oryza sativa Japonica Group
MDAMRQSTPRAMLLLCAVLMLAVAPPGAATAAAVAGCECGNAAAAAVAGEDARGALRLKLVAIASILAAGAAGVLVPVLGRSFAALRPDGDVFFAVKAFAAGVILATGMVHILPAAFDALASPCGGGRGGGGGFPFAGLVAMAAAMATMMIDSVAAGYYRRSHFKKPRPVDDPADAARAAGVEEGGAEHAGHVHVHTHATHGHAHGHVHSHGHGHGHSHGSAPAAATSPEDASVAETIRHRVVSQVLELGILVHSVIIGVSLGASLRPSSIRPLVGALSFHQFFEGIGLGGCIVQANFKAKATVIMATFFSLTAPVGIALGIAISSSYSKHSSTALVVEGVFNSAAAGILIYMSLVDLLAADFNNPKLQTNTKLQLAVYLALFLGAGMMSLLAIWA

SEQ ID NO: 62541 - protein, 445 aa, Desulfovibrio vulgaris subsp. vulgaris str. Hildenborough
MKVCIVGTGYVGLVSAACFAEMGNDVRCVDVNPEVVATLRAGKVHIYEPGLETLVQRNYADGRLTFTTNLAEGLAGAQFAFITVGTPSRDDGSCDLCFVEEVARQIGRHMQAPLIVVDKSTVPVGTADRVRSLIAEELASRGADIAFDVVSNPEFLKEGDAVSDFMKPDRVIVGTDSERTAEKLKELYAPFARSRDKLIVMSIRSAEMTKYAANCMLATKISFINEIAGICEKVGADVRDVRVGIGSDHRIGYHFIYPGVGYGGSCFPKDVKALIHTAHDADFKPELLEAVESVNARQKRSMAKRIAAYFEPQGGVAGKTLALWGLAFKANTDDMREAASLSVIEELTALGMRVRAYDPVAADNARRLLEGNDLVEIVGDQYAACEGAQALLVITEWNQFRNPDFDRVKASLTAPILFDGRNLYAPRNMAEAGFAYFCVGRKDVV

SEQ ID NO: 62542 - protein, 495 aa, Vitis vinifera
MGCFQSKTAHLHSPDDPSSTPEPTAKPDSANGDQSDQEHQVPAFKEYGLSELRKATNGFSSDHIVSESGEKAPNVVYRGKLDSNRLVAVKRFSKLSWPDAQQFVAEAAGVGKVRHKRLVNLIGCCAEGDERLLVAEYMPNDTLSKHLFHWDKQPLPWDMRVRVAYYIAQALDHCNTENRKIYHDLNAYRVLFDEDGDPRLSSFGLMKNSRDGKSYSTNLAYTPPEFLRTGRVIPESVIYSYGTVLLDLLSGKHIPPSHALDLIRGKNVLLLMDSSLEGQYANDDATKLVELASKCLQSEARDRPDTNFLLTAVAPLQKQKEVASHVLMGLTKTTVVLPTMLSPLGKACARMDLTAVHDILLKTGYKDEEGAENELSFQEWTQQVQEMLNTKKFGDIAFRDKDFKSAIDYYSKLVVMMPVPSATVFARRALSYLMIGQAELALRDAMQAQVCIPEWPTAFYLQALALSKLGMETDAQDMLNDGAAFEAKRHNSWRN

SEQ ID NO: 62543 - protein, 386 aa, Dechloromonas aromatica RCB
MKIHEYQGKQILKKFGVTVPRGIHCTTVEDAVKAAETLGGKVWVVKAQIHAGGRGKGGGVKVATSLEKVREYAGQILGMQLVTHQTGPEGQKVRHLLIEEGADIKHEYYVAALTDRATQSVAIMASYEGGMDIEEVAHKTPEKIVKVFVNPLVGLTDEQALTLAKGMGMNEASIPQCIETLKSLYTCYMETDASLAEINPLIHEGDGTVKALDAKFNFDSNALYRQPEIVAMRDLDEEDPDEVEASQFDLAYISLDGNIGCLVNGAGLAMATMDTIKLFGAEPANFLDVGGGATTEKVTEAFKIMLKNPKVKGILVNIFGGIMKCDTIAEGVVAAAKLTHLSVPLVVRMKGTNEDLGKKILKDSGLPIISADSMAEAATKIVAAVK

SEQ ID NO: 62544 - protein, 366 aa, Pseudomonas putida GB-1
MGFNCGIVGLPNVGKSTLFNALTKSGIAAENFPFCTIEPNSGIVPMPDARLAALAEIVKPNRILPTTMEFVDIAGLVAGASKGEGLGNKFLANIRETDAIAHVVRCFEDENVIHVSNSVDPKRDIEIIDLELIFADLDSCEKQLQKVARNAKGGDKEALAQKAILEKLIPHFTEGKPARSLMKHMADDEKAVIRGFHLLTSKPVMYIANVAEDGFDNNPHLDVVKAIAEEEGAVVVPVCNKIEAEIAELEDGEEKDMFLEALGLEEPGLNRVIRAGYELLNLQTYFTAGVQEVRAWTVRVGATAPQAAGVIHTDFEKGFIRAEVVAYDDFIQFKGESGAKEAGKWRLEGKDYIVKDGDVMHFRFNV

SEQ ID NO: 62545 - protein, 433 aa, Prochlorococcus marinus str. MIT 9301
MKPLDSKTPNQDWHPNIWPPFTQVNKSKPQIEVTHGKDALLFTKNPKKELIDAISSWWVTLHGHSNEYIADAIFNQSKKLEQVIFADFLHPQAKKLAERLSELTKLERLFFSDNGSTAVEVALKIAFQSWQNKGETRTQIVAFDGAYHGDTFGAMALGERNIFNENFDNLMFPVRRVPWPSTWINDEEVENKENEAIQKLETLLKTPTVAVILEPLVQGAGGMNMVRPQFIKRVSEIIKNNNSLLIADEVLTGFGRCGSLFAFQKAKIIPDLISISKGLTGGFLPMGITLCKEKIFQSFVDDSPRKTFWHGHSFTANPLGCAAANASLDLLEKEPHKYLSFEEKHLSHLIKFKNLHHIKKIRVSGTIAAFDLDIGNKKGYFNNIGKEIKSLAMEQGLFIRPLGNVIYLLPPLCITDDQLEKSYWIIRQILENL

SEQ ID NO: 62546 - protein, 236 aa, Triticum aestivum
MAGDDARSGAVAPAEEEPHVERLPADILAHVLSLLPSFHDLSMAGAVSRRWRRAVGRSLATRRRLSLAGQRTGDESTARLVRAAVNLRDLDISRSCWGCHITDQGLLDISSAACVGNLTSVSLWGLAGITDKGVVHLVSRARSLQHLNIGGTFITDESLYAVADSCPNLKSIILWSCRHVTEAGLVALVNKCLELECINVGGMRVSPESFAGLQSISPALRIRSIPQILNADVQVA

SEQ ID NO: 62547 - protein, 294 aa, Chenopodium rubrum
MDQYEKVEKIGEGTYGVVYKARDKVTNETIALKKIRLEQEDEGVPSTAIREISLLKEMQHGNIVRLQDVVHSEKRLYLVFEYLDLDLKKHMDSCPDFAKDPRMIKRFLYQILRGIAYCHSHRVLHRDLKPQNLLIDRQTNALKLADFGLARAFGIPVRTFTHEVVTLWYRAPEILLGSRHYSTPVDVWSVGCIFAEMVNQKPLFPGDSEIDELFKIFRTLGTPNEETWPGVTSLPDFKSSFPKWISKDLSAVVPNLDPAGIDLLNKMLCLDPSKRITARNALEHEYFKDIGFVP

SEQ ID NO: 62548 - protein, 294 aa, Vigna aconitifolia
MEQYEKVEKIGEGTYGVVYKARDRVTNETIALKKIRLEQEDEGVPSTAIREISLLKEMQHRNIVRLQDVVHSEKRLYLVFEYLDLDLKKHMDSSPEFVKDPRQVKMFLYQILCGIAYCHSHRVLHRDLKPQNLLIDRRTNSLKLADFGLARAFGIPVRTFTHEVVTLWYRAPEILLGSRHYSTPVDVWSVGCIFAEMVNRRPLFPGDSEIDELFKIFRILGTPNEETWPGVTALPDFKSTFPKWPPKDLATVVPNLDAAGLNLLSSMLCLDPSKRITARIAVEHEYFKDIKFVP

SEQ ID NO: 62549 - protein, 204 aa, Aspergillus oryzae
MAPQDHDRPMKLCFVTVGATASFHLLLQAILDDKFLAALHEANYTHLLVQYGKDSQALFEELLSKYPPGSPSRHGIEIDGFDFNHAGLDREMRLAQARPDEGRNGGLVISHAGSGSILGALRLGVPLVVVPNTTLKDNHQVELARELQKQGYVIASGHQEVYVAVERAEALRARMLAWPPVNGANQKRHRTLEQVMSDELGFLD

SEQ ID NO: 62550 - protein, 286 aa, Caulobacter crescentus CB15
MKTAFIGMGVMGFPMAGHLKAAGHEVAVYNRSPEKARRWAEKHGGAAFETIAEAVAGAEVVLLCVGNDDDVRDLVAQVLPAMGEGGVIVDHTTTSAKVAREMAALAAQSGRAFVDAPVSGGQAGAESGQLTIMAGGDQAAYDRVLPVIEVYAKAVRRIGEVGAGQLTKMCNQIAIAGVVQGVAEALHFAKRACLPTDDVLAAISKGAAQSWQMENRWPTMAQGKFDFGFAVDWMRKDLGIALDEARTNGAKLPATALIDQFYAEVQAMGGNRWDTSSLVARLEKDG

SEQ ID NO: 62551 - protein, 302 aa, Picea sitchensis
MDAYEKLEKVGEGTYGKVYKAKDKNTGQLVALKKTRLESDDEGIPPTALREISLLQMLSQDIHIVRLLDVEHTENKNGKPLLYLVFEYMDSDLKKYIDGYRRSHTKMPPKIIKSFMYQLCQGVAYCHSRGVMHRDLKPHNILVDKQRGVIKIADLGLGRAFTIPIKKYTHEIVTLWYRAPEVLLGATHYSTPVDIWSVGCIFAEMSRMQALFIGDSEVQQLFKIFRFLGTPNEEIWPGVTKLRDWHIYPQWKPQDISSAVPDLEPSGVDLLSKMLAYEPSKRISAKKALQHPYFDDLDKSQF

SEQ ID NO: 62552 - protein, 400 aa, Caulobacter crescentus CB15
MKTARPPLPVVATRGARLILEDGRELVDGLASWWTACHGYNHPHIAGALRKQIETMPHVMFGGLAHEPAYRLAKRLARLLPGDLDHVFFAESGSVAVEIAMKMALQYQINRGVGGRTRFLAFRGGYHGDTLATMTVCDPEEGMHSLFAGVMPAQVIADLPRDPASEAALDALLAARGHEIAAMLVEPLIQGAGGMLPHPPEVLRTLRRLADKHGVLLIFDEIFTGFGRTGSLFAMQAAGVEPDIVTLSKALTGGTLPLSAAVARRHVFEAFWSDDPAAALMHGPTYMANPLACAAANASLDLFEDGAWARDVARVSAALAEGLEPCRAGEGVVDVRTLGAIGVVEFEAPVPVSDLCARFAALGVWIRPMGKVVYLTPAFTTPDEDLSRLTSAVRQVVGVD

SEQ ID NO: 62553 - protein, 384 aa, Pseudomonas stutzeri
MTKPATTPAILALADGSIFRGESIGADGQTIGEVVFNTAMTGYQEILTDPSYAKQIVTLTYPHVGNTGTTPQDAESWKVWAAGLVIRDLPLLASNWRNKQSLPDYLKENDTVAIAGIDTRRLTRILREKGAQNGCILAGADATEEKALELARSFPGLKGMDLAKEVSVKERYEWRYSLWNLETDSHPEIPASELPYHVVAYDYGVKYNILRMLVARGCRVTVLPAQTPASEALALNPDGIFLANGPGDPEPCDYAIRAIQEVLETDIPVFGICLGHQLLALASGAITVKMPSGHHGANHPVQDLETGVVMITSQNHGFCADEASLPANLRATHKSLFDGTLQGIERTDKVAFGFQGHPEASPGPCDVAPLFDRFISAMAPVVDR

SEQ ID NO: 62554 - protein, 338 aa, Rhodopirellula baltica SH 1
MLIMPVDPTPVLQYINGFRFSKVMFAAVELGVFDSLEQQKRSAEDLAIELQCDPAAVSRLLNGLVGMELLSRDGEQYKNTGLASELLTSTSPNRMTGYIKFSNDVSWKLWSHFENAIREGSHRWKDAYGWDQPIFSSFFADDAAMREFLMGMHGYGVISSPKVVRAVDLSQFNHLVDLGGATGHLPMAACEAYESLTATVFDLPGVIPLTKEIVAQSSVSDRIDVVAGDFFDDELPQADLMSLGRILHDWSDEKIDRLLSKIYDRLPEGGGLLLAEILIQDDRGGPDWGQMQDLNMLVCTEGRERTLAEYEAILRRAGFREVTGQVTGAPVDAVLAIK

SEQ ID NO: 62555 - protein, 185 aa, Vibrio cholerae O1 biovar eltor str. N16961
MRFNIPNLLSLLRLFLIPVFVVTFYLPFEWAPFVAAMVFWVAGFTDWLDGMLARKLGQTSRFGAFIDPVADKVLVATALILITEHYHSIWITIPAVTMIAREIIISALREWMAEIGKRASVAVSWVGKVKTLTQMFALWVLIWRYDDWMIWLGYISIYVATVLTYWSMVQYLAAAKDDLLNEEHH

SEQ ID NO: 62556 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 62557 - protein, 182 aa, Acidobacteria bacterium Ellin345
MSESTTGPCHDSLKAYVREIPDYPKPGILFYDITTLIKEPVGLARTIDGITEHFLNKNIDLVVGMEARGFIFGPAVAYRLNAGFIPIRKPRKLPGETVKHTYKLEYGEDTLEIHKDAIQKAQRVLVVDDLLATGGTAVAATELVKQLGGEICGIAFVIELDFLNGRERLKDYDVYSLLHYDK

SEQ ID NO: 62558 - protein, 315 aa, Hordeum vulgare subsp. spontaneum
MATAGKVIKCKAAVAWEAGKPLSIEEVEVAPPQAMEVGVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 62559 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 62560 - protein, 408 aa, Desulfovibrio vulgaris subsp. vulgaris str. Hildenborough
MRILVQKFGGTSVANLECMKQVRAKVLAARERGYKVVVVLSAMSGETNRLLALADEWSSEPDPAETDALVVTGEQVSIALFSMLLKDSGIKARSFLGFQIPIVTSDTFGSARILSIDDSRLRAELETHDVLVVAGFQGCTADGRLTTLGRGGSDTSAVALAAALGSVECEIYTDVDGVYTTDPNLCSTARKLDRITYDEMLEMASMGAKVLQIRSVEFAKKYNVPVHVRSTFTDTTGTLVTQEDSSMEAVLVSGIAYDKDQARITLRSVPDRPGVAAAIFVPLSTNGVVVDMIVQNPSREGVTDMTFTVPRKDLKKTLTLMEGIREETEALEVLHDVSVAKVSAIGVGMRNHSGVAAKAFAALRKENINILMISTSEIKITCLIEEKYTELAVRVLHDAFGLSSNTEH

SEQ ID NO: 62561 - protein, 268 aa, Gloeobacter violaceus PCC 7421
MIKSPDCAGGCGMSIKLFDLSQKVAAITGSGRGIGRAIARGMAAAGAKVVIADIDAASARVSAAEIEQAGAEALAVEVDTVSPEQCTRMVDSTVERFGRIDVMVCNAAVDVIKPAVELAEAEWDWIVDVDLKGYFNAAQAAARRMLAQGGGSIVMTSSLASVIGIHGLVAYAAAKGGVNQLVRSMAVEWATSNVRVNAIAPGYCENIMVGAESTHADPVKEQQIRTFTPMGRRCKPEELVGPVIFLASEAASYVTGAILHVDGGYTAM

SEQ ID NO: 62562 - protein, 526 aa, Oryza sativa Indica Group
MEAGTWAVVVAAVAAYMAWFWRMSRGLSGPRVWPVVGSLPGLVRHAEDMHEWIAANLRRTRGTYQTCIFAVPGLARRGGLVTVTCDPRNLEHVLKSRFDNYPKGPFWHGVFGDLLGDGIFNSDGETWVAQRKTAALEFTTRTLRTAMSRWVSRSIHSRLLPILSDAAAAGGGGGGATVDLQDLLLRLTFDNICGLAFGKDPETLARGLPENDFASAFDRATEATLNRFIFPECVWRFKKWMGLGMETTLARSVQHVDRYLSAVIKARKLELAAGNGKGTYSDESLQHVALNFILAGRDTSSVALSWFFWLVSTHPAVERKIVRELCTVLAASRGADDPALWLAAPLNFEELDQLVYLKAALSETLRLYPSVPEDSKHVVADDVLPDGTFVPAGSSVTYSIYSAGRMKTVWGDDCLEFRPERWLSADGTKFEPHDSFRFVAFNAGPRICLGKDLAYLQMRNIAGSVLLRHRLAVAPGHRVEQKMSLTLFMKHGLRMEVRPRDLAPIVDELRGAGEYAAAARATAACA

SEQ ID NO: 62563 - protein, 318 aa, Paracoccus denitrificans
MKPLDRIHEAAKALDRHIILPEGEDPRVAEAARRLLAAGLARVTLMGGPEIPGAGRIDPAGGPDLAELADHWHRMRAARGMTAERALTEMRDPIRQAAMRVRLGQADGTVGGAVATTADTVRAALQIIGKAPGAGIVSSFFLMLSCGPGAPVRGGMIFADCGLVIQPDARELAAIALSAADSCRRILAEEPRVALLSFSTAGSAEHPSLGRIREALALIRAAAPGLEVDGEMQFDAALDEAIRARKAPESPLTGRPNVFVFPDLADGNIGYKIAERLAGLTAIGPILQGLAKPANDLSRACSVKDIVNATAITAMQTK

SEQ ID NO: 62564 - protein, 530 aa, Candida albicans SC5314
MMLPRNSPHRTESTLAYNNNNSNNNNNNNGSSLFQRKPLAPINSEFKISKPQHIKPNTHSHTFTTPTPKTRNTATTTTTNNNNRNNHQYRNPNLNTSLVFTPTKNSSSSSSSSHSSSLLSSSPFVEEPENQPESNHTRATSHYRTTSTSQYKSSANKDASHSLITSSKRKTSTKQTSESTNPKRRTTTTATQNTNNNKILNPSLSSSTIRFSTVSSSTSSSTTSSSSSSHTSPKPQQQLTLDDFEFGKILGKGKLGRVYCVKHKQSGLIFALKVMSKSEIMNLKLEKSLRREIEIQSNLYHINITRLYSWFHDSINIYLLLEYSIEGELYTHLKKLKRFDNIMASNYIFQITQALIFLHQRGIIHRDLKPENIMISLDNQLKLSDFGWSVQINQNQNQNQIHNQTQTQKTPHQKKQKQKRLTICGTLDYLPPEMIESKSHDFSVDIWALGILCYELLVGKPPFEAINRNITYEKIAKVDIKYPSNLDVDAIDLISKLVVKDPNKRLSLKEVLNHNWIIKNKPKWPKNIYK

SEQ ID NO: 62565 - protein, 502 aa, Arabidopsis thaliana
MEDIIIGVVALAAVLLFFLYQKPKTKRYKLPPGPSPLPVIGNLLQLQKLNPQRFFAGWAKKYGPILSYRIGSRTMVVISSAELAKELLKTQDVNFADRPPHRGHEFISYGRRDMALNHYTPYYREIRKMGMNHLFSPTRVATFKHVREEEARRMMDKINKAADKSEVVDISELMLTFTNSVVCRQAFGKKYNEDGEEMKRFIKILYGTQSVLGKIFFSDFFPYCGFLDDLSGLTAYMKECFERQDTYIQEVVNETLDPKRVKPETESMIDLLMGIYTEQPFASEFTVDNVKAVILDIVVAGTDTAAAAVVWGMTYLMKYPQVLKKAQAEVREYMKEKGSTFVTEDDVKNLPYFRALVKETLRIEPVIPLLIPRACIQDTKIAGYDIPAGTTVNVNAWAVSRDEKEWGPNPDEFRPERFLEKEVDFKGTDYEFIPFGSGRRMCPGMRLGAAMLEVPYANLLLSFNFKLPNGMKPDDINMDVMTGLAMHKSQHLKLVPEKVNKY

SEQ ID NO: 62566 - protein, 570 aa, Pseudomonas putida GB-1
MPDTTRFDWQRWLPGLVTLLHYKAAWLPKDIAAGLVLTTMLVPVGIAYAEASGVPGIYGLYATIIPLLAYALFGPSRILVLGPDSALAAPILAVVVQYAASDPQRAIAIASMMALVAGAFCVVAGLLRLGFITELLSKPIRYGYMNGIALTVLISQLPKLFGLKVDSEGPLRDLWHLGQALFAGQGHWPSFVVGAGSLVLILLLKPFKRLPGILIAVVLATLAVSLFNLDQMGVKVLGQLPQGLPSFVFPWVTDIDLVEVILGGVAVALVSFADTSVLSRSYAARLKMPVNPNQEMFGLGVANLASGLFQGIPISSSSSRTPVAEAAGSQTQLTGIIGALAVTLLLLVAPNLMQHLPNSALAAVVIAAALGLFEFADLKRIFRMQQWEFWLSITCFVGVAVFGAIPGICIAVAVSVIEFLWDGWRPHHAVLGRADGLRGYHDVQRYPQARRIPGLVLLRWDAPLFFANAEQFQSTVMAAVDASPTPVQRLIIAAEPVTSIDITSADMLAELDRALEARGVELQFAEMKDPVKDKMRRFGLFEHMGERAFHPTVGAAVDAYLEESGVDWQP

SEQ ID NO: 62567 - protein, 174 aa, Zea mays; identical to SEQ ID NO: 1528

SEQ ID NO: 62568 - protein, 398 aa, Pseudomonas putida GB-1
MPHDGSLLQATVVFLLAVVLLVPLAQRLKMGAVPGYLLAGILIGPSVLGLLGNPDNVARLSEMGVVMLLFVIGLELSPRRLWTMRRALFGVGSLQVGLTAVLLGLLAYGVFDQSRAAAIVLGLGLALSSTAFGLQVLAERKDLGKPHGRLAVAILLFQDIAAIPLIAVVPLLGGDVSTADEGAWPLLAVAVGIGVLIVFGRYLLTPVFKWTVGSGLPELSTATALLVVLGTAWLMEHVGVSMALGAFLAGVLMAESPFRHELETQIEPIKGLLLGLFFVGVGMSADLRLLFGMPLMVLGLTLLLVAIKLPLLYGLGRTLGGLNKAQALCLGVVLASGGEFAFVVFKLALDHQVLTQQVHDLLVLAITLSMAVVPLVMMALARQLRDDSPVQVSPETGQ

SEQ ID NO: 62569 - protein, 559 aa, Geobacillus kaustophilus HTA426
MAYQALYRVFRPQRFADMVGQEHVTKTLQSALLQHKISHAYLFSGPRGTGKTSAAKIFAKAVNCEQAPAAEPCNECPACLGITNGTVPDVLEIDAASNNRVDEIRDIREKVKFAPTSARYKVYIIDEVHMLSIGAFNALLKTLEEPPKHVIFILATTEPHKIPTTIISRCQRFDFRRIPLPAIVSRLKYVASAQGVEASDEALSAIARAADGGMRDALSLLDQAISFSDGKLRLDDVLAMTGAASFAALSSFIEAIHRKDTAAVLQQLETMMAQGKDPHRLVEDLILYYRDLLLYKTAPYVEGAIQIAVVDEAFTSLSEMIPVSNLYEAIELLNKSQQEMKWTNHPRLLLEVALVKLCHPSAAAPSLSASELEPLIKRIETLEAELRRLKEQPPAPPSTAAPVKKLSKPMKTGGYKAPVGRIYELLKQATHEDLALVKGCWADVLDTLKRQHKVSHAALLQESEPVAASASAFVLKFKYEIHCKMATDPTSSVKENVEAILFELTNRRFEMVAIPEGEWGKIREEFIRNKDAMVEKSEEDPLIAEAKRLFGEELIEIKE

SEQ ID NO: 62570 - protein, 856 aa, Cryptococcus neoformans var. neoformans JEC21
MPRHKVALYLPHPLPSLPIEPPPTPSPLQQVIASTLSTTDYDLVSFPLTNAAWQARWEKLCLRPIEEEGLSEAELERRAIEEKKVDQEADIWRRDGGLKRSEVVVSRLEESQGVIPLASEWLELDSPDEGIRFDSELALRAEFAHALYLSLPVLILPAPSLANREYLPSYARAISNLLQMGGQSAVTNISIRIPVSNPLELIAPESVMPNGLPGSPSPIAPPLASGAPQTDKKHKRLSSLSTRPQSMQTSLFGQPANQGTNQNQQQGMRITSGASSLMSANTAYGSVAGVGQASLGVAAHGGDLSSTWEMWDCIRTLCGYHPRLSVTLDLTNPLPPSAGALARWSAEPVNYIWLPASSFIPNAKGYPVLSKACQAFIREMGKQNPTYILSQTTMKRHSAGGHNAYLQYIRHITSTPQPGPNAQPRAIMALPAGASEKFQDYSDYLQAPLQPLMDDLGSMTYNIFENDPVKYAQYESAITQALLDLPANKKHVVTVVGAGRGPLIDCTLRALLHSGRQASIYAVEKNTNAFVTLQERKELEWRDKVHIISGDMRAVDVPEKCDILVSELLGSFGDNELSPECLDGALRLMKSTGVSIPSSYTAHIAPLSTSKLYQETHSPTRGPSSAETPYVVMLSQVDPISGDNNVPGVSARCGERIQQCWQFVHPNRDITVDSNGVPLSNSHNARASTHTFHIPHAATLHGFGGYFEAHLYGDVGLSIHPENAHAVSPDLTSWFPLFFPLKEPMYLPSGAELQVNLWRMGDGKGKKVWYEWAVESYLPVVQSVSSGPGAATVPGSRNVSSASASGIGFGGQPSPLMDAQFSPGTGHMGLSGELGRVKIGQSTLHNPGGIHSWVGL

SEQ ID NO: 62571 - protein, 251 aa, Alteromonadales bacterium TW-7
MNETPEKTTHFGYKTVAENEKASMVADVFHSVAAKYDVMNDLMSFGVHRLWKRQTIASSGVRKGHHVLDLAGGTGDLTAKFSQLVGETGQVVLGDINSSMLKVGREKLHNLGLVGNIDYVQMNAEMLPFPDNSFDVITIAFGLRNVTDKDKALRSMYRILKPGGRLLVLEFSKPKHEALSKAYDFYSFNLLPTMGKLVANDSESYQYLAESIRMHPDQDTLKAMMDEAGFEQTTYQNLTGGIVALHRGFKY

SEQ ID NO: 62572 - protein, 451 aa, Trichodesmium erythraeum IMS101
MKVSMIGTGYVGLVSGVCFAEKGHSVICVDIDQDKVDSINQGIPPIYEKGLQELLQKNIGDGLQAVTDLGQAVQETEISMIAVGTPFDGKEIDLGYIKQVSQQIGEALRNKNSYHLVVIKSTVVPGTTENVVLPILEETSGKKAGVDFGLGMNPEFLREGEAIEDFMFLDRIILGGIDAKSISLLELLYQVFEGIEKLTTNCTTAEMIKYTANSLLATMISFSNEIGNLCSAVGGVDVVEVMQGVHLDKRFSPITASGDRITPAFLSYLQAGCGFGGSCFPKDIKALTAYGSKLGNQMEILEAAIRVNVAQPQKVLDLLKKHFPSTEGVKVSVLGLAFKPGTDDIRESPAIPIIESLLSQGAIVKTYDPFAQKEAQKYFCENELLFCDDLTDALDAVEAVIIVTCWSEFEALPRLLAGKDNPPVVVDGRRMLGKQSVSIYEGIGWSSKSKY

SEQ ID NO: 62573 - protein, 251 aa, Rubrivivax gelatinosus
MNEPTPLSRSFGYQSVDEREREQRIRRVFSAVAARYDLMNDLMSFGIHRLWKRRFVRMAAPQAGQHIVDLAGGTGDVAALMAAADRRVTVVDPSAEMMAVGQARGHAHVDWQVGSAEQLPLADASVDTLTISFGIRNATRIDVALREIHRVLKPGGRFLCLEFSTPAWWLRPFYNLFSFTVIPRLGAWIANSPEAYTYLVESIRRFPDQRGFAAMISAAGFESVRWHDLSFGIACVHVGTRAAAATPAGTA

SEQ ID NO: 62574 - protein, 128 aa, Oryza sativa Japonica Group
MVKDAAAPGKGGRLKMESSNAQPQDSAYSVPKNPSMTCCRKRTDGATFLEDLKDHIEEFIHASMDEHKTCFKHHPKGQMCKHSDTALLCSFCILDILMMKHFLCFMFRISDVWDVKGCRGAFGGCQGS

SEQ ID NO: 62575 - protein, 419 aa, Trichodesmium erythraeum IMS101
MQNIKIAVIGLGYVGLPLAVEFAQKFPTLGFDISQTRVEQLNQGFDSTLEVDNDYLASVISETGFRVTTSIEDIANCNIYIVTVPTPIDRHKQPNLVPLIQASEAVGKILKKDDIVIYESTVYPGTTEEECVPVLEKISGLKFNQDFFCGYSPERINPGDKIHTVTKVKKVTSGSTPEIAQKVDALYNTIVIAGTHLASSIRVAEAAKVIENSQRDINIAFVNELAIIFNKMGIKTREVLEAAATKWNFLPFQPGLVGGHCIGVDPYYLTYKAQELGYHPEIILAGRRLNDNMGIYVAKQVVKLAIKKGQKVEGAAVLILGITFKENCSDIRNSKVIDLIRELEDFGCVVDVYDPWALPEEVKQEHDIDILSDLPKLASYQAIVLAVAHDEFKQLPLAKNDGQVIFDVKSFLPSADATL

SEQ ID NO: 62576 - protein, 509 aa, Listeria monocytogenes
MAKELKGIAASDGIAIAKAYLLVEPDLSYEKTEVTDVESEVKRFESALEVSRTELSMIREKAAKDLGEDKAQIFDAHLLVLNDPELTGPIEESIKNSKTNAETALQETTDMFIGMFESMDNEYMRERAADIKDVRKRVLSHLLGVTIPNPALIDEEVVVVAADLTPSDTAQLNRNFVKGFVTDIGGRTSHSAIMARSLEIPAVVGTKEVTASVAKNDIVIIDGLEGNVIIHPTEEQIAHYEKIKSDFALQQAEWDKLKNEKTVSKDGVHVELAANIGTPNDLEGVISNGGEAVGLYRTEFLYMGRDNFPTEEEQFEAYKAVVSGMDGKSVVVRTLDIGGDKTLPYLELPEEMNPFLGFRAIRLCFANEELFRTQLRALLRASVYGNLKIMFPMIATVNEFRQARDILLDEKAKLKAAGTEVSDSIELGIMIEIPAAAVLADQFAKEVDFFSIGTNDLIQYTMAADRMNERVSYLYQPYNPSILRLVKMVIDASHKEGKWTGMCGEMAGD

SEQ ID NO: 62577 - protein, 614 aa, Cryptococcus neoformans var. neoformans JEC21
MTTLSQSNLPLDPEAHQDAKKARDLEEAGAAPQDELYYEDTSSEEVLTGVSKVEAAAAVWGPKSQWFLFIGIALSAYIYSLDGVTTYQYLSYATSYVLDHSVSGTISTANAIIIAVGKPLMAKLADVVGRGETFIIVTILYVVGYIVIATANDVGQIAGGQVIYSFGYTGLQMLQQIIIADMTNLRWRGLVTGLVSAPFIINNFVSAEIAEGVLPNWRWGYGMFAILVPVSLSPIIIALMWAQHKAAKQLKIRYSRPPIKVGFWITIREACLEMDFMGLILIAASLALILLPLGLAPSASNGWKTPSMIVMLIIGGLLFPVFLYYESRFPRKPVLPMRWLKRGPILGACLIGFFDFVSFYLQYTYLYSYVYVTEDWSYRNLTYFSSTQSLALTIFGIMAGFIMYATRRFKWMLFIGLLIRLLGVGLMLKARSATGNTAELVMCQILQGMGGGAAATAIQVSAQAAVAHVDVATVTAVVLLITEVGNSVGSAVASGIWASYMPKELAKNVPTTNATLLAELYGSITDIALYPSDDPIRLGAIAAYQNVMFRLVLGAVIVAIFPPIWCLLFTKDVKLTRAQNAVDAKDLSGRPTDEPTLDERTPSEAGMSDPRRKD

SEQ ID NO: 62578 - protein, 410 aa, Arabidopsis thaliana
LPSSIVLYIYREAEEICNHRQRKNKNKKMYNLPRDLPEEVLCRIPLTSLRPVRSTCKKWSTLSKCGSFAKKHLAQAKVLADAKEFMVVLMMNFRVYLMRVNLQNNVVESSSSSSSSSSSCIKREAKLISLGDEEADISQVFHCDGLLLCISITESKTRLVVWNPYWGHTRLFEPTHQFNKFDSYSYALGYDKSRKSHKILRGITCLDPFKIYDFNSDLWRDLDVTPEWHLWQMLHGVSLKGNAYWFARENYTETMDTDHFFLLCFDFTSETFGPPLPLPFEFAVSEDTMSVSSVREEQLVVLYQPWDYLQLDIWVTSKIEPNAVSWNSKVFLSVSLKQLVSPQFQLTFGSFFIDEEKKVAVVFDKDYDNKRNIAYIFGVDGSFKAVDLGDSDRKCFPLVCSYVPSLVQLN

SEQ ID NO: 62579 - protein, 231 aa, Prochlorococcus marinus str. MIT 9301
MKQVVADAAIREVKSDMILGLGSGSTAALMIKSLADEMRSGKLQNIKGVATSFQSEVLALELNIPLIDLASVSQIDLAIDGADEVDPGFQLIKGGGACHVREKLVASKADQLLIVVDETKLVQNLNLSFPLPVEVLPNAWKQVQEVISEMKGSSTLRMATKKAGPVVTDQGNLILDVLFDDGINNPKDIEMKINNIPGVLENGLFVDLTDKVLVGKIENNTPVVYSPSRAS

SEQ ID NO: 62580 - protein, 315 aa, Hordeum vulgare subsp. spontaneum
MATAGKVIKCKAAVAWEAGKPLSIEEVQVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 62581 - protein, 732 aa, Arabidopsis thaliana
MSNQKKRNFQIEAFKQRVVVDPKYADKTWKILEHAIHEIYNHNASGLSFEELYRNAYNMVLHKYGDKLYTGLVTTMTFHLKEICKSIEEAQGGAFLELLNRKWNDHNKALQMIRDILMYMDRTYVSTTKKTHVHELGLHLWRDNVVYSSKIQTRLLNTLLDLVHKERTGEVIDRVLMRNVIKMFMDLGESVYQDDFEKPFLEASAEFYKVESMEFIESCDCGEYLKKAEKPLVEEVERVVNYLDAKSEAKITSVVEREMIANHVQRLVHMENSGLVNMLLNDKYEDMGRMYSLFRRVANGLVTVRDVMTLHLREMGKQLVTDPEKSKDPVEFVQRLLDERDKYDRIINMAFNNDKTFQNALNSSFEYFVNLNTRSPEFISLFVDDKLRKGLKGVGEEDVDLILDKVMMLFRYLQEKDVFEKYYKQHLAKRLLSGKTVSDDAERNLIVKLKTECGYQFTSKLEGMFTDMKTSHDTLLGFYNSHPELSEGPTLVVQVLTTGSWPTQPTIQCNLPAEVSVLCEKFRSYYLGTHTGRRLSWQTNMGTADIKAVFGKGQKHELNVSTFQMCVLMLFNNSDRLSYKEIEQATEIPTPDLKRCLQSMACVKGKNVLRKEPMSKEIAEEDWFVVNDRFASKFYKVKIGTVVAQKETEPEKQETRQRVEEDRKPQIEAAIVRIMKSRRVLDHNNIIAEVTKQLQTRFLANPTEIKKRIESLIERDFLERDNTDRKLYRYLA

SEQ ID NO: 62582 - protein, 516 aa, Saccharophagus degradans 2-40
MSEVKKPLALIILDGFGYSESDKYNAINAAKAPTWRKIWAENPKTTIATSGMAVGLPEGQMGNSEVGHMTLGAGRVVYQNFTRINKAIADGDFYTNPVYTKAVDDAQSQGKAVHVIGLLSDGGVHSHEDHMIAMMELAVKRGAEKVYMHAFLDGRDTPPRSAKAPLQKTEEKLKALGGGKIASIIGRFFALDRDNRWDRVQQAFDLMVDGKAAFTAQSATAGLEAAYERDENDEFVKATAIVDADGKPVTIEDGDAVIFMNFRPDRARQLTNAFVDKNFDGFARARVPALSDFVMTTEYSADIDTSCAYPPEDLVNSFGEVMAKNGKKQLRIAETEKYAHVTFFFSGGQESLYEGEDRILVPSPQVETYDEQPEMSAPEVTAKLVDAIENGGYDAIICNYANCDQVGHTGDFDASVKAVEAVDAALAEVFAALERVGGEALITADHGNVELMYDDEAQQLHTQHTTLPVPLVYVGKRDISLEQGGSLADIAPTMLALLDVPQPTEMNGRNLVKFSK

SEQ ID NO: 62583 - protein, 345 aa, Zea mays
MDHAAEAQRTDLMTITRHALNEQGRHPESRGDFTILLSHIVLGCKFVASAVNKAGLAKLIGLAGETNVQGEEQKKLDVLSNEVFVKALVSSGRTCVLVSEENEAAIFVDAPLRGKYCVCFDPLDGSSNIDCGVSIGTIFGIYMIKDKDNATLEDVLQPGTDMIAAGYCMYGSSCTLVLSTGNGVNGFTLDPSLGEVILTHPHIKIPNKGKIYSVNEGNARNWDAPIAKYVEKCKYPKDGSPPRSLRYIGSMVADVHRTLLYGGVFLYPADQKNPNGKLRILYEVFPMSFLMEQAGGQSFTGKERALDLVPTKIHDRSPIFLGSYDDVEEIKALYAEQAKSSSASS

SEQ ID NO: 62584 - protein, 380 aa, Alteromonadales bacterium TW-7
MFNSKLPDVGVSIFSQMSELANQFSAINLSQGFPEFDTPNFLKSQITHYVQHGVNQYSPSSGVPKLQQQIASLIQKKYATELNAAKQITITSGATEALFVAIQTIVRPNDEVIVFDPAYDAYKPAIELAGGRSVHIALKAPDYTINWRTVEQKITKHTRAIVINSPHNPTAKVITQQDITELKRLVGTYKLYIVSDEVYEHIAFDGQPHLSVLRDKELLAQSFVVSSFGKTFHCTGWKMGYCIAPEHLASEFRKIHQYVTFSSFTPAQHALADMLEQQSEHVDSLSDFYQQKRDLLIRHLLGSRFTVLPSQGTYFLLLDYSDVSDLNDVEFCHWLVEQAGVAAIPLSVFYQTSPGDKVIRLCFAKNDETLKEAAHILCQL

SEQ ID NO: 62585 - protein, 476 aa, Pseudomonas putida GB-1
MTTSHYIAGRWVEGQGSDCISVNDPALGQPFAELMAASVAQVDQAVAAARSALPAWKNTSASERATFLRGFAEQLGQRREALITLQMRNNGKPRHEAEIDLDDAIATFGYYAELAEQLPSKNRDVPLAAPGFTARTRLEPVGVVGLIVPWNFPLVTSAWKLAPALAAGCTVVLKPSEVTPLIEQAYGQLADALGLPAGVLNIVNGKAETGAALSNHNGLDKLSFTGSNSVGSQVMRSASAQCRPVTLELGGKSAIVVFDDCDIDQAVEWIVAGISWNAGQMCSATSRLLVQDGIADALLPRLQAALENLRVGNPLTEEVDMGPLTSQAQWLKVASYFATAREEGLQCLAGGKALDRDGWFVSPTLYADVPKDSRLWTEEIFGPVLCARRFATEEQAIAEANDSRFGLVATVCSADLERAERVADALEVGHVWINSVQAVFVETSWGGTKGSGIGRELGPWGLSAYQSVKHVTRCLG

SEQ ID NO: 62586 - protein, 129 aa, Haloarcula marismortui
MPTVEYLNYEVVDDNGWDMYDDDVFGEASDMDLDDEDYGSLEVNEGEYILEAAEAQGYDWPFSCRAGACANCAAIVLEGDIDMDMQQILSDEEVEDKNVRLTCIGSPDADEVKIVYNAKHLDYLQNRVI

SEQ ID NO: 62587 - protein, 457 aa, Shigella flexneri 2a str. 2457T
MESKNKLKRGLSTRHIRFMALGSAIGTGLFYGSADAIKMAGPSVLLAYIIGGIAAYIIMRALGEMSVHNPAASSFSRYAQENLGPLAGYITGWTYCFEILIVAIADVTAFGIYMGVLFPTVPHWIWVLSVVLIICAVNLMSVKVFGELEFWFSFFKVATIIIMIVAGFGIIIWGIGNGGQPTGIHNLWSNGGFFSNGWLGMVMSLQMVMFAYGGIEIIGITAGEAKDPEKSIPRAINSVPMRILVFYVGTLFVIMSIYPWNQVGTAGSPFVLTFQHMGITFAASILNFVVLTASLSAINSDVFGVGRMLHGMAEQGSAPKIFSKTSRRGIPWVTVLVMTTALLFAVYLNYIMPENVFLVIASLATFATVWVWIMILLSQIAFRRRLPPEEVKALKFKVPGGVATTIGGLIFLLFIIGLIGYHPDTRISLYVGFAWIVVLLIGWMFKRRHDRQLAENQ

SEQ ID NO: 62588 - protein, 471 aa, Alteromonadales bacterium TW-7
MNTLITPVILAGGIGSRLWPLSRQAMPKQFLPLLNNENSLLQNTLNRVSGAEFSQPILVCNEQHRFIAKEQSSAANVFGLILEPTGKNTAPAIALAAHYAIQSGLKGPMLVMPADHHIKDFSPLTSQINDAVTLAEQGKLVTFSITPSMAHTGFGYIQQGCKISGSNCFEVAEFKEKPNLATAERYIAEGGYSWNSGMFLFTPQAYLNELERFAPKIAHSVKVASHFSHDLGFTRPDSEPLEFCPSDSIDYAILERSNNVAVMPVALKWSDVGSFSALASLTKQDAHGNNENQNHIAQNSTNNFVISEHDHSIATLGVSDLAIIHTHDATLVADKNKLDDLPLLLKQLALSQSDKLNHHQVVYRPWGNYRTLVEGSGFKVKKITVNSGAKLSTQRHQHRAEHWVVVSGVADVRIDDQVLTLTQDQSCYIAAKQLHSLANNQQVPLIVIEVQTGVILDENDIERFNDIYGRY

SEQ ID NO: 62589 - protein, 298 aa, Thermobifida fusca YX
MTRVVVVGDLMTDSIARAFYPLARGSDTPASVATFGGGSGANVAAWLAVEGTDTALIGRRGSDITGRTREMELMGYGIDARMVMDPERPTGTCVVMITHRGDRTMLSDPGANAALQPEDLPRDLFGPDGHLHLSGYTLLNEGSRRAGRVALRLAQESGMSISVDCGSHAPLERVGAEAFLEWTNGVRLLFANQEQAAVLTGRDDPDAAAKVLTAWYPNIVIKLGADGALWASKAREGTLHVPAEPVEPVPGAIGAGDAFIAGFLPAWLAGKHPKEALISAQRLAARALLQPGARPELD

SEQ ID NO: 62590 - protein, 490 aa, Toronia toru
GPGVSALEEKNLGRITQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLSAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62591 - protein, 177 aa, Musa acuminata
FGSVYRGEMPDSGAIAVKRLESIRQGEKQFRMEVSTIGTIHHVNLVRLRGFCCEGDKRLLVYDYMPMGSLDSVLFADGREALDWKKRYGIALGIARGLAYLHEKCRECIMHCDIKPENILLDMDMCPKIADFGMAKLLGREFSRVLTTVRGTIGYLAPEWITGSAITPKADIYSYGI

SEQ ID NO: 62592 - protein, 392 aa, Corynebacterium melassecola
MTIDLQRSTQNLTHEEIFEAHEGGKLSISSTRPLRDMRDLSLAYTPGVAQVCEAIKEDPEVARTHTGIGNTVAVISDGTAVLGLGDIGPQASLPVMEGKAQLFSSFAGLKAIPIVLDVHDVDALVETIAAIAPSFGAINLEDISAPRCFEVERRLIERLDIPVMHDDQHGTAVVILAALRNSLKLLDRKIEDLKIVISGAGAAGVAAVDMLTNAGATDIVVLDSRGIIHDSREDLSPVKDALAEKTNPRGISGGINEAFTGADLFIGVSGGNIGEDALKLMAPQPILFTLANPTPEIDPELSQKYGAIVATGRSDLPNQINNVLAFPGIFAGALAAKAKKITPEMKLAAAEAIADIAAEDLEVGRIVPTALDPRVAPAVKAAVQAVAEAQNA

SEQ ID NO: 62593 - protein, 442 aa, Methylophaga alcalica
MKIFEEIESEVRSYARAFPRVFDRAQGALIYDREGNEYLDFLAGAGSLNYGHNHPIFKEKLIEYIQADGITQGLDLHTRAKGEFLESFNEHILKPRNLDYVVMFTGPTGTNAVEAALKIARKKTGRENVISFTNGWHGQTLGALSVTGNSTHRGGAGIALHGSTRIPYDGYLGDDFDTTNLLDKMLSDSSSGVDKPAAVIVETVQGEGGINAASMTWLKSLSEICKRHDVLLIIDDIQAGCGRTGTFFSFEEAGIYPDIVTLSKSLSGYGLPFAIVLMKPEVDQWSPGEHNGTFRGNNHAFVTAKAALDHFWKDDKFAKEVQRKGDYIAKRVDSIVAEYGEGNFNSHGRGMFRGINCVNGELAGQITRKCFQKGLIIETSGADDHVVKFLCPLIITDEQLTKGIDILEEAIKEVCAKADSIPEEKDFFEGDYSVSDEVNKAS

SEQ ID NO: 62594 - protein, 388 aa, Actinobacillus pleuropneumoniae serovar 1 str. 4074
MNLHEYQAKQIFAQYRLPVSKGIVCHSLDDAVSAIHTLAGDTWAAKCQVHAGGRGKAGGVKLVRSEAEIREFCNQWLGQRLVTFQTDKNGQPVNTIYLEETCLIERELYLGAVIDRSSQKIVFMASNAGGMNIEDVAAQTPELIHKATIDPLTGAQAFQGRELAFKLGLSGDQIKQFAHLFVQLAKLFIEKDLALLEVNPLVLTKQGQLLCLDAKMVIDSNALYRHPELKALQDPSQEDAREADAAKWDLNYVALDGNIGCMVNGAGLAMGTMDIVKLHGGRPANFLDVGGGATKERVSEAFKLILSDQNVKAVLVNIFGGIVRCDLIAEGIIAAVNEVGINIPVIVRLEGTNAELGREILANSGLRLIAANTLTQAAQLAVKAAEGK

SEQ ID NO: 62595 - protein, 490 aa, Symphionema montanum
APGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62596 - protein, 484 aa, Sinorhizobium meliloti 1021
MNLKDPSLFRQAALVGETWIEADPKNAIEVNNPATGEIIGRVPKLGAADTRTAIEAAARVQKEWAARTAKERSAVLRRWFELMIENKDDLGRILTMEQGKPLAEATGEIVYGASFIEWFAEEARRVYGDLVPGHQKDKRILVMKQPIGVVAAITPWNFPNAMITRKAGPALAAGCAMVLKPAAQTPFSAIAIAVLAERAGMPKGLFSVITGSAREIGAEMTSNPTVRKLTFTGSTEVGAELYRQSAATIKKLGLELGGNAPFIVFDDADLDAAVEGALIAKFRNNGQTCVCANRIYVQDGVYEAFSDKLAQAVAKLKTGNGMEDGVILGPLIDQPALKKVEEHVADALAKGARVVQGGRRHSLGGTFYEATVLADVTQAMAVAREETFGPVAPLFRFKDESDVIAQANDTEFGLASYFYAKDLARVFRVAEALEYGMVGVNTGLISTAEAPFGGVKLSGLGREGSKYGIEEFMEIKYVCLGGIA

SEQ ID NO: 62597 - protein, 177 aa, Musa acuminata
FGSVYRGEMPDSGAIAVKRLESMRQGEKQFRMEVSTIGTIHHVNLVRLRGFCCEGDKRLLVYDYMPMGSLDSVLFADGREALDWKKRYGIALGIARGLAYLHEKCRECIMHCDIKPENILLDMDMCPKIADFGMAKLLGREFSRVLTTVRGTFGYLAPEWITGSAITPKADVYSYGV

SEQ ID NO: 62598 - protein, 438 aa, Methylophaga alcalica
MDFHTVEKIGGTSMSDYVAVRDNVILKPVHSTSLYQRIFVVSAYGGITNLLLEHKKNGQAGIYGQFANSVNDDGWQASLEQLKQEMLAINATLFDSAETIAKADAFISERLDDTERCLADLQRLCQHGHFSLDGHLATVREMLASIGEAHSAWNTVQLLQQDDINAVFVDLTGWQTDKHMTLDERIETAFAKIDLNTQLPIVTGYAHSIDGLMSTFDRGYSEMTFSRLAVLTNANEAIIHKEFHLSSADPRLVGEDNAVPIGRTNYDVADQLANLGMEAIHPKAAKGLRKNEIPLRVRNTFEPEHAGTLITGDYVSSKPCVEIIAGCKGVYAFEVFDQDMAGEIDSYDKEILAQIRRFKAHIVSKDINANTITHYLTASLKKIRRIRDALQERFPDAEINQQKVAIVSAIGSDMKIPGILAKTVAALAEKNISVLAMH

SEQ ID NO: 62599 - protein, 123 aa, Glycine max
WALLPCAINAACTALVDAGIPLKHLADSGCIILDPTKEEEEKMKAYINLVFPNTIVSVLPERSSQVGSEPMAHGIMTSVTQGAMSVDDYLHCLDRGRAASARLSEFVRKNIGPKSTCEASKAG

SEQ ID NO: 62600 - protein, 339 aa, Trichodesmium erythraeum IMS101
MFGLIGHLTNLEHAQSVARDLGYPEYADQGLDFWCSAPPQIVDTIKVTSITGQKIEGKYVESCFLPEMLASSRIKAATRKIMNAMAHAQKHGIDITALGGFSSIVFENFNLQKFKQIRNITLEFKRFTTGNTHTAYIVCQQVEQGAQKLGIDLSKATVAVCGATGDIGSAVCRWLNTKTEVEELLLIARKQERLNALQKELKRGKILELNSALPMADIIVWVASIPEALEINPNVLKKPCLLIDGGYPKNMATKVQQEGIYVLNGGIVEHSLDIDWKIMKIVNMEVPGRQLFACFAESMLLEFEKLYTNFSWGRNLITVEKMELIGKLSVKHGFKPLML

SEQ ID NO: 62601 - protein, 294 aa, Mycobacterium avium subsp. paratuberculosis K-10
MGVVVIGQIGRDLVLRTDRPPTAGESATVLRREELLGGKGANQAVGLAQLGVPVALIGVVGDDQAGTSILQQAQRDGIDVSKVARRGTTALLVDVVAAPPERMLLEDVPDSSLVRVADLDRSSSLFDTADTVSIQLQQPAATALEAAQRARQRGLRVVADGVPAPQVRADLLATLDVLRADATEASIIAGTEITTVEQAFELADHLLSGGPELVALAVPDVGDLLTWRGGSELFEFADVEVVDPTGAGDAFVAGLVAALRDGAAPREAGRRAAAAAGATVQRLGGRPDLTGLRA

SEQ ID NO: 62602 - protein, 592 aa, Myxococcus xanthus DK 1622
MSHPVSGLSGTDPSEVAPAPSLALVTERPAPLELTTRALGMGLLIGGLLAITNVYMGLKTGWWESGSVTAAVLGFSALASVSRRRGAPYTPLENNLTQTAAAAVGAMPAAAGLLGALPALALLGTSVPGWGVAVWSVALGVLGVLAAHLLRRRLVAQEALPFPTGIATAELITAMHASTGDTVRAGRGRLLAGAGVAAVAVTAARDAFKWLPGMTALPGTLAGLPAASLTWGVGWSPMLLAIGMMTGPRLGLSMLAGAAVAWGLLAPGLAGMGALADTRYETLSAWLTWPGVGLMVGSALAALLAQARDFLSAARDVSSLGRGAAVPSWALGAGLAACVLAVVVGSALFGLGVPYMLLALVLVLPLCAVCARGAGQVDVSPVTQMGQVTQVIFGALLPGAMAPNVAAGAVVSGAAAQTGVSMWSLKAGHLLGASARHQLAAQLVGVLAGSVVGVPVYLLLSRTYGLGSEALPAPFAHQFRAVAEVAVRGLDGLPPHAALAACVAVGVGALLTWVSRGRAARWLPLPVALGIGFILPAYYAVTLCLGALGLAAARWRWPQAADRNTSTLAAGAIAGESLAGVLIAALMAFGLT

SEQ ID NO: 62603 - protein, 141 aa, Triticum aestivum
  misc_feature (2)..(2): Xaa can be any naturally occurring amino acid
  misc_feature (7)..(7): Xaa can be any naturally occurring amino acid
VXYITAXKFDKDANTGYATDKDGIPDGWQGLDCGEESVKLYKEAIADAKTILWNGPAGVFEFEKFASGTKATLDAVVDAVQKDGKIVIIGGGDTATVAKKYGVEDKISHVSTGGGASLELLEGKELPGVTALSSWAGKASL

SEQ ID NO: 62604 - protein, 509 aa, Myxococcus xanthus DK 1622
MRAPAPTPKRTVYTEAMEIFHRAADLIALDKRVRLELEEPDYEHIFYVTAKLKDRLVPLSEEKARTFSNLPETQVRNKEGLELLANGNIILNGRALLGSDVDIRQGHLRLPDGKVYQLVPGESQRFKAYRVQHNQARGPYKGGLRYHREVSLDLFKALAAEMTWKTAIAEVPFGGGKGGIQIDPREYGREEIEAITLRFMYRLKSMIGPDIDIPAPDVGTNPGIMALLYRQYSDGERERHNLRGIVTGKDVRIGGSEGRHKATGQGVAFCIEDYYADRGESVKGKTFIIQGFGNVGSHAANILSQMGARLLAVNDADGTIFNGDGIDVTALSAYVQDPKNLKRSVLGFPGAQRIEKKDLWDVQADILVPAALGGEITADVAERLRVKLVAEGANGPTTPEADRILEKRGIELIPDIIANAGGVTVSYYEWIQNKRMERWSEAEVDQRLERAMKRNYRIIRDISRNQPRKTEMHDSRQYCIGETVDTRCAAMILALKRIEAHYLLEGFSQ

SEQ ID NO: 62605 - protein, 358 aa, Oryza sativa Japonica Group
MSAYCGKYKDELIKNAAYIGTPGKGILAADESTGTIGKRFASINVENVEENRRSLRELLFCTPGALQYLSGVILFEETLYQKTKDGKPFVDVLKEGGVLPGIKVDKGTIEVAGTEKETTTQGHDDLGKRCAKYYEAGARFAKWRAVLKIGPNEPSQLAIHLNAQGLARYAIICQENGLVPIVEPEILVDGPHDIDPCAYVSEVVLAACYKALNEHHVLLEGTLLKPNMVTPGSDAKKVSPEVIAEYTVRTLQRTVPAAVPAIVFLSGGQSKEEATRNLNAMNKLSTKKPWSLSFSFGRALQQSTLKAWSGKAANIEKARAAFLTRCKANSEATLGTYKGDAVLGEGASESLHVKDYKY

SEQ ID NO: 62606 - protein, 408 aa, Prochlorococcus marinus str. MIT 9301
MVQVNENYLKLKAGYLFPEIAKRVKAYSQSNKSADIIKLGIGDVTEPLPRACIEAMGKALDEMGTTDGFKGYGPEQGYSWLREKISEHDFISRGCQISSEEIFVSDGSKCDSSNILDILGKDNSIAVTDPVYPVYVDSNVMTGRTGDSLENGTYKGLTYLAINEDNNFLPELPEKKVDILYLCFPNNPTGATINKADLKKWVDYALQNKSLILFDAAYEAFIQDDNIPHSIYEIEGAKDCAIEFRSFSKNAGFTGVRCAFTVIPKNLKGLSSTNEEIDLWPLWNRRQSTKFNGVSYVVQRGAEAVYSLEGKKQVKGLIDFYMENAKIMKNKLQNAGYKVYGGDNAPYIWIKVPDQMSSWDFFDFLLQKVGVVGTPGSGFGLAGEGYFRLSAFNSRSNVLDAMERIINI

SEQ ID NO: 62607 - protein, 407 aa, Parvularcula bermudensis HTCC2503
MTDFDVDRFRQQFPILSRDIGKSPLAYLDNAASVQKPQAVIDAMATAMATSYANVHRGLHTLANETTAAFEEARTIAANYLGAASQDEIVFCSGGTDAINLVANSLGQDHIGEGDEIILSVMEHHSNIVPWHFLRERKGVVLKWLDVDENGHIDIEAYKANLSPRTKLVAITGQSNVLGAFPDVRTMADLAHDVGALLLVDGCQHAVHGPVDVQALNCDFYVLTGHKTYGPTGIGVLYGRQSVLEGMPPFRGGGEMIDRVDLDGVTYNEPPHRFEAGTPPILEAIGLGAALSWVMEQDHEGLRSHERALTDHAMEALRSTNIVTLYGASPEKGPIVAFNLKGAHPHDVATLLDNKGVAVRAGHHCCQPLMARLGVTATARASFAPYNTHDEVDALVDACVKAHNLLN

SEQ ID NO: 62608 - protein, 148 aa, Vibrio cholerae O1 biovar eltor str. N16961
MLNWQQVLDFANQGNPKPEREVTRSDEEWRTLLDEQQYYVMRQHGTERAFSNAMCELFEPGLYQCAGCQTLLFDSATKFDSGTGWPSFSQPVKFNAISYHMDQSLARARVEVRCNTCESHLGHVFPDGPPPSGLRYCINSVAVNKLSA

SEQ ID NO: 62609 - protein, 468 aa, Saccharophagus degradans 2-40
MSEKTLNLIKESEATWLDLRFTDTKGKEQHVTIPASYVDEEFFENGQMFDGSSIAGWKGINESDMILMPDDSTAMLDPFTDEATVILRCDIVEPSTGQGYERDPRSVAKRAEEFLKSTGLGDTAFFGPEPEFFVFDDVKWGADMSGSFVKINSEEAAWSSGSKFTDGNLGHRPRVKGGYFPVPPVDSLHDIRASMCNAMMQMGLDVEVHHHEVATAGQCEIGVKFNTLVKKADEVQILKYCVHNVAHAYGKTATFMPKPIVGDNGSGMHVHQSYWKDGVNQFAGDGYAGLSETALYYIGGIIKHAKAINAFSNPGTNSYKRLIPGFEAPVMLAYSARNRSASIRIPYVPSPKGKRIEARFADPIANPYLCFAAMLMAGIDGVKNKIHPGDAADKDLYDLPKEEADKIPQVCGSLREALDNLDKDREFLTQGGVFTDDMIDAYIELKMEDVFKIEHTTHPLEFDLYYSV

SEQ ID NO: 62610 - protein, 195 aa, Oceanicola granulosus HTCC2516
MAREPNRRDGGRGRRDRDENPEFADRLVAINRVSKTVKGGKRFGFAALVVVGDQKGRVGFGKGKAKEVPEAIRKATEQAKRQMIRVALREGRTLHHDIEGRHGAGRVVMRTAPQGTGIIAGGPMRAVFEMLGVQDVVAKSIGSQNPYNMIRATLDGLKAEQSPRNVAQRRGKKVADILPKRDEAPEASAQVAEEA

SEQ ID NO: 62611 - protein, 319 aa, Salmonella enterica subsp. enterica serovar Paratyphi B str.
MKAMNKVWVIGDASVDLVPEKQNSYLKCPGGASANVGVCVARLGGECGFIGCLGDDDVGRFLRQVFQDNGVDVTFLRLDADLTSAVLIVNLTADGERSFTYLVHPGADTYVSPQDLPPFRQYEWFYFSSIGLTDRPAREACLEGARRMREAGGYVLFDVNLRSKMWGNTDEIPELIARSAALASICKVSADELCQLSGASHWQDARYYLRDLGCDTTIISLGADGALLITAEGEFHFPAPRVDVVDTTGAGDAFVGGLLFTLSRANCWNHILLAEAISNANACGAMAVTAKGAMTALPFPDQLNTFLSSHSLAQAMTVK

SEQ ID NO: 62612 - protein, 555 aa, Magnaporthe grisea 70-15
MAAEVVPLQQLKLPAGPSPVTAEQKYWKSFTNQKSHTSTASWPVTHISFPAPGYSSATSTTAVKNNDVFAVTAGPRVDVYSIRRREPLKTISHFDTAARSGEIRPDGRVLLAGEDSGRMQVFDVAGSTRAALRTWNIHKQPVWVTKWSPRPGDLTTLMSCSDDKTVRLWDLPSADPTRTFVGHQDYVRSGAFMTGPAATGSGNILVTGSYDSTVRLWDARVPGPAVLTFQHTAPIEAVLPLPSGTTILAASGNSISVLDVVHARPLRTITNHQKTVTSLCLASNGRRVLSGGLDGHVKVYDAESGGWNVVASTKYPSPVTSLSVISAGANAADRHLAVGMASGLLNIRTRLTGTAADRERELEVARTMTEVSDLRAIDAARDKRKRAAQHSLALDKAGLSADFVIDATGGKGRKTRAAKEPRWQKDLRQQKYRQALDRVLDVTSPDHSRMAVLTLLTALRHRSALVHALEGRDEETVQPILAWVTRHVVDPRYVSVCVDVGLHLLDLYAEYADRSPELEQGFRMLRSQVIKEVERAQMACQTGGMLETLMVSSEA

SEQ ID NO: 62613 - protein, 513 aa, Arabidopsis thaliana
MEALNSILTGYAVAALSVYALWFYFLSRRLTGPKVLPFVGSLPYLIANRSRIHDWIADNLRATGGTYQTCTMVIPFVAKAQGFYTVTCHPKNVEHILKTRFDNYPKGPMWRAAFHDLLGQGIFNSDGDTWLMQRKTAALEFTTRTLRQAMARWVNGTIKNRLWLILDRAVQNNKPVDLQDLFLRLTFDNICGLTFGKDPETLSLDLPDNPFSVAFDTATEATLKRLLYTGFLWRIQKAMGIGSEDKLKKSLEVVETYMNDAIDARKNSPSDDLLSRFLKKRDVNGNVLPTDVLQRIALNFVLAGRDTSSVALSWFFWLVMNNREVETKIVNELSKVLKETRGNDQEKWTEEPLEFDEADRLVYLKAALAETLRLYPSVPQDFKYVVDDDVLPDGTFVPRGSTVTYSIYSIGRMKTIWGEDCLEFRPERWLTADGERFETPKDGYKFVAFNAGPRTCLGKDLAYNQMKSVASAVLLRYRVFPVPGHRVEQKMSLTLFMKNGLRVYLQPRGEVLA

SEQ ID NO: 62614 - protein, 599 aa, Oryza sativa
  misc_feature (276)..(276): Xaa can be any naturally occurring amino acid
MTTYRVCCFLRRFRAASNEPSEELGDVFQAYADGGGGVMGEEALRRFLREVQGEAAGGGDDELEATAREVMAFAAEQRLLRKGGAAAAGGGLTVEGFHRWLCSDANAALDPQKRVYQDMGLPLSHYFIYTGHNSYLTGNQLSSGCSEVPIVKALHDGVRVIELDLWPNAAKDAVEVLHGRTLTSPVGLMKCLEAIREYAFVASPYPVILTLEDHLTPDLQSKVAKMIKETFGDMLYVSETENMAEFPSPDELKGKIIVSTKPPKEYLQTKNDADAXDEAGVWGEEITDDKVAATAMTTEEKCAAAEEAVAAAAVDEEMQEAETDKKTQHGVDNEYRRLIAIPLTRRKHDMDQDLKVDPDMVTRLSLGEKAYEKAIVTHGAHIIRFTQRKLLRIFPRSTRITSSNYNPLMGWRYGVQMVAANMQGHGRKLWLTQGMFRANGGCGYVKKPDILMNNDPDKLFDPTSKLPVKTRLKVTVYMGDGWRFDFRKTHFDKCSPPDFYARVGIAGVEADTRMEQTKVKMDTWIPAWDHEFEFPLSVPELALLRVEVHESDNHQKDDFGGQTCLPVWELRRGIRSVRLCDHRGEPLRSVKLLMRFDFT

SEQ ID NO: 62615 - protein, 229 aa, Ralstonia eutropha JMP134
MSVIAANLQAVYRGIAAAAQQAGRTPEEVVLLAVSKTVAPGIVREAFEAGQRAFGENYVQEGVEKIVALADLRSQITWHFIGPLQSNKTRLVAEHFDWVHALDRLKIAQRLSEQRPAGMAPLQVCIQVNISNEASKSGVAPGEVPELARAVAALPGLRLRGLMAIPEPATDPAAQREPFTAMRNLLQSLQAEGLQLDTLSMGMSGDMNAAIAEGATIVRIGTAIFGARA

SEQ ID NO: 62616 - protein, 63 aa, Glycine max
NSVNRLGISYPELTEMQARAIFQAAVSVSNHGITVLPEIMVPLIGTPQVWSFFLLISSLVCVF

SEQ ID NO: 62617 - protein, 324 aa, Burkholderia vietnamiensis G4
MPKAIRYDQPGGPEVMKWVDVEVGEPKAGEVRIRQHAVGLNYIDVYFRTGLYPQPLPGGLGMEAAGEVTAVGDGVSALKAGDRVAYVGQPPGAYAQERVMPAERLVKLPDALGYDDAASVMLQGLTAHYLLRRTYPVKAGDTILIHAAAGGVGLLVCQWAKALGATVIGTVGSDEKAALASAHGCDHPIVYTRENFTQRVKEITNGAGVPVVYDSIGKDTYIGSLDCLAPLGYFVSFGNASGPLPPIDSKDFSSRGSLFFTRPTLFSYIAKRADLEAAAAELFDVILSGKVKTSINQRYPLAEVGRAHADLESRKTTGSTVLVP

SEQ ID NO: 62618 - protein, 278 aa, Ralstonia eutropha JMP134
MLDTLTFGFLGGGNMATALISGLIARGVPAGSIRVVDPFPDAQQRLVRDLRVHVAGAPDAAFGGSDVLVLAVKPQQFREAAASLLPHLPATGAGNLIISVAAGIRLQDMERWLGGRTRLVRAMPNTPALSGMGMTGLAAPAGLSQHDRAIASAVAEAVGKSAWVDGDEQIDAVTAISGSGPAYVFYFIEAMERAATELGLTTQQGRELAVQTFLGAATLAGQSTEPVATLRERVTSKGGTTYAALTAMESAGIGDAFVRAMQAAAARGKEMGEEFGKD

SEQ ID NO: 62619 - protein, 742 aa, Yarrowia lipolytica
MSDQFNQDFANKANINEQGQGQGQGQQGQGYGQYQAPQQFVPGQSFVPGQSFVPGQSFAPQGGYDQYQGQGGYQGGYQGGYQGGYQGNNRGGYSGRGRGGYRGGYQGGYNNQYGNQGGYQGGYQGGYDNQYGNQGGYQGGYDNQYGYDQPEEPQEKTLTLEEYQKQKQEALNKLKKPKVGGALKIGGDKPKAGGALKIGGDKPASTGGALKIGGDKPKTSGGALKIGGDKPKSGGVLKIGGDKESEKKEAVSKEASPAPKESTPKESTPAPASKESTPSAAEKKEAAENAASADALIAAQNAEIDQETIKEMFGETKDHMSIIFMGHVDVGKSTLGGQILYLTGTVNKRTIEKMEKEAADAGRPGWYLSWVMDINKEERAEGKTVEVGRSYFETEKRRYTLLDAPGHKMYVPSMIGGAAQADAGILVISARKGEYETGFERDGQTREHAMLAKTQGINKLVIAINKMDDSTVNWSKERYDECINKLKLYLKGLGYSDKTEITFMPVSGFTGANVKERVSKEVCPWYDGPSLLELLDSFELERNLTGPFMLPISNKEKNLGTIVEGKIEVGQVKKGDNLVVMPSKVPVEVTTLYKETEQEVGGASVGEQIRLKVKGIEEEEVQIGQVLCSAAQPVAAVTVFEAQIAITELKSILSTGFSCVMHIHTAAEEVTFTALLHKLEKGTNRKSKKPPAFAKKGMKIIARLETQNPVCMDEFSKTPQLGRFTLRDQGQSIAIGRVTKLC

SEQ ID NO: 62620 - protein, 447 aa, Poncirus trifoliata
IGGGVGGGIALALVVGFCVFAASRCRRQGKDPSSSDAQSGWLPLSLYGNSHSAGSAKTNTTGSYASSLPSNLCRHFSFAEIKAATNNFDEALLLGVGGFGKVYRGEIDGATTKVAIKRGNPLSEQGVHEFQTEIEMLSKLRHRHLVSLIGYCEENCEMILVYDYMAYGTLREHLYKTQKPPLPWKQRLEICIGAARGLHYLHTGAKHTIIHRDVKTTNILLDEKWVAKVSDFGLSKTGPTLDHTHVSTVVKGSFGYLDPEYFRRQQLTEKSDVYSFGVVLFEILCARPALNPTLPKEQVSLAEWAAHCHKKGILEQIMDPYLKGKIAPECFKKFAETAMKCVSDQGIERPSMGDVLWNLEFALQLQESAEESGKVPGGGMDIEEGAFDVDCKGKKDPNACSGFNGNITDSRSTGMSMSIGGRSLASEDSDGLTPSAVFSQIMNPKGR

SEQ ID NO: 62621 - protein, 472 aa, Enterococcus faecalis V583
MARKSRIKTPIAEQAPTIRKNNFEEVCLGYTLAEGQEEAIRCLQCKNAPCIAKCPVMIDIPGFILAIREGNMEQAADILSKYTNLPAICGRVCPQEKQCEQVCKLGKAKNFEPVAIGKLERLVADWALENHKFPKKTAEPTKGKIAVVGSGPSGLTVAGDLSKLGYEVIIFEALHEAGGVLTYGIPEFRLPKKIVKQEIASIEALGVTIETNVVVGKTITMEEIMSEFDACYLSVGAGAPNFMGIPGTSLNGVYSSSEFLTRINLMHSYEFPEYDTPIKRAKNVVVIGGGNVAMDAARSAKRLGAENVNIVYRRSLEELPARIEEYHHSLEEGINYYWLTNPIAYLDDQQGNLAGVECVKMVLGEPDASGRRRPEPIPNSTFTIPADAVIEAIGQGANRVLLSTYPEIELNQWGYIQADPKTGATSIPGVFAGGDIVTGAATVILAMGAGKIAANAIDQYVKTQKTTVTSNV

SEQ ID NO: 62622 - protein, 375 aa, Shigella flexneri 2a str. 301
MLNTGHLHPKVVAAVEAQLKKLSHTCFQVLAYEPYLELCEIMNQKVPGDFAKKTLLVTTGSEAVENAVKIARAATKRSGTIAFSGEYHGRTHYTLALTGKVNPYSAGMGLMPGHVYRALYPCPLHGISEDDAIASIHRIFKNDAAPEDIAAIMIEPVQGEGGFYAASPAFMQRLRALCDEHGIMLIADEVQSGAGRTGTLFAMEQMGVAPDLTTFAKSIAGGFPLAGVTGRAEVMDAVAPGGLGGTYAGNPIACVAALEVLKVFEQENLLQKANDLGQKLKDGLLAIAEKHPEIGDVRGLGSMIAIELFEDGDHSKPDAKLTAEIVARARDKGLILLSCGPYYNVLRILVPLTIEDAQIRQGLEIIGQCFDEAKQ

SEQ ID NO: 62623 - protein, 305 aa, Helicobacter pylori J99
MILTAMQDAIGRTPIFKFTRKDYPIPLKSAIYAKLEHLNPGGSVKDRLGQYLIKEAFRTRKITSTTTIIEPTAGNTGIALALVAIKHHLKTIFVVPKKFSTEKQQIMRALGALVINTPTSEGISGAIKKSKELAESIPDSYLPLQFENPDNPAAYYHTLAPEIVQELGTNLTSFVAGIGSGGTFAGMAKYLKERIPNIRLIGVEPEGSILNGGEPGPHEIEGIGVEFIPPFFANLDIDRFETISDEEGFSYTRKLAKKNGLLVGSSSGAAFAAALKEVQRLPEGSQVLTIFPDMADRYLSKGIYS

SEQ ID NO: 62624 - protein, 524 aa, Solanum lycopersicum
MDTCCAAMKSTVHLGRVSTGGFNNGEKEIFGEKIRGSLNNNLRINQLSKSLKLEKKIKPGVAYSVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDSRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCTVEHSIVGERSRLDCGVELKDTFMMGADYYQTESEIASLLAEGKVPIGIGENTKIRKCIIDKNAKIGKNVSIINKDGVQEADRPEEGFYIRSGIIIISEKATIRDGTVI

SEQ ID NO: 62625 - protein, 443 aa, Rhizobium sp. NGR234
MYRTNTPNLENYWMPFTANRQFKAAPRLLASAEGVYYRDIDGNQVLDGTAGLWCVNAGHARKEISQAVERQLNTLDFAPSFQMGHPIAFQFAEKLAEIAPGEPGKKLDRIFYTGSGSESVDTALKIAIAYQRAIGQGTRTRLIGRERGYHGVGFGGISVGGLVNNRRVFPQVPGADHLRHTHDLARNPFTKGGLPEHGAELADDLERLVALHGAETIAAVIVEPVAGSTGVLLPPKGYLERLRATADKHGILLIFDEVISGFGRLGAPFAVDYFGVTPDIITTAKGLTNGVVPMGAVFTSSKVHDALMHGPEAQIELFHGYTYSGHPVACAAGLAAMEIYEKEALLTRASELATYWEDAVHGLRSRKNVIDIRTIGLVAGIELASRSEAAGARAYDVFVDCFKRGLLIRVTGDIIALSPPLTIEREQVDELMSILADALDRAD

SEQ ID NO: 62626 - protein, 788 aa, Azoarcus sp. EbN1
MTRYVIPFTELRMSDVEQVGGKNASLGEMISQLPASVRVPGGFATTADAFREFLAHQGLAGRISAALETLDVDDVNTLAKTGAQIRQWIVDTPFPANLEEEIRTAYNALTAEGEGSFAVRSSATAEDLPDASFAGQQETFLNIHGYEHILHAMKEVFASLYNDRAISYRVHKGFTHAEVALSAGVQRMVRSDTGASGVMFTIDTESGFNDVVFITASYGLGETVVQGAVNPDEFYVHKSTLALGKPAVIRRNLGSKLIKMVFADKKEAGKSVRTVDVAEADRVKFSLTNEDVLELARYAVIIEKHYGRPMDIEWGKDGGDGKLYILQARPETVKSQSSGHVMEKYRLKQYGKSLTHGRAIGQKIGVGTVRIVADASEMSRVQAGDILVTDMTDPNWEPVMKRASAIVTNRGGRTCHAAIIARELGIPAIVGCGNATEVLDEGDSVTVSCAEGDTGYVYRGRLDFEVVTTDMGNLPEIPVKIMMNVGNPELAFEFAQIPNGGVGLARLEFVINNMIGIHPKAILELGQVPASLRDEILRRSRGYATPKQFFIEKLVEGVATIAAAFYPKPVIVRMSDFKSNEYRKLLGGEIYEPEEENPMLGFRGASRYIAHSFRDCFELECTAMKKVRNELGLTNVQIMIPFVRNVEEAAGVVELLAEHGLKRGVNDLKLIMMCEIPSNALLADAFLEHFDGFSIGSNDLTQLTLGLDRDSGLVAHAFDERDPAVKQLLSMAIQSANRLGKYVGICGQGPSDHADFAEWLMDEGIQTISLNPDTVIDTWLKLAAHVKN

SEQ ID NO: 62627 - protein, 367 aa, Gentiana lutea
MVDSWVVQSHSVFHTPISLFRSFLGFLCKPMNYNKIGSNLIEKKKLISSFSVASLITKEEEAMGGPKASNYFDFKAYLIEKANKVNEALDQAVSVKNPPMIHEAMRYSLLAGGKRVRPILCIAACELVGGEESNSVPAACAVEMIHTMSLIHDDLPCYGQRDLRRGKAHETTKSSCEDVAVLAGDSLLAFSFEYIATATKNVSPAKNFSRSRRISKSIGTEGLVAGQVADFVINGENQMFGLDQLEFIHIHKTAALLEAAVVLGAILGGGNPEEVEKLRRFARCIGLLFQVVDDILDVTKSSEELGKTAGKRSCGGKTTYPKLMGLDGAREFADKLNKDAKNQLSEFDREKAAPLLALADYIAYRQN

SEQ ID NO: 62628 - protein, 527 aa, Solanum habrochaites
MDTCCAAMKSTVHLGRVSTGSFNNGEKEIFGEKMRGSLNNNLRINQLSKSLKLEKKEKKIKPGVAYAVITTENDTETVFVDMPRLERRRANPKDVAAVILGGGEGTKLFPLTSRTATPAVPVGGCYRLIDIPMSNCINSAINKIFVLTQYNSAALNRHIARTYFGNGVSFGDGFVEVLAATQTPGEAGKKWFQGTADAVRKFIWVFEDAKNKNIENILVLSGDHLYRMDYMELVQNHIDRNADITLSCAPAEDSRASDFGLVKIDNRGRVVQFAEKPKGFELKAMQVDTTLVGLSPQDAKKSPYIASMGVYVFKTDVLLKLLKWSYPTSNDFGSEIIPAAIDDYNVQAYIFKDYWEDIGTIKSFYNASLALTQEFPEFQFYDPKTPFYTSPRFLPPTKIDNCKIKDAIISHGCFLRDCSVEHSIVGERSRLDCGVELKDTFMMGADYYQTESEIASLLAEGKVPIGIGENTKIRKCIIDKNAKIGKNVSIINKDGVQEADRPEEGFYIRSGITIISEKATIRDGTVI

SEQ ID NO: 62629 - protein, 370 aa, Rhizobium sp. NGR234
MKSRAAVAWAANKPLSIETIEIGGPKTGEALIEIMATGVCHTDAYTLSGLDSEGKFPAILGHEGAGIVREVGPGVTSLRPGDHVIPLYTPECRECKTCLSQRSNLCTSIRATQGQGLMPDRTTRFSCDAGEIFHYMGCSTFSNFTVLPEIAIAKVREDAPFDKICYIGCGVTTGIGAVIHTAKVWPGANVAVFGLGGIGLNVIQGARMVGADRIIGVDLNPAKAEMARRFGMTDFVNPNEVGTGKVVEAIQDLTGGGVDFSFDATGNTNVMRQALECCHRGWGESIIIGVAEAGKEISTRPFQLVTGRVWKGTAFGGARGRTDVPQIVDWYMEGKINIDDLITHTMPLDEINTAFDLMHEGKSIRSVVLF

SEQ ID NO: 62630 - protein, 258 aa, Picea sitchensis
MPYPFQRVEVGRADETYHPDTLRAALAEFISAIIFVFAGEGSVIAFSKLSHDGSTTPAGLVAEALAHGIALFIAVAVASNISGGHVNPAVTFGALVGGHITLVRGIFYWIAQMLGATVACGLLKYTTNGMSIGVFSLSSGVGLGNALVFEIVMTFGLVYTVYATAIDPNRCSLGTIAPICIGFIVGANILAGGAFDGACMNPARAFGPALVSWTWKNHWIFWVGPLIGGGLAGAVFEVFFIEARPTTNGCPCRRYDGI

SEQ ID NO: 62631 - protein, 455 aa, Nostoc sp. PCC 7120
MSRHTDYSSLEQIQTTGADAPKPLLTLSDAVALIVGIVIGVGIFQTPALVASQAGSDTAVLLFWLAGGIVSIIGALCYAELATTYPNVGGAYYYLKRAFGQNTAFLFAWARLTVIQTGSIALAAFVFGDYASEIWRLGTFSSSMYAAVIIALLTILNILGLHQGKWTQNLLTAAQVLGLLLVVLFGLASTANSANSAVSPEPSSSGSWGLAMVFVLLSYGGWNEAAYISAEIKNRQRNILRSLMWSIGIITAIYLLINLAFLRGLGLANMANSSAVAADLMRAVWGTPGVVFISLLIAICALGTINASIFTGARTNYALGQDFNLFGFMGSWRQIPSTPATALLVQGAIALALVVLGTFTRKGFETMVDYTAPVFWFFFLLSGISLLILRQKEPHIPRPFRVPFYPITPLLFCAVCGYLLYSSVVYTNVGAVVGVLVVIAGVPLLFWNRYRQGKA

SEQ ID NO: 62632 - protein, 176 aa, Musa x paradisiaca
WVGVQGRDTGSGAIAVKRLESIRQGEKQFRMEVSTIGTIHHVNLVRLRGFCCDGDKRLLVYDYMPMGSLDSVLFADDREALDWKKRYRIALGIARGLAYLHERCRECIMHCDIKPENILLDMDMCPKIADFGMAKLLGREFSRVLTTVRGTIGYLAPEWITGSAITPKADIYSFGV

SEQ ID NO: 62633 - protein, 545 aa, Bifidobacterium longum DJO10A
MTNQTFEQLKKTYESGRTRPLAWRRAQLNALRRLVTENRDAFVSSAMADLGKPAAETVLMELNLVAGEAQFVRNRLGLWTARHPKAMHWMLQPAAGWTIAEPKGVVFIISPWNYPVLLALEPMADALAAGNAVCLKPSELSPNTSKLLAELVPQYLDTEAVRVVEGGPKETGDLLKNPFNHIFYTGGGHVGKIVMRAAAENLTPVTLELGGKSPCFVDRTADINVAARRIAWGKFTNAGQTCVAPDYVLATPDVAEALVKRIAVAVTEFYGEDPKASPDFGRIINDRHFERLCKLLPVGTVPPEEPSSPLVQVASAVGAAMDMVGRRFNAVTTGRGGAGEMAGSANNAAKPTAGSNMAAADDGATASAAVEPSEIHKVPGVFDPAGRIVCGGKVDRAARYIAPTVLYGTSPDAPVMKEEIFGPILPILVVEDAESAIRFINKRSRPLAAYVFSRDHEVRLTFERQTSSGALGYSLPLGHLLSSRLPFGGVDASGIGTYHGKAGFLTFSHVKTVVTKPQFPDTLRLVYPPFNEAKAKLFDIIAKFS

SEQ ID NO: 62634 - protein, 281 aa, Prochlorococcus marinus str. MIT 9301
MRKQVAYLGPKGTYAEKAAHILSKLANFQTPIFVPCNGLHSVIKSLAYNICDAAVVPIENSVEGGVTATLDSLWKFPEIFINKAIVLPIKHALISDGELSNISEVLSHPQALAQCSEWLSENLPNAIPLPTNSTSEAVNMVKGSKFRAAIGSKSLIQIEGLKELAFPINDVPGNCTRFVLLSKESNSNLANIASFAFSLISNKPGALLKAINYIADFGFNMSKIESRPSKRELGEYIIYIDLEINNQNNIANFLELKNKLEPLCNNLVDFGSYFSKNIELN

SEQ ID NO: 62635 - protein, 270 aa, Zea mays
CDAVPFVIGPGMRRDGTTRFRDARGSPLHDLLAVSSFSEYTVVDVNQVVKVDPAVPPKLACLLSCGAGTGVGAAWRSAKVEPGSTVAIFGLGSVGLAVVQGAKMCGASKIIGVDLNPDKEEVGRSFGVTDFVNPSQLDKRSVVEVIVEMTGGGVDYSFECIGVPSVMTDAFRCTKMGKGKTIVLGLGRDSDEVCLPSLELLFGRCVMGSLFGGLKPKTHIPVLAKKCMDKELQLDALVTHELGLQDINKAFDLLLQGKSLRCILWMDKDK

SEQ ID NO: 62636 - protein, 468 aa, Nostoc sp. PCC 7120
MKTPPINQKSLRETESWKLLESSIIYYEGNPIGTVAAQDPELAALNYDQCFLRDFVPSAFVFLMDGQTDIVRNFLIETLTLQSHEKEMDCFQPGAGLMPASFKVESDGSKEYLVADFGEKAIARVPPVDSCMWWILLLRAYEKATGDLTLAREPKFQAGIKLILDLCLAHRFSMYPTMLVPDGAFMIDRRMGVYEHPLEIQVLFYAALRAARELLLPDGDGEQYLNKVHGRLGALQYHIRNYYWVDLKRLREIYRYKGNEFGKEIANKFNIFSQSIPDWVIEWLPEKGGYLAGNLGPGRMDFRFFALGNLMAILAGLASEEESQRIMNLFAHRWEDLIGYMPVKICYPALQGLEWQIVTGCDPKNIPWSYHNGGNWPVLLWLFTAAALKTGKVELAHEAIAIAEGRLSNDKFPEYYDGNNGRLIGKEARIYQTWSIAGLLVAKQFLANPDHVEFISFPDTFIGPGCSL

SEQ ID NO: 62637 - protein, 177 aa, Musa x paradisiaca
FGSVYKGEIPDSGAIAVKRLESIRQGEKQFRMEVSTIGTIHHVNLVRLRGFCCEGDKRLLVYDYMPMGSLDSVLFADDREALDWKKRYRIALGIARGLAYLHERCRECIMHCDIKPENILLDMDMCPKIADFGMAKLLGREFSRVLTTVRGTIGYLAPEWITGSAITPKADVYSFGV

SEQ ID NO: 62638 - protein, 177 aa, Musa x paradisiaca
FGSVYRGELPDSGAIAVKRLESVRQGEKQFRMEVSTIGTIHHVNLVRLRGFCCEGDKRLLVYDYMPMGSLESVLFADGREALDWKKRYGIALGIARGLAYLHEKCRECIMHCDIKPENILLDMDMCPKIADFGMAKLLGREFSRVLTTVRGTIGYLAPEWITGSAITPKADVYSYGV

SEQ ID NO: 62639 - protein, 272 aa, Actinobacillus pleuropneumoniae serovar 1 str. 4074
MNHQKLAFIGTGNMAYAIIQGLLKSHYPASQIIACNKSNLVRRAELQAVGIATNFTNRAAVEQAEVVVLAVKPQMMAEVCSEFSAVDFSNKTVISVAAGISVARLEQLLPTAKNIIRTMPNTPSLIGEGMTGLFAKKSVNSTACQFAESLMSAVGKCYWVEQEQQINHIIAVTGSSPAYFFRFMEAMQQSAMQMGFSEADARLLVQQAALGAAKLVEANPNTPLSTLRENVTSKGGTTAKALEVFEQHALAETVDQAMWAAIHRAEEMEQQL

SEQ ID NO: 62640 - protein, 407 aa, Zea mays
MAGELRHRRVPSEDGDEGAAASQGPDPAAGNGKAGTASEGAEPRRGKRDALGWLEWGRGWMAVVGEFLFQRIAASHLANPLELPPLDGVSVVVTGATSGIGLEIARQLALAGAHVVMAVRRPKVAQDLIQRWQNQNSETGRPLNAEVMELDLLSLDSVANFADAWNARMAPLHVLINNAGIFAIGEPQRFSKDGHEEHMQVNHLAPALLAMLLIPSLLRGSPSRIVNVNSIMHTVGFVDAEDMNLRKHKYRSWLGYSNSKLAQVKFSSMLHKKIPAEAGIGVVCASPGIVDTNVARDLPKIVVAAYHLIPYFIFDAQEGSRSALFAASDPQVPEYCETLKSEDWPVCACINYDCSPMNASEEAHNLETSQLVWEKTLEMVGLPPDALEKLIAGESVQCRYGQQDTTF

SEQ ID NO: 62641 - protein, 533 aa, Listeria monocytogenes str. 4b F2365
MLTVNNVGLRYGDKKLFEDVSIKFLPGNCYGLIGANGAGKSTFLKVLSGELDSQSGNVHIGSGERLAVLRQDHFQYDNELVLNTVIMGHERLYKIMDEKNAIYMKEDFSDEDGIRAAELEGEFAELDGWEAESDAAVLLNGLGIPTDLHGKLMKDLTGGEKVKVLLAQALFGKPDILLLDEPTNHLDIRAIHWLEEFLINFDNTVIVVSHDRHFLNKVCTHIADLDFSKIKLYVGNYDFWYESSQLAQTMMGDRNKKKEEKMKELQDFIARFSANASKSKQATSRKKMLEKITLEDIQPSSRRYPFIQFKPDREVGNDLLTVTNLSKTIDGVKILDNLSFSINRNDKVALVGDDEVAKTVLFQILAGEMEPDEGSYKWGITTSQSYFPKDNSEFFEENDMSLVEWLRQFSPEDDSEAFLRGFLGRMLFSGDEVLKKVRVLSGGEKVRCMLSKMMLSGSNVLLLDEPTNHLDLESITALNNGLEAFKGAMIFASHDHQLLQTIATRIINLSKDQFYNKEISYDEYLKEVMNVAE

SEQ ID NO: 62642 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQVKKFGCTDFVNPKDHTKPVQEVLVEMINGGVDRAVECTGHIDAMIAAFECVHDGWGVAVLVGVPHKEAVFKTHPMNFLNEK

SEQ ID NO: 62643 - protein, 413 aa, Oryza sativa Indica Group
MDRASENRRLAAVGKPVPGIGEMGNRRPLRDINNLVGAPPHPSAIAKKPMLEKSGKEEQKPALVVSHRPMTRNFAASLTRKEQLDHQVSVADAAVVCTDPQKNPIPDGTVDDDVESCESNDYIAVDECNDTDEDESMMDIDSADSGNPLAATEYVEELYKFYRENEEMSCVQPDYMSSQGDINEKMRAILIDWLIEVHHKFELMDETLFLTVNIVDRFLEKQVVPRKKLQLVGVTAMLLACKYEEVAVPVVEDLVLISDRAYTKGQILEMEKLILNTLQFNMSVPTPYVFMRRFLKAAQSDKQLSLVEYQMLKYRPSLLAAAAVYTAQCALTRCQQWTKTCELHSRYTGEQLLECSRMMVDFHQKAGAGKLTGVHRKYSTFKFGCAAKTEPALFLLESGAGGYNLQKHLQQAC

SEQ ID NO: 62644 - protein, 360 aa, Zea mays
  misc_feature (191)..(191): Xaa can be any naturally occurring amino acid
MAPVDLTPKQPRKAYGGDGGAYYEWSPADLPMLGVASIGAAKLSLAAGGLALPSYSDSAKVAYVLQGTGTCGIVLPEATKEKVVAVKEGDALALPFGVVTWWHNGPAAPTPLTVLFLGDTSKGHRPGQFTNFQLTGATGIFTGFSTEFVSRAWDLPEADAAALVSSQPASGIVRASSSPLPAPSPRDREGXAINCLEAPLDVDIPGGGRVVVLNTANLPLVKEVGLGADLVRIDAHSMCSPGFSCDSAYQVTYIVRGSGRVQVVGPDGVRVLETRVEGGFLFIVPRFHVVSKIADASGMEWFSIITTPNPIFSHLAGKTSVWKAISAEVLQASFNTTPEMEKLFRSKRLDSEIFFAPPSN

SEQ ID NO: 62645 - protein, 507 aa, Juglans regia
MAKPILLSIYLFLIVALFNGCLAQSGGRQQQQFGQCQLNRLDALEPTNRIEAEAGVIESWDPNNQQFQCAGVAVVRRTIEPNGLLLPQYSNAPQLVYIARGRGITGVLFPGCPETFEESQRQSQQGQSREFQQDRHQKIRHFREGDIIAFPAGVAHWSYNDGSNPVVAISLLDTNNNANQLDQNPRNFYLAGNPDDEFRPQGQQEYEQHRRQQQRQQRPGEHGQQQRGLGNNVFSGFDADFLADAFNVDTETARRLQSENDHRRSIVRVEGRQLQVIRPRWSREEQEREERKERERERESESERRQSRRGGRDDNGLEETICTLRLRENIGDPSRADIYTEEAGRISTVNSHTLPVLRWLQLSAERGALYSDALYVPHWNLNAHSVVYALRGRAEVQVVDNFGQTVFDDELREGQLLTIPQNFAVVKRARNEGFEWVSFKTNENAMVSPLAGRTSAIRALPEEVLATAFQIPREDARRLKFNRQESTLVRSRPSRSRSSRSERRAEV

SEQ ID NO: 62646 - protein, 552 aa, Cucumis sativus
MAVSTSFSGAKLEALLFKSASNSSSTRNLSSSHLPGFCKSIRTRRILFQRTGVSSFTPFKCELASSDVLVQNDEIDPPKSSNLSALEQLKTSAVDRYTKERSSIVVIGLSIHTTPVEMREKLAIPEAEWPRAIGELCGLNHIEEAAVLSTCNRMEIYVVALSQHRGVKEVTEWMSKTSGIPVSEICQHRFLLYNNDATQHIFEVSAGLDSLVLGEGQILAQVKQVVKVGQGVAGFGRNISGLFKHAITVGKRVRTETNIAAGAVSVSSAAVELALMKLPEPSHATARMLVIGAGKMGKLVIKHLVAKGCTKMVVVNRSEERVTAIREEMKDVEIIYKPLTEMLSCTAEADVIFTSTASESLLFTKEQVKDLPPVGHDVGGLRLFIDISVPRNVGACINNLEDVRVYNVDDLKEVVAANKEDRLRKAMEAQSIITEESKQFEAWRDSLETVPTIKKLRAYAERIRTAELEKCLSKMGDDIPKKTRRAVDDLSRGIVNKLLHGPMQHLRCDGSDSRTLSETLENMHALNRMFSLETEIAVLEQKIRAKVEQNQK

SEQ ID NO: 62647 - protein, 527 aa, Hordeum vulgare
MAGATSATAAAGAFAAAKARGPAAACPWLVAAGGRRRSGVVRCDAGGDAQAASKAASITALEQFKISADRYMKEKSSIAVIGLSVHTAPVEMREKLAVAEELWPRAISELTSLNHIEEAAVLSTCNRMEIYVVALSWNRGIREVVDWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYRPLTEMYEAAADADVVFTSTASESLLFTKEHAEVLPPISLAMGGVRLFVDISVPRNVGACLSEVEHARVYNVDDLKEVVEANKEDRVRKAMEAQTIITQELKRFEAWRDSLETVPTIKKLRSYADRIRASELEKCLQKIGEDNLNKKMRRSIEELSTGIVNKLLHGPLQHLRCDGSDSRTLDETLENMHALNRMFSLDTEKAVLEQKIKAKVEKTQS

SEQ ID NO: 62648 - protein, 465 aa, Hordeum vulgare
QFKISADRYIKEKSSIAVIGLSVHTAPVDMREKLAVAEELWPRAISELTSLNHIEEAAVLSTCNRMEIYVVALSWNRGIREVVDWMSKKSGIPASELREHLFMLRDSGATRHLFEVSAGLDSLVLGEGQILAQVKQVVRNGQNSGGLGKNIDRMFKDAITAGKRARCETNISAGAVSVSSAAVELAMMKLPKSECLSARMLLIGAGKMGKLVVKHLIAKGCKKVVVVNRSVERVDAIREEMKDIEIVYRPLTEMYEAAADADVVFTSTASESLLFTKEHAEALPPISLAMGGVRLFVDISVPRNVGACLSQVEHARVYNVDDLKEVVEANKEDRVRKAMEAQAIITQELKRFEAWRDSLETVPTIKKLRSYADRIRASELDKCLQKIGEDNLNKKTRRSIEELSTGIVNKLLHGPLQHLRCDGSDSRTLDETLDNMHALNRMFNLDTEKAVLEQKIKAKVEKTQS

SEQ ID NO: 62649 - protein, 504 aa, Bixa orellana
MESTGRAPLGNGRIGNPGGLVVPEIKFTKLFINGRFVDNVSGQTFDTRDPRTGDVLATIAEADKDDLDLAVKNAREAFDHGPWPRMSGYERARIMTKFADLVEAFIEELAALDTADAGKTLSMGKAVDIPAAVQIMRYYAGAADKLHGQPLKMNQDTQGYTLKDPIGVVGHIIPWNYPTMMFFLKNAPALAAGCTMVVKPAEQTPLSALFYAHLARMAGVPDGVVNVVPGFGPTAGAAVSSHMDVDSVSFTGSQEVGRAIMRAAAQSNLKNVSLELGGKSPVIIFDDADVDMAVSLSQLACFTNKGEICVATSRVYVQEGIYDALVKKIVEAAREWRFDTKANMGPQVDKKQFERVLKYIDLGKREGATLLTGGKTNGDKGYYIQPTIFLDVREDMNIAQDELFGPVMALMKFKTVDEAIQKANCTKYGLAAGIVTKELNLANTVSRSIRAGAVWVNCYFGFDPDAPFGGYKMSGFGKDRGVLAIDQYLKAKTVNTAIPNSPWY

SEQ ID NO: 62650 - protein, 274 aa, Zea mays
MAERGGERGGERGGFGRGFGRGGRGDRGGRRGGRRGPRQEEEKWVPVTKLGRLVKESKINKIEEIYLHSLPVKEHQIIETLVPGLKDEVMKITPVQKQTRAGQRTRFKAFVVVGDGDGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPEFWTQTKFSMTPFQQFTDLLGKPTKGLVLEAPTETAEA

SEQ ID NO: 62651 - protein, 311 aa, Oryza sativa
  misc_feature (288)..(288): Xaa can be any naturally occurring amino acid
MAPMAGGGGVPWGDRARVVGAQIRSRFRVGVAPVDRRWLWRRGDGRVASEAVRQWTERVRSLWQREKSTDQISSSPGTSQVAAAAKPSSSALRFYRKKVGKEVDGIEDSVIFRSLQALAVPLIGNACHIFMHGLNSVQEFLQIYGAEKLQQALQERPKGKPLLTVSNHVAAMDDPFVIASILPPSVMLEAQKLRWTLCASDRCFTNPILSTFFRSVKVLPVSRGDGIYQKGMDMALSKLNNGGWVHIFPEGSRSKDGGKTVAPAKRGVGRLVMDADSLPVVIPFVHTXNAGYNACRKTYSKSRQKGDCGCW

SEQ ID NO: 62652 - protein, 382 aa, Enterococcus faecalis V583
MKDLVYLNYAATSYKKFPATIEALTAYLAENQFMNYGRNAPLLREGLPLLETRQLLADFFQAPSAAQITFTNNATTSLNLALAGILQPGDHVITTMLEHHAVARPLHLLEKERGISVTYVACQKTGLLEVEDIQRAWRTNTKALVMTHASNVLGTILPIEECFQWAQQKGLLTILDAAQTAGFLPIKMTQMAIDVLAFTGHKSLYGLAGIGGLAFSERGAEAVKPLMAGGTGSHSNSFDQPSFLPDKFEAGTLNSLGILSLNSSIKELNKIGLAAIQKHERTLMQNFLNGLSGLPVTILGTKDVAQTVPVVSITLWNQEETIVAQQLAEQYGIMTRAGLHCAPLAHQTAGTLATGTLRFSFGWQTTPEEITWTIHALQELLI

SEQ ID NO: 62653 - protein, 515 aa, Clostridium josui
MQLGRHNSGSIKKRLEMYILSIISASLDYKSAAIDIRERFSYTSTRIREILRRIKAADGVSGAVLLCTCNRTELYISGDNIENMNPALLLCQLSGEEDHKSLMTLFSIRHDSEAIFHLMEVACGLQSMVLFEDRVITQVKNAAAISREEKTIDSTLETLFRLCITAAKKAKTEIKVKAVPTSAAERAITELSKKYCFTDKRILVIGNGEIGRLCCKKLIELGAEITITLRKYKHGEIIIPVGCNTIPYDEREEVLPLSDVVISATTSPHFTITYDMIEKLERKPEIFVDLALPRDIESSISNFTGVELYNLDRFYTDYSVLNQKEVSKIREIINHFILQFEKWKDYREEAAFTKIPDLHNDTLYGRFPLFIDLSGKKVLVVGGGEIATRRVKTLLRFGADIYLVAPHLTSELQEMLNCKLINYREGYYESQDIQNMFLVIAATNDRETNHKVYLDAKEKGIQMSIADCREECSFYFPAIFEFDGIVGGLVSQNGDNHSLVKSVAEQIRKIGQATD

SEQ ID NO: 62654 - protein, 254 aa, Shigella boydii
MVAAGIKEILLVTHASKNAVENHFDTSYELESLLEQRVKRQLLAEVQSICPPGVTIMNVRQGEPLGLGHSILCARPAIGDNPFVVVLPDVVIDDASADPLRYNLAAMIARFNETGRSQVLAKRMPGDLSEYSVIQTKEPLDCEGKVSRIVEFIEKPDQPQTLDSDIMAVGRYVLSADIWPELERTQPGAWGRIQLTDAIAELAKKQSVDAMLMTGDSYDCGKKMGYMQAFVKYGLRNLKEGAKFRKGIEKLLSE

SEQ ID NO: 62655 - protein, 490 aa, Petrophile circinata
  misc_feature (485)..(485): Xaa can be any naturally occurring amino acid
GPGVSALEEKNLGRIAQIIGPVLDVAFPPGKMPNIYNALVVKGRDTVGQQINVTCEVQQLLGNNRVRAVAMSATDGLMRGMEVINTGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEVXSNLKK

SEQ ID NO: 62656 - protein, 490 aa, Beauprea montana
GPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYIEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLASKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62657 - protein, 177 aa, Musa x paradisiaca
FGSVYQGEMPDSGAIAVKRLESMRQGEKQFRMEVSTIGTIHHVNLVRLRGFCCEGDKRLLVYDYMPMGSLDSVLFADGREALDWKKRYGIALGIARGLAYLHEKCRECIMHCDIKPENILLDMDMCPKIADFGMAKLLGREFSRVLTTVRGTFGYLAPEWITGSAITPKADIYSYGV

SEQ ID NO: 62658 - protein, 417 aa, Oryza sativa Japonica Group
MAGRKENPVLTACQAPSGRITRAQAAANRGRFGFAPSVSLPARTERKQTAKGKTKRGALDEITSASTATSAPQPKRRTVLKDVTNIGCANSSKNAPPRASCSDKVIPLFQQKSKPTQRVKQIPSKKQCAKKVPKLPPPAVAGTSFVIDSKSSEETQKVELLAKAEEPTNLFENEGLLSLQNIERNRDSNCHEAFFEARNAMDKHELADSKPGDSSGLGFIDIDNDNGNPQMCASYASEIYTNLMASEVSEEYKLVPDTLYLTINLIDRFLSQHYIERQKLQLLGITSMLIASKYEEICAPRVEEFCFITDNTYTKAEVLKMEGLVLNDMGFHLSVPTTKTFLRRFLRAAQASRNNHTLEHYTSYKSSDIQICVCALRELQHNTSNCPLNAIREKYRQQKFECVANLTSPELGQSLFS

SEQ ID NO: 62659 - protein, 176 aa, Musa x paradisiaca
RVGVQGRDTGTGAIAVKRLESIRQGEKQFRMEVSTIGTIHHVNLVRLRGFCCEGDKRLLVYDYMPMGSLDSVLFADDREALDWKKRYRIALGIARGLAYLHERCRECIMHCDIKPENILLDMDMCPKIADFGMAKLLGREFSRVLTTVRGTIGYLAPEWITGSAITPKADVYSYGV

SEQ ID NO: 62660 - protein, 490 aa, Adenanthos obovatus
  misc_feature (335)..(335): Xaa can be any naturally occurring amino acid
  misc_feature (338)..(338): Xaa can be any naturally occurring amino acid
GPGVSALEEKNLGRIAQIIGPVLDVAFPPGKMPNIYNALVVKGRDTVGQQINVTCEVQQLLGNNRVRAVAMSATDGLMRGMEVIDTGSPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNITESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTXGHXDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62661 - protein, 593 aa, Oryza sativa Japonica Group
MASAAAPKRCYYEVLGVPRDCSPADIKLAFRRLALSLHPDKQPPGSDVAAATAAFQELQHAHSVLSDPHERSYYDSHRSQILFSDHHPSSGPGRGGGVASASASPVPDLFAFFSSSAFSGFSDSGRGFYKVYGDVFDRVFAQELAYARRMGMPADAVPTPPVIGNLDSPQAQVAAFYSYWLGFGTAMDFGWAAEWDAARGESRRVRRLMEEDNKKATRKARREYNDAVRGLAAFCKKRDKRVVDMALKKKVEEEKRKAEEAARKKEEERRRKERAMAYQEPEWARVDEDEAAVFEDDEEEETRAKRKEELYCVACNKKFKSDKQWKNHEQSKKHRDKVSELRMVFEEEEEALKDAEEEEPEEVDVGFDFQPAQESEESEFSDAAEELADELSEGLEVRDEEEKGDKHLGNGEQKVGSYDETSVLEEMLSRSRRKNRKSGFVAPQEEASPAGAMDDDDDEDTSYEINNVKKKGRRRRAAKKGGTYADNGQGRKSENQPEESRHNNDENGADDKMEGPSSNEDSAAASKEDQQKGKTGNTKKNKKGTEKNTTISSEQKGTSKGKKQKEQVVFSLGRNRSCNAEDTTEKSLKRTRK

SEQ ID NO: 62662 - protein, 221 aa, Zea mays
MVTLCQTLKGEDDELITNMLETLVNLAPVLDLRIFSSSKPSFIKMTEKGAIHAIMGMLSSSVKPWHCAAAELIGRLIINPDNEPFLLPIIPQIYKRLVDLLSVPAYDAQAAAVSALYNVAEVNMDCRLKLASERWAVDRLLKIVKTPHPVPEVCRKTSMILESLVSEPQNRMHLLVHENTFAEILTSEGKYSDTFARIVYELTARPSNKVTSGHAIWGNIN

SEQ ID NO: 62663 - protein, 85 aa, Oryza sativa
FRRLILSEHQLAKLADHHGTEIVRFTQINLLRLYPKGTRVTLSNYNPFLGWVHGAHMVAFNMQGYGRALRLMHGFFKTNVGCGYM

SEQ ID NO: 62664 - protein, 720 aa, Zea mays
FSKSTKERSSRFFSASFFSSKADGEFTPTSVFRGEMKSVQKQAPKLVVGILLLGAGAFFLNRAEKSQLFQQQGIATSIGKVTSTTKPIVLEIRQIPQRVKKLIELLPHQEVNEEEASLFDILYLLLASVIFVPLFQKIPGGSPVLGYLAAGVLIGPYGLSIIRNVHGTKAIAEFGVVFLLFNIGLELSVERLSSMKKYVFGLGSAQVLATTAAVGVIAHRFAVLPGPAAIVVGSGLALSSTAVVLQVLQERGESTSRHGRATFSVLLFQDLAVVVLLILIPLISPNSSKGGVGFQAIAEAMGMAAVKAVAAITAIIAGGRLLLRPIYKQIAENQNAEIFSANTLLVIFGTSLLTARAGLSMALGAFLAGLLLAETEFSLQVESDIAPYRGLLLGLFFMTVGMSIDPKLLLSNFPMISMILGLLIIGKTLLVTFVGRVFGVSTIAAIRVGLLLAPGGEFAFVAFGEAVNQGLLSPQLSSLLFLVVGISMALTPWLAAGGQFLASKFEQHDVRSLLPVESETDDLHDHIIILGFGRVGQIVAQLLSERLIPFVALDVRSDRVAVGRALDLPVYFGDAGSREVLHKVGAERACAAAITLDTPGANYRAVWALNKYFPNVKTFVRAHDVDHGVNLEKAGATAVVPETLEPSLQLAAAVLAQAKLPMSEIQESINEFRNRHLSELTELCATSGNSLGYGFSRVMSKSKSISSDDESETVDGALAI

SEQ ID NO: 62665 - protein, 446 aa, Listeria monocytogenes str. 4b F2365
MAKFTYDVVIIGSGASGTTVAFEAQAAGLKVAIVEERSWGGTCVLRGCDPKKVLVGAREARNLSTRLRGKGIKQAATISWTDLMAFKETFVENVPESRLENFQEAGIETFFGAASIQDSHSLQVGDDLIQANKIVIATGATPSTLKVEGQEYIQTSDDFLSLEKLPDSVVFIGGGYISFEFASIALATGREVHIIHHNSEPLKKFDPDFVAALVSNMKEEGIHFHFDTDITKVENKGEKLHIHGKDGFSLQTDLIIGATGRKPNIAHLSLENANIDYTKKGIIVNEKLQTTNNPHIYACGDVAATKGAPLTPVVSMEAAFVAKNVIGGDEKMIYPAIPSVVFTSPKLASIGISAEEAKAHPEKYQIKNHDTTNWYTYKRTNEQIALAKIIEDRESGQIKGAHFLSEEADYMINYVAILMKANLTLSDLQSVIFAYPSPASDLTALN

SEQ ID NO: 62666 - protein, 122 aa, Trichodesmium erythraeum IMS101
MVTWRCIKSCGACCYLDPTERPDLEEYLSAEEVEYYMSLIGADGWCINYDSLSRECRIYPDRPKFCRVQADIFKDMYDVEPEELDEFAIDCCQQHIGDMYGEYSLEMLRFNNAVGVRSGFER

SEQ ID NO: 62667 - protein, 403 aa, Listeria monocytogenes str. 4b F2365
MKIIVQKFGGTSVQNEKSRLMAFNHIKQVLKEGYKVVVVVSAIGRYGDPYATDTLLELIGAKNTKLTAREQDTLLSVGETISASVFTNMLKEANIKAEAFSGGQAGIITSDDHLNAKITEVDTARLKDALTNLDVAVVAGFQGITANGDISTLGRGGSDTSAAALGVSLQADYIDIFTDVDGMMTADPRIVEHARSLPRVSYNEVSNMAYQGAKVIHPRAVEIAMTAKIPMRIRSTYLESTGTLVTSLTNDSDHFDVKERIVTGVAHVTNLTQISVQTDTVKAQQLAFKILADAGISLDFINISTNSVIFTVPEEKSHVVKQLLEDADLQTTVRQACAKVSIVGAGITGVPGVTAKIVGALSEKNIPILQSADSHTTIWVLVKEEDLISAVNALHDVFCLEIK

SEQ ID NO: 62668 - protein, 520 aa, Caulobacter crescentus CB15
MTQKTDHQRVLIVDFGSQVTQLIARRVREAGVYCEIHPFDKAEAIVDEYAPSAIILSGGPASVLEADSPRIGRKLFDLGLPLLAICYGQQLLCDVLSGKVEGGHAGEFGRAELTIGKDSPMFQGLAGVGGVETVWMSHGDRVTAIPEGFEVIGTSTGAPFAAIANDAKKIYALQFHPEVYHTVNGPAMYRNFLFNIAGLKGDWTMAAFRQEMVQKIRDQVGDGKVICGLSGGVDSSVAAVLIHEAIGDQLTCVFVDTGLLRKNEADQVVTLFRDHYNIPLVHVDAGDLFLGELAGVSDPETKRKTIGRLFIDVFDKEAAKIEGATFLAQGTLYPDVVESVSARGGPSAVIKSHHNVGGLPDYMKLKLVEPLRELFKDEVRALGVELGLAPAFVGRHPFPGPGLAIRIPGEITPEKVKVLQDADAIYLEEIRNAGLYDQIWQAFAVLLPVKTVGVMGDARTYENVLALRAVTSTDGMTADFFEFPWPVLGKTATRIINEVRGVNRVVYDVTSKPPGTIEWE

SEQ ID NO: 62669 - protein, 533 aa, Oryza sativa Japonica Group
MERMSRVAVAVLLLLCLQLQLGISGGGGGGHGARRDDQLVQECSGFCLADLCVRPAARLIHAKKSSSSSQQQQQQQRSRQAGSKAGWPSTSSTPSNPFGLPMLLPPPPPLKDWPPWLDMPPVQGPSSSPSPSPSPAPSPASSAAVAEHAAPPRRGEEHARPRSIALPPASSSGDAGETSRPEVTDGSATRRGGGGGKTNYVLVAAAGASVLLAASAAAFAACYRSEQGRAFVTGVPALRRAELEAACEDFSNVIGSLPEYTMYKGTLSSGVEIAVVSTTKTSPKDWSKKCEAHFRKKITSLSRVNHKNFVNLLGYCEEEQPFTRMMVFEYAPNGTLFEHLHARDEGHLDWPTRLRVAVGVAYCLEHMHQLAPPEIVRTLDASTVYLTDDFAAKISDVGFCEEEMAAAAAAPAMADRESVVHGYGMLLLEMMAGRLAASEGGLVQGWAAALLRGERRLRDVMDPALRGAFHAETVDRLDAVVRSCADRDPRRRPSMADVAARLREITAMPPDAATPKVSPLWWAELEIISTEAA

SEQ ID NO: 62670 - protein, 612 aa, Gibberella zeae PH-1
MPSQKNSNGTGQVSHRLRNFFRMNTGGSTGSASSDKEKDKDKEKNSASTTPDPSKPRHTKFFSNTVGRLRAHTVASEGNQLEEAMSPTAHANPYFAHQGQPGLRHHNSDSVPPSPPDTPSLKVHGPDGTPATDQTTSETKEELARRLRRVASAPNAQGLFSKNDPNNERPATAELGKDPLLTSSGALGLIEPAKTPQNEEMPTHANPEDILAALPAPNMSMAFRRTYSSNSIKVRNVEVSPSSFDKIKLIGKGDVGKVYLVREKKSSRLYAMKILSKKEMIKRNKIKRALAEQEILATSNHPFIVTLYHSFQSEDYLYLCMEYCSGGEFFRALQTRPGKCIPEEDARFYAAEVTAALEYLHLMGFIYRDLKPENILLHQSGHIMLSDFDLSKQSDPGGKPTMIVGKNGARTDALPTIDTRSCIANFRTNSFVGTEEYIAPEVIKGSGHTSAVDWWTLGILIYEMLYGTTPFKGKNRNATFANILREDIPFPDHAGAPQISKKLLIKDENRRLGARAGASDIKAHPFFRTTQWALIRHMKPPIVPHAGRGVDTVNFRNVKESESVDLSGSRAMNLKGVPLDSGLATPGGEIADPFLEFNSVTLHHDGDDDHHR

SEQ ID NO: 62671 - protein, 315 aa, Hordeum vulgare subsp. spontaneum
MATAGKVIKCKAAVAWEAGKPLSVEEVEVAPPQAMEVRVKILYTALCHTDVYFWEAKGQTPVFPRILGHEAGGIVESVGEGVTELVPGDHVLPVFTGECKDCAHCKSKESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 62672 - protein, 199 aa, Geobacter metallireducens GS-15
MLVPIVVEQTGRGERSYDIYSRLLKDRIIFLGGPIDDHVANLVIAQLLFLEAEDPDKDIHLYINSPGGVVTAGMAIYDTMQYIKAPVSTICVGQAASMGALLLSGGEKGKRFSLTHSRIMIHQPLGGFQGQATDIHIHAQEILKMKKRLNEIIAENSGQALEKVEADTERDYFMSGEEAKSYGIIDAIIARKPTSGGSR

SEQ ID NO: 62673 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGATLNVAKPKKGSTVAIFGLGAVGLAAMEGARMAGASRIIGVDLNPAKYEQAKKFGCTDFVNPKDHTKPVQEMLVDMTNGGVDRAVECTGHIDAMIAAFECVHDGWGVAVLVGVPHKEAVFKTHPMNFLNEK

SEQ ID NO: 62674 - protein, 561 aa, Zea mays
MASIPPPSSSVAALTRQPAQFLKWCSVSKETKASVCSFLATNSNSTRVKSVGLRVALSFKNDGGYPADGFSGNGNTLLPKSTSVRGEDHPVADPVLPMDSMMTPEILSANLALVMDKFSDDDTDTELDLDSPTEGFASIPDAIEDVRQGKLVIVVDDESRENEGDLIMAASLVTPEAMAFIVRHGTGIVCVSMKEDDLERLSLPLMVTTKENEEKLCTAFTVTVDAKEGTTTGVSAKDRAKTVMTLASPDSRPEDFNRPGHIFPLKYREGGVLKRAGHTEASVDLAMLAGLPPVAVLCEIVDDADGSMARLPKLRVFAERENLKIISIADLIRYRRKRDRLVERASVARLPSQWGNGHGYCYRSAIDGIEHLAMVKGDIGDGQDILVRVHSECLTGDIFRSARCDCGDQLAMAIEMIEKAGRGVIVYLRGHEGRGIGLGHKLRAYNLQDDGRDTVEANEELGLPVDSREYGIGAQILRDLGVRSMKLMTNSPAKYSGLKGYGLSIAGRVPLVTPITSENPQILCPIREHGRATEDGEELVKQGYIPDLGILVFSCGRCTSC

SEQ ID NO: 62675 - protein, 522 aa, Ehrlichia ruminantium
MLITARLRYAIMFMVKLAHGLCTQQNKLQPVRMSYIASNQSLSEGYLEQVIVQLKKKGLINATKGPGGGYSLSIAPHLITLSLILESIGENIKITRCENNSPGCLSNNNRCVTHKLWDDIGNYIKDYLNNISLEDIVNNNFRSNIALHKNEEPYIYADYNSTSTILPEVKYQLNNLSYIKLYNPSSIHKLGQKTKSIIEETRNIAIKQLNAQYYDVVFTSSGTEANNLVINSTSDYKHLISSTEHLSIIKCATNAELIPVDSNGIICLNALSSLLHKFKDDKILVSVMTANNETGAIQPIKKIVELSHKFGALVHTDAIQACGKIHIDIEDLGVDLLTISSHKLGSIAGAGVLFFNSKKINIKPMIIGGHQEKGLRAGTENVLAIYLLSISLSNLYKSITKMLLVEKLRNKLENEILSLVPNAQIFSRNVERLPNTSCISMPNVNSEIQVISFDIKNIAVGNGSACSTGVVEPSHVLSAMGVNQEIANNSIRISLSPDTTDEHIRTIVNCWYEIYTHNQVHK

SEQ ID NO: 62676 - protein, 315 aa, Hordeum vulgare subsp. spontaneum
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEASLDKVCVLSCGISTGLGATLNVAKPKKGSTVAIFGLGAVGLAAMEGARMAGASRIIGVDLNPAKYEQAKKFGCTDFVNPKDHTKPVQEVLVEMTNGGVDRAVECTGHIDAMIAAFECVHDGWGVAVLVGVPHKEAVFKTHPMNFLNEK

SEQ ID NO: 62677 - protein, 382 aa, Zea mays
MEATLAFSQDSPPISIICAAKFVGLPLTIDPSLASGLAPTLRFASGESLHGVNPILLYIASGATIPCFSGKNDIEFGHVVEWLEYVPIFLSGSEFENACLFVDGFLASRTFLVGHGLTIADIVVWSNLAGIGQRWESLRKSKKYQNLVRWFNSIDSEYSDTLNEVLAAYVGKRGIGKSPAPSLKEKVHVSKDPSAPEVDLPGAKVGKVCVRFAPEPSGYLHIGHAKAGLLNKYFAERYQGRLIVRFDDTNPSKESNEFVENVLKDIETLGIKYDAVTYTSDYFPKLMEMAGSLIKQGKAYIDDTPKEQMRKERMDGIESRCRNSTVEENLSLWNEMVNGTERGMQCCVRGKLDMQDPNKSLRDPVYYRCNIDPHHRVGSKYK

SEQ ID NO: 62678 - protein, 405 aa, Geobacter metallireducens GS-15
MALVVQKYGGTSMGSIERIRNVAKRVAKTYDAGNDMVVVVSAMSGETNKLVALANEVCEFPDNREYDVLVASGEQVSIALLAMCLKSMGYKAKSYHGWQVPIITDSVFSKARIEEIPDAKVRADLKDGTIVVVAGFQGIDKDGNVTTLGRGGSDTSAVAMAAAMKADVCEIYTDVDGVYTTDPNICEDARKIDKISYDEMLELASLGAKVLQIRSVEFAKKYNVDIHVRSSFNDNQGTMVTKEDKDMEAVLVSGIAYDKNEAKIAVLGVPDKPGIAAKILSSLSDANISVDMIVQNVSGGDLTDFTFTVTKADFKKALAITKEIATEIKATGVSADESISKVSIVGVGMRSHAGVATKMFQTLANEGINIQMISTSEIKVSVVIDAKYTELAVRVLHEAFGLSGK

SEQ ID NO: 62679 - protein, 478 aa, Shigella boydii
MSNNIICPVIMAGGSGSRLWPLSRLFYPKQFLKLVDDSSMLQETISRLGDLPCSLPVVICNEQHRFIVAEQLRMINKLTNNIILEPVGRNTAPAIALAAMISESFSSLEDPLLLVLAADHDIKNHKSFRDAVRKAIPFAEQGKLVTFGIVPSMAETGYGYIKRGHEISLENDEVAYTVSKFYEKPNISDAQKFLASGKFYWNSGMFLFRASRYLSELNKFRPDIYLACASSTKNINTDLDFIRVDENSFSNCPDESIDYAVMEQTSDAVVVPMNAGWSDVGSWSSLWEISKKNEQGNVSHGDVINHNTENSYVYAESGLVTTIGVKDLVVVQTKDAVLVADRNSVQDVKKVVEQIKAHGRSEHQMHREVYRPWGKYDSIDAGERYQVKRITVKPGEGLSVQMHYHRSEHWVVVAGTAKVTIDGVIKLLGENESLYIPQGAKHCLENPGKIPLELIEVRSGSYLEEDDVVRFADRYGRV

SEQ ID NO: 62680 - protein, 573 aa, Symbiobacterium thermophilum IAM 14863
MRVASVSEKVLNGVAAAAGVVIGPAFVYREGQPETAARAAAAPEEELARFEEARRRAENELNALAERADDQGREILTAHQLMLQDPELQNLVEAAIRDGQPAEEAVRTATEQFAAMLEALDDEYLRERAADVRDVGRRLVAALTGRTVGVVLQRPSVVVARDLAPTDTIGIDRSLLLGIVTEQGGPTSHTTILARSWGIPAVVATAGVLEAASDGMTVALDGDAGEVVLDPGAETRSRYEAAMARAREQAERDRAEASLPAETPDGVRVELAGNAGSPGEVAFAMEKGAEGIGLLRSEFLFMGRSTAPTEEEQYQAYAEALRNARGQRVIIRTLDIGGDKDVPYLGLAKEENPFLGVRALRLCFRRPELFQTQLRALLRASVHGRLAIMFPMVSGLSDLRRAKEALAEARRSLEAEGHPVADRYEVGIMVEIPSAALLADHLAREVDFFSIGTNDLVQYTLAVDRGNPELTEMYQPYHPAVLRLIDRIVQAAHAAGKWVGVCGEMGGLPEGALLLLGLGVDELSMAPALLPRIKRLVRSTPAAEARAVARECLELGTPEEVLALVGPLVRRVG

SEQ ID NO: 62681 - protein, 397 aa, Enterococcus faecalis V583
METFKEYIEKLDKLEFEKMYENDFFLTWEKTRDELEAVFTVADTLRYLRENNISTKIFDSGLGISLFRDNSTRTRFSFASACNLLGLEVQDLDEGKSQISHGETVRETANMISFMADIIGIRDDMYIGKGNAYMHEVSESVQEGYKDGVLEQRPTLVNLQCDIDHPTQAMADALHLIHEFGGIENLKGKKVAMTWAYSPSYGKPLSVPQGIVGLMTRLGMDVVLAHPEGYEIMPEVEEVAKKNAAEFGGNFTKTNSMAEAFKDADVVYPKSWAPFAAMEKRTELYGNGDQAGIDQLEQELLSQNKKHKDWECTEELMKTTKDGKALYMHCLPADITGVSCEEGEVEASVFDRYRVELYKEASYKPYVIAAMIFLSKVKNPQKTLTELADKATPREVK

SEQ ID NO: 62682 - protein, 490 aa, Leucadendron salignum
GPGVSALEEKNLGRIAQIIGPVLDVAFPPGKMPNIYNALVVKGQDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62683 - protein, 446 aa, Shigella boydii
MSKQQIGVVGMAVMGRNLALNIESRGYTVSIFNRSREKTEEVIAENPGKKLVPYYTVKEFVESLETPRRILLMVKAGAGTDAAIDSLKPYLDKGDIIIDGGNTFFQDTIRRNRELSAEGFNFIGTGVSGGEEGALKGPSIMPGGQKEAYELVAPILTKIAAVAEDGEPCVTYIGADGAGHYVKMVHNGIEYGDMQLIAEAYSLLKGGLNLSNEELAQTFTEWNNGELSSYLIDITKDIFTKKDEDGNYLVDVILDEAANKGTGKWTSQSALDLGEPLSLITESVFARYISSLKDQRVAASKVLSGPQAQPAGDKAEFIEKVRRALYLGKIVSYAQGFSQLRAASEEYNWDLNYGEIAKIFRAGCIIRAQFLQKITDAYAENPQIANLLLAPYFKQIADDYQQALRDVVAYAVQNGIPVPTFAAAVAYYDSYRAAVLPANLIQAQRD

SEQ ID NO: 62684 - protein, 490 aa, Protea neriifolia
GPGVSALEEKNLGRIAQIIGPVLDVAFPPGKMPNIYNALVVKGQDTVGQQINVTCEVQQLLGNNRVRAVAMSATDGLMRGMEVIDTGAPLSVPVGGATLGRIFNVLGEPVENLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62685 - protein, 1001 aa, Enterococcus faecalis V583
MSDIMHPISIEALLNWIFSEYQQDGTIFGIRKFYHADPTKTISLFGEKMETPCGPAAGPHTQLAQNIIAAYLTGSRFFEVKTVQILDGEDLPVSKPCIAAADECYNVEWSTELRVPQAYDEYVKAWFVLKLLSKEFELGDPNGFIFNMSVGYDLAGIQSPKIDRYINEMQNAEGTPIWAECQAAAKKYLSYFKKVDDLYIEAISPKVCHSITLSTLHGCPSDEIERIAAYLLSEKGLHSFIKCNPTMLGYEYARQTMDELGFDYMVFDDHHFKEDLQFEEAVPMLQRLQLLANSKNLSFGVKITNTFPVTIAANELPGDEMYMSGRSLFPLSISLAQKLSEAFDGKLQISYSGGADIFNSKEIFDAGIWPITMATTLLKPGGYQRMNQVANVLSAAEYPQMVHVNLDKLAQVVEKAKTQARYQKSIKLPESTKLRKTVPLTDCYIAPCRSDGGCPINQDIPAYLRYVSEGNYLKALQVIVDKNPLPFITGTICAHPCMTKCTRQFYEESIHIREVKLEAAEHAYDELLTTLEKPQPKENAPKTAVVGGGPAGISAGYLLAREGMPVTVFEKSETIGGVCSQIVPEFRISMESVQKDVQLAEFMGAEFRTGQEAPSLAELKNQGYTNVIYAIGAWKHGVLRLESGRALNSLEFLKANRENPTINPYGEQIVVVGGGNTAMDCARAATTLPGVKKVSVVYRRNKRNMPADEEELYLALEDGVDFLELLSPIKHENQQLTCEKMVLGERDASGRRRPIGTGEMIDIPADTVIAAVGEKVDTEFYQALGIHTDNYGKVVSNQETLETNIPGVYVIGDANLGPATIVEAIADATKAANNICLVHNHHYEKDNLNSDVAFVRNKRGILVTDEMSCSQASRCLECSTICESCMDVCPNRANIVVYVEGKPQIVHVDRMCNECGNCETFCPYASAPYKDKFTLFNSEADFYDSTNSGFYVQNPVDKICLLRLWGTVSTIQLTDQGLDVPEDLIALMVTMIEEYAYCMQA

SEQ ID NO: 62686 - protein, 372 aa, Serratia marcescens
MKSRAAVAFGPGKPLEIVEIDVAPPQKGEVLVKITHTGVCHTDAFTLSGDDPEGVFPAVLGHEGGGIVVEVGEGVTSLKPGDHVIPLYTAECGECKFCKSGKTNLCQAVRATQGKGLMPDGTTRFSYNGEPIYHYMGTSTFSEYTVCAEISLAKVNPQAPLDKVCLLGCGVTTGIGAVHNTAKVKEGDSVAVFGLGGIGLAVIQGAAQAKAGRIIAVDTNPEKFKLAGEMGATDFVNPNDYDKPIQDVIVELTDGGVDFSFECIGNVNVMRAALECCHKGWGESVIIGVAGAGQEIRTRPFQLVTGRVWRGSAFGGVKGRSQLPGMVEDAMAGKIRLDPFITHRLPLEKINEAFDLMHEGKSIRTVIHFGDK

SEQ ID NO: 62687 - protein, 359 aa, Lentisphaera araneosa HTCC2155
MIYQDYAIFTPGPVKMSEEILKLGAQQTPYFRNSEFSNITFDCEKNLLEMVNAPEGSRVVFLTASGTAGMEATVMNLLTQNDKALVINGGGFGARFVKICQTHAVPHHELKVKDTNLSDIAEIAPQEKFTSLVVNAHETSVGHLYDLNAMGDYATKNGLLYIVDAISMLVTDPLDMQESNIDVVIASSQKGLGLPPGLTMVVLAPKALEQVQEINSLYFNYKDYLSNGERGQTPYTPAVTIMLQLHGRLEQIKKRGGVAQSINNAQEVAQYFRESIKGLPLAEYSTYMPNAMTTLTPTDGKSAMDIVNDLEEKYKVMVCPNGGPERDLIFRVSHMGEMTKEYTDILIDALYDYYGKTRS

SEQ ID NO: 62688 - protein, 384 aa, Trichodesmium erythraeum IMS101
MSISAQPALLVLADGTSYCGLSFGAPGTTIGEVVFNTGMTGYQEVLTDPSYCGQIVTFTYPELGNTGVNSEDEESNKPQIQGAIARNICPRPSNWRSTKSLPEYLQEHKIQGIYGVDTRALTRKIRTVGAMNGAISTEILNPTELLEQVQFAPSMAGLNLVQKVTTKETYQWSEPTNPDWEFNLSVSGNTGEKFTVVAIDFGVKKNILRRLASYGCQVIVVPADTPPEEILKHNPDGIFLSNGPGDPSAVREGIETTKELLKSSKPVFGICMGHQVLGLALGADTFKLKFGHRGLNQPAGLQQRVEITSQNHGFAINADSLVAELEITHLNLNDQTVAGLRHKSLPLFSVQYHPEASPGPHDADYLFERFVQAMKDTRKVKALS

SEQ ID NO: 62689 - protein, 251 aa, Nostoc sp. PCC 7120
MFSNREGQRVPQVTFRTRQNNEWVNVTTDDLFAGKTVAVFSLPGAFTPTCSSTHLPGYNELAKVFKDNGVDEIVCISVNDAFVMNEWAKTQEAENITLIPDGNGEFTEGMGMLVDKTDLGFGKRSWRYSMLVKDGVIEKMFIEPDVPGDPFEVSDAQTMLKHINPQAAKPKLVSLFTKVGCPFCARAKAALQENGIEYEEITLGKGITTRSLRAVTGATTVPQVFIDGVLIGGSEALTDYLSTIKQEKVGV

SEQ ID NO: 62690 - protein, 477 aa, Coccidioides immitis RS
MHLTTAIAATALVATPAWAIGSFNFPDNNIHHGVHEDNHAPQACLRACWHRPRLCPARMIVLRVGNCWTCCRQGHDADDNMIHKFFKGGHHAENDNMIHKLFKGRGHAENDNLLNKLFKGGDQTENNHGHFEDDNNMHEGLKHIQFGGGDHHGDSKHGRHMQHDDHKHGGHGHDDHKHGGHKYGGHGHDDHKHGGHGHDDHKHGGHGHDGHKHGGHGHDDHKHGGHGHDDHKHGGHGHDDHKHGGHKYGGHGHDGHKHGGHGHDDHKHGGHGHDDHKHGGHGHDDHKHGGHKYGGHGHDDHKHGGHGHDGHKHGGHGHDDHKHGGHKHDGHMQDEKEHGDFMHGGLMQPGKQHGDFVHGGLMQPEKQHGDFKHGGHMQHDNEYGHSKHGGHMKDEKRHGDKHDGHKHGGHGHDDHKHGGHGHDGHKHGGHGHDGHKHNGHKHDGHKHDENECGHSKGGDHGKTYGRFRGRHGKNCEA

SEQ ID NO: 62691 - protein, 895 aa, Oryza sativa Japonica Group
MVKPGLSSYAGKPQEAANSIAPLLEKAKGVVPKQLQKRTPLKLGATAGLRLIGDEKSEQILEAVRDLVHSKSNFQYKPEWISVLGGSQEGSNLWVALNYLLGKLGGDYSKTVGVIDLGGGSVQMAYAISSDAAENSPPVPVGKDPYVTKEYLKGKDYNLYVHSYLHYGLQASRVEILKTKNGQFSSCMLRGFNGTYKYNGEEYDAAASPEGADHGKCGEEAAAALGLDAPCESRNCSFNGVWNGGGGAGMADLYVASYFYDRAVHGGFVVDDAPSAVTTPAAFAEAASKACSLSSGEAAAAYPEAFDVQFICMDLTYQYTLLTKGFGQVWGLLRGVGVAAGYCHRSLVLPEESSVCMIHLAISRKDAYIYSLNLRAFHFIANFNLVNFEVTEFCAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEGNAPLYKGSAWGVPYRAGYLHGERPPAKTTTRNGGGSPKGATSPVYACLSYNSNRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKEQKANPRKFADCIHWCLPGLPDTWNEFIYGHIVSSPQRRPVEPIENQPQR

SEQ ID NO: 62692 - protein, 336 aa, Actinobacillus pleuropneumoniae serovar 1 str. 4074
MAISSVYAAELPNITILATGGTIAGSGQSAVSSAYQAGQLNIDTLIEAVPEMKTLANIKGEQVVKIGSQDMSDEVWLKLAKTVNSQCANTDGFVITHGTDTMEETAYFLDMTVKCDKPVVLVGAMRPATEKSADGPLNLYNSIVVAKDKKSAKRGVLVAMNDVVLGARDVTKTSTTAVQTFSSPNFGTLGYIHNSKVDYERAPESKHTLNTPFTIDNLNELPKVGIIYAYSNMPTEPLKALLDAGYQGIVVAGVGNGNMNAANLALLEQAAKNGVAVVRSSRVPTGYTTRDAEVDDSKYGFAASGTLNPQKARVLLQLALTQTKDINTIQQYFEDF

SEQ ID NO: 62693 - protein, 137 aa, Ehrlichia ruminantium
MSYSESLLEHYKNPKNVGTLPKEDYNVGTGLVGAPSCGDVMKLQIKVDDNGKIIDAKFKTFGCGAAIAASSLATELIKGKTVDEAHELKNTVLAKELSLPPVKIHCSLLAEDAVKAAINDYHMKQANKKNATKDPNE

SEQ ID NO: 62694 - protein, 213 aa, Parvularcula bermudensis HTCC2503
MGPNAVDNCARPLPGGPVVLPFPLYFIRHGQTDWNKEGRFQGHSDIPLNDTGKAQAGRNGQTLAAQLGPAAAAYDFAASPLSRARQTMEIIRNALGLPASGYTLDARLLEVDLGDWNGQTVADIEAHSPGIWKKRQADKWAFAVPGGEAYKDAAVRIRHFLEDLRRPTVIVGHGASGRILRGYCIGLDQSRVGHLPSPQDRVFHLTEGTETSL

SEQ ID NO: 62695 - protein, 486 aa, Bifidobacterium longum DJO10A
MDLFRKKSVDQLVAESTPLKRTMRTFDLTMLGIGAIIGTGIFVLTGKGALTAGPALSVSFLLAAVCCGFAGLCYAEFAAMAPVSGSAYSYAYLAFGELIAFVIGWDLILEYALQAATVSAGWSGYFNKLLEGFGLHLPVELTAAYGTNPDVTTYFNLPGFVIVLIITWVLSIGINQTKRTNDVMVLIKLAIIVLFIVCAVWYVKPSNWQPFSPYGVYTFQPGSTQPYGIVPAASIVFFSFIGFDAVSSSAEETINPNKTLPRGILLSLAVSTVLYVIMTLIMTGVVPYKEFAKYIDAPVAGVILETGMNWLAVIVNLGALIGMTTVMLVQLYGQSRICYAMSRDGLFPKFFGHVHEKYRTPFKGTWFFGLLTAFAGGFININVLFELVNIGTLSAFIIVSAGILWMRKTQPNAPRGFRAPGVPVTPILAIVFCFVLIAGLNWETWVRFAVWFGLGLIVYFGYSRKRSKLGLEQKAGADAKVAATED

SEQ ID NO: 62696 - protein, 210 aa, Actinobacillus pleuropneumoniae serovar 1 str. 4074
MALNIYLVRHGKTVWNLEGRLQGSGDSPLVEEGIEGAKKVGRALKAVKFAAAYSSMQKRAQDTANYILAENNDKNIPHFHHFGLNEFDFGLWEGTKSVDLYSNDEYWTMKKTPAEYRAETNGGETYEDLYSRVIKVFNQIAQLHQDNENILIVAHGMTLTVLTAVLRGLHWSECRDETKHSFVINTAINRAVVEKGKAELVEFNRTEHLA

SEQ ID NO: 62697 - protein, 216 aa, Vibrio cholerae O1 biovar eltor str. N16961
MQMLRNVHPVTEIQVSANMAEVRARVDFKVGAKSNIDAEILSFHGLQSDKEHVAVIFKSADTTQEAPLVRMHSECLTGDVFHSSRCDCGEQLEETITRMGQSGGIILYLRQEGRGIGLYNKIDAYRLQSQGMNTYEANNHLGFGDDLRDFTEAAQMLQALGVKKIRLVTNNPKKIRELQEHGIEIVEVVHTSAHIKDGNENYLKAKVSHGKHQLKL

SEQ ID NO: 62698 - protein, 512 aa, Parvularcula bermudensis HTCC2503
MTEIRVPTLGESVTEATVGEWLVKEGDRVSVDDPLVELETDKVSVSVPAPMAGVITSITAKEGDTVELDALLGEIGEANGTKASSSASSSNGSEAAASSAPTNKDEGGEPIEVLAPSSGESVTEADVGEWLVKIGDQVAVDETLVSLETDKAAVDVSAPSAGTITEIRQKEGETVTPGTVLAIITQGGGAVPETKSPEKASSAKPDPAAAKSASTTDRAALSPAPRRMIQENGLDPASIAGSGKDGRITKGDVVSYLKDQEAKPTPTPSTPSPSAPRDLGEREERVKMSRLRQTIARRLKESQNTAAMLTTFNDVDMSAVMEVRSQYKDLFEKKHGVKLGFMSFFVKACVHALREIPDVNAEIDGTDIIYKDHYDIGIAVGTEKGLVVPVLRDAEQKSLAEIEKGITDFGRRARDGQLSLEEMQGGTFTITNGGVYGSLMSTPILNMPQSGILGMHRIEKRPIVVGNEIVVRPMMYLALSYDHRIVDGKGAVTFLVRVKENLEDPQRLLLDL

SEQ ID NO: 62699 - protein, 524 aa, Parvularcula bermudensis HTCC2503
MTDALDPSRHHDRLLVIDFGSQVTQLIARRLREDGIYCEIHPFNRVDAAFLEEFSPKGIILSGGPSSVRTATAPRPIEAIYAYGVPILGICYGEQCLVAQLGGEVERATHREFGRADVTVVSSSPLFQGVWTEGGTYPVWMSHGDRVIALPDGFHPIATTPSAPFAVIADELRNYYGVQFHPEVVHTLDGARLLSNFTRQICGLSGDWTMASFREEMTAKIKDQVGDGRVICGLSGGVDSAVAAVLIHEAIGDQLTCVFVDTGLMRQGEARAVVDLFREHYHIPLVHVEAEDLFLSKLEGVEDPERKRKIIGGTFIDVFEAEAKKIKGDFLAQGTLYPDVIESVSFDGGPSVTIKSHHNVGGLPERMNLKLVEPLRELFKDEVRHLGQELGLPEGFVKRHPFPGPGLAIRIPGAVTREKADLLRQADAIYLEEIRAEGLYDAIWQAFAVLLPVKTVGVMGDERSYDWVLALRAVTSTDGMTAESYPFEHRFLSRVATRLINEVDGINRVTYDVTSKPPGTIEWE

SEQ ID NO: 62700 - protein, 288 aa, Zea mays
YGKVYRAREKATGRIVALKKTRLPEDDEGVPPTAMREVSLLRMLSQDPHVVRLLDLKQGVNKEGQTILYLVFEYMDTDLKKFIRGHRNNREKIPEATVKILMYQLCKGVAFVHGRGVLHRDLKPHNLLMDRKTMALKIADLGLSRAITVPIKKYTHEILTLWYRAPEILLGATHYSTPVDIWSVGCIFAELVTNQPLFPGDSELQQLLHIFKLLGTPNEEVWPGVDKLPNWHVYPQWKPTKLSTLVPGLDADGYDLLEKMLVFEPGKRIPAKKALEHPYFNDVRKEMH

SEQ ID NO: 62701 - protein, 258 aa, Mycobacterium tuberculosis H37Rv
MMDLSQRLAGRVAVITGGGSGIGLAAGRRMRAEGATIVVGDVDVEAGGAAADELSGLFVPTDVCDEDAVNGLFDGAAETYGRIDIAFNNAGISPPEDNLIENTELAAWQRVQDVNLKSVYLCCRAALRHMVLAGKGSIVNTASFVAVMGSATSQISYTASKGGVLAMSRELGVQFARQGIRVNALCPGPVNTPLLQELFAKNPERAARRMVHVPLGRFAEPDEIAAAVAFLASDDASFITASTFLVDGGISSAYVTPL

SEQ ID NO: 62702 - protein, 407 aa, Parvularcula bermudensis HTCC2503
MPSDIQGALSRLSPLLDYEQHLQSIVGLLQSPTELIQRQLIIEREDGRSDALDAWRCRYNDFLGPTKGGLRFSPGVNADEVQRLAFLMTLKCALVGLPFGGAKGGVKVDISQCNDRERARIAHEFGRRFSDILGPERDIAAPDVGTGAPEMAAIARGYDRMGAGRGVVTGKPLDLGGIDLRFGATGKGAAIVVQSMRETLGLAEGKSARIAIQGFGGAGQAFARAMAENGDDLVAFADSTGTVSDPDGLNVEDMIEAKGQGNLSYTEESEAIFDKECDILCLAALGDAINRDRADRVGAKAVIEISNAGVAPEADASLRAKGVKICPDILVNAGGVIASYHEWVAYRTGNAQAIGDAEAQWRKSLISAASAVTEKCSVTDGDLRQAALLCALSRLDGAARHQGVYHR

SEQ ID NO: 62703 - protein, 455 aa, Mycobacterium tuberculosis H37Rv
MSTTQLINPATEEVLASVDHTDANAVDDAVQRARAAQRRWARLAPAQRAAGLRAFAAAVQAHLDELAALEVANSGHPIVSAEWEAGHVRDVLAFYAASPERLSGRQIPVAGGVDVTFNEPMGVVGVITPWNFPMVIASWAIAPALAAGNAVLVKPAELTPLTTMRLGELAVEAGLDEDLLQVLPGKGTVVGERFVTHPDIRKIVFTGSTEVGKRVMAGAAAQVKRVTLELGGKSANIVFHDCDLERAATTAPAGVFDNAGQDCCARSRILVQRSVYDRFMELLEPAVHSIVVGDPGSRATEMGPLVSRAHRDKVAGYVPDDAPVAFRGTAPAGRGFWFPPTVLTPKRGDRTVTDEIFGPVVVVLTFDDEADAISLANDTAYGLSGSIWTDDLSRALRVARAVESGNLSVNSHSSVRFNTPFGGFKQSGVGRELGPDAPLQFTETKNVFIAVGEEM

SEQ ID NO: 62704 - protein, 457 aa, Mycobacterium tuberculosis H37Rv
MTGPGSPPLAWTELERLVAAGDVDTVIVAFTDMQGRLAGKRISGRHFVDDIATRGVECCSYLLAVDVDLNTVPGYAMASWDTGYGDMVMTPDLSTLRLIPWLPGTALVIADLVWADGSEVAVSPRSILRRQLDRLKARGLVADVATELEFIVFDQPYRQAWASGYRGLTPASDYNIDYAILASSRMEPLLRDIRLGMAGAGLRFEAVKGECNMGQQEIGFRYDEALVTCDNHAIYKNGAKEIADQHGKSLTFMAKYDEREGNSCHIHVSLRGTDGSAVFADSNGPHGMSSMFRSFVAGQLATLREFTLCYAPTINSYKRFADSSFAPTALAWGLDNRTCALRVVGHGQNIRVECRVPGGDVNQYLAVAALIAGGLYGIERGLQLPEPCVGNAYQGADVERLPVTLADAAVLFEDSALVREAFGEDVVAHYLNNARVELAAFNAAVTDWERIRGFERL

SEQ ID NO: 62705 - protein, 321 aa, Physcomitrella patens subsp. patens
MIVSFGELLIDFVSTVAGVSLADAPAFKKAPGGAPANVAVGVSRLGGRSAFIGKVGDDEFGRMLADVLEKNGVNVKGLRFDIVARTALAFVALKECGEREFMFFRNPSADMLMVPSDLDEGLIRNAEVFHYGSISLISEPSRSTHLAAMKLAKQSGALMSYDPNLRLALWPSPEAARREILNIWNEADIIKVSDEEVKFLTNGGDDKLDEVVLGTLWHDKLKLLLVTDGPEGCRYYTPTFKGHVDSFKVAAIDTTGAGDAFVAGLLQTLAQNKSILSDEPALRAALRFACACGAITTTERGAIPAMPDLAAVTRFMGTVAA

SEQ ID NO: 62706 - protein, 324 aa, Enterococcus faecalis V583
MQKVIIDCDPGIDDTLALLYALASPELDVQAITVVCGNVPVEIGVENVFKCLEKVNRLDIPVYQGAASPLKRPFVSAQDTHGMDGLGETYFPRTSKIQAQALSAADYLAQTFQQATDCSIIALGPLTNIALGLKKEPLLGRNLQRFVSMGGTFKSHGNCSPVAEFNYWCDPDAAAWVFEKLGAKIEMVGLDVTREIVFTPTILNYCQRLNPKMGNYLAEITQFYFDFHWKYERILGCVINDPLAVAYFIDPTLCQGFSSYGQIVPDGIAMGQSMIDQYHFQQQPANCHVLTTVDSQQFFVKFLSILLNVQIDEIERDFKNLRMG

SEQ ID NO: 62707 - protein, 154 aa, Xanthomonas oryzae pv. oryzae KACC10331
MSQFDLTPPSPAQRDALIAGLSDEEQRVLLQHGTEAPFCGVFLDNKLDGVYTCRLCGLPLFRSSAKFESGTGWPSFFAPYDPAHVREIRDTSYGMIRTEIVCARCDSHLGHVFPDGPPPTGERHCLNSVSLGFTENGQALPNPLHREGAEAQSA

SEQ ID NO: 62708 - protein, 425 aa, Azoarcus sp. EbN1
MHTLSDINLAIIGLGYVGLPLAVEFGRKQHVTGFDIHAERIAELQAGRDRTLEVDARELAAAEYLRFTADPADLAECNVFIVTVPTPIDEHKRPDLTPLIRASETIGKVLKRGDIVIFESTVYPGATEEECVPVLERVSGLRFNHDFYAGYSPERINPGDKAHRVSTIKKVTSGSTPQVADLVDALYARIITAGTHKAPSIKVAEAAKVIENTQRDLNIALINELAIIFNKLGIDTEAVLEAAGTKWNFLPFRPGLVGGHCIGVDPYYLTHKAQAIGYHPEIILAGRRLNDGMGAYVVSQLVKAMLKRRIQVEGARVLVMGLAFKENCPDLRNTRVVDIVRELADYNVRVDVFDPWVDADEARHEYDITPIELPTPGQYDAVLVAVAHDQFKAMSAQGIRALGKPEHVLYDLKYVLPRQAADLRL

SEQ ID NO: 62709 - protein, 208 aa, Thermobifida fusca YX
MTETRRVICWRHGQTDWNIENRFQGQRDVPLNETGLAQAERAARLLAQLRPDAIVASDLQRAADTARALARIVGLPVTYDPALRERFGGPWEGLTRAEIAAGWPERLPTMDIPGGEDLGTVGKRVAEAIQRGLEKVPEGGTLVVVGHGAALRAGIHTMLGLQADQWEVLGTLSNCSWSVLGPSRSGGWRLLEYNARSLPEEKVLGDDR

SEQ ID NO: 62710 - protein, 490 aa, Banksia cuneata
GPGVSALEEKNLGRVAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62711 - protein, 343 aa, Azoarcus sp. EbN1
MIAYQALQSILRDAPKTWLVTGVAGFIGSNLLETLLKLDQRVVGLDNFATGHARNLDEVQTLVTAEQWARFAFVRGDIRQLDDCRRACAGVDYVLHQAALGSVPRSLDDPITSNATNIDGFLNMLVAARDAEVKSFTYAASSSTYGDHPSLPKVEDLIGKPLSPYAVTKYVNELYADVFARCYGFNTIGLRYFNVFGKRQDPNGAYAAVIPKWTTAMIQGEDVFINGDGETSRDFCFVDNAVQANLLAATTVDDAARDQIYNVAVSGRTTLNELYGYLQEALGQNGVNYDRTPKYRDFRAGDVRHSQADIDKANRLLGYAPQFDIRSGIQAVMPWYIGLIDPR

SEQ ID NO: 62712 - protein, 490 aa, Austromuellera trinervia
GPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62713 - protein, 174 aa, Bartonella quintana str. Toulouse
MIKKTVPNATFHTRVRDESIGGNNPYRWQEVNSDTYFKGKRVILFSLPGAFTPTCSTFQLPDFEKLYDEFKKVGIDEIYCLSVNDAFVMNAWKEAQGIKNVKLIPDGSGEFTRKMGMLVAKDNVGFGMRSWRYAAVIHDGVIEKWFEEEGYSDNCTTDPYEVSSPQNVLKALKG

SEQ ID NO: 62714 - protein, 355 aa, Bifidobacterium longum DJO10A
MTIHNSLAELIGNTPLVKLNHIPQAAGVKATIAVKVEYFNPGGSSKDRIAERIIDAAEQSGQLKPGGVIVEPTSGNTGVGLALVAQQRGYRTIFTLPDKVSESKRAVLRAYGAEVIVTPTDAGPDDPRSYYQVAERLANTIPGGFRPNQYDNPNGPLSHYYTTGPEIWEATDHKVTHFVAGIGTGGTISGTGKYLKEASNGAVKVIGSDPEGSIYSASSRDEVHQYDIEGVGEDFYPKAFDRNITDDIVRVSDAEAFEMTRRLAGEEALLVGGSSGMAVASAIKYALANDLDENQIVVVLAPDSGRSYLEKIFNDDWMRANGYGDIVERTSKPSLAEQYLNGAPSDEGAGDGLHN

SEQ ID NO: 62715 - protein, 539 aa, Oryza sativa Japonica Group
MSPATAAADDLRAEEEGKGGRSSSRQEEANVLLAVDAAEGGGAWSPVGWFRMLGRELHWSFVAGVVATYGASQGLGGGVMRVASDYYWKDVQRVQPSAAQVYQGVTSIPWMVKPLWGLLTDVLPIAGYRRRPYFVIAGFMGVVAMLVLSLHSKLHVLFALLALMAGSASVAIADVTIDACVAENSIVHPHLAADMISLNGFCASVGGLIGFSISGFLVHAIGSQGALGMLAIPSALVILAGMMIKDVHMPNFPYELAHMKFVEASRTMMATLKCPEVWRPCVYMYMSLALSVDIQEGMFYWYTDRNAGLSFSEGLIGFIFAVGSVGSLIGVILYQNILKDHSFRSVLCLSQLLLSLSGMLDLILVLRLNLKLGIPDYYFAVIDEGVSKMINRIKWMPLLVLSSKLCPPGIEGTFYALLMSIDNVGLLSGSWAGGLILHVLNITRTEFKNLWAAILIRNAMRLLPLALLFLVPRSDQNSNLLPADLLPEDDAAQYQMDNVELTSLTVDGKSSTGSLHQECKNQDVVENDDDEASLLANRS

SEQ ID NO: 62716 - protein, 164 aa, Ehrlichia chaffeensis
EHYAIIIENPDYSNPIIRIHSSCYTGDLLNSLSCDCRCQLHTAIKLMIENKGGIILYLAQDGRGIGLANKIRTYQLQIKHNFDTVDANRFFGFEDDERVFIPAIKILQKLGISRLQLLTNNPNKISEIQNHGIQVTKILPIFVDTNQHNINYINTKAKRLGHVC

SEQ ID NO: 62717 - protein, 208 aa, Methanosarcina barkeri str. Fusaro
MAFDEEWIPKTRLGKLVMEGQVASMEEAIKSGLPIREPQIIDMLLPDLEDEVLDINMVQRMTDSGRRVKFRATVIVGNRNGYVGLGQAKDVQVGPAIRKAIDAAKLDITYIHRGCGSWECACGLPHTVPYEVTGKAGSVSVTLIPAPRGLGIAAGNTATKVLEKAGIKDVWTKTFGTTRSTLNFAKATFDALNQVNVMRLPVYCKEEA

SEQ ID NO: 62718 - protein, 382 aa, Oceanicola granulosus HTCC2516
MTDAFRPTACLALADGTLFYGRGFGAVGETTAELCFNTAMTGYQEIMTDPSYAGQVVTFTFPHVGNVGVNPEDDETADPVAAGMVVKWDPTEPSNWRAAEALTPWLARRGRIGIGGVDTRRLTRAIRHQGAPHVALAHDPEGKFDIDALVQKARAFRGLEGLDLAREVTCAQSYRWSETKWSWPHGFGRLEAPRHKVVAIDYGAKRNILRSLASTGCDVTVLPATATADDILALAPDGLFLSNGPGDPAATGVYAVPTIREVLERSNMPVFGICLGHQILALALGARTVKMNHGHHGANHPVKDKETGKVEITSMNHGFTVDTQSLPEGVRETHVSLFDGSNCGIRMEERPVFSVQYHPEASPGPQDSAYLFDRFSAAMDAA

SEQ ID NO: 62719 - protein, 807 aa, Oryza sativa Indica Group
MEVEEEAFFDTREELLPPSPAAALPWSGGLDSVRQRRERFMRSMGLERSPSLRQADFADVVGDVEEEGEVAAEAAAAEIGRWSSQSDENECSMSSWSTEETTSYDDGASDDNSVSGSGKASRSFSSLSFIQRLMSRNGKPSGAPKTIDRRRNGWLRRLGVSACVVDSGAADEASTSSSDSEQIEAGRYERIKVHSYRKRSKELSAVYQGQVIKAHDGAILTMKFSPDGQLLATGGEDGVVRVWAVMQSEDCKIPLDDPSCVYLKARRKYGLAPVNAESEKKSKINGLKKSDSACIVVPTMVFQISEEPVHEFRGHSGDVLDLSWSSNKHLLSASTDKTVRMWEIGYANCIRVYPHSNFVTCVQFNLADENLFISGSIDGKIRVWDITRSSVVDWVDIRDIVTAVCYRPGGKGVVVGTITGNCRFYEISDNLLKLETQIALNGKKKSSLKRITGFQFCPSNPSKLMVTSADSKIRILDGTNVIQNYSGLRSGSCQLSATFTPEGQHIISASEDSNVYVWSHENQYECACKQAKTTQTSEHFRSNNAAIAIPWNGTKPRSPVPLSSQILPPQGDTFWSMSKAIKYNSSLCGKDSSIKKIVSTPAAPGIFNLNQEFFIESSCKSSATWPEEMLPSTTASVNLDESQFKLLRNCFQGTSNSWGQVIVTAGWDGRIRCGQFVLLFGVTSCLLWTLWSISRAIIVPLMGPEEGEFPAILGLERVLDYVKQTIYIKPTILTMSNTGLSRNTSSVRLSGFVYSFISFKISGSAASQKHVGKAEKATAADSEVSRFHSYYSTVETVEENLQQPSNY

SEQ ID NO: 62720 - protein, 483 aa, Fulvimarina pelagi HTCC2506
MDASYEGKALDHFDLLVIGSGPSGRRAAIQAAKLDSSVLVVERGRRVGGVSVHTGTIPSKTIRETALNLSGWRERGFYGRSYRVKKDITAGDLRERLHKTLNHEIEVLEHQFARNKVATLRGEARFVDPHTVEVESEGGETQRFTADTFMIAVGTQPFRPDYVPFDGKRIFDSDEILELPELPRTMAVIGAGVIGVEYASIFNSLDVKVTLVEPRQTMLDFIDDDILDDFTYDLRDRGVAMRFGQKVEAVKRVGDGCEIVLEGGRKVQAQMVLFAAGRMGSTDRLGLDAAGLSADHRGRLSVNPKTLQTAVPHIYAAGDVIGFPSLASTSMEQGRIAACHALSKPTHQPPEFFPYGIYSVPEISTVGMSEKEVLERDIPYEVGVARLRETSRGHIMGLNSGMLKLLFSIKTRRLLGCHIVGEGATELIHIGQAVLNLKGTLEYFVENTFNYPTLAEAYKIAALDAYNRMSATKVAEVSDMPAQ

SEQ ID NO: 62721 - protein, 369 aa, Bradyrhizobium sp. BTAi1
MKTRAAVAFEAKKPLEIVEVDLEGPKAGEVLVEIKATGICHTDAYTLDGFDSEGIFPSILGHEGAGIVREVGPGVTSVKPGDHVIPLYTPECRQCKSCLSRKTNLCTAIRATQGKGLMPDGTSRFSYKGQTIYHYMGCSTFSNFTVLPEIAVAKIREDAPFDKSCYIGCGVTTGVGAVVNTAKVEPGSNVIVFGLGGIGLNVIQGAKMAGADKIIGVDLNDGKEEWGRRFGMTHFVNPKKVTGDIVQHLVALTDGGADYTFDCTGNTTVMRQALEACHRGWGESIIIGVAEAGKEISTRPFQLVTGRVWKGTAFGGARGRTDVPKIVDWYMNGKIEIDPMITHTLKLEEINKGFDLMHEGKSIRSVVVF

SEQ ID NO: 62722 - protein, 171 aa, Triticum aestivum
  misc_feature (113)..(113): Xaa can be any naturally occurring amino acid
MELHRGGYRSKTSGSAGHGVCSRDHYLKHPIRTDRTRGLFGATQLTPKLAYPFPPPSAMGTTTRVLPDARQNPNSVPVTLVPRGPSARITKTALPDGTASHTAKWMQDRSKKXPMELINEGPPIDDEGRIAIREGDKDPALDHPIDYICLDLDAPAVCNYSALRYAQDPHH

SEQ ID NO: 62723 - protein, 84 aa, Zea mays
PMGVFEFDKFAVGTEAVAKKLAELSGKGVTTIIGGGDSVAAVEKVGVADVMSHISTGGGASLELLEGKELPGVVALNEAATVTV

SEQ ID NO: 62724 - protein, 344 aa, Oryza sativa Indica Group
MAASSSSAPALADAYDIPWVEKYRPTRVADVVGNSDAVARLQVIARDGNMPNLILSGPPGTGKTTSILSLAHELLGPSYREAVLELNASDDRGLDVVRNKIKMFAQKKVTLQPGRHKIVILDEADSMTSGAQQALRRTMEIYSNTTRFALACNTSSKIIEPIQSRCAIVRFSRLSDQEILGRLMIVVAAEKVPYVPEGLEAIIFTADGDMRQALNNLQATVSGFRFVNQENVFKLIVILYWLQVCDQPHPLHVKNMVKNVLDGKFDEACSALKQLYDLGYSPTDIITTLFRVIKNYDMAEYLKLELLKETGFAHMRICDGVGSFLQLSGLLAKFALVRETAKAS

SEQ ID NO: 62725 - protein, 334 aa, Fulvimarina pelagi HTCC2506
MAEYDLLCIGNAIVDVISHCEEDFLTKESIQKGGMTLIDTARAEQLYDAMPPGMEASGGSAANTIACFTSLEGKGAFIGKVADDQLGSIFSHDIRSIGIAFNSEPNRGEGEPTARCLILVTPDGERSMNTFLGACTELGPEDIDEALVKASKVTYFEGYLWDPPRAKEAIVKAAKAAHEAGNEVAMTLSDAFCVERYRAEFLDLLRSGTVDIVFANEAEALSLYETDNLDDALDGLGRDAPKLAVVTRSEKGCIIVEGQARTVVPASKVEKVLDATGAGDAFAGGFLKGYIDGMPSELCGRLGVECAAHIIAKVGARPERPLKELSAVQTMLAA

SEQ ID NO: 62726 - protein, 272 aa, Physcomitrella patens subsp. patens
MGLQHYADLESCLSVAVDAAKRAGQIIANNFNTAKVIEHKGMVDLVTETDKACEDLIFKLLKSTFPSHELIGEETSAENGTPLLTDAPTWIVDPLDGTTNFVHRFPFVCVSIGLVVNKVPVVGVVYNPILKELFTAVQGKGAYLNGKLIHASSQDKIGNSILATEVGTTRDKQTVDRTTNCINNLLFQVRSVRLSGSCAMNLCGVACGRLDMFYETGFGGPWDVAGGALIVQEAGGLIFDPSGKDFDLMSRRIGASNGHLKQPLVTALTSYV

SEQ ID NO: 62727 - protein, 641 aa, Desulfovibrio vulgaris subsp. vulgaris str. Hildenborough
MALLSLQNITLNLGGRPLLDGATLHVEAGERLCLVGRNGAGKSTLLRLMAGDLRPDAGEVVRAQGTRFGHMPQDVPAHLSGSVYEVVAEGMGPDGVALAAYHRLETGHADSGTLDAARHHLDTGNGWERHGDMMTVLNHLHLDPDARFEELSGGLKRRALLARALVSSSDVLLDEPTNHLDIEAISWLEDFLQRRARTLVFVTHDRTFLRHLATRIVELDRGQLFAYDCGYDAYLERREERLENETRQNALFDKKLAQEEAWIRQGVKARRTRNMGRVRALQALRSERAERRERMGTAAMRVHEAERSGKLVIEATGVTFAHGDSEPVLRDVDVCIQRGDRVGLIGPNGAGKTTLLRILLGDLEPQQGRVRHGTRLEVAYFDQMREALDIDANAMDNVANGNDRVTVNGVNRHVAGYLREFLFDDDRMRIAVRHLSGGERNRLLLARLFLRPSNVLVLDEPTNDLDVETLELLEELLTDYSGTVLLVSHDRTFLDNVVTSTIALEGQGIVREYIGGYEDWLRQRDEPQRPAREARDVATATQPAERRAVDTRPRKLTFKEQRELAEARDELEQLPARLEALETEQAVLERRLADPASFGSDMSALTETGERLASLEEQQLTLLERWEELEARIAELEMCRS

SEQ ID NO: 62728 - protein, 128 aa, Triticum aestivum
  misc_feature (63)..(63): Xaa can be any naturally occurring amino acid
  misc_feature (65)..(65): Xaa can be any naturally occurring amino acid
  misc_feature (73)..(73): Xaa can be any naturally occurring amino acid
PIPGALVSGNWNEYNLNPLTRIHWRASLVPCKVTGKCGSVTVRMVPAPRGSGIVAARVPKKVXQXAGIDDVFXSSRGSTKTLGNFVKATFDCLMKTYGFLTPVFWEGDHPFTQGATRFTGTSLKADQG

SEQ ID NO: 62729 - protein, 161 aa, Symbiobacterium thermophilum IAM 14863
MRIRLVTVGKVKEKYLQDGVQEYLKRLRPYARVEIVTVPDEPIPDGASPAQEAQVMQREGERLLRALDQGGQEHVVVLDGRGKNFSSEELAAFLAERALHGDANLAFVIGGSLGLDPAVLARAGTTLSLGRMTFLHQMVPLILLEQIYRAFKINRGEKYHK

SEQ ID NO: 62730 - protein, 490 aa, Musgravea heterophylla
GPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYPRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62731 - protein, 490 aa, Lambertia formosa
DPGVSTLEEKNLGRVAQLIGPVLDVAFPRSKMPNIYNALVVKGRDTAGQQTNVICEVQQLLGNNRVRAVAMSATDGLMRGMGVIDTGAPLSVPVGGATLGRIFNVLGEPVDNLGPVATRTTSPIHRSAPAFIQLDTKLSIFETGIKVVDLLAPYRRGGKIGLFGGAGVGKTVLIMELINNIAKAHGGVSVFGGVGERTREGNDLYKEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGKEHYETAQRVKQTLQRYKELQDIIAILGLDELSEEDRLAVARARKIERFLSQPFFVAEVFTGSPGKYVGFAETIRGFQLILSGELDGLPEQAFYLVGNIDEATAKAMNLEVESNLKK

SEQ ID NO: 62732 - protein, 308 aa, Rhodopseudomonas palustris CGA009
MATGTSTIDFAKRLDTTAEETEALLGRLLSDELMSDEIARPRRLMDAIRYSTLGGGKRLRPFLAVESAAVFGIDRAAALLVGAALECIHCYSLIHDDLPSMDNSDLRRGRPTLHKAYDDATAILAGDALLTFAFDIVTRDEVHNDPTVRLLLTRVLARCAGLGGMVGGQMLDLAGEGRFGDREPVDVARLQQMKTGALLRYGCVAGAILGQASPDQYRALDDYGRALGEAFQIADDLLDVEGDAAALGKPAGADAALGKTTFVTQLGIDGAKQRLRDLVARADQALAPFGERGEVLRAAARFVAERKS

SEQ ID NO: 62733 - protein, 205 aa, Photobacterium profundum SS9
MELTMSVLVGRPAPDFTAAAVLGNGEIVDSYNLFENIKGKAAVIFFYPLDFTFVCPSELIAFDKRYADFQSKGVEVIGISIDSQFSHNAWRNTLVEDGGIGEVQYPLIADTKHEICKAYDVEHPEAGVAFRGSFLIDKEGMVRHQVVNDLPLGRNIDEMLRMVDALQFHEEHGEVCPAQWEKGKEGMDASPAGVAAYLSEHTDDL

SEQ ID NO: 62734 - protein, 206 aa, Prochlorococcus marinus str. MIT 9301
MTDTPTKQEIQSKNDNVPGATPVEQKKNNRNDRKRNRRGDSKNLERDSDWQERVVQIRRVSKTVKGGKKMSFRAIVVVGNEKGQVGVGVGKAGDVIGAVRKGVSDGKKNLVRVPLTPNNSIPTLSLGRDGAANVLIRPAAPGTGVIAGGSIRTVLELAGIKNVLAKRLGSKTPLNNARAAMVALSQLRTHKSASKERGISLEQLYS

SEQ ID NO: 62735 - protein, 545 aa, Candida albicans SC5314
MVEDKDIDLNINNLKIHDAPTRTPPVSSPPALPTPPTPSGISLNTTMQAKLMAFQQQRSKAAAAAAAAASVSSSSSGTQASSSSISASTSESSVSTIPANINRTVSGKKKPKPNLKLSDLPLSRNNSLHRSNTSASDSSVTTPEADTPTGKISNEPQPQGLFANYSDYVDIKSGQLNFAGKASLHSKGIDFSSGSSFRVSLDEFEYLEELGRGNYGSVSKVLHKPTGVLMAMKEVRLELDENKFTQILMELDILHKCDSPYIVDFYGAFFVEGAVYMCIEYMDGGSLDRIFGNDVGVKDEYELAYITESVILGLKELKDKHNIIHRDVKPTNILVNTQGKVKLCDFGVSGNLVASLAKTNIGCQSYMAPERINTMRPDDATYSVQSDVWSLGLTILELAVGHYPYPAETYDNIFSQLSAIVDGEPPKLYPKVYSKEAQIFVKSCLAKNPDLRPSYAALLNNPWLIKNRGKETNLAQTVKDRVEEIAKLEKNKSVSRSNSMNKSAAAVPPPRNVESVQSLLRNKVKAPALHRGGLQKVNRSFLNNH

SEQ ID NO: 62736 - protein, 639 aa, Trichodesmium erythraeum IMS101
MNNFFGLDVKDLVELAKTLEEKAKSGEIKTSFEVQSGPMRNIPRHGNIPRGMGRSNYQAQTGQSSQDTNFTVQSPNKDSVTQNRAQEKTNSTTSSPETKLRPTLRDIGGMSEVIQELREVIELPLKRPDLLTKLGLEPSRGVLLVGPPGTGKTLTAKAIAEELGLNYIAINGPEVMSKYYGEAEGKLRDIFAKAKKSAPCLIFIDEIDSIAPDRSKVEGEVEKRLVAQLLGLMDGFEVLEGVLLLAATNRPDHIDPALRRPGRFDQEVYFHVPDRDGRSEILQILTKAMPLDNSVDLEEIADLAVGLVGADLKAVCQKAAYFALRREVPSLENLNIQTPEDMSLLQSDLLRAIKEIKPSILRSVAVEVPNVSWQHIGGLDVVKQKLQESVEGALLYPELYEKTKAKAPKGILLWGEPGTGKTLLAKAVASQAQANFIAVNGPELLSKWVGAAEEAVRELFSKARQVSPCVIFIDEIDTLAPARGKTMGDSGVSDRLVGQLLTELDGLRDCTQLLLVGATNRPDALDPALLRAGRLDLQIKVDLPDQASRLEILKVHNQDRPLEEVNLEDWASRTEGWNGADLALLTNQAALAAIRSYSAQGIKSSKENDIKITSADFENAYNALKSQKQSNNFDSDICV

SEQ ID NO: 62737 - protein, 342 aa, Haloarcula marismortui ATCC 43049
MAGRYEPIDSPDETTLFPYHDLTPPTVATVARARQRIRQHLPETPLVRSEALSEALDADVLLKREDTLPTGAFKVRGGVNLVASLDEEFHDAGLLAASTGNHGQSIAWAGREFDVPVTIGVPEEANAGKVGALEQLGAEVIQYGEDYDEAREHIEDLATQREARYVHSGNEPKLLAGVGTAGLEILDERPDVDRVFCPVGGGTAAAGYCTTLGAMTDADVVGVQAAGAPAVYRAWQDETLDALDSVDTIAEGVATRVPFALPTEILQAGLADFRLVSEDAITDAVARLFETDRIVMEGACATAVAAAIQAGDELRGETVVLPISGRNIDREKFDRLLAESEY

SEQ ID NO: 62738 - protein, 590 aa, Mycobacterium leprae
MRRTHATGDRYAIDALRAALCSRWIDAGGTTGGCRRGVDREAALCVAACLGSCCQPLDWLPVADSAGLDQPEPSPRPVLVVDFGAQYAQLIARRVREARVFSEVIPHTTSIEEITARDPLAIVLSGGPASVYTEGAPQLDPALFDLGLPVFGICYGFQAMAQVLGGTVARTKTSEYGRTELKVLGGDLHSGLPGVQPVWMSHGDAVTAAPDGFDVAASSSGAPVAAFENRDRRLAGVQYHPEVMHTPHGQQVLSRFLHDFAGLDADWTAANIAGVLVEQVRAQIGNGHAICGLSGGVDSAVAAALVQRAIGDRLTCIFVDHGLLRDGERGQVQRDFVAATGAKLVTVDAAETFLQALSGVTNPEGKRKIIGRQFIRAFEGAVRDLLGDSTFDSGIEFLVQGTLYPDVVESGGGSGTANIKSHHNVGGLPDNLRFKLVEPLRLLFKDEVRAVGRQLDLPEEIVARQPFPGPGLGIRIVGEVTAERLDTLRRADSIAREELTTAGLDYQIWQCPVVLLADVRSVGVQGDNRSYGHPIVLRPVSSEDAMTADWTWVPYEVLECISTRITNEVAEVNRVVLDITNKPPGTIEWE

SEQ ID NO: 62739 - protein, 472 aa, Debaryomyces hansenii CBS767
MNGEELVLNDTVENSDVSNVDMQSDKPDDVTVVEHSPIDQQTEVNYRIWKKNAPFLYDYITTHSLLWPSLTVQFFPDLEKPLSKDAMLDPFQDFKKADSNGSKSENEASMQRILLGTFTLGQSTDSISILQLPYYTNLNKNLTIDKLDYNHEKEEFELTKIAKKKINVLQKINHWGDVNKLRYMPQNPDVIASSNNLGNLVIYDRTKHASFKNSLIGEDTEINKPQLHLINEWNPSDADIFAIDWNKQKEGVIISANMEGNINLYDIKSKFTSKDVQTINESQHFGNSNIAINDIEWIPNHDSILTYVDDQGSIKLLDVRLPEHQLLVLQHQKSNKGINSVSVNPGNQACLATGDIDGMIDVWDIRSFGSGNANSVYNIKKQHEGSITQLKWHPKYHNILASSSSDKLVKIFDLNTIEEEEGLIFTHAGHMLGVNDLDWSLHDDWMMASVADDNSLHVWKPSSQIVKQYKSI

SEQ ID NO: 62740 - protein, 303 aa, Haloarcula marismortui ATCC 43049
MKDSILDTIGSPLVSVRAPEGATVAAKIESFNPGGSAKDRPAKYMIDDAERNGSLQPDDTLVEPTSGNTGIGMAMVGATKGYDVVLVMPSSKSPERRQIMKAYGAEIELVEGDISDAKERANELCERDDYVQLRQFENPANPTAHYETTGEEILEQVGDRTVDALVAGVGTGGTLTGTGRRLQDAFPGMDIVAVEPADNAVLSGMEPGTGEDSFQGMGPGFVSDNLDTDLLDDVMTVELPDAEDECRRLAHEEGILVGQSSGASNLAAREFAEQLIRDGVDDPLVVTVYWDSGERYMSTGMFD

SEQ ID NO: 62741 - protein, 448 aa, Oryza sativa Indica Group
MEKSELLLGSYSYAALCGVTLIIGWLAHWIYKWMNPPCIGRLPPGSMGFPIIGETFQFFRASPSIDMPSYYKQRLERYGPLFKTSLVGRPVIISLDPEVNRFIFQQEGKLFQSWYPETAINIFGKKSLTTYNGTIHKFIRGVAAKLFGLENLKESLLPELENSMRESFASWTGKPSVEVQDGVSDMIFDLVAKKLIGLDVTNSRELRKNFQDFFQGMVSFPIYFPGTSFYRSMQGRRNVRNTLTDIMKERLSAPGKKYGDLVDLIVEELQSEKPMIDENFAIDALAALLFTSFATLSSTLTVAFKYLTDNPKVVEELKEEHGTILKKREGVNSGFTWEEYRSLKFSTQVMNEITRISNVTPGVFRKTLTDVQVKGYTIPSGWLVMISPMAVHLNPKLFEDPLKFDPWRWRTVSKSIIGTKGGKSKASEARAPPLSSIRTLCNYAALGY

SEQ ID NO: 62742 - protein, 424 aa, Solibacter usitatus Ellin6076
MAAFERILKRLLVVPALAAALGVASAQTTPPDSQAAPPETNTFTAEQLTDLVAPIALYPDPLLTQVLVASTYPLEVVEAQQWLQQNPGLQGTELTDAAKQQPWDPSVQALVAFPDVVTRLNQDIRWTRDLGNAFLSQEADVMAAVQRLRVSAQANGRLNSTPQQTVSTETQGGEPAIIIQPANPDIMYVPVYDPAYIWGPPLWGFYPSLYYPAFGFGWGPGINIGLCFGGWGGWGGWGWGPNWFNHTVVVNNNFFHRYAFRGAGNVGVNRVTWTHDPMHRLGIPYPNRQLTGRYQSASMASRGNFPGVAGRPGNLPNGNRPAMTGRMPGNAGNPQAYRGMPPSQGGAARSMPVPQSRPMQAMPHYGSPTMGGGGMRGFGGGGHSFGTPGGGHSFGGGFGGGGHGFGGGGGHGFGGGGGHGGGHR

SEQ ID NO: 62743 - protein, 490 aa, Oryza sativa Indica Group
MYAYVGLVGAAAALVLLLRHQARRWRNPRCGGQLPPGSMGLPLVGETFQFFSSDASLDIPPFIRHRLASLGCKFRYGPIFKTSLVGHPVVVSADEELNHMVFQQEGQLFQSWYPDSFVEILGKDNVGEQQGAMFRYLKNMVLRYFGPESLKEGIIRDVERAVSSSLCTWSTLPAVELKEAVSTMVFDLAASKLLGLEPSRSKILRKSFFDFVRGLISFPLYLPGTAYYSCMQGRRRAMVVLEQVLEERKQSTGLQRGGEAQQHGDFLDYVIQEITKEKPVMTEKMALDLMFVLLFASFHTTSLALTLAVKLLADHPLVLEELTVEHETILKDREAGSELDRITWKEYKSMAFTSQVINETVRLANIAPVIFRKALKDIRFNGYTIPAGWGVMVCPPAVHLNPYIYPDPLTFIPSRFKDKPEINRGSKHFMAFGGGLRFCVGADFSKLQLAIFLHFLVTKYRWIPLGASRVVRTPGLEFPDGYRIKVIQRH

SEQ ID NO: 62744 - protein, 474 aa, Anabaena sp.
MTTPQEVLKRIQDEKIELIDLKFIDTVGTWQHLTLYQNQIDESSFSDGVPFDGSSIRGWKAINESDMTMVLDPNTAWIDPFMEVPTLSIVCSIKEPRTGEWYNRCPRVIAQKAIDYLVSTGIGDTAFFGPEAEFFIFDSARFAQNANEGYYFLDSVEGAWNSGKEGTADKPNLAYKPRFKEGYFPVSPTDSFQDIRTEMLLTMAKLGVPIEKHHHEVATGGQCELGFRFGKLIEAADWLMIYKYVIKNVAKKYGKTVTFMPKPIFGDNGSGMHCHQSIWKDGKPLFAGDQYAGLSEMGLYYIGGLLKHAPALLAITNPSTNSYKRLVPGYEAPVNLAYSQGNRSASIRIPLSGTNPKAKRLEFRCPDATSNPYLAFAAMLCAGIDGIKNLIHPGEPLDKNIYELSPEELAKVPSTPGSLELALEALENDHAFLTDTGVFTEDFIQNWIDYKLANEVKQMQLRPHPYEFSIYYDV

SEQ ID NO: 62745 - protein, 461 aa, Colwellia maris
MSTGKVVQIIGAVVDVEFPQDAVPQVYDAVKITEGDLEGLVLEVQQQLGGGVVRTIAMGSSDGLRRGLNVENTGQGIQVPVGVETLGRIMNVLGEPIDEAGPIGEKDRWSIHREAPAYAEQSMSNELLETGIKVIDLVCPFAKGGKVGLFGGAGVGKTVNMMELIRNIAIEHSGYSVFAGVGERTREGNDFYHEMNDSNVLDKVSLVYGQMNEPPGNRLRVAFTGLTMAEKFRDEGRDVLFFVDNIYRYTLAGTEVSALLGRMPSAVGYQPTLAEEMGILQERITSTNKGSITSIQAVYVPADDLTDPSPATTFAHLDATVVLSRDIASQGIYPAIDPLDSSSRQLDPLVVGAEHYETARGVQTVLQRYKELKDIIAILGMDELSEDDKQTVFRARKIQRFLSQPFFVAEVFTGSPGKYVSLKDTIAGFKGILAGDFDDMPEQAFYMVGSIEEAVEKASKM

SEQ ID NO: 62746 - protein, 518 aa, Lentinula edodes
MFYFSSFLLLGPIGGALAAIGPVTDLHIVNSFIQPDGFNRSGVLAEGVFPGPLITGNKGDNFQINVIDELTNGTMLLSTSIHWHGLFQKTTNWADGPAFVNQCPIAANDSFLYNFNVPDQAGTFWYHSHLSTQYCDGLRGPLVVYDPQDPYADLYDVDDDSTVITLADWYHVPAPQAGAVPTSDATLINGLGRSVNGPADAPFAVVNVVQGSRYRFRLVSISCDPNFLFSIDGHTFTVIEADGVNHEPIVADSIQIFAAQRYSFILTANQTADNYWIRANPNNGHTGFAGGINSAILRYSGAPVADPVTTQTSANLLQETSLVPRENPGAPGNATANGVDVDLNLVLSFVGGRFEINGVSFVPPTVPVLLQILSGATTAAELLPSGSVYTLPLNSVIQLSFNTVAVAAVGGPHPFHLHGHTFDVVRSAGSTEYNYINPPRRDVVSTGAATDNVTIRFTTDNAGPWFLHCHIDWHLEAGFAIVFAEDAPDVAAVNPVPDAWNQLCPTYDALTPAQLGGN

SEQ ID NO: 62747 - protein, 135 aa, Thermobifida fusca YX
MERTLVLIKPDGVRRNIIGEVISRIERKGLKIVAMELRTLDEETAKAHYEEHVEKPFFSSLVEFITGGPLVAMVVEGNRAIEAFRSLAGATDPVLAAPGTIRGDYGLDVQANIVHGSDSTYSAEREIKLFFPDLA

SEQ ID NO: 62748 - protein, 533 aa, Lentinula edodes
MLPFVSLLAAELVCLVYGAEVIRDTTTYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDAYHNFSIDGHRLTVIEVDGENHEPATVDNIQIFPGQRYSFVLSATQPVDNYWVRALSSSGVGFSGFTGGLNSGILRYQGAPDADPTTTNSTGVVLTESMLHPLENPGAPGLPFPGGADEVLNLTLGFNLPATFFMNDTQYIPPTVPVLLQILSGAQSPQDLMPPGSVYTLPINKTIEINFFGNATPGGPHPFHLHGHSFDVVRSADNTTYNYKNPVRRDVTAVAIGNQTTIRFVTDNPGPWFLHCHIDLHLEFGLAVVMAEAPSLVKATDVTTPAWDELCPIYDSLTPAQLP

SEQ ID NO: 62749 - protein, 112 aa, Petunia x hybrida
MAGKLSIVLFVLLVVLLAQNQVSRAKMVLDSKVQRRGNDQIYGVSQGSLHPQDCQPKCTYRCSKTSFKKPCMFFCQKCCAKCLCVPAGTYGNKQTCPCYNNWKTKEGGPKCP

SEQ ID NO: 62750 - protein, 505 aa, Lentinula edodes
MLPFVSLLAAELVCLVYGAEVIRDTTSYGQTVSENLFIVNKQLAPDGFQRSTVLAGLTPSTGSFPGPLISGNKGVRFNLNVTDQLTDPSMVRSTTVHWHGLFQKTTNYADGVAFVSQCPIAANHSFLYDFQVPDQAGTFWYHSHISVQYCDGLRGPLVIYDPQDPQAYLYDVDDETTVLTIADWFHNTSTELIAAAVAPPADATLINGKGRYLGGPAVPLAVINVQQGKRYRFRMISIACDANHNFSIDGHRLTVIEVDGENHEPATVDNIQIFPGQRYSFVLDATQPVDNYWVRALSSSGVGTSGFIGGLNSGILRYQGAPDADPTTTNSTGVVLTESMLHPLENPGAPGLPFPGGADEVLNLTLGFNLPATFFMNDTQYIPPTVPVLLQILSGAQSPQDLLPPGSVYTLPINKTIEINFFGNATPGGPHPFHLHGHSFDVVRSADNTTYNYENPVRRDVTSVAIGNQTTIRFVTDNPGPWFLHCLLLKPYRPSFGIRTCRRNG

SEQ ID NO: 62751 - protein, 203 aa, Chlamydomonas reinhardtii
MSAPVPPAAPTSVGSAPSPPPGVGALMLIAGRLKEYASGVARQGKPWAEVVDRNAFSKPGNLAEATSRLRKNANYFKVNYLIVMLLCTAFTFVLHPSSLLVLALLAGSWIYVFLMRTTPLVISGRTLSEREKLIGMSAISFITIFFLTSVGTVFFSALSISIALIALHGAFREPDNLFIDEGETQQGFMNIFAVPAVPATVST

SEQ ID NO: 62752 - protein, 176 aa, Zea mays
  misc_feature (33)..(33): Xaa can be any naturally occurring amino acid
  misc_feature (63)..(63): Xaa can be any naturally occurring amino acid
  misc_feature (139)..(139): Xaa can be any naturally occurring amino acid
  misc_feature (150)..(150): Xaa can be any naturally occurring amino acid
MSPDKSMNNYINLDARLHHNWVVGGSKLTMREXDAAGHMGSLFMSLMIHKKSDSEFTIDAIRXFATQVQVKNLLKCIEDVIPANARDNESRTPLHCIIDRVHRNVDHTLIDTTAHDNARDNEVQISLYYAVVTLERCTXELLMQQMADTXIKDEHVNSPLDLYESDSTCIRVDEDS

SEQ ID NO: 62753 - protein, 437 aa, Magnaporthe grisea 70-15
MAKYVDAAKQDLREDVTWQKAGRLSRRGIKEFPEASVQYLLDKAPIIGWLPKYNPRWLINDAIAGLTLGLMLIPQGLAYAKIAEIPVEYGLMSSWLPASIYAIMGTTKDLSTGPTSLIGLLTSEGVHEFGEEYTPSQVASAMALWMGVFGMVLGFLKLGWLLEFISLPILSGFITAVAITIALNQMPSLLGISGVGSGTAQQIHDVFAFLPRASLMTCTFTRVTASGIPAPSDISDRDLPHPDSPQARDVHVFRFNDSFFFPNSYMCSTAILDSIQTYHAPAYHGAQGPEVRERNWSVVAEKRIQRLRRRAGVTDPDALPPIGLVVLDFGRVNHVDSTACSHLKNLAKEISRYGGKHVELRFVGMTEYVRERFDATLLFPTVAAAVLAPRRNDAPEVVQHDFDEKRSSSEDLEKGMAMHAETADRSSSQERKTEARP

SEQ ID NO: 62754 - protein, 377 aa, Nepenthes alata
AVIGSGVLSLAWAIAQLGWIAGPAVMLLFSFVIYYTSILLADCYRVDDPIFGNRNYTYMDAVRSNLGGVKVKVCGLIQYLNLIGVAIGYTIAASISMMAIRRSNCFHNSGAKKPCHMSSNPYMIMFGILEIILSQIPDFDQIWWLSIVAAVMSFTYSTIGLSLGIAQVAANKAFKGSLTGISIGAVTQTQKIWRSFQALGDIAFAYSYSIILIEIQDTVKSPPSEAKTMKKASLISIVVTTAFYMLCGCMGYAAFGDIAPGNLLTGFGFYNPFWLLDIANAAIVVHLVGAYQVYCQPLFAFVEKSASGKWPKNAFINKGIKIQIPGFGAYDLNIFRLAWRTAFVITTTIISMLLPFFNDIVGILGAFGFWPFTVYFP

SEQ ID NO: 62755 - protein, 376 aa, Nepenthes alata
AVIGSGVLSLAWATAQLGWIAGPTAMLLFSFITFYTSRLLADCCRSGDSFTGERNPTYMDAVRSNLGGIQVKICGLVQYANLFGVSIGYTIAASISMMAIKRSNCFHASDDKNPCQYPASPFMIIFGLTEIIFAQIPDFHRLWWLSIVAAVMSFTYSTVGVSLGIAQVAENGKIKRSLTGISIGTVSQAQRIWRRFQALGDIAFAYSYSLVLVEIQDTIKSPPSEIKTMKKATVMSIAVTTLIYLLCGCMGYAAFGDLAPGNLLTGFGFYNPYWLLDLANAAIVVHLLGAYQVCCQPIFAFIETTASNAFPDNEFITKEVEIPIPGFKPYKLNLFRLVWRTSFVGVTTTISILLPFSNGVVGLLGALAFWPLTVYY

SEQ ID NO: 62756 - protein, 350 aa, Oryza sativa Indica Group
MGSSCSRSHSLSEAETTKNAKSADIDRRILQETKAEQHIHKLLLLGAAESGKSTIFKQILYEGAKELSQVESDSSKYVISPDNQEIGEKLSDIDGRLDYPLLNKELVLDVKRLWQDPVIQETYLRGSILQLPDCAQYFMENLVRLAEAGYVPTKEDVLYARVRTNGVVQIQFSPVGENKRGGEVYRLYDVGGQRNERRKWIHLFEGVNAVIFCAAISEYDQMLFEDETKNRMMETKELFDWVLKQRCFEKTSFILFLNKFDICEKKIQKVPLSVCEWFKDYQPIAPGKQEVEHAYEFVKKKFEELYFQSSKPDRVDRVFKIYRTTALDQKLVKKTFKLIDESMRRSREGT

SEQ ID NO: 62757 - protein, 297 aa, Nepenthes alata
DQFDDTDPREKIKKGSFFNWFYFSVNIGALISSSLIVWVQENLGWALGFGIPAISMGIAIASFFSGTALYRLQKPGGSPLTRMCQVLVASFRKSKLALPEDSNLLYETSDENSVIEGGRKLEHTNDLKCLDKAAVVSDKEIKCEDFSNPWRLCTVTQIEELKILIRMFPIWATGIVFSAIYAQMSTMFVEQGEVMDRTIGSFTIPAASLSMFDTISVIFWVPVYDKILVPLARKSTGKQRGFSELQRMGIGLFISILSMAAAALVEMKRLQLAKELGLVDEDVAVPLSIFWQIPPYF

SEQ ID NO: 62758 - protein, 857 aa, Oceanicola granulosus HTCC2516
MQKERTYDEVTLITVDATMSAAIHGGRAKCLQRLVRLDMPVPRTVALSFGAVRRIAAGELPDLDTILRPFGPDPLVSVRPSSQDPDWGGPGAILNIGMCDSRHADMCATMGEAAATSLYLRFIQSYATEVARLEADSFELPDHPDRAALARALAAFEDEMDEPFPQDPARQLADVLKSMARAWEGTSARLLREAKGAPADAGLGLVVQAMALGVGQGECGSGVIQFIDAATGQRRITGRYLSQSQGRDALTAESGALYLTKDPRGPSLEEAHPDTFAKLVAFGDRSRERLREEMEIEFTVEDGRLKILDAVRVPRSNRAAVRIAVDLAADGVIPPEEAVMRIEPQALSELLHRQIDPGAPRDVITRGIAASPGAASGRIVFTATDAQAAAARGESCVLVRRETSPEDIRGMHAAAAVLTIRGGVTSHAAVIGRGLGLPCVVGASTLRIDRKRGCLIAPDGRRFAEGETLTVDGTTGDVIAGEPPMVEAALDGAFRQLLDWADGFRDIGVRANADTPADAQTARNFAAEGIGLCRTEHMFFEGERLSLMREMIFADAPDDRTAVLARLLPMQRGDFIELFKIMAGHPVCIRLFDPPLHEFLPSDKAGLRDLADILNLPLADVTARVEAMEEYNPMLGMRGVRLGVTVPEIYEMQARAIFEATIAASRKGAPVVPEIMIPLVSAMREVELVKNRIDAVAVNVHNETGAEFDYRLGVMVETPRAALRAGDIALHAAFLSFGTNDLTQMTYGLSRDDAGRFMSAYVSQGVYEEDPFHTLDLEGVGELLTIGAQRARSSCPEIMLSICGEHGGSRSAIAFSRARGLNYVSCSPFRVPVARLSAAQIALTDRNQLPGLAADRP

SEQ ID NO: 62759 - protein, 178 aa, Prunus avium
MASAEIEFRCFVGGLAWATDNDALERAFSPFGEIIESKIINDRETGRSRGFGFVTFSNEKAMRDAIEGMNGQNLDGRNITVNEAQSRGSGGGGGGNGGGYSRGGGGGGYGGGGGYGGGGRREGGGGGYSRGGGGGGYGSGGGGYGGGGRREGGYGGGEGGGARYSRGSGGSEGGSWRS

SEQ ID NO: 62760 - protein, 1165 aa, Methanosarcina barkeri str. Fusaro
MKKKTGIYNEIFSRKWRLIFITLVLIFSVISLSATGAENRTNSQARDKVVHESNIGVSNETGKNNCSYCIESDEKNDTGKEYSYFMGSNEEDENEDGYSYIIVDENHKDKCSYCTEDEENFEQKVGENKSKENQKTVENSTKSKTETENNTKTQETIENSTKSKTETENNTKSKIETVENNTKSKTETENNTKSKTETVENNTKSKTETENNTKSKIETVENSTKSKTETENNTKSKIETVENSTKSKTETENNTKSKTETENNTKSKIETVENSTKSKTETENNTENQGIVEDIEQETDLADSILHYKVYKVENSQEKIKENESKSSESNVSDWYKKIAVNKTIAQENESNSNDTDSKENIEENDSKSSGINVTDWYKKIAVNKTVAQENESNSNDTDSKENIEENDSKSSESNVSDWYKKIAVNKTVAQENESNSNDTDSQENIEENDSKSSESNVSDWYKKIAVNKTVAQENESNSNDTDSQENIEENDSKSSGINVSDWYKIIAVNKTVAQENESNSNNTDSKGNIEENNSKSSEINVSDWYKIIAVNKTVAQENESNSNNTDSKGNIEENDSKSSEINVTDWYKKIAVNKTVAQENESDSNNTDSKENIEGDDSKSSKSDGSNCKCKIITVNKTAIQENKSDSSESNVSNLKYKTTTVNRTVTQNNTKTKNETKTETVNESKSLKSTEVETENKTKISNGNSNGTSDGNSNGNLSGNSNGNSNGNLSGNSNGNSNSTKSVESEVVSPEVNWTNNLRSQKVNEIKVYNWTDSQGNKSVTSEVKTEKNSWNNIKYILSYSYPLRSFYTTNDNVNISYNGPETLRYQSVDIFLIKERSPSSPENEISYGMNESTISLEDVLNNDTEAYVKIPATLNKEGDLDPLRLDPLQAGHYWILITPAGNETEKTVSEKEVLLAKYFEVLKYQIEARSPSAIQKGENLEVNLDLENEPAEKNYTYWAVLIKDGAYTAFEGTNPRWRMTTGIRPIVNGVDLIKRLETNLSRYESDNEKDELKNEIQTLIGKDNGTISIGEKNQSKLSLKSLDLPPGDYILLTGAYEDNKGLIGTTQKKMRISPEDLYGLGLTPSSENTLGDESSTKFETSPLMEIKSILENPKSFIFEDVKPYIQANSLAEVLRNPPKLPSFLLGFAVTLLIGFAVLRKKK

SEQ ID NO: 62761 - protein, 466 aa, Vitis vinifera
MALATRRFFNTICRGTRSFGALPEGIPSSSQHLINLEYEYSAHNYHPIPIVFSQAKGSTIWDPEGKKYLDFLSAYSAVNQGHCHPKVLKALVEQAERLTLSSRAFYNDRFPIFAERLMNMFGYDMVLPMNTGAEGVETALKLARKWGYEKKKIPKDQAIIVSCCGLLHGRTLAVISMSCDNEATRGFGPLLPGHLKVDFGDEVALEKIFEENGDRIAGFLFEPIQGEAGVIIPPDGYLKAVRELCSKFNILMIADEIQSGLGRSGRMLACDWAEVRPDVVILGKALGGGVIAVSAVLADKDVMLSIQPGEHGSTFGVNPLASAVAVASLDVITEEGLSERSDQMGQELRNQLMKIHQLFPNLIKEVRGKGLFNAVELNSKALFPVSAYDICLKLKERGVLAKPTHDTIIRLTPPLSISLDELQEGSNALRDVMEFDVPKMQKAKHKRVPQTTTNICDRCGRNMDDS

SEQ ID NO: 62762 - protein, 369 aa, Gloeobacter violaceus PCC 7421
MQVKAAVAMEAGKPLQIESVELEGPKAGEVLVEIKATGICHTDAFTLSGADPEGLFPAILGHEGAGVVVEVGPGVTSVKLGDHVIPLYTPECRQCEYCLSRKTNLCQAIRTTQGRGVMPDGTSRFSLGGEPLYHYMGTSTFSNFTVLPEIAVAKIREDAPFDKVCYIGCGVTTGVGAVLYTAQVEPGANVVVFGLGGIGLNVIQGCRMVGADKIIGVDTNPAKKELAEKFGMTHFVNPKEVEGDLVPYLVELTKGGADYSFECIGNVNVMRQALECCHKGWGVSVIIGVAGAGQEIRTRPFQLVTGRIWKGSAFGGARGRTDVPKIVDWYMEGKINIDDLITHVLPLGEINQAFDLMHEGKSIRTVVTF

SEQ ID NO: 62763 - protein, 345 aa, Zea mays
  misc_feature (114)..(114): Xaa can be any naturally occurring amino acid
MDHAADTFRTDLMTITRHVLNEQSRHPESRGDLTILLSHIVLGCKFVASAVNKAGLAKLTGLAGETNVQGEEQKKLDVLSNEVFVNALVSSGRTCVLVSDAWADAWADACKLRXKYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAQNWDAPVAKFVEKCKYPKDGSPPRSLRYIGSMVADVHRTLLYGGVFLYPADEKNPNGKLRILYEVFPMSFLMEQAGGQSFTGKERALDLIPTKIHDRSPIFLGSYDDVEEIKALYAEQAKSSSASS

SEQ ID NO: 62764 - protein, 128 aa, Humulus lupulus
EWIRNHPKASICTAEGVHEFKNVAIFQDYHGFSKFRKAIAKFMSKVRGGRVTFDPDRIVMGGGATGANELVIFCLADPGDAFLVPSPYYPAFVRDLGWRTGVNIIPVPCESSNNFQITKQALERSIRE

SEQ ID NO: 62765 - protein, 381 aa, Haloarcula marismortui ATCC 43049
MTFEAADRVDSVPPSGIRRFFELAEEMDDIISLGVGEPDFSAPWSAREAAIASLERGQTSYTANRGKRELRERIADYEAATHNLQYDPDEEILVTAGASEGLDLAFRALLNPGDSIAIAQPCYVSYVPGATFAGIDVIDVPTRAEDEFKLTQEVLESSGAAEADALVYCFPNNPTGATMTAEEMADVAAFCRENDLLVFADEIYADLTYEHDHTSIATLPGMRERTVVFNGFSKAFAMTGFRLGYAMAPPEAVEAMNRIHQYSMLSAPTTAQHAAIEALDNCRDEVTDMAAQYDRRRKYVLTRFEEMGLDCFPAAGAFYAFPECPWDDAGEFAESLLQEKRVAVVPGTAFGEGGSGHLRVSYATGLDDLKEAMARIESFLN

SEQ ID NO: 62766 - protein, 180 aa, Solibacter usitatus Ellin6076
MPVAFAGLMALWYRRERPLPNPRQPGSGRPIRVVLFLDNGKRGETIQVNKIAKTDADWQKELTPEEFAVTRKKGTERAFTGRYWDNHEPGLYRCTCCGTTLFRANEKFDSGTGWPSFYAPAAEENVATETDSSLFMKRTEVLCSKCDAHLGHVFDDGPAPTGLRYCINSAALKFTPEKEK

SEQ ID NO: 62767 - protein, 485 aa, Burkholderia cepacia
MLKKSTTSSTANMCRVSVGSRSSSPLNNAVIAKVHEAGRAEVDAAVAAAQAALKGAWGRMSLAQRVEVLYAVADGINRRFDDFLAAEVEDTGKPMSLARHVDIPRGAANFKIFADVVKNVPTEFFEMPTPDGVGAINYAVRRPVGVVGVICPWNLPLLLMTWKVGPALACGNTVVVKPSEETPQTAALLGEVMNTAGVPPGVYNVVHGFGPNSTGEFLTSHPDVNAITFTGETGTGEAIMKAAADGARPVSLELGGKNAAIVFADCDLDKAIEGTLRSCFANCGQVCLGTERVYVERPIFDRFVSRLKKGAEGMQLGRPEDLATGMGPLISQEHREKVLSYYKKAVEAGATVVTGGGVPEMPEALKGGAWVQPTIWTGLGDDSVVAREEIFGPCALVMPFDSEEEVIRRANDNDYGLARRIWTTNLSRAHRVAGAIEVGIAWVNSWFLRDLRTAFGGSKQSGIGREGGVHSLEFYTELKNVCIKL

SEQ ID NO: 62768 - protein, 222 aa, Thermobifida fusca YX
MSEFNFDPYRRYGGGMAPMAPQSRYVLPSYIERTAYGVKEMNPYNKLFEERIIFVGVQIDDTSANDIIAQMMTLEHIDSDRDITLYINSPGGSFTSLMAIYDTMQFVRPDIQTVCVGQAASAAAVLLAGGTKGKRTALPNSRILIHQPATEGTHGQASDVEIMANEIMRIRHQLETILAKHTGRSVEEISRDIERDKILTAEEAKEYGIVDDVLPYRKASLK

SEQ ID NO: 62769 - protein, 98 aa, Anabaena variabilis
ATFKVTLINEAEGTKHEIEVPDDEYILDAAEEEGYDLPFSCRAGACSTCAGKLVSGTVDQSDQSFLDDDQIEAGYVLTCVAYPTSDCVIQTHKEEDLY

SEQ ID NO: 62770 - protein, 505 aa, Triticum aestivum
  misc_feature (97)..(97): Xaa can be any naturally occurring amino acid
  misc_feature (286)..(286): Xaa can be any naturally occurring amino acid
  misc_feature (327)..(327): Xaa can be any naturally occurring amino acid
  misc_feature (347)..(347): Xaa can be any naturally occurring amino acid
KPGPAPQLASTWTWRRATTSHSYASLCGALAVIVAGWLVYRWMSPPCNTGRLPPGSMGFPLVGETFRFFKPSPSIDIPAFYKQRLKRYGPLFKTNLXVGQPLVVSMDAEVNRFIFQQEGKLFRSWYPDTTNIIFGKESLASCDGSLHKFVRSFAARLFGVDSLRDVLLAEMEHNVARSFAAWAAEPEGIEVKDAVSTMIFDLMAKKLIGFGPEKSRKLRKNLDVFFQGMVSFPLYFPGTAFYKCIQGRKNVQKVLKDLLKERLSAPQKRHGDFLDEVVDELQSGAXMGMLNEENSAVDLVGAPLVRSFATVSSLLTVACRSLHDLPXVVDSLREEHEAILRKREGCXILAGFTWHGFKFHDIHCSRSRTEIVRLSNVAPGIFRKTLPDVHVKGYTIPAGWLVMISPISVNLNPELYEDPLAFNPWRWQDESKKSTLLKNFMPFGGGLRLCVGAEFSRIQIALFLHTLVTKYRWKEIKGGEVQRISEIVFPKGYHIKIIPREESIN

SEQ ID NO: 62771 - protein, 580 aa, Chlamydomonas reinhardtii
MAPGGSTAHVLTKGARLLPQGQPLYLVATGLRPSRCIPGRIRPATDFLSGALTAAVTPAASRQQALDAASTPVGPPVAMNAILLRTLQPPRTPSLLAFSDYREAEQANARHSSTTATGALLEYETLELRVHPPNVVVDNESYSDRTLITLDSANRPGTLVEVVQLLTELGLCVTKARISSDGGWFVDEFHVTDAGKKVLSVDTDPGSDAEADVGVFEEASQCSTVFELAGNDRIGLLAEVIALLKNNGCEVGPGAWGQVRSAAVWTHNHRVAFVISVLEASASATAGAVAAPAPGGGVGGGSCPIKDGIKLARLRQLLLGMMDPSGQDSVVNVATTKGLIHYERRLHQLLLKEEEAQWRRAGELAAAYEAELAELQKPEVSIQHTKQHNYWMISIRCRDRQKLLFDTVCTLADLNYDVYHGAVDCEVERERAHGQPLSIAVQTFYLRPRFGDCVWDAKRAAKLKYMLEVAIQRRQPTGTKVHISGVPASAAAAASGAGGGGGATSDLPALTAVWRDFGLCISRAKVRALAGAAGEHTFYLVDRNGLPPADTVVQAACQQIGGVRLARPDAGMMGSSAGAG

SEQ ID NO: 62772 - protein, 490 aa, Telopea sp. Weston s.n.
GPGVSALEEKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNITESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEVESNLKK

SEQ ID NO: 62773 - protein, 490 aa, Alloxylon wickhamii
GPGVSALEEKSLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNITESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDSLPEQAFYLVGNIDEATAKAMNLEVESNLKK

SEQ ID NO: 62774 - protein, 393 aa, Taxus canadensis
MAYTAMAAGTQSLQLRTVASYQECNSMRSCFKLTPFKSFHGVNFNVPSLGAANCEIMGHLKLGSLPYKQCSVSSKSTKTMAQLVDLAETEKAEGKDIEFDFNEYMKSKAVAVDAALDKAIPLEYPEKIHESMRYSLLAGGKRVRPALCIAACELVGGSQDLAMPTACAMEMIHTMSLIHDDLPCMDNDDFRRGKPTNHKVFGEDTAVLAGDALLSFAFEHIAVATSKTVPSDRTLRVISELGKTIGSQGLVGGQVVDITSEGDANVDLKTLEWIHIHKTAVLLECSVVSGGILGGATEDEIARIRRYARCVGLLFQVVDDILDVTKSSEELGKTAGKDLLTDKATYPKLMGLEKAKEFAAELATRAKEELSSFDQIKAAPLLGLADYIAFRQN

SEQ ID NO: 62775 - protein, 541 aa, Trichodesmium erythraeum IMS101
MLESIIWILLTGFFVGEIALRLKAPPLIGMLLVGILLGPQISNTIDSSILEAADSLRTFAVTIILMKAGLGLDREKLAQQGSVALRLGFLPATCEAIVIALAAMWLLNFDFATGLLLGCIIGAESPAVIVPGMLRLKSLGWGVTKGIPDAILTGSALSDVLLLLIFSLLLAFLSQGTTIGITLPGGITINLLQILPFQVTLQIILGAIAGLLMAQILVLLLVKQNWTQNSTQDTLVAGSLTLLLVVLAEKFPIFSGYLAVMATGFFVLEFDPPLGRRLRNGFETLWTIAQIILFVLLGASIPLQVLENVFLVGLLILALGTFVGRMFGWYLSTLGSNWNLQERLFLLPGNSAKATVQAAIGAIPLAVGIEGGETILAIAALSILVTAPLGAWAIPALAPKLLEKGEVDPTKVAIARPIILLAAVDTSPLAVDVLLKAAELARRCDGEIVVLHVLQFEYRNSIEQLRQQTRQLLADIRHQFITVAGDASEEIIFIAQEYGAAEIVIGKKGDRLWDNVLVGSVSQAVLEKSLIPVVVVEKIKT

SEQ ID NO: 62776 - protein, 482 aa, Prochlorococcus marinus str. MIT 9301
MLEILSHQYLKIFLKDQSISWKHIYSFGRIISKCIENDSTYLINSEIFSSYDWLPPILISLFLKEEDSTFILSREKIQFISQFQIDSLKNLGFNFIFKNDQFIFSNYYVRLITIQDLLNDPNFYNFTNHRIVYSGIEDIKEDLKNHFRISLLKKDWTKNFKEFELINQEFLKVYDSLKKKFFSRKVLGNSYINLDENEISFFSKFFYENSFFSDKFFSVNKALSQGWACWVKLNDINLDWNLYLQPIDELSQIKKLFLNNKFVFLSALRKDNFFQMYLKKISLDIDLVINFKSNFEEKKIKLYIPPKQLLPNNPLFTNSILDTCKKLILFRKGLTVVLSDDIDLKTNLATELASKYGKRVLLETIPSGKNEILCSSFDWWIINSFLIQIPEQIIIPLLPIPNMSEPINAITVSYKNKLSQDWFRDFFLPQARIKLERAVSPLRRNSGKLIILDGRVNKRNWGRLLLQNIQPSKKINYMLPFD

SEQ ID NO: 62777 - protein, 148 aa, Mesembryanthemum crystallinum
MASKRILKELKDLQKDPPTSCSAGPVGEDMFHWQATIMGPSDSPYAGGLFLVTIHFPPDYPFKPPKVAFRTKVFHPNINSNGSICLDILKEQWSPALTISKVLLSICSLLTDPNPDDPLVPEIAHMYKTDKGKYESTARSWTQKYAMG

SEQ ID NO: 62778 - protein, 290 aa, Lactobacillus rhamnosus
MKGIILAGGSGTRLYPITEAISKQLVPVYDKPMIYYPLSTMMLAGIRDILVISTPRDIDRFEDLLKDGKQLGLNISYKVQDKPNGLAEAFIVGADFIGDDSVCLILGDNIFYGSGLSKLVQRSAAKTTGATVFGYQVNDPERFGVVAFDKQHHVQSIVEKPEHSESNFAVTGMYFYDNQVVEIAKNLKPSPRGELEITDVNKAYLERGQLDVELLGRGFAWLDTGTHESLHEAASFIETVQKRQNLKIACLEEVAYRIGYIDRDQLRELAQPLKKNDYGQYILRLADEEA

SEQ ID NO: 62779 - protein, 371 aa, Bacillus cereus
MKSRAAVAFKPGEPLQIVEIDVEEPKAKEVLVKILYTSVCHTDAFTLSGDDPEGVFPAVLGHEGAGVVVSVGDEVTSVKPGDHVIPLYTPECGECKFCRSGKTNLCSAVRETQGKGLMPDGTTRFSYNGEPLYHYMGTSTFSEYTVVNEINLAKIDENAPLDKVALLGCGVTTGIGAVHNTAKVEEGAVTAVFGLGAIGLAAIQGLVQAKASRIIAVDLNPQKWELAKKMGATDFVNPADYDRPIQEVIVEMTDGGVDYSFECIGNVEVMKSALEACHKGWGESIIIGVAGAGKEIHTRPFQLVTGRVWRGSAFGGVKGRSELPEMVEDYMHGDIDLDSFITHHLEFKDINAAFDLLHKGESIRTILTYGE

SEQ ID NO: 62780 - protein, 292 aa, Prochlorococcus marinus str. MIT 9301
MQKLSPIEVNEICDELGETYPKSIEQVHGGDIHSAWQIEFSNRKLFLKKNIRNKKFLEFEKYCLQNLRKFINQENLVVPEVIAYKNIKNVEILLIEWIDMHNSDQKKLGKGLGEMHLKSAESNPKMFGSPVEGFIGTTDQKKGWKDNWIDCFLNLRIIPQLLLLESTILDKETINKVQDKIKSELLNHKPINSLVHGDLWSGNVGTEKNGKGVIFDPASWWADNEVDLAMTKLFGGFRKEFYEEYHRILPIKNGFEKRIIIYNFYHILNHANMFGGGYLKQVKDYVKAILNM

SEQ ID NO: 62781 - protein, 204 aa, Haemophilus somnus 129PT
MTNIKLNYHKTHFLMSAPNIKVLPEDSGIEIAFAGRSNAGKSTALNALTQQKNLARTSKIPGRTQLINLFQVEPNCKLVDLPGYGYAAVPEQMKLQWQKSLGEYLQKRECLGGLVILMDIRHPLKDLDQQMIEWAVSADLPVLLLLTKADKLSQSARSKQVKMVREAILPFQGDVQVEAFSAQNKIGIERLSEKLDQWFSPLFS

SEQ ID NO: 62782 - protein, 477 aa, Rhodopirellula baltica SH 1
MTATASERPAIGPVKKICCIGAGYVGGPTMAMIAHQCHGIEVKVVDINAERIAQWNSDELPIYEPGLDDIVKGRRGQNLIFTTEVDEAIREADMVFISVNTPTKTFGVGAGRAANLEFIEKCARKIAEVSVGHKIVVEKSTLPVRTAEAVKAILAEATSGATFDVLSNPEFLAEGTAIDDLLAPDRVLIGGESEAAIQALVDVYAQWVPAERLLTTNLWSSELSKLTANAFLAQRVSSINSISALCEATEADVDEVAMAIGMDSRIGPKFLKSSVGFGGSCFQKDILNLVYLCEYFGLPEVADYWQQVVTMNDYQKRRFVHRMVRTMFNTVSDKKIAIWGFAFKKDTNDTRESAAIYVCRDLLLEKARLSIYDPQVTKAQIVANLEAVFQNGDQELSAMSRQLIENNVEVVSDAEAAADSAHAIAVLTEWDEFANANFAKILERMKKPAFVFDGRNTLKGLNLEELGFDYQGIGFSR

SEQ ID NO: 62783 - protein, 350 aa, Frankia sp. EAN1pec
MIAARLHGPGDLRVEEVDEPEAAAGEVKIAVAHNGLCGTDLTEIFSGPRACTTVPHPLTGGVLPQIVGHEFAGVVAAVGAGVTDVAVSERVSVEPLYSCGDCDRCQASLPELCRQVMTHGICSNGGGLAQFTTVPRAMVHRLPASMSLAEGALVEPMAVAFNGVLRSGVEAGGSALVFGAGPIGMGVVFGLRAVGVADILLVEPASARRAAAERLGVADVLDPNTTDVADEVRRRTGGRGVDVVLDAAGAPGTFGLAPAVLRARGRYVGIAVAERPVEFAPWVLARGEIELTGSLGYGPGVFTRVIDLIAGGAYPTAGWVDHVGLSDLHDALQDLRDGRRMKVLVDLPAG

SEQ ID NO: 62784 - protein, 165 aa, Triticum aestivum
VAGSAQGGYLKDLSAPSGFKYVEGSRPWKLVERVDVALPSATQNELDEEDAKALVAAGCGFVAEGANMPCTLEAINVFEAARKEKGSKGVWYGPGKAANCGGVAVSGLEMAQNSARLQWTEEEVDAKLKNIMQTAFKTCYETAQEFAGEGELPSLVSGANIAGFL

SEQ ID NO: 62785 - protein, 371 aa, Oceanobacter sp. RED65
MALRNDIDPDGLLEYSVVFTDRSLNHMSQSFQHVMRDISRELKQVYNADGVIVVPGGGTYGMESVARQFANDETCLVVRNGWFSYRWTQILDMGKITSEHHVCKARTKSASRAFEPAPIDEVVASIREKQPAVVFAPHVETSSGILLSDDYVRQLAQAAHDVGALMVLDCIASGTLWVDMKDLGVDVLISAPQKGWSASPCAALVMMSENALKRLDETTSSSFACDLKKWQQIMQAYENGGHAYHATMPTDALKKFRDTLLESKEYGFDKLKQQQIDLGQKVRAMLETHGFDSVAADGFKAPGVVVSYTDDADMQNTKKFAQQGLQAAAGVPLMCDEGDDFKTFRIGLFGLDKLKDVDQAVAKLEQAIKAM

SEQ ID NO: 62786 - protein, 270 aa, Methanosarcina mazei Go1
MINRKIGFIGAGKMGSALMQGIIKAGIVQPENIGASDVYEPFLKELQTKLGIRVSTDNTVIVRESDILILAVKPQTLGSVLENLKNEITSEKLVISIAAGVPLSTYEGALLEGTRVVRVMPNIAATVSEAASGISPGKNATPEDMKDALTIFSAVGTAVQVPESLMDAVTGLSGSGPAFIFPVIEAMADGAVLEGMDRKSALTLAAQTVLGAAKMALETGMHPGELKDMVTSPAGTTIQGVHALEEAGIRAAFMNAVIRASERSRELGKK

SEQ ID NO: 62787 - protein, 396 aa, Arabidopsis thaliana
MLRDGNKQSKNNVRFVRKSIKTTVKTSLQNRSSLKKPPVGRSKSRSISSIPSSAVASTLSLPEKVETKCLEEDTQGESSSSGNKDPTTKVLDVTAKPKSKRRKSFTSLLVNGSKFDEKNGETTEPEKLPSIDDESNQLEVAEYVDDIYQFYWTAEALNPALGHYLSAHAEVSPVTRGILINWLIEVHFKFDLMHETLYLTMDLLDRYLSQVPIHKNEMQLIGLTALLLASKYEDYWHPRIKDLISISAESYTREQILGMERSMLKQLKFRLNAPTPYVFMLRFLKAAQSNKKLEQLAFYLIELCLVEYEALKYKPSLLCASAIYVARCTLHMTPVWTSLLNNHTHYNVSQMKDCSDMILRFHKAAKTGNLRVTYEKYINPDRSNVAVLKPLDKLPL

SEQ ID NO: 62788 - protein, 262 aa, Physcomitrella patens subsp. patens
MAKETENLFVKQAEVYKRARPHAPEELYSYLASLTPSHELAWDVGTGNGQAAAVISKHYKKVIATDVAAEQLSHAEQRPNITYAATPTTLSKDDLTRIVGPEGSVDLVLIVEALHWFDLDKFYDNVKYVLRKPGGLIAATVYPPMLRVNPRLDKVLNDFNDTIKHHWAPQVDHVVNLYKNLPFPFAPVEQADERVSRFKMSLDATLDDYLNYLESWSAVQTAIDNGEDPLNEHWRKLFAEAWGAPETEHTVKWPFKVLLGKV

SEQ ID NO: 62789 - protein, 173 aa, Solibacter usitatus Ellin6076
MLQVISLLLENKPGALMRVTGLLTQRGYNIESLTVARTLDPELSRMTIVVDVDSTQRLQVIKQMNKLINVLQANDLTDAPAVIRELVLLRIRTTQESRTAVLKEAEIFGGRVVDSSTEGFAIEVTGDPEKLGEFIDVMGSYGEVEVTRSGALAIALESKKLRLQPPVPTKAAV

SEQ ID NO: 62790 - protein, 68 aa, Physcomitrella patens subsp. patens
MTTSKRLADKKSAKFQKNVHRRGSVPETTIKKKNQYPVGPMVLGLFVFVVIGSSLIQILRTATTGAMA

SEQ ID NO: 62791 - protein, 627 aa, Lactobacillus sakei subsp. sakei 23K
MMETGYAVAGRYKIIRPIGEGGMANVYLAQDLILDRQVAVKVLRLDLRNDPSTVRRFTREALATTELNHPNIVSIYDVGEENSMQYIIMEYIKGTDLKKYIVEHFPIPYQRVIDIMTQILSAVQNAHAHNIIHRDLKPQNILVDEDGNIKISDFGIAIALSETAMTQTNTLLGSVHYLSPEQARGSMATKRSDIYSLGIVLYELLTGMVPFEGESAVSIAIKHFQDEVPPVRNYDPRIPQALENVVLKATAKDPDERYSGVDAMMADLATSLSASRAHEPKFVPSKADDLSETKVIPALDPEGITQTNNDEEQVKEAESTQKKVKKPAKSKRKWWLLGGGVVLLLLLATVIAFAVQGSEVTVPDLTDMTQQNAESALTDKKLKVGTVQKTTSQKYSKGHVIRTTPKAGLSVKSKSTVNLIVSSGRQKYKIKDYTNQAYSDVRDALKDKGLKVKRKYQSSSEVSPGLIIDQSIAAGKRVVPSKTTITLTVSSGKPGFALHNLSNYTKQGIQDYAAQNGLTVVFSEEYSSSISEGMVISQSPASGTMVQEGDSVSVILSKGEQPTEHHSIVTSSSNSVIESSAPESSQSSESSASESESESESESESESASESISSSASQSSQSSVQSK

SEQ ID NO: 62792 - protein, 220 aa, Lactobacillus sakei subsp. sakei 23K
MTQIAPSILSADFMNLQRDVQNLEAAGADLLHIDIMDGMFVPNMSFGAQVVSGIRPLTQLGLDVHLMVEQPERYIEQFITAGSDLIMIHAEATEHLYRGLQMIKDAGVKAGVVINPGTPVSYIESVLPLVDQVLVMTVNPGFGGQKFIPAMLTKVAELAAYREAHADADFTIEVDGGVNDQTIAACAKAGADVFVAGSYTFAGDLATRIETLKKAANEAR

SEQ ID NO: 62793 - protein, 448 aa, Solibacter usitatus Ellin6076
MNIRNKATAIRLLDFRSVPMRAFHMSWLSFFLCFFGWFGLAPLMPVIRQELHLTREQIGNSIIASVAITVLARLLIGWLCDRVGPRRAYTGLLILGSLPVIGVGLAHDYTTFLLFRLAIGAIGASFVITQFHTSVMFAPNIVGSANATAAGWGNLGGGVTQMVMPLLFAAFLSLGVGSWWGWRLAMIVPGIALFLAGIAYYRLTRDTPDGDFEELRAQGRMPGRASANGAFREACSDPRVWALAVLYAACFGMELTVDNIAALYFVDYFKLSLQAAGIAAGAFGMMNLFARALGGIVSDRCYFRWGLRGRSLLLGATIALEGFAFTCFSQARSLPLAIACMLLTGLFIKMSNGATYAIVPFVNKRALGAVAGIVGAGGNLGAVAAGFLFKTKTLTWPQALLILGALVFASAGLAVLVRFSQRDEVSARAEMEARLNTDLIPVLTGAGD

SEQ ID NO: 62794 - protein, 142 aa, Photobacterium profundum SS9
MSVSAKMDKIGFKMTDKTDAYWRKKLTEDQYHICREKGTEASFSGTLLHNRETGLYSCTCCEAPLFVSDNKYDSGCGWPSFDAPVNKEAVRYIEDNSHGMLRTEIRCANCDSHLGHVFPDGPNTTGERYCVNSVSLVFNTEE

SEQ ID NO: 62795 - protein, 605 aa, Serratia marcescens
MLLKTSRRTFLKGLTLSGVAGSLGVWSFNARSSLSLPVAASLQGTQFDLTIGETAVNITGSERQAKTINGGLPGPVLRWKEGDTITLKVKNRLNEQTSIHWHGIILPANMDGVPGLSFMGIEPDDTYVYTFKVKQNGTYWYHSHSGLQEQEGVYGAIIIDAGEPEPFTYDREHVVMLSDWTDENPHSLLKKLKKQSDYYNFNKPTVGSFFRDVNTRGLSATIADRKMWAEMKMNPTDLADVSGYTYTYLMNGQAPLKNWTGLFRPGEKIRLRFINGSAMTYFDIRIPGLKMTVVAADGQYVNPVTVDEFRIAVAETYDVIVEPQGEAYTIFAQSMDRTGYARGTLATREGLSAAVPPLDPRPLLTMEDMGMGGMGHDMAGMDHSQMGGMDNSGEMMSMDGADLPDSGTSSAPMDHSSMAGMDHSRMAGMPGMQSHPASETDNPLVDMQAMSVSPKLNDPGIGLRNNGRKVLTYADLKSRFEDPDGREPGRTIELHLTGHMEKFAWSFNGIKFSDAAPVLLKYGERLRITLINDTMMTHPIHLHGMWSDLEDENGNFMVRKHTIDVPPGTKRSYRVTADALGRWAYHCHLLYHMEMGMFREVRVEE

SEQ ID NO: 62796 - protein, 532 aa, Propionibacterium acnes KPA171202
MLQVKDVEVRVGARLLLNPVSFQVATGDKVGLVGRNGAGKTTLTRVLAGEALPAAGSVRRTGELGYLPQDPRDPDMETIARARILSARGLDHMLERMRTLEHQMANGSEEDRAVAMDKYAKTEDRLIAAGGYGASAEAARIASNLGLDDRVLSQPLKNLSGGQRRRVELARILFSGADTLLLDEPTNHLDADSIIWLRSFLQSYSGGVLMISHDTELVEATVNKVFHLDANRATLDIYSMGWKLYLEQRAADEKRRHKERINAERKAAALQAQADKLHAKATKAVAAQQMARRAEKLLAGVEGERAVDKVAAIRFPDPAPCGKTPLTARNLTKTYGSLEVFAGVDLNIDRGSQVVVLGLNGAGKTTLLRILAGKETPDTGEVIAGHGLKLGYFAQEHDLLDMDRTVLENMASSATDLNETEMRKILGSFLFTGDDVHKPAGVLSGGEKTRLALATLVVSSANVLLLDEPTNNLDPASRAQVLDAIGNFGGAIVLVTHDEGAVHALDPDRVLVLPDGTEDMWSADYAELISLA

SEQ ID NO: 62797 - protein, 145 aa, Alkalilimnicola ehrlichei MLHE-1
MENTLHAVLKDKGVALYSVDADVPVAEAIKTMADGHVGCVLVMEKGSLRGIFTERDVMIRVVHDGKDPAQTPVSEVMTREVAVVPPTMTVEEAMVVCLERRVRHLPVYDGSDLEGVVSSGDLMRWVIGDQKHMIDDLIQYIYIGR

SEQ ID NO: 62798 - protein, 332 aa, Rhodopseudomonas palustris CGA009
MSSAATASIKAVAEAPAHRPGRGRVYESIADAYGDTPLVRLNRLPQQHGVKATIYAKLEYFNPASSVKDRIGAAMIAALEQEGIIKPDTVLIEPTSGNTGIALAFVAAAKGYRLKLVMPESMSIERRKMLAFLGAELVLTEAAKGMKGAVAKAEELVAATPNAVMPQQFKNLANPAVHRRTTAEEIWNDTDGAVDIFVAGVGTGGTVSGVGQVLKPRKASLKVVAVEPEESPVLSGGAPGPHKIQGIGAGFVPDILDRSVIDEVVKIPSATAIETSRALARHEGIPGGISSGAAIAAAIELGKRPENAGKTIVAIVPSFSERYLSTVLFEGV

SEQ ID NO: 62799 - protein, 449 aa, Oceanobacter sp. RED65
MSDLDSFYQWLEERNPGQEEFIQAVKEVVCDVHGLVEDEERYQNWNILERLTEPDRIISFRVTWQDDDGRIRVNRGWRVQYCGVIGPYKGGLRFHPSVNESILKFLGFEQTFKNALTTLPMGGAKGGSDFDPRNCSDGEIMRFCQAFMNELYRHIGENTDIPAGDINVSSREIGYLFGQYRRLANSFSGTLTGKDIEFGGSHVRLEATGYGLVYFISEMLKQDDEELKDKTIAISGAGNVALHAAKKAIQMGGKVITLSSSKGYLYVEQGLEEYHINELIERQGKCYSDSTELLKSINGDSNAKWHDDKTPWEVECDIALPCATQNELKLDDAKKLVKNKVKYVAEGSNMPCTQDAIDCFEESSIKHAPGKASNAGGVALSGFEMAQNASFTPMGYDDLDEKLKAIMTNIHTQCCEEGQQDNGFIHYRKGANLAAFKRVADAIVSQGVG

SEQ ID NO: 62800 - protein, 70 aa, Zea mays
  misc_feature (18)..(18): Xaa can be any naturally occurring amino acid
MKTFDRGPVFFLREWKRXRTFLTLFIITGFIITNMTTNFTEEDLKNSKFVQEHKKRSPTGNRPNRLLMKN

SEQ ID NO: 62801 - protein, 371 aa, Candida albicans SC5314
MGVISFYLIGQLLYLIRKKYTTTYRQQQQYQYNMDSKHSTSSSSSGSLATRISNSGPISIAAYCLSSILMTVTNKYVLSGFSFNLNFFLLAVQSIVCIVTIGSLKSLNIITYRQFNKDEAKKWSPIAFLLVAMIYTSSKALQYLSIPVYTIFKNLTIILIAYGEVIWFGGKVTTMALSSFLLMVLSSVIAYYGDNAAVKSHDDAFALYLGYFWMLTNCFASAAFVLIMRKRIKLTNFKDFDTMYYNNLLSIPILLICSFIFEDWSSANVSLNFPADNRVTTITAMILSGASSVGISYCSAWCVRVTSSTTYSMVGALNKLPIALSGLIFFEAAVNFWSVSSIFVGFGAGLVYAVAKQKQQKEQSQQLPTTK

SEQ ID NO: 62802 - protein, 432 aa, Morganella morganii
MSASKNKMSVLQLTILTAVNMMGSGIIMLPTKLAEVGTVSILSWLVTAVGSMALAYAFAKCGMYSRRSGGMGGYAEYAFGKSGNFMANYTYGVSLLIANVAIAISAVGYGAELMDAAMTPLGICIATIVVLWICTVANFGGARITGRISSVTVWGVIIPVVGISVIGWWWFSPELYVNSWNPHNFPLFEAVGSSIAMTLWAFLGMESACANSEAVDNPEKNVPIAVLGGTLGAAVIYIVSTNVIAGIVPNMDLANSTAPFGLAFSQMFTPGVGKVVMALMIMSCCGSLLGWQFTIAQVFKSSSDSGYFPKIFSAVTKADAPVKGMLVIVIIQSALSLMTISPSLNKQFNVLVNLAVVTNIIPYILSMAAMIILQKVANVDPKKARTGNVIAFIGAVYSFYALYSSGEDAVMWGALATFLGWTLYGLFPRGLK

SEQ ID NO: 62803 - protein, 73 aa, Physcomitrella patens subsp. patens
VPLKLLHEGEGHGVTVELKNGDVCRGKLIESENNWTLQLDTANFIFSRTGKEVKLDSIFIRGRRIKLVLFQPM

SEQ ID NO: 62804 - protein, 162 aa, Oryza sativa
LGIDFRRLLLVSSPLRRLRRSPSRERAGAPGAGAVVRPVASARILVSGDGTLQVDYFTFSPSIADYIRDASLVISHAGSGSIFETLRHGKPLIVVVNEDLMDNHQSELAEELATRKHLFCASPQTLGETIQEMDIETLNPYVPGDAKPVVSLINKFFGFPDD

SEQ ID NO: 62805 - protein, 200 aa, Oryza sativa
MSEADGGEGAKPKRPAPRLNERILSSLSRRSVAAHPWHDLDTGADAPAVFNVVVEISKGSKVKYELDKKTGFIMVDRVLYSSVVYPHNYGFIPRTLCEDNDPMDVLVLMQEPVIPGCFLRARAIGLMPMIDQGEKDDKIIAVCVDDPEYRHYNDLSELSPHRVQEIRRFFEDYKKNENKEVAVNEVLPVTAARDAIQYSM

SEQ ID NO: 62806 - protein, 483 aa, Bradyrhizobium sp. BTAi1
MNMTAIPSTEATKARMQATLHRQKAEQTRLGPPSLSLRRDRIARAISMVLTHKNELLDAMNTDFGARSRDMGMLYDIVGSVQPLREAHKNVAKWMRPQRRKVSPPILSLLGARSTVRYQPKGVIGIVTSWNFPLQLMMDAAAAAFAAGNRVMLKPSEFTPATGGLVAQLFDSHFDEDEISTFLGGPDVASAFTSLPFDHLIFTGSTNVGRHVMRAAADNLTPVTLELGGKSPVVVGRSADIGKTAARIMMGKMINAGQVCVAPDYVLAPDDRVEPFITAATTAVAKMFPTLKDNPDYTSIITQRHYERLQMLIDDARAKGARIVEINPAKENFSQQQFRRMPPTLIVDATDDMAVMQEEIFGPVLPIRRYGTFDDSIDMINARPRPLSLYYFGSDKAESEKLLERTHAGGVTINDIFWHIAMPDLPFGGIGPSGMGAYHGHRGFVEFSHEKAVYHQTGSEIIAMFRPPYGPKYRKMIGGLLKG

SEQ ID NO: 62807 - protein, 289 aa, Saccharothrix mutabilis subsp. capreolus
MLVTEVEYGGNAIPILHRAREVGFEVVTIPSDAVGQVDVEALRELVDERVKLVSLVHAPTNGGLVNPVREVASAAHEVGALVLLDACQSLGQLPVRADELGVDIISATGRKWLRGPRGTGVLVVCRSAADRLRPRLVDLHSGEWVGPEEVKLREDARVYELWETSVADRLGLIAAARYALDLGIDAIAAEVRSRAERLRAGLREVPGVEVRDIGARLSGIVTFTVEGRDPVAVRDELARHDVVVTTSHLTSTRIDMTRRGVEGLVRMSPHYFVSPEQVDRAVEVVAALG

SEQ ID NO: 62808 - protein, 413 aa, Propionibacterium acnes KPA171202
MSYDVEKIRKDFPILSTRVGDYPLTYLDSANTSQKPQVVIDALSEHYARHNANVARAMHQLGLESTQAYEGGRERLARFIGAARPEEVVALSNASEALNLCAYTLGERLGPDDEVVISVMEHHSNLVPWQIVCQRTGATLRCFDITDDGRLDLEKAEAEGLINERTKVVSLTLASNVLGTINPIGKIAEQAHSVGAVMVVDASQAVPQIPVDMTTLGADLVAFTGHKMCGPTGIGILWGRYDLLAELPPFLGGGEMIEVVRMEGSTYAEPPHRFEAGTPPIAQLAALGVAADYLDGIGMQAIAEHEHELAARMLEELQTVKGVHILGPSDATARTGTVSFTIEGVHPHDAMSIMDGHGVAVRGGHHCARPLHERLGIQSSLRASSYLYSTTDEVNRLVESVEYARNFFAGGVA

SEQ ID NO: 62809 - protein, 363 aa, Buchnera aphidicola
MKQKYRIAILPGDGIGPEVMREAYKILNILKNDFLLPLEFQEFNIGGIAIDNEGLALPKKTLLGCENADAILFGSVGGKKWDTLPIDQRPERAALLPLRKHFNLFANLRPAKLYSELEYLSPLCSKITKNGFDILCVRELTGGVYFGHPHGRVKKDDIEYAFDTEVYYDYEINRIAHLAFQLARNRKNKVCSIDKSNVLNSSLLWKEIVEKVSNSYSDVRLSHLYIDNATMQIIKNPNQFDVLLCSNLFGDIISDECAAISGSIGMLPSASLNENNFGLYEPAGGSAPDIEGKNIANPIAQILSVSMLVRYGMHLTKIADQIDKSVISVLKRGYRTADISNNNNYLKTHEMGDVIADALINGK

SEQ ID NO: 62810 - protein, 248 aa, Alkalilimnicola ehrlichei MLHE-1
MLENREGQRVPEVVFRTRKDGEWVDVDSRDLFNGRTVAVFSLPGAFTPTCSSTHLPRFNELAPVFFENGVDEIVCISVNDAFVMNEWARDQHAENITLIPDGNGEFTEGMGMLVDKTDLGFGKRSWRYSMLVKDGVIEKMFIEPQKPGDPFEVSDADTMLRYINPEAPHPEFVTLFAKAGCPHCARAKALLESHQMAYEEITLGEGVTTRSVRAATGSGSVPQVFVDGRLIGSADALERFLEERRKVA

SEQ ID NO: 62811 - protein, 313 aa, Zea mays
MAACVDKWHPTHAGRLTGAIYRYLPDGATDRAVAAAAAAPASASGGDDDDVWDELRAEAEADGDAEPLLRKYYADLVLSRPSLEAALAAHLSANVCVPGALPQDALRDLLAAALAARPESGPAARADLPAARDRDGCGRMVHCFLYYKGFLALQAHRAAHGLWCEGPSAPAFLLQSRASEVFGVDIHPGARIGSGILFDHATGIVIGETAVVGNDVSILHGVTLGGTGKESGDRHPKVGDGVLIGAGASVLGNVRVGAGAKIGAGAVVLRDVPEGTTAVGNPAKAVGKKAAPQRRPEEQPGVTMEQGWSAYVI

SEQ ID NO: 62812 - protein, 361 aa, Alkalilimnicola ehrlichei MLHE-1
MTANILITPGDGIGPEIVAEARKLLEALRDDFGFDCTLEEAPIGGAGYEAHGKPLPEETLALAREADAILLGAVGGPRWEQLDRPLRPERGLLAIRAELGLFGNLRPAILYPQLAEASSLRHEIVAGLDIMIVRELTGGIYFGEPRGIRRLENGERQGYNTMVYSESEIDRVGRLAFDIASKRGSRVCSVDKANVLEVSELWREVMERVARDYPGVELSHMYVDNAAMQLVRAPKQFDVVVTSNLFGDVLSDCAAMLTGSIGMLPSASLDVNSKGLYEPVHGSAPDIAGKGLANPLATLLSVAMMLRYSLDQGALADRVQQAVGDVLNQGLRTPDIAARQSRTVSTAEMGDAVVAALRARG

SEQ ID NO: 62813 - protein, 216 aa, Mycoplasma penetrans HF-2
MEKIIELSVLALDQKDENKFKEQLESCLKNNIKDIHYDIMDNKFVPNTSFNNLEFLDYLIEKGCNVSAHLMVENVAHYVDKLITKKVKYITFHCEAQTIEESISIINTIKKHNIKAGIAIKPNSSLKEYESLIKISDKITVMSVEPGFGGQKYIENSEIRIREIKKLSHKNLIVEIDGGINDQTILLCKDDATHFVTGSFLFNNLEKFEELKKLLD

SEQ ID NO: 62814 - protein, 609 aa, Gibberella zeae PH-1
MDPNNSNNRLYLNFGNGNDRLTASDRTAYPTTPSTFPQPVFPSASSGQQSGGLQPQQQQQQQFAGGYAPQGYFNQNQYAQYGGQQPQQNDYQQGAGYQQRSNTPGTNDPNTGLAHQFSHQNLGGAARGQAYARGPSPGQRPRTAGSSGQQPDMAPTPTATRRNALSLLPTSSRIVSREHASATKEQSELEQKLQDPTQGAARREQLWSTAGRKEGQYLRFLRTKDKPENYNTVKIIGKGAFGEVKLVQKKGDGKVYAMKSLIKTEMFKKDQLAHVRSERDILAESDSPWVVKLYTTFQDSYFLYMLMEFLPGGDLMTMLIKYEIFSEDITRFYIAEIVLAIEAVHKLGFIHRDIKPDNILLDRGGHVKLTDFGLSTGFHRLHDNNYYQQLLQGRSNKPRDRNSVAIDQINLTVSNRSQINDWRRSRRLMAYSTVGTPDYIAPEIFTGHGYTFDCDWWSLGTIMFECLVGWPPFCAEDSHDTYRKIVNWRQTLYFPDDITLGTDAEHLIRSMVCNTENRLGRSGAHEIKSHAFFRGVEFDSLRRIRAPFEPRLTSNIDTTYFPTDEIDQTDNATVLKAQAIQSGRQVEESPEMSLPFIGYTFKRFDNNFR

SEQ ID NO: 62815 - protein, 544 aa, Candida albicans SC5314
MSQSPTNVPRSYNSVLDLKLASPTNSASGATGGWIVQKFGGTSVGKFPENIVDNIVKVYSQTNRVAVVCSARSSQTKSEGTTSRLLRSADLAENDKDYQPLLNAIEEDHVTNAERIQSKEIKQELIKDTKQEIEHVRELLHACQIIGEISPRSLDSIMAVGEKLSCLFMTALMKDHGLNAVYINLQDVIPLSYDFQKGFDDSFYQFLSQEIGKRVLQCDKEREEEEDVIPVLTGYFGVVPGGLLNGVGRGYTDLCAALAAVALQADELQIWKEVDGIFTADPRKVPNARLLDSVTPEEAAELTYYGSEVIHPFTMEQVIRAKIPIRIKNVENPTGKGTIIYPDNIGRRGEATPPHPPAAFEQLAMSSLLQRKRSATAITAKQDIVVINIHSNKKTLSHGFLAHVFTTLDKYKLVVDLISTSEVHVSMALSIQSDQESQLKHALVDLRKMGTVDVTKKMTIVSLVGKQMVNFIGIAGNMFKVLADEKINIEMISQGANEINISAVINEKDTIRALKSIHAKLLEGGSAIGDSSAVDTRLEALKLS

SEQ ID NO: 62816 - protein, 337 aa, Spinacia oleracea
KLKVAINGFGRIGRNFLRCWHGRKDSPLDVVVINDTGGVKQASHLLKYDSILGTFDADVKTAGDSAISVDGKVIKVVSDRNPVNLPWGDMGIDLVIEGTGVFVDRDGAGKHLQAGAKKVLITAPGKGDIPTYVVGVNEEGYTHADTIISNASCTTNCLAPFVKVLDQKFGIIKGTMTTTHSYTGDQRLLDASHRDLRRARAACLNIVPTSTGAAKAVALVLPQLKGKLNGIALRVPTPNVSVVDLVVQVSKKTFAEEVNAAFRESADNELKGILSVCDEPLVSIDFRCTDVSSTIDSSLTMVMGDDMVKVIAWYDNEWGYSQRVVDLADIVANKWQA

SEQ ID NO: 62817 - protein, 559 aa, Vibrio vulnificus YJ016
MSKKMFIRQAGNTLLNTPLLNKGSAFTLEERKNFNLIGLLPANIETIDEQVSRAYEQFSLFNSAMEKHIYLRNIQDTNETLYFRLINQHIEEMMPIIYTPTVGEACQKFSQIYRRNRGLFLSFEDQDELEAILNNAPNTHVKVIVITDGERILGLGDQGIGGMGIPIGKLALYTACGGISPEHTLPIVLDVGTNNSALLSDPMYMGWRHPRITGDQYDDFVDDCLKAIRRRWPNALIQFEDFAQANAMPLLMRYQNQFCCFNDDIQGTASVTVGTLLAAAHATGKKLSAQKVLFAGAGSAGCGIAEAIVAQMVSEGISVQQARSQVFMVDRWGMLEQEMPNLLPFQKPLAQPASLRTEWQIEANREISLLDVIQHAHPDVLIGVTGVPGLFNQEIIEAMAEDCERPVVMPLSNPTSRVEAKPEDILMWTQGQAIVATGSPFPDVVLAGKRYPIAQCNNSYIFPGVGLGVISANAHRVTNEMLQQASITLASLSPMLNGGNMLLPPLSEIQNVSRKIALEVAKKAVEQGKASHRTEERLLERIDEEFWYAQYCEYRRIAS

SEQ ID NO: 62818 - protein, 272 aa, Bradyrhizobium japonicum USDA 110
MDNLKTQGISMPKLGLGTFRMQGDACRAAVESALSIGYRHIDTAEMYANEEPIGAALAAARLPRGELHVTTKVWHENLAPDAIRRAFDASLKKLRLDHVDLYLVHWPSRSANWGAVFETLMKLKEEGRTRAIGVANFTTALLKIAVEDIKAPIACNQIEYHAMLDQSKVLAYLNARSIPLVAYCPLAQGRVASDPVLAEIGARHNATAAQVALKWLLDQGGVAAIPKASRRESQQANLDALKIMLDDADRNKIAALPKDRRCVNPGFAPAWD

SEQ ID NO: 62819 - protein, 319 aa, Solanum pimpinellifolium
MGSKYSKATNSISDASNSRYGVPFENYRVPLVDLEEATNNFDDNFFIAEGGFGKVYRGVLRDGTKVALKRHNCDSQQSIEEFRTEIEILSRRSHPHLVSLIGYCDGRNEMILIYDYMENGNLKSHLYGSDLPSMSWEQRLEICIGAARGLHYLHTNGVMHRDVKSSNILLDENFVPKITDFGLSKTRPQLYQTHVSTDVKGTFGYIDPEYFIKGRLTEKSDVYSFGVVLFEVLCARSAIVQSLPSEMVNLAEWAVESHNNGQLEQIIDPNLAAKIRPESLRKFGETAVKCLALSSEDRPSMGDVLWKLEYALRLQESVI

SEQ ID NO: 62820 - protein, 209 aa, Neisseria gonorrhoeae FA 1090
MNLFQNAKFFTTVNHLKDLPDTPLEIAFVGRSNAGKSSAINTLTNHVRLAYVSKTPGRTQHINFFELQNGNFMVDLPGYGYAQVPEAVRAHWVNLLGDYLRHRKQLIGLVLIMDARHPLKELDIRMLDFFHTTGRPVHILLSKADKLSKNEQIKTLSQVKKLLKPYSDRQNISVQLFSSLKKQGIDEANRTVGSWFDAADAAASSPEEN

SEQ ID NO: 62821 - protein, 88 aa, Glycine max
  misc_feature (46)..(46): Xaa can be any naturally occurring amino acid
NCFPCPMREEDEEIEADGANYQLEMMRCLTDVNVDNNTVGWYQSTXLGSFQTVELIETFMNYQESIRRWVCMIYESSTSDHGVLALEA

SEQ ID NO: 62822 - protein, 329 aa, Burkholderia pseudomallei K96243
MHAWSAQHVPPQGGKVAVVTGANSGLGWQIAQTLAAKGAQVVMGCRDTAKGELAAHAIRTRYPRARIEVEALDLADLASVCRFADAVADRHGRVDILCNNAGVMFLPLRHTRDGFEMQMGTNHLGHFALTGLLLPALRASHRARVVTMSSGFNRLGKIRLDNMLAERGYNKYRAYCDSKLANLMFTLELQRRFDQACLPILSVAAHPGYAATHLQFAGPEMANSSLGTFAMRLSNRLVAQSADVGALPAIHAATAVDVDGGAYIGPAHLCETRGYPAEARIPRQARDVRMGKRLWEKSEQLTGVRYLDTPPPPGSRRRASRDDATFGAL

SEQ ID NO: 62823 - protein, 576 aa, Bradyrhizobium japonicum USDA 110
MHELIRDITLCILFAWMLGLLAHFSRQPLILAYLIAGFCIGPFGAGWVKSQESISVISELGLIFMLFMIGLEIDLKKIVRAGKVILFAAGGQLPGGCLLGVLFFAGIGLSLGGGHFDAVYLCIACALSSTVIIVKVLYEKRELDTLPGRITLGVLVLQDIFAILFLAVQPSLANLQVSVILLSIGRVAVLVAAALLVSRYVLPRLFHQIARRPELILLGALAWCFLVAETAERLSLSREMGALIAGVSLSTFPYALDVTAKVTTLRDFFITLFFVALGMTIPVPGLSVIGLALMIAAFTVVSRLVTTFTPLYLMKQGLRASLLPALNLAQISEFSLVVIQTGVTDNHIAAETANAASFAFVVLAVLSTFVMTRSDEIARWAIGPLKRIGLRDLDHGNGHAEEGHEGGHGEARRIVILGFFRAASALLAEIERQAPVLLEQITVVDFNPNVYQTLLSRGLHVIYGDISSADTLLHAGVGKSEMIILSVPDALLKGASNEKLVRHVRTLNPTAMIVATADLLSDVGELYEAGASYVTVTRLSDAHELFTVIEAAQAGLLADKRAELDLRLGERREVLP

SEQ ID NO: 62824 - protein, 358 aa, Bradyrhizobium japonicum USDA 110
MPDTVQEVLQAFARGELVVVTDDEDREGEGDLIVAASLCTAEKMAFIIRHTSGIVCAPVTTEDARRLRLDPMVAHNDSAHTTAFTVSIDYKPDGGTGISAEERASCCRALSNPNVGANDFARPGHIFPLIAKDGGVLLRSGHTEAAVDLCKLSGLPPVGVISELMNDDGSVMKGEQVARFAAQHKLKHVTIADMIAYRQVREKLIERVSTFVTDSPIGPLQGYAYRSPFDSIAHVAFVYNGVGDGKNVLTRFHKPNIVKDIFTGHKRMAAVLEHFERSGRGVLVYLRDGAAGVPVAPLPDETSTEADRNRQWREIGVGAQILRDLGVTSIRHLTSSVHDYKGLSGFGIEIVANELLEI

SEQ ID NO: 62825 - protein, 226 aa, Petroselinum crispum
TSKSMATVKLLGFWASPFVNRVQIALNIKSISYELIEENLRAKSQLLLESNPVHKKVPVLIHGDKPISESLVIVEYIDEAWTHGPSILPSDPFARATARFWAAYITDKWWPLLTEYRTAEGEEAKAAAKEKFLEGLVLLEEAFVKSSQGKGYFGGDNIGYLDVVLGSLLAWLRVREVTQGVAFLDKAKAPELAAWADRFTSNPAVVDVLPKTEKVVDFLNSFNRAN

SEQ ID NO: 62826 - protein, 233 aa, Photobacterium profundum
MTELTVNQPLNYRNTGFITSAPDIRHLPQDTGVEIAFAGRSNAGKSSALNRITDQKGLARTSKTPGRTQLINMFEVTQGCNLIDLPGYGFAQVPLELKIKWQKALGEYLQKRECLKGLVVLMDIRHPMKDLDQQMIFWAIESRLPVLVLLTKADKMKSGARKAQLLKVRESSKSFGGDVQIELFSSLKGIGLDQVRRKLDTWFGPELERQLMLAAAENGETYTGESLSDKSDD

SEQ ID NO: 62827 - protein, 428 aa, Nonomuraea sp. ATCC 39727
MIPPHTLLVFFVQAAALLLLALLLGRLAVRLGLAAVVGELCAGVILGPSVLGQVAPGAEQWLFPSPSSHMLDAVGQLGVLLLIGLTGAHLDLRLIRRQGATAVRVSAFGLVVPMALGIGAGLLLPAEFRGTGGSAVFALFLGVTMCVSSIPVIAKTLMDMNLLHRNVGQLTLTAGMIDDAFGWVLLSVVTAMATAGAGAGTVVLSIASLLGVIVFSVVIGRPAVRVALRTTEDQGVIAGQVVVLVLAAAAGTHALGLEPIFGAFVAGLLVSTAMPNPVRLAPLRTVTLGVLAPLYFATMGLRVDLTALARPEVLAVGLLVLALAIIGKFLGAFLGAWTSRLSRWEALALGAGMNARGVIQMIVATVGLRLGVITDEIFTIIIVVAVITSLLAPPLLRLAMTRIEATAEEEARLLAYGLRPGEAREDVR

SEQ ID NO: 62828 - protein, 224 aa, Glycine max
  misc_feature (8)..(9): Xaa can be any naturally occurring amino acid
STASSAKXXKALFAKVSGGFAGGSVKGDDGPSLCCNEPSLSEVYADVMRVTNKPMMGRDSANRAQQTPVREKRKKASNKKAPKPPRPPKAPSLDAADHKLIREISELAMLKRARMERMKTLSVRKIAKSSAPSSSNASSLLAMIFTVVFFVVIILQGMSSGKTSVASFQGSPVSAGESEDGLISVHYQLNPSAIDSNAPGSESHTFVQQVAGSDLPEKLRRDSG

SEQ ID NO: 62829 - protein, 490 aa, Xanthomonas campestris pv. campestris str. 8004
MPRFPDQLLYIGGRYVPARGGHTFEVVNPATGEVLANVHNADADDLDAAVDSAKAGQRHWAALTVVERSRILLRAVALLRERNDALAELETLNTGKPLSETRSVDIVTGADVLEYYAGVAQALQGVQVPLREGSFFYTRHEPLGVVGAIGAWNYPIQIALWKAAPALAAGNAMIFKPSEVTPLTALKLAEIFTEAGLPDGVFNVLPGDGASVGHALTEHPEIEKISFTGGTATGRKVMASASSSSLKDVTMELGGKSPLIVCADADLDLAADIAMMANFYSSGQVCTNGTRVFVPRALRTAFEARLLARVQRIHIGDPLDERTTFGPMVSAAHMQRVLEHIEQGKAEGARLLCGGERLRDGALAQGCYVAPTIFSDCTDVMTIVREEIFGPVLSLLTYDDEDEAITRANATSYGLAAGVVTPDLSRAHRLIHRLEAGICWINTWGESPAPMPVGGYKQSGVGRENGLATLQAYTRTKSVQVELERYASVF

SEQ ID NO: 62830 - protein, 455 aa, Bradyrhizobium sp. BTAi1
MSNELAAGLAGHRISAELCRENFKDLVAPLHPNEARVAAERCLFCYDAPCVAACPTEIDIPLFIRQIANGLPVAAAKTILDANIMGAMCARVCPTENLCEGACVRESSEARAVEIGRLQRHATDALLASGRQLYRAGSPTGKRIAVVGAGPAGLSCAHALARAGHQVTIYEARPKGGGLNEYGIAAYKVTGDIAQAELAYILAVGGITIEYGKALGRDISLAGLRADYDAVFLGLGLGGTNGLGLGDVPAGVSDAVAFIAALRQAPDKTVLPIGRNVIVIGGGMTAIDAATQVKLLGAECVTIAYRRSKSEMPASLYEQEVAQVRGVLIREHLVPVAFEQAGGVVSGVTFARTRREEGRLIPTGERMTLAADQVLIAIGQTLLASDLADGGLSFESGRIAVDAACRTSLPGVWAGGDCVAGGSDLTVAAVADGKAAAASIIAALQGAAVPHHAGA

SEQ ID NO: 62831 - protein, 827 aa, Propionibacterium acnes KPA171202
MKRLRGCALPILLTTLALAGCSSGRQTKGGGGGEANLKLPPLNEHVGNVSGTALLWIGLVICLFGLGFGLVTYSKLEKLPVHEAMHEVSELIYETCKTYLKQQAKFLMLLWAFIAAIIVVYFLLLEHMGAKVLIILLFSLVGMAGSFGVAWYGIRVNTFANSRTAHASLRGSPWATFDIPMRSGMSIGMVLISVELTLMLFIMLVLPGDLAGPCFIGFAIGESLGAACLRIAGGIFTKIADVGADLMKIAFHIKEDDARNPGVIADCTGDNAGDSVGPSADGFETYGVTGVALITFVLGAVPDQTEQVQLLVWIFVVRVVMLIASFVSYLINNAVAKARYGTVSEMDFEKPLSSLVWITSVMSILLTVLTTRWMLGSMGDGTMWWKLSIIISCGTLAGALIPELVKAFTSTNSRHVREVVTSAREGGASLDILSGLVAGNFSGFWLGIIIVALMGASFLVSGTGSGLGDMGTMSEVKWAVFAFGLVAFGFLGMGAVTIAVDSYGPVTDNAQSVYELSTIEDIPNVSDEFEKHYGFAPRWDIAKRILEAQDGAGNTFKATAKPVLIGTAVVGATTMIFSIIMMLTEGLSNAAEVNKLGLAHAPFLLGLITGGAVIYWFSGASMQAVTTGAYRAVEFIKNNMQLDQNATKASSKDSKKVVQICTEYAQKGMLNIFLGVFFAALGFAFVDPYFFIGYLISIAIFGLYQAIFMANAGGAWDNAKKIVEVDLDAKGTELHDASVVGDTVGDPFKDTSSVALNPVIKFTTLFGLLAVELAVSIGVGLLTYILAAVFILVACVFVYRSFYGMRIDSTKDPEEFGVVAKEAGSGS

SEQ ID NO: 62832 - protein, 394 aa, Arabidopsis thaliana
  misc_feature (281)..(281): Xaa can be any naturally occurring amino acid
  misc_feature (321)..(321): Xaa can be any naturally occurring amino acid
  misc_feature (330)..(330): Xaa can be any naturally occurring amino acid
  misc_feature (344)..(344): Xaa can be any naturally occurring amino acid
  misc_feature (353)..(353): Xaa can be any naturally occurring amino acid
  misc_feature (356)..(356): Xaa can be any naturally occurring amino acid
  misc_feature (366)..(366): Xaa can be any naturally occurring amino acid
  misc_feature (369)..(369): Xaa can be any naturally occurring amino acid
MAAMITVDFQNSFAFILFCLFSLLCYSLFFRKAKGSRAGRDLPPSPPSFPVIGHLHLLLSVLVHKSFQKISSKYGPLLLLRIFHVPIVLTSSASVAYEIFRAQDVNVSSRGHPPVEESLWFGFSSFFFAPYGDYFKFMRKLIATKLLGPQALDRSRKIRADELDRFYRNLLDKAMKKESVEIDDHGEELMIMGRSCSEKNGEAERVRGLVIESLALSPKIFLGMIFHKPLKKLGISLFQKDIKSVSPKFDELLEKFLVEHEEKMEEDHYKANDMMDLLLEXYGDENAEYKITRNHIKSLFVELLVAGTDTSALAIEWTMAXIIKKPNILXRLRKEIDSFVGKTXLIQEKDLPXLPXLQAVIKGGLXFTXTSNSGEGKSQIGCVWLVPKGHNFFG

SEQ ID NO: 62833 - protein, 554 aa, Zea mays
MASIPPPSSSVAALTRQPAQFLKGCSVSKETKASVCSFLATNSNSTRVKSVGLRVASSFKNDGGYPADGFSGNGNTLLPKSTSVRGEDHPVADPVLPMDSMMTPEILSANLALVMDKFSDDDTDTELDLDSPTEGFASIADAIEDVRQGKLVIVVDDESRENEGDLIMAASLVTPEAMAFIVRHGTGIVCVSIKEDDLERLCLPLMVTTKENEEKLCTAFTVTVDAKEGTTTGVSAKDRAKTVMTLASPDSRPEDFNRPGHIFPLKYREGGVLKRAGHTEASVDLAMLAGLPPVAVLCEIVDDADGSMARLPKLRVFAERENLKIISIADLIRYRRKRDRLVERASVARLPSQWGNGHGYCYRSAIDGIEHLAMVKGDIGDGQDILVRVHSECLTGDIFRSARCDCGDQLAMAIEMIEKAGRGVIVYLRGHEGRGIGLGHKLRAYNLQDDGRDTVEANEELGLPVDSREYGIGAQILRDLGVRSMKLMTNSPAKYSGLKGYGLSIAGRVPLVTPITSENRKYLETKRTKMGHVYGLANAQVNQPSGSQSTEEKH

SEQ ID NO: 62834 - protein, 492 aa, Serratia marcescens
MLLSSTRKDWLGNVRGDVLAGIVVALALIPEAIAFSIIAGVDPQVGLYSAFCIPLVMAFFGGRPAMISSSTGAMALLMVTLVKDHGLQYLLAASILTGVFQLIAGYLKLGGLMRFVSRSVVTGFVNALAILIFMAQLPELTNVTWHVYAMTAAGLGIIYLFPYINKTIPSPLVCIVVLTGIAMWLHLDVRTVGDMGKLPDSLPVFLLPDVPLNLQTLLIILPYSAGLAVVGLLESMMTATIVDDMTDTPSDKNRECKAQGIANICTSFIGGMAGCAMIGQSVINVKSGGRGRLSTLTAGVVLLCLIVFLRNWVSQIPMAALVAVMIMVSIGTFSWRSIANLRTHPLSTSVVMLATVAVVVATHNLAFGVLTGVLIASLNFATKVSRFMRVTSVLEGTSRTYTVTGQVFFASADRFTSHFDFREAIENVVIDVSHAHFWDITSVSALDKVVIKFRREGAGVEIRGMNEATRTIVDRFGVHDKPEEVEKLMGGH

SEQ ID NO: 62835 - protein, 524 aa, Propionibacterium acnes KPA171202
MAGRDASGSTTRAISGLRGDRVNPLRDPSDRRLPRVAGPCVLVMFGVTGDLSRKKLMPAVYDLANRGLLPPGFGLVGFARRDWEDEDFAKVVHDAVAEHARTPFREEVWEQLLEGIRFVRGEFDDNDAFERLANTIRELDEERGTGGNHAFYLSIPPRSFEAVISQLKRHGMTGHDSSHWSRVVIEKPFGHDLESARDLDEIISSAFSPESVFRIDHYLGKETVQNIMAFRFANQIFEPIWNNHYVSHVQITMAEDIGIAGRAGYYDGIGASRDVIQNHLLQLMALTAMEEPTSFDAKQLCAEKIKILAAIQPPDNMFAQTCRGQYVAGRQGGERVRGYLEEDGVDPRSRTETYAAVRLTIDNRRWAGVPFYLRTAKRMPRRVTEVALNLQRAPHLPFSDTAALGTNAVVLRIQPDEGVTLKFGAKVPGTQMELRDVTMDFAYGSSFTEASPEAYERLILDVLLGDPPLFPQHEEVELAWKILDPVLDFWAESNTPPCEYPAGSWGPSEADEMIARDEFVWRRP

SEQ ID NO: 62836 - protein, 404 aa, Photobacterium profundum SS9
MHNIGMSSKLNNVCYDIRGPVLKHAKRMEEEGHKILKLNIGNPAPFGFDAPDEILVDVIRNLPTSQGYCDSKGIYPARKAIVQHYQKRGLLDLDVEDVYIGNGVSELIVMAMQALLDNNDEILVPSPDYPLWTAAVSLSGGNPVHYICDEESDWYPDLDDIKKKITPNTRGIVLINPNNPTGAVYSRDFLLEIVEIARKHKLIIFADEIYDKILYEGAQHTSIAPLAPDVFCITFNGLSKSYRVCGFRAGWMVLSGPKHEAKGYIEGLEMLSSMRLCANVPMQHAIQTAIGGYQSINELILPGGRLLEQRDKAYDLITQIPGVSCVKPKGALYLFPKLDQKKFNIVDDQRMALDFLQQEKVLIVHGTGFNWEKPDHFRIVTLPRVDDLEMAIGRLERFLHNYRQ

SEQ ID NO: 62837 - protein, 363 aa, Buchnera aphidicola
MKKNYRIAVLSGDGIGPEVMQEACKILNVLKKYFFLSLEIQKFNIGGIAIEREGVALPKTTLLGCENSDSILLGSVGGKKWDNLPVEQRPERAALLPLRKHFNLFSNLRPAKLYPELKCLSPLRSDIVKNGFDILCVRELTGGIYFGEPKGFVNKNNTKYAFDTEIYHEYEIIRIAHLAFKLARSRKKKVCSIDKSNVLQSSILWREVVESVSKKYPDVHLSHLYIDNAAMQIIKDPNQFDVLLCSNLFGDIISDECATITGSIGMLPSASFNEKNFGLYEPAGGSAPDIEGKNIANPIAQILSLSMLVRYGMNLNQIADKIDKAVNNVLKKGYRTSDISHDNNFLKTDEMGDLIVDSLINGK

SEQ ID NO: 62838 - protein, 685 aa, Magnaporthe grisea 70-15
MSQSQQPPATGRDNSVPATPDEQFDSMPTSPCSIVDDDSEASTPLDPPSPSALPKRVPSLRTVSDPSTTAMTSTSTVTGTLTNARRPPPSAGVLPADLMAKARALQSTRMGRPQMQAFGSGSSTSSASGIGSPLPMGSGLGPQSPPVGLPTGGMSGNMRFPPNIAANMQLNLGGRPLPQGFPKSAPAVPSARKAPPSLSERRAMKLGGLPGGPGATPSMGTPKLSDLQGGASGPTDGNSNADKTSGAGGQAVPDNKLHDFKQYIDAENGWITFDGAATITRTGVNFASGHKFSISLDEIQVLDELGKGNYGTVYKVRHAKPKVPRFGQGLGSLTKQSVSRQNSMKDEGEDANGVVDGQTTSGVVMAMKEIRLELDEAKFTTILKELVILHECVSPYIIDFYGAFFQEGAVYMCIEYMDGGSIDKLYAGGIPEGVIRKITYATVMGLKSLKDDHNIIHRDVKPTNILANTRGQVKICDFGVSGNLVASIAKTNIGCQSYMAPERISGGGFAQGGADGTYNVQSDIWSLGLTIIECAMGRYPYPPEVSSTIFSQLSAIVEGDPPDLPTEGYSDTARNFVRSCLDKNPAKRSTYPMLLAHPWLRSLAQPATISEEAEDTEDLEAAAQKLSLGAGPIGADDEVAQWVKSALDRKRRGDAQSPDKPALHAAPFDSASPMAAPKAGPMTGA

SEQ ID NO: 62839 - protein, 201 aa, Zea mays
  misc_feature (32)..(32): Xaa can be any naturally occurring amino acid
  misc_feature (130)..(130): Xaa can be any naturally occurring amino acid
  misc_feature (151)..(151): Xaa can be any naturally occurring amino acid
  misc_feature (161)..(161): Xaa can be any naturally occurring amino acid
  misc_feature (171)..(171): Xaa can be any naturally occurring amino acid
MPHPGDDQPVKTCTTMSDTDIAAALIESLRAXLILLCDLPGLPQPTCPRGPLCLLLAPSMRKRIRIDAALEATDERRIKEVKPELVEGPDCAMDNAGKDFVDLVCPRGYVYDIMTSSKRFVLLTDAHFLXHYWLAINTAYCAENVECSTTXFLTGHLVYRXSSVGYSVLYXKDYVIIWQPARVIGANCPVFDCDLTNDYLT

SEQ ID NO: 62840 - protein, 479 aa, Methanosarcina mazei Go1
MVAMKMQINGKAAGSCGGECFDVRNPATCELLEQVPRGTEEDVALAVEAALSAFEGWASISPQQRGMVFYRAAGLVRQRKEELAALLTQEQGKPLAEARNELEGFSHVLEYYCGLAGSLRGDFIPVTGNGYSFTVKKPLGVCAAIIPWNMPALIMGWKIAPALISGNTFVLKPASSTPLTNLTLASILNEAGLPAGVLNVVTGSGEIAGESLVRSPDVRKISFTGESGTGKRISELAASGMKRVTLELGGSDPMIVCDDANLESAVAGAIRGRFYNCGQTCTAVKRLYVFESVAREFIRKLEEGVKRLKVGNGLDKDTDMGPLNNHSQFEYIKELVAGIEEKGEGRIIAGGKAPSFKGMGKGYFFEPTLVSDVPGDSRLLKEEVFGPLLPIVTVRNLDEAIEEANRSIYGLGASIWTKDLDRIRMGCEQLNAGIIWVNQHLKVAPEVPFGGVKESGFGRENGPDILSEYLETRTIMLKT

SEQ ID NO: 62841 - protein, 225 aa, Zea mays
  misc_feature (155)..(155): Xaa can be any naturally occurring amino acid
IQKPPAPGQFLDRIATHPISMATSALAALSATAAAAGKRILLSRPVSSSSLSFASRRLAAGAPLRGFLGAPIRAVASSASARPAAAAKTIAVGDRLPDATLSYFDTSSPDGELKTVTVRDLTAGKKVVLFAVPGAFTPTCTQKHLPGFVAKAGGXGDQVLLLPDGNGQLASAMGGELDLSDKPVGLGVRSRRYALLTEDGVVKVINLEEGGAFTNSSAEDMLNAL

SEQ ID NO: 62842 - protein, 483 aa, Magnetococcus sp. MC-1
MGEVGWCFDNSYGRLPAHFYARLAPVPVAQPRLVLCNDALAQQMGLDFSQVDAHTLAQQLSGNQLPTGAEPLAQAYAGHQFGHFTMLGDGRAIVLGEHLTPSGQRLDVQLKGSGRTPFSRNGDGRAALGPMLREYIISEAMHGLGIATTRSLAVVATGEVVMREEPLAGAILTRVAASHVRVGSFQYLAMREDEAGLAQLAAYTLARHYPERQGGDNPALELLKGVLQRQLSLVVAWMRVGFIHGVMNTDNTTLSGETIDYGPCAFMDHYHKDTVFSSIDHAGRYRYGNQPRMIRWNLARLAEALLPLLHPKPNKAIALAEEVVFAFDDRYTASWREMMAHKLGLFELQDGDDALMEQLLTWMQQSQADYTQTFRQLSTPAGSPPWLASLEPWWQQWQARLARQAQPLERVYARMQQVNPAIIPRNHRVEAALQAATEAGDLAPVRQLVAALQDPYHDGVAQQAYVTPPAPAQVAHYQTFCGT

SEQ ID NO: 62843 - protein, 213 aa, Pseudomonas fluorescens Pf-5
MQLKNPILGLCQQATFMLSAAKVDQCPDDEGFEVAFAGRSNAGKSSALNTLTHASLARTSKTPGRTQLLNFFKLDDDRRLVDLPGYGYAKVPIPLKQHWQRHLEAYLGSRESLKGLILMMDIRHPMTDFDLLMLDWAVASGMPMHILLTKADKLTYGAAKNTLLKVQSQIRKGWGEAVTIQLFSAPKRMGLEEAYTVLAGWMELADKGAEAEA

SEQ ID NO: 62844 - protein, 185 aa, Pasteurella multocida subsp. multocida str. Pm70
MKPNIPIFLTLFRVILIPFFVIAFYLPFSWSPFLTVLIFFIAGVTDWFDGYLARKWKQTTRFGAFLDPVADKVMVTVALALVVEYHHSFWITLPAVIMISREIIISALREWMAEIGDRNKVAVSWLGKVKTTAQMLALGGLLWRYNVVMEIAAIVLLYVAAILTVWSMLQYLKAAKGSLLSDITL

SEQ ID NO: 62845 - protein, 425 aa, Oryza sativa Japonica Group
MAAAAAATFLPHTPTPRRRLAVAVHSPTRRRLSLVFSGPPDGALSVAAAEEKADAGEEAAAAVSAPRGGGGGGGKERRRVVRKAWEKLVRWSRSWRRRNRSDVVETTRKVVVLGGGSFGTAMAAQVAAKKADLEVSMLLRDDLVCRSINHSHINCKYLRDHRLPENITATTSASDALAGADFCFHAVPVQFSSSFLEGISTHVDPKLPFISLSKGLELNTLRTMSQIIPQALGNPRQPFIVLSGPSFAIELMNKLPTGRNLIVIKLYMAAMVVASKDKKLAAAVQQLLASPNLRISTSNDVTGVEIAGALKNVLAIAAGIVEGMHLGNNCMAALVAQGCSEIRWLATKVAEGVSTAGAVIALAQKYHVKMPVLTAVARIIDNELTPKKAVMELMNLPQVQYLSENILFIQRKLAHGELENIEINE

SEQ ID NO: 62846 - protein, 341 aa, Williopsis saturnus
SGVAKFAKYPLTFGPSPISNLNRLSQHLGSKVNVYAKREDCNSGLAFGGNKLRKLEYIVPDIVEGDYTHLVSIGGRQSNQTRMVAALAAKLGKKCVLIQEDWVPIPEAEKDVYNRVGNIELSRIMGADVRVIEDGFDIGMRKSFANALQELEDAGHKPYPIPAGCSEHKYGGLGFVGFADEVINQEVELGIKFDKIVVCCVTGSTTAGILAGMAQYGRQDDVIAIDASFTSEKTKEQTLRIANNTAKLIGVEHEFKDFTLDTRFAYPCYGVPNEGTIEAIRTCAEQEGVLTDPVYEGKSMQGLIALIKEDYFKPGANVLYVHLGGAPALSAYSSFFPTKTA

SEQ ID NO: 62847 - protein, 211 aa, Pseudomonas syringae pv. syringae B728a
MQLKNPILGLCQQATFMLSAAKVDQCPDDEGFEVAFAGRSNAGKSSALNTLTHASLARTSKTPGRTQLLNFFGLDEDRRLVDLPGYGYAKVPIPLKLHWQRHLEAYLGSRESLKGLILMMDIRHPMTDFDVLMLDWAIASNMPMHILLTKADKLTYGAAKNTLLKVQAEIRKGWGDAVSIQLFSAPKRMGLEEAYTVLADWMELEDKAPAE

SEQ ID NO: 62848 - protein, 369 aa, Synechococcus elongatus PCC 7942
MKSRAAIAWAAGQTADDREVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 62849 - protein, 336 aa, Frankia sp. EAN1pec
MTAATSGAGGPATGAGAVAGPGFDRESTALEVARSADLRGRVAVLTGASSGIGVETARALAATGADVVLGVRDVAAGEELVREVRAGATGDIRAERLDLSDLGSVVAFAAQVTGPVDLLIANAGVSRTPESHLPNGLDVRFATNHLGHFLLALRLSEQLAERGARIVVVSSGAHRSIPVRLDDLQWTARRHNPGMAYAESKTANILFAQEATRRWGPDGIFANAVLPGSALTGLQRFHGDEMKRRIGFLNEDGSPNPVLKSPAQAAATTLWAATAPELAGRGGLVLEDCAEALPPGPPGSDVLVRSGFDPSVADPDTARRLWDRSIELLRVLGRPE

SEQ ID NO: 62850 - protein, 508 aa, Oryza sativa
YVWVSAVPRKRTAQRRGPHDVEDEAWGLLRESVVRYCGSPVGTIAACDPNDASPLNYDQVFIRDFVPSGIAFLLKGDYEIVRNFILHTLQLQSWEKTMDCHSPGQGLMPASFKVRVVPLDGDDDVTEEVLDPDFGEAAIGRVAPVDSGLWWIILLRAYGKCSGDLSVQERIDVQTGIKMILKLCLADGFDMFPTLLVTDGSCMIDRRMGIHGHPLEIQALFYSALLCAREMLTPEDGSADLIRALNSRLIALSFHIREYYWLDKRKLNEIYRYKTEEYSYDAVNKFNIYPDQIPPWLVEWIPPKGGYFIGNLQPAHMDFRFFSLGNLWSIVSSLATSHQSDAILDLVEAKWSDLVADMPMKICYPALAEREWKFLTGTDPKNTAWSYHNGGSWPTLLWQLTVACIKVDRSEIAAKAVEVAERRIANDKWPEYYDTKRARFIGKQSRLFQTWTIAGFLVAKQLLENPDKSRILWNNEDEEILNAMNRMTDASNLKRRRGRKGLKKTYIV

SEQ ID NO: 62851 - protein, 174 aa, Zea mays
FASSFKHPHTHSASAPLSPPVRPSSPPLRLPESHQPFSSCRDSRAKPSPWRRRPTPFVATPPPAPAMATLSPPPKSGIPPRYDLDAKWDACLDLSIRRVAYSSLAGALAGLLLFRSPTTRWASVTLGAGVGIGAAYTECSYLFSGGPPNWSPKVSTIPSAHSEVIALSFSLNPV

SEQ ID NO: 62852 - protein, 456 aa, Xylella fastidiosa Ann-1
MVIHSSVLELIGNTPIIKAQRLDTGLCDLFLKLESANPGGSIKDRVGLSMIEAAECRGHIKPGATLVDGAASTTSMGLAFVARQKGYRLILVVPDNMAWEKISNLKAMGAEVILTRSDVSKGHPEHYQDLAEKLAAETPGAYFINQFGNADNPAAHEFGTGPEILKQMGGHVDAVVLGCDSAGTITGLSRAFDSVASDVELILADPVGSILTQYINEGTRSDRSGTWLVEGIGSDCLPPISDFRRIKKTYAISDAESFHTARELLSKEGILGGSSTGTLLAAALKYCREQIERKRVLVFVCDTGNKYLLNMYNDDWMLDNGFLKRPHYGDLRDLILHPYNQRHTVVVDPNDLLTVAYQRMKRYGVSQLPVIEGRQLVGILDESDVLLHVYGDETRFCDPVSTAMVSKLHRLDVKSPIEALLPVFERGQVAIVMEDDQFLGLITRIDLLNYLRRRMQ

SEQ ID NO: 62853 - protein, 78 aa, Oryza sativa
GKRLGIDEELVELLGRYSPIPVTYAGGVSTMDDLERIKRAGNSRVDVTVGSALDIFGGDLPYKDVVLWHKEQNMVSQP

SEQ ID NO: 62854 - protein, 253 aa, Propionibacterium acnes KPA171202
MGSLTTSTAMRRSFAATPPISEVTMGFNAFDKNRLAALNAEQAEQAAPGGLAPAGPRNDYYIPQWEERTSYGVRRVDPYTKLFEDRIIFLGTPVTDDIANAVMAQLLCLQSMDADRQISMYINSPGGSFTAMTAIYDTMNYVRPDIQTICLGMAASAAAVLLAAGAKGQRLSLPNSTVLIHQPAMGQATYGQATDIEILDDEIQRIRKLMENMLATATGQSVEQISKDIDRDKYLTAQGAKEYGLIDDILTSL

SEQ ID NO: 62855 - protein, 212 aa, Propionibacterium acnes KPA171202
MSHNTSIASQGMPAMAGPETGGAGMTDNVYQSLLRNRIVFLGSEVKDENANALCAQMLLLNAEDPEADIYLYINSPGGSVTGGMAIYDTMQWISNDVATVTMGMAASMGQFLLTAGTPGKRYALPHAKILMHQPLGGVGGTATEIAINAKMLKDTKRELSQLNADHSGHTLEQILEDSDRDHWFTAQEALEYGLIDHVYSNASQLRGDAPNQ

SEQ ID NO: 62856 - protein, 207 aa, Photobacterium profundum SS9
MSYQERNAMSPITDALVPMVVEQTSRGERSYDIYSRLLKERVIFLTGQVEDHMANLVVAQLLFLESENPDKDIFLYINSPGGSVTAGMSIYDTMQFIKPNVSTVCMGQACSMGAFLLAGGAKGKRYCLPNSRVMIHQPLGGFQGQASDIQIHAKEILTIKHRLNSLLAKHTGQPLEVVEGDTDRDNFMSADQAVEYGLVDSVLTQRD

SEQ ID NO: 62857 - protein, 297 aa, Rhodopseudomonas palustris CGA009
MSTSPEHKRTALVTGANSGLGKAIVTALAADGLRVGLVARDRGRGEAALADVRAATGNQDLHLFVADLADQESIRALAQDVRARFDRLHLLINNAGTAFPERRLSPQGIERAFAINHLGPFLLTNLLLDLIKASAPARIVNVGTRIDAAIDFDDLNWDKRPYGMMKGYAQSKLGNLHFTFELARRLEGSGVTVNCVFPGVFKSNLGGTDGAQGLFWKLLAKLGGWAIPKPESAAQRVLYLANAPELESVSGQYYANRKTIPAPAQALDAEANRRLWEISERMTGLTQSQTVGDQAAT

SEQ ID NO: 62858 - protein, 493 aa, Rhodopseudomonas palustris CGA009
MAGIWTRKSLSSLQIEAAAGDSGDGEVRHLKRSLSAVNLVALGVGGIIGAGIFVLTGHAAAANAGPAVSLSFLLGAITCAFAGLCYAEMASTVPVSGSAYTYAYATIGELVAWIIGWDLILEYAVGAITVAIGWSGYFVSLLGNFGIHLPPQFTTAPLAYDAATHAWSTTGAFLNLPAIAIVVAIATLLVIGIQESARFNNVIVGIKLTVIALFLIFAAPMVTPANWVTAANPDGAFIPPAQENGIFGWSGVLRGAAVVFFAFIGFDAVSTAAQEAKNPQRDMPLGILGSLAICTVLYVSVAFVLTGIVPYDRLNVPDPIAVGIDAAGIGWLSSIVKIGVVTGLTSVILVLMLGQTRVLRAMAHDGLMPRGAAATHPRFRTPHVATIGTGVIVAGLAGVLPIGLVGELVSIGTLFAFAVVCVGVLALRIKHPEQHRPFKVPAIWLVAPAGAIVSFILMLGLPLDTWIRLAVWLAIGLAIYFLYGRHHSKPARR

SEQ ID NO: 62859 - protein, 86 aa, Oryza sativa
  misc_feature (46)..(46): Xaa can be any naturally occurring amino acid
  misc_feature (74)..(74): Xaa can be any naturally occurring amino acid
IYVLYACQPFVLLEYRADLPLGRYCAEKTNTMKPGRGICDGECLVXSTLLEGSVVGIVLWIILISGLKCMMGIXDTPSKFDSPPES

SEQ ID NO: 62860 - protein, 391 aa, Magnetococcus sp. MC-1
MASYDYDVAVVGGGIHGAGVAQIAAHAGWSCVVLEQAHVAAGTSSRSSKLIHGGLRYLQQMQFGLVRECLQERTRLLHVAPQLVRLIPFYLPVYQHASRPPWMIRAGLTLYAMLAGRNPGGHYERLPQSQWDTLGGLRQSGLKQLFCYYDAQTDDRALTVAVMASAQSYGAQLWCATTLQQLHRLPQGYRLSGQRGAVTFTIQARVVVNVAGPWIGTVAAKCQPPLELPPFAQVQGAHLSLPNWHPPGAFTLQSPLDGRVFFVLPWQGGALLGSTETPFDGDPAQAACTPQEQAYLLESAHPFFPQADMTVGASFAGIRVLPKGDANRASREALLPVDDPTKPRLVTLIGGKLTSYHPTARAIIKRLQGALPPANTAGDPGLLPLPPTTPP

SEQ ID NO: 62861 - protein, 227 aa, Ralstonia metallidurans CH34
MSLLHQARFFTTVNHLRDLPATAVPEVAFAGRSNAGKSTAINILCNQKRLAFSSRTPGRTQHINFFTVAPVKAPDPVGFLVDLPGYGYAEVSGSAKFHWQGLLSDYVQARTQLSGLILMMDARRPFTDLDCQMVEWFLPTGKPIHVLLTKADKLTTSDNAKALRETRKVLADYAAQMENPPALTAQLFSSLKRRGIEEAQRVVAGWLALPEAQPAVAKSDTPDTPQG

SEQ ID NO: 62862 - protein, 214 aa, Ageratina adenophora
  misc_feature (29)..(29): Xaa can be any naturally occurring amino acid
TLISLKDDADADGEGVKLTDIEIKALLLXLFTAGTDTSSSTVEWAIAELIRHPRLLKQAQEEIDTVVGRDRLVTELDLNQLTFIQAIVKETFRLHPSTPLSLPRISSEACEVDGYYIPKGSTLLVNVWAIARDPEMWTDPLEFRPSRFLPGGEKPNVDVRGNDFEVIPFGAGRRICVGMTLGLRMVQLLVATLVQTFDWELAKGLEPEKLNMER

SEQ ID NO: 62863 - protein, 191 aa, Aspergillus oryzae
MGVQKKTRKFAQVKRAIKKHDDRAKKDNNAPKQDKAKGDEVVRAIPQAPSNMFFAANTALGPPYHVLVDTNFVSHSIRAKTDMLKSMMDLLYAKCIPTFTDCTIAELEKLGDKFRLALRVAKDPRWARVRCDHPGTYADDCLVDRITKHRIYIVATNDKDLVRRIRKIPGVPIMKVARAKYVIERLPDHFE

SEQ ID NO: 62864 - protein, 163 aa, Pasteurella multocida subsp. multocida str. Pm70
MRRILSVLLENESGALSRVVGLFSQRAFNIESLTVAPTDDPTLSRMTIEAYGDEQVLEQIEKQLHKLVDIFKVISLSDCDHVEREVLLIKVRAQGASRDELKRLTDIYRGQIVDVTTKSYTIQLTGTKDKLDAFISAVKEETTIIEIVRSGLISLSRGEKNCL

SEQ ID NO: 62865 - protein, 511 aa, Pelargonium x hortorum
MYNMSLYLLLGSSALAFAAYLVLFSFSKSRRRLPPGPKAWPIVGNLPHMGSMPHQNLAAMARTYGPLVYLRLGFVDVVVALSASMASQFLKTHDSNFSSRPPNAGAKHIAYNYHDLVFAPYGPRWRLFRKITSIHLFSGKALDDYRHVRQEEVGVLASNLARAVSTIVNLGQLLNICATNALGRAVIGKKVFKDGTDDVDPKADEFKSMVVELMVLAGVFNIGDFIPPLDCLDLQGVASKMKNLHKRFDAFLSAILQEHNINSAASATPSMLTTLISLKDSVEDSEGGKLTDTEIKALLLNMFTAGTDTTSSTVEWAIAELIRQPEILIRAQKEIDSVVGRDRLVTELDLSKLPYLQAIVKETFRLHSSTPLSLPRIATQSCEINGYHIPKGATLLVNVWAIARDPDVWADPLSFRPERFLPGSEKENVDVKGNDFELIPFGAGRRICAGMSLGLRMVQLLTATLLHAFNWDLPQGQIPQELNMDEAYGLTLQRASPLHVRPRPRLPSHLY

SEQ ID NO: 62866 - protein, 977 aa, Debaryomyces hansenii CBS767
MNGSRVSDQNTKARLAAQFNQFYLQITSPEVTQIGNYQIIKEIGEGAFGKVYLANHVLLNVQVVLKCGLIDDPNIVREVYYHRQLQHKNIVKLYEVIKSERHLWMALEYCEGSELFYYIYEKRRLEYHETQNLFNQIITGVKYVHSLNLAHRDLKLENILLADSKRSIVKLTDFGFVREFNPVKRQFLSTVCGTTVYMAPELIKNQPYSGFAIDIWSLGVILFTMLYGEMPFDEDDDLKTKYKIINEEPLYRDSIPQDAIELLRKMLSKDPRARPGLSDISNSSFLIDISNKTSEKNNRSSFYNDQESILSISQHYSSEMQPFQSKMDRNLMRKLDKLNIDIIQLQQDVLNGEKNPLTAFYELSLVREFTKKKKHYREKKRKYNEAKKSLINSRKKVKSALSLSEQGSGSQPLERIISSLSLSSNRNSISRTNLSKIGSRKSIEFSDPYKKPRGSELNRNSLTGQRMSKTVSNLDHDYTPNSILEGTDSNIEVPLSKIVTFNQSEMKRRPSNATTTLSSTTGSENLKKKIKNAKILNRLQFWKKNKNNNGLETARENTTKPTEPQYGNGEKIPLISNGSSPSPKTNLNEINRNIVPIIETQDTTLVNENLIPNNENEIEAKNDLIQEMDNNMEDSVFESPNRQATPTLENYPMSSKYLKTRPSSVVSQASQLSHLSQLSTMMSETDLLGETDTMDEEEYDEDGIYESSLDNFQQDFPQRHSSVMTPTSGSSVTKKRPSYRRTLSSDISIMSTSTAATGSNSAPAKSHHQKRSLSRLSSNSSEESYSQSRKNATMNGHLFASPVPTVPMTDLASDINSSLSPVPNRPSSPDGTPPPKKMTFVNSKLLRHSRNTASQNSIPSINKINSVPQPYQFLNDNEATTRSHSPPIPNKFNKLKLKNKPINNIQEQPYSSKFSVKTTWPSKANQQENNDVNYRNMQLIDDNSVWNKNNNTAIGPMNGKNMYQANFIINEEEEDEN

SEQ ID NO: 62867 - protein, 253 aa, Synechocystis sp. PCC 6803
MGDTITLLSRREIEKMRQAGQLAAALLDHLAPMVQPGITTLELNDEAEKWTKAHGAISAPLGYNGFPKSICTSINEVICHGIPHRKRVLQAGDIINVDVTPIVDGYHGDCSRTFFVGTPSPVAEKLVKVTEECLRLGIEAVKPGGKIGDIGAAIQSHAEAQGFSVVRDFVGHGISKIFHTAPQIPHYGKAGKGKRLRPGMVFTIEPMINEGTWEAVLLDDGWTAITKDGKLSAQFEHTIAVTEDGVEILTLGE

SEQ ID NO: 62868 - protein, 415 aa, Prosthecochloris vibrioformis
MNIISVGVNHKTAPIEIRERIALSEVQNKEFVTDLVSSGLASEAMVVSTCNRTELYVVPGMPEVNCDYLKDYIISYKDARNAVRPEHFFNRFYCGTARHLFEVSSAIDSLVLGEGQILGQVKDAYRIAAEVGTAGILLTRLCHSPFSVAKKVKTRTKLMEGAVSVSYAAVELAQKIFSNLSMKKVLLIGAVKQSWQQSTCTPRTPGTSSSPTGRNPRPRACEELGTNRVLPYESYKEHLHEFDIIITAVSTKEYILNAAEMQQSMAKRRLKPVIILDLGLPRNVDPEVGALQNMFLKDIDALKHIIDKNLERRRAELPKVKSIIDEELIASASGSTPSRYVRPSLTCNPSSSKSRRKNSSVPPQGERRGVEAHGTPDRQDPEKNPASSYQDAQGSGRYRRQHPQQSQPRQEHLRS

SEQ ID NO: 62869 - protein, 484 aa, Xanthomonas oryzae pv. oryzae KACC10331
MLLHLQCVCAPGLAWWRRFTWSFLMSFESLGLAPFLLRALAEQGYETPTAIQQQAIPLVLAGHDLLAGAQTGTGKTAAFGLPLLQHLGTSPQPVNGPRKPRALILTPTRELATQVHDSLRGYSKYLRIPSAVIYGGVGMGNQLDTLRRGVDLLIACPGRLIDHIERRSVDLSGIEVLILDEADRMLDMGFLPSIKRILTKLPRQDRQTLLFSATFEENIKQLALEFMRNPMQIQVTPSNTVAESITHRVHPVDGARKRDLLLHLLAQDSREQTLVFARTKHGSDKLALFLEKSGIKTAAIHGNKSQGQRMRALSDFKAGRVTVLVATDIAARGIDIDQLPKVINYDLPMVAEDYVHRIGRTGRNGSTGEAISLVAQDEAKLLRQIVRMLGRDVEIRDVPGYEPQTPIRWGNSAPGRAEQPGGDRAPRKSHARRPHGDAPRQAHAHAGPKKPGGQRSGGPRQANAGPGAGRRDGGRGGQRPSGTR

SEQ ID NO: 62870 - protein, 424 aa, Zea mays
MERYKLIRKIGDGTCGNVFMASNVETNEIVAVKKMKRKFCHWEECISLREVKALQKLFHPNIVKLKEVTMENHELFFIFEHMECNLYDVIRERQVAFPERDIRNFMVQILQGLAYMHNNGYFHRDLKPENLLVTNGIIKIADFGLAREISSNPPYTDYVSTRWYRAPEVLLQSSVYTPAIDMWAVGAILAELFTLSPLFPGESETDQLYKICTVLGTPDCTIWPEGMNLPRSCSFKFFQNPPRNLWELIPNASSEAIDLIQQLCSWDPRRRPTAEQALQHPFFNVCNWVPRPVHDAYHTKTNGPKAEPRLELNLWDFSTEPDDCVLDLTLSLKPSFSGTDLGKHVPRRTEEEILLYPGFENTPVKSGFWPLVPSDRPVGDVPAIPSWQQAYMVDSQGAFSGSPFLQSNLLENRSLAPIRQVNFF

SEQ ID NO: 62871 - protein, 570 aa, Zymomonas mobilis subsp. mobilis ZM4
MTQKHPQTLVVDAPLSDAERLKRESNFLRGTIAEDLNDGLTGGFNGDNSTLIRFHGMYQQDDRDIRAERAEEKLEPRYAMMLRCRLPGGIISPEQWLKMDSFASEKTLYGSIRLTNRQTFQFHGILKKDLKTVHHLLHESGLDSLATANDVNRNVLCTSNPVESDLHAEAYEWAKKISEHLLPQTHAYAEIWLDQEKLATTDQEPILGATYLPRKFKTTVVIPPQNDVDIYANDLNFIAISENDQLVGFNVLIGGGLSITIGDKTTHPGVAKDIGYIEKEKVLAVAEAVVTTQRDWGNRSNRKNARLRYTLERVGLDVFKAEVEKRAGVTFEASRPFTLTGRGDRFGWVKGIDNQWHLTLFVENGRLLDYPHRPLKSGIAEIAKVHKGDFRLTANQNLIVAGVSEEDKDTIEKIARDHGLLENISELRKNSMACVSFPTCPLAMAEAERFLPNFLTKVEAVMTKYDIADEYIVFRTTGCPNNCGRSLLAEIGLVGRAIGRYNLYIGGDRVGTRIPRLFRENITEDEILSEVDSLIGRWAKERDGKEAFGDFVVRAGIVKAVTDPAIDFYD

SEQ ID NO: 62872 - protein, 279 aa, Candida albicans SC5314
MTKFRGCIDIHSGQVKQIVGGTLTQDDSASSKTSSAKENFVSTKPSSHYAQLYKDYNVKGCHVIKLGSNPANDDAAKLALSTWPHNLQVGGGINLDNAQYWLDQGASHVILTSWLFTKNEQDKMELDFGKLREINKLIGKEKLIVDLSCRTVIENGKTNWYVAMNKWQTITDTILSAEFLLKVSAYCDEFLIHAADVEGLCKGIDEKLVENLGEWCPVGFEEKIVYAGGAKSINDLDTVAKLSKGKVDLTYGSSLDIFSGKLVNFTDLVEWNKANSKTN

SEQ ID NO: 62873 - protein, 551 aa, Acremonium sp. HI-25
MLLGTLFTLLAQCLLIEATSCLVKHDGGFVPDHVLRVSSRNISIACTSRQSAVVNGTSPGPELRVPAGQRTWIRVYNDLEQENLTMHWHGLAQRMAIFADGSPQGSQWPIPPGHFFDYELQTTVEDAGTYFYHSHVGMQALTASGALIVEGCERPPYQYDDERTLHWSDFFPQTDHEIEVGLQSVPLVWPGEVRAVLLNGKGIGIGHEADVSPSGDCSLPVIDVDPGKTYRFRFIGATGLSLVSMGFEGHQNLTIIQVDGGEWTKPASVDRIQLASGQRFDALFKAKTEEELASEGRQTYFIQFETRDRPEVYRGYAVIRYSKASTTPHVPTIPPLTLPNNTYDWLEYELRPLIETVTQPTLGEVTRRVIINASQLTDPQNQHVVWRLANLSWTEAVRQTPLLVDIYKFGDLAIPNYDAALANYGWDPETRAFPAKVGEVLEIVFQNTGSLVGSDGAVDIHPFHAHGEHFYDIGSGDGVYDAEANEAKLVAMNYTAVKRDTTMLYHYAATTTPGAPAGWRAWRLRVTQPGVWMIHCHILQHMVMGKSADAV

SEQ ID NO: 62874 - protein, 607 aa, Oryza sativa
MASAAAPKRCYYEVLGVPRDCSPADIKLAFRRLALSLHPDKQPPGSDVAAATAAFQELQHAHSVLSDPHERSYYDSHRSQILFSDHHPSSGPGRGGGVASASASPVPDLFAFFSSSAFSGFSDSGRGFYKVYGDVFDRVFAQELAYARRMGMPADAVPTPPVIGNLDSPHAQVAAFYSYWLGFGTAMDFGWAAEWDAARGESRRVRRLMEEDNEKATRKARREYNDAVRGLAAFCKKRDKRVVDMALKKKVEEEKRKAEEAARKKEEERRRKERAMAYQEPEWARVDEDEAAVFEDDEEEETRAKRKEELYCVACNKKFKSDKQWKNHEQSKKHRDKVSELRMVFEEEEEALKDAEEEEPEEVDVGFDFQPAQESEESEFSDAAEELADELSEGLEVRDEEEKGDKHLGNGEQKVGSYDETSVLEEMLSRSRRKNRKSGFVAPQEEASPAGAMDDDDDEDTSYEINNVKKKGRRRRAAKKGGTYADNGQGRKSENQPEESRHNNDENGADDKMEGPSSNEDSAAASKEDQQKGKTGNTKKNKKGTEKNTTISSEQKGTSKGKKQKEVSKAPSNDCETCGSTFDSRNKLFSHLEETGHAMLKTRQKNR

SEQ ID NO: 62875 - protein, 144 aa, Zea mays
MSAANQLAALVSNMYATGLLDDQFQQLQMLQNASTPDFVSEVVTLFCQDGERIIGELAKLLEKPNVDFDRVDAFVHQLKGSSASIGAQKVKNTCIQFRESCQQKSKDGCLKTLETVKINFYDLRDKFQTMLQLQRQVNGCPPSK

SEQ ID NO: 62876 - protein, 450 aa, Triticum aestivum
  misc_feature (24)..(24): Xaa can be any naturally occurring amino acid
AALGRGRKTPTPELGEVVTSDMSXGRRTMSRSSDSGRMGNDEKEDLELGKGDYMDVDRGEASVNGSANLLSSDSEDEVRRSETPEPVKPAHRCINMLQGCRSVDVFERLNKINEGTYGVVYRAKDKKTAEIVALKKVKMEKEREGFPLTSLREINILLSFHHPSIVDVKEVVVGSSLDSIFMVMEYMEHDLKGVMETMKQPYTQSEVKCLMLQLLEGVKYLHDNWVLHRDLKTSNLLLNNRGELKICDFGLSRQYGSPLKPYTQLVVTLWYRSPELLLGTKEYSTAIDMWSVGCIMAELLAKEPLFNGKTEFEQLDKIFRTLGTPNEKIWPGYAKLPGVKVNFVKQPYNRLRDKFPAASFSGRPNLSEAGFDLLNKLLTYDPAKRISAEAALEHPWFSEVPLPKSKDFMPTFPALNELDRRTRRYMKSPDPLEEQRLKELQAKGNRGLFG

SEQ ID NO: 62877 - protein, 498 aa, Arabidopsis thaliana
MSILLYFIALLSLIIIKKIKDSNRNLPPSPLKLPVIGNLYQLRGLFHKCLHDLSKKHGPVLLLRLGFLDMVVISSTEAAEEALKVHDLECCTRPITNVTSKLWRDGQDIGLAPYGESLRELRKLSFLKFFSTTKVRSFRYIREEENDLMVKKLKEAALKKSSVDLSQTLFGLVGSIIFRSAFGQRFDEGNHVNAEKIEDLMFEVQKLGALSNSDLFPGGLGWFVDFVSGHNKKLHKVFVEVDTLLNHIIDDHLKNSIEEITHDRPDIIDSLLDMIRKQEQGDSFKLTIDNLKGIIQDIYLAGVDTSAITMIWAMAELVKNPRVMKKVQDEIRTCIGIKQNEKIEEDDVDKLQYLKLVVKETLRLHPAAPLLLPRETMSQIKIQGYNIPSKTILLVNVWSIGRDPKHWKNPEEFNPERFIDCPIDYKGNSFEMLPFGSGRRICPGIAFAIATVELGLLNLLYHFDWRLPEEDKDLDMEEAGDVTIIKKVPLKLVPVLHH

SEQ ID NO: 62878 - protein, 370 aa, Oceanobacter sp. RED65
MSKRDYYEVLGVDRQADAKEIKRAYRKLAMKYHPDRNPDDADADAKFKEASEAYEILGDQEKRAAYDQFGHAGVDGSAGAGAGGFGGGNFSDIFGDVFGDIFGGGGGRRGGPQRGNDLKYNLELSLEEAVKGTEKTIKVPTLVDCEVCDGSGAKAGSKPTVCGTCNGQGQVRMQQGFFAVQQTCPTCQGQGTIIKDPCDSCHGQGVKEETKTLNVKIPPGVDNGDRIRLNGEGEAGAMGGPAGDLYVEAHIKPHSIFERDGRNLYCDVPISIADAALGGEIEVPTLDGRVNLKIPAETQSGKLFRLRGKGVLPVRGGPQGDLLCRVMVETPVNLNDKQKEILREFQASLKGEKHSPRKKTWFDNVKAFFE

SEQ ID NO: 62879 - protein, 343 aa, Bartonella quintana str. Toulouse
MNECLGDIAQALVCAGKGILAADESTATIGKRFESIGVESNEDNRRAYREMLFTAKEAMESAISGVILFDETVRQRASTGQMLTDLIRNAGALPGIKVDTGAKPLAAFPQEMITEGLDGLRERLKDYYALGARFAKWRAVIAIDAYALPTKGAISQNAQALARYAALCQEAGLVPIVEPEVLMDGASRQHSITRCFEVTQAVLNMVFKELFEARVLFEGMILKPNMVIDGKDARTASVEEVAEKTVRVLKQTVPAAVPGIAFLSGGQSDEEATAHLSAMNALGPLPWKLTFSYGRALQAAALKAWGSHHQNIALAQKAFCHRARMNHLAALGKWTKEQERSCA

SEQ ID NO: 62880 - protein, 397 aa, Bartonella quintana str. Toulouse
MGFRTLDDVDVTGKRVLVRVDFNVPMSQGKVCDETRLKRHKETLLELQKRGAKLILLSHCGRPKGQGEPEFSLRPVVRVLEKIINQPVAFAPDCVGVAAQTAIEALQNGGLLLLENVRFHPGEEKNDCSFAEALAHNGDLYVNDAFSVSHRAHASVEGITHLLPSYAGRSLQCELQALEKGLDNPKRPVVALVGGAKVSSKLFVLNHLVEKVDYLVIGGGMANSFLAAQGVHIGKSLCEHALMQTIKKVIEKAQEYQCTLLLPVDAVVGFRFEKGAPHRLYDIGDIPDDGMILDIGTRSIAHINEVIDKAATLVWNGPLGVFEMSPFDQGTIAVARHAAECSLTGKCVSIAGGGDTVFALNHAGVANDFTYLSTAGGAFLEWMEGKVLPGIFALRQA

SEQ ID NO: 62881 - protein, 340 aa, Bartonella quintana str. Toulouse
MTVRVAINGFGRIGRNILRAIVESGRQDIQVVAVNDLGSVETNAHLLRYDSVHGHFPGSVQVLGDAIDVGCGLIKVTSERDPAQLPWKALDIDIALECTGIFTARDKASAHLSAGAKRVLVSAPSEGADFTVVYGVNHQSLSKEHRVVSNASCTTNCLAPVAQVLHNTVGIEKGFMTTIHSYTGDQPVLDTMHRDLYRARAAALSMIPTSTGAAKAVGLVLPELKGLLDGVSIRVPTPNVSVVDLTFTAKRSTMVEEINTAICTAARGELKGILDYTEEKLVSCDFNHNPHSAIFHNDQTKVIDGKLCRVLVWYDNEWGFSNRMADTAVAFAKTVDEERT

SEQ ID NO: 62882 - protein, 515 aa, Thermus thermophilus HB27
MRYADRVAGISWETIEEVRRRLKERPALHFIAGEFVPSESGETFPSLDPATNEVLGVAARGGEREVDRAAKAAHEAFQRWSRTKAKERKRYLLRIAELIEKHADELAVMECLDAGQVLRIVRAQVARAAENFAFYAEYAEHAMEDRTFPVDRDWLYYTVRVPAGPVGIITPWNAPLMLSTWRIAPALAFGNTVVLKPAEWSPFTATKLAEILKEADLPPGVFNLVQGFGEEAGAALVAHPLVPLLTLTGETETGKIVMRNAADHLKRLSPELGGKSPALVFADADLERALDAVVFQIFSFNGERCTASSRLLVEEKIFEDFVGKVVERARAIRVGHPLDPETEVGPLIHPEHLQRVLGYVEAGKREGARLLVGGERAKTSFRGEDLSRGNYLLPTVFVGENHMKIAQEEIFGPVLVAIPFKDEEEALRKANDTKYGLAAYVFTRDLERAHRLALELEAGMVYLNSHNVRHLPTPFGGVKGSGDRREGGTYALDFYTDLKTIALPLRPPHVPKFGK

SEQ ID NO: 62883 - protein, 327 aa, Zea mays
MSWAAIENDPGVFTELLQQMQLKGLQVDELYSLDLDALNDLQPIYGLILLYKWRPPEKDEGPVIKDAIPNLFFANQIINKACATQAIVSVLLNSPGITLSDELKKLKEFAKDLPPELKGLAIVNCASIRMLNNSFARSEASEEQKPPSGDDDVYHFINYVPVDGVLYELDGLKEGPISLGKCPGGVGDAGWWLRLAQPVIKEHIDLFSQNEIRFSVMAILKNRKEMFTVEIKELQRKREGLLQQMGDPNASRHVEQSLAEVAAQIESVTEKIIMEEEKVKKWKAENLRRKHNYVPFLFNFLKILEEKQQLKPLIEKAKAKQKSHGPS

SEQ ID NO: 62884 - protein, 421 aa, Pasteurella multocida subsp. multocida str. Pm70
MDYGKTLTQSLLSNGADKRENKMAFNPSVFKQHFPYLQQADAVVYLDSAATALKPQVLTDATIAFYQSAGSVHRSQYDEKQTALFEQARENVKNFIGAESEETIIWTSGTTHAINCVARGLSHQLHPKAEIIISEADHHANFVTWSEIARQYGATLHILPINEQWLIEEQDLIAVLNTNTVLVALNMVSNVTGTEQPVANLIKLIRQHSHALVLVDAAQAISHLPIDLQRLDADFIAFSAHKLYGPNGLGVLSGKRHALEQLHPLLYGGKMVERVSAQHIRFAELPYRLEAGTPNIAGVIGFNAVLEWLSQWDLTAAEQHAIALAEQCKMRLKNYPHCQLFLSPQPSSIVCFVFNGIATSDIATLLAEQNIALRAGEHCAQPYLARLGQHSTLRLSFAPYNQQADVDAFFSALDNALALLD

SEQ ID NO: 62885 - protein, 322 aa, Zea mays
MPVSCPDVPLLDSPLLKTHSMASATGVSSSEMAVDHATGPGAVDKPRFDALTPNEMSGGRPQFRKVPVPQHRFAPLKRCWMEIYTPVYEHMKIDIRMNLKARRVELKTRQDTPDVSNLQKCADFVHAFMLGFDIADAVALLRLDDLYVDSFEIKDVKTLRGEHLSRAIGRLSGKGGKTKYAIENSTRTRIVIADTKIHILGSFVNIKVARDSLCSLILGSPAGKVYSKLRAVSARLAESFADRVHAFYKVDRLEDARRTYRRMVFLRFEPNNQTYPSLINGYVSSEKYFSVLILWSVDRRGFFGMAMQVTEKAQEFKIFVDK

SEQ ID NO: 62886 - protein, 631 aa, Synechocystis sp. PCC 6803
MEGSFSLTLQIILTVLFGIGAQVLAGFLKLPSIVFLLIFGVILGNSGLHWIQPANFGDGLEVIVSLSVAIILFEGGLNLGLRELGQVSGSLRNLVTIGTLITLVGGGLAAHWLAEFPWYLAFLYGSLVVVTGPTVVGPLIKQVQVQKSVATLLEGEGVLIDPVGAILAVVVLETIFNTNVSVETDIIEIAMGLILRLGVGLAIGVGGGWLLSNFLKRASFLSEDVSNLVVLAGVWGVFGAAQASLSESGLMATVAMGIYLNSSALPDNRLLRRFKGKLTLLCVSVLFILLAAELSLSSFGALGWGSVLTVAVLMLVIRPISIAICTWTSAFNWRQKLFVAWIAPRGIVSASVASLFSLLLTERGINGGDAIKSIVFLTIMMTVFIQGLTAKPLAKLLRITDTHTTGAVIIGCTPLGRLVARLFTAQGESVVLIDSDPEACATAIAEGLTAIQTSALDSHALEKAGIEEMGAFMALTNNGEVNLVLAQNTINEFNPPRVCVIAPDNLPEDNPLLKNKGVRIFMEQKTFKTWNQYLKDGQIKLGKTLFKETGLALQQAHTQALIRSGELLPLMLKRQGSLQLAKTTENAQIGDEVFYLLHDPRPQLLKQLSGSRSPDVLIPEPLAEVEEVPIY

SEQ ID NO: 62887 - protein, 104 aa, Zea mays
MAAASGRAPSACALLLFLLLVVGAAAAAAVVVDAAPAPSPVSFIDCGSACGARCALSSRWNLCPRACGSCCARCNCVPPGTAGNHDVCPCYAAITTRGGRPKCP

SEQ ID NO: 62888 - protein, 246 aa, Triticum aestivum
MMDLHIKPDPQQEAHESAPSTKSFQHSPEATGTELERALHGRHLQFIAIGAAVGTGLFIGTGNALATAGPVSLLIAFIFVGTLLFSVMTALGEMAAYIPVAGAFTTYATRFLDPTFGFAMGWIYWFSWSITFALELTAAGLIIQYWEKDLSIGIWITVFWFLFTAANFMPVRWFGEFEMWFSSIKVITIIGFIIFSICVNAGVGDQGYIGFKYWKDPGAFNEHIVEGDIGRFVGFWSVLITAGFSY

SEQ ID NO: 62889 - protein, 323 aa, Gibberella zeae PH-1
MPHTKVDPAIIEALGLDPANAVMHSHGGSGFASTFKIKGEKDGNPVNYFVKTGVGKEAEVMFRGEHASLNAIADVVPNFCPRSHAHGALFDRPGHHFMATDFLDLGSSAPGGSGKTLASKVAQMHTTPAPMPDGYDKPMFGFPVPTCCGSTEQDNSWRESWANFYADNRLRHIARQGVRNNGADPELEEAVEKVAGKVVPRLIGDDVVKDIKPVVIHGDLWSGNHSKGQIAGQGGCEEVVYDPSAVYGHSEYELGIMSMFGGFSNHFWKEYHEFVPKAEPMDEWPDRVRLYELYHHLNHFAMFGGGYRGGAMSIMRKLINKYA

SEQ ID NO: 62890 - protein, 237 aa, Arabidopsis thaliana
MRDPDIVQNTRSLILLRVLTHEKLIQSHRYFFVGWIHKNLSRFRRKIRRRFLHCDFSGFGFFPRRFLFGFVLEKMACVIYYGPDGELKTWPKEREKVEDIALRYSQLNEALRRKKSVTLYDFLNKKKDKTNLEKKAMITDNDDLKTCLKNVNVLKSPIADHYFNDQISQLIQSLEPHVSKVQERIRFVESQKHKETKLDHQSLASIYSLNQSLNPSQFTLFLYNHGDNTMSQIPVTA

SEQ ID NO: 62891 - protein, 454 aa, Neurospora crassa
MSNLPSEPEFEQAYKELAYTLENSSLFQKHPEYRTALTVASIPERVIQFRVVWEDDNGNVQVNRGYRVQFNSALGPYKGGLRLHPSVNLSILKFLGFEQIFKNALYGLSMGGGKGGADFDPKGKSDAEIRRFCCAFMAELHKHIGADTDVPAGDIGVGGREIGYMFGAYRKAANRFEGVLTGKGLSWGGSLIRPEATGYGLVYYVGHMLEYSGAGSYAGKRVALSGSGNVAQYAALKLIELGATVVSLSDSKGALVATGESGITVEDINAVMAIKEARQSLTSFQHAGHLKWIEGARPWLHVGKVDIALPCATQNEVSKEEAEGLLAAGCKFVAEGSNMGCTLEAIEVFENNRKEKKGEAVWYAPGKAANCGGVAVSGLEMAQNSQRLNWTQAEVDEKLKDIMKNAFFNGLNTAKTYVEAAEGELPSLVAGSNIAGFVKVAQAMHDQGDWWSKN

SEQ ID NO: 62892 - protein, 332 aa, Wolinella succinogenes DSM 1740
MYNPPRLIAQESFKKIKTLNEGEKMKVAQNVQELIGKTPLVRLNFASKESGANVIGKCEFMNPSGSVKDRIALGMINAAIGAGKITPETIVIEPTSGNTGIGLASVCAAKGIKLILTMPSSMSIERRKLLAALGAQIELTPAEKGMKGAVERALELAQETKNSFVPQQFENPANPEYHRVTTAVEIWEDLDGKVDVLVAGVGTGGTITGVGEVLKAKNPNLKIYAVEPIDSPVLSGGKPGPHKIQGIGAGFVPKALNTALYDEVIQVKVSDAYEMSRRLGKEEGILVGISAGANIWASKEIGKKYPGKTVVTILCDTGERYLSTELFDLQPS

SEQ ID NO: 62893 - protein, 415 aa, Panax ginseng
MGSLGAILKHPEDFYPLLKLKFAARHAEKQIPPEPHWAFCYSMLHKVSRSFGLVIQQLGPQLRDAVCIFYLVLRALDTVEDDTSIPTEVKVPILMAFHRHIYDKDWHFSCGTKEYKVLMDEFHHVSNAFLELGSGYQEAIEDITMRMGAGMAKFICKEVETINDYDEYCHYVAGLVGLGLSKLFHASGAEDLATDSLSNSMGLFLQKTNIIRDYLEDINEIPKSRMFWPRQIWSKYVDKLEDLKYEENSAKAVQCLNDMVTDALVHAEDCLKYMSDLRGPAIFRFCAIPQIMAIGTLALCFNNTQVFRGVVKMRRGLTAKVIDQTKTMSDVYGAFFDFSCLLKSKVDNNDPNATKTLSRLEAIQKTCKESGTLSKRKSYIIESESGHNSALIAIIFIILAILYAYLSSNLLLNKQ

SEQ ID NO: 62894 - protein, 220 aa, Zymomonas mobilis subsp. mobilis ZM4
MSKLPLIAPSILSADFAHLGDEVAAIDQAGADWIHIDVMDGHFVPNITIGPMVVKALRPYSQKPFDVHLMIAPVDQYIEAFSEAGADIISFHPEAGAHPHRTIQHIKSLGKKAGLVFNPATPLSWLDYLMDDLDLIMVMSVNPGFGGQKFIKTQLEKIKDIRQRITASGRDIRLEVDGGIDATTAPLAVEAGADVLVAGTASFKGGATCYTDNIRILRKS

SEQ ID NO: 62895 - protein, 319 aa, 'Flavobacterium' lutescens
MSSPAAAPAPAPAPDAQVIAHKFGGTSVASAQRYRHVAELLLQRPEPTQVVVVSAMKGVTDALIELATLAAHGQPRWRDAWQALRQRHHEAATELLGEDSADLLQWLDGRFDKLAGLLEALAVIGGLPEEVLERVQGLGEVFSAQLLGRYFNRLGHPCAVLDARDVLVVAHGELGVSVDWERSAANLAAWRVDNPQSRVVVTGFVARDGQGRITTLGRNGSDYSGAIFAALFEAAELHIWTDVDGVLSADPRVVPEAVTLATLSYDEACELAYFGAKVVHPQTMSPAIARQMPIVIRNTFNPSHPGTRIASSSEPSGPI

SEQ ID NO: 62896 - protein, 417 aa, Rhodopseudomonas palustris CGA009
MGRLVMKFGGTSVANIERIQNVARHVKREVDAGHEVAVVVSAMSGKTNELVAWCTEASPLHDAREYDAVVASGEQVTSGLLAIALQSLGIQARSWQGWQIPILTSDAHASARIVGIDGSEIIKRFSERKEVAVIAGFQGIHAETGRITTLGRGGSDTSAVAIAAALKADRCDIYTDVDGVYTTDPRVVPKARRLDKVSFEEMLELASLGAKVLQVRSVELGMVHNMPIFVRSSFDKPEDIDPHGTPPGTLISSEENSMENHVVTGIAFSKDEAQISVRRIEDKPGVAASIFGPLADANINVDMIVQNVSEDGKTTDLTFTVPASDFARAKQTITSAQDKIGYARFDSETDVAKVSVIGSGMRSHAGVAAQAFAALAARNINIRAITTSEIKFSVLIDAAYTELAVRTLHTLYGLDQV

SEQ ID NO: 62897 - protein, 800 aa, Rhodopseudomonas palustris CGA009
MFDSGHASRANARGPGRRWTMIVFGAFLLALRRAGRQCSQRRLRHMRSTSGGPRVLLRRLRETMAEQVSAQERLDKIVVLIAANMVAEVCSVYVLRIDNTLELYATEGLNREAVHQTVLNAHEGLVGLVASEATPLNLSDAQSHPAFSFRPETGEEIYHSFLGVPILRAGNTLGVLVVQNRAKRTYVEEEVEALQTTAMVLAEMIASGELSALAQPGAEPAARHSIHKTGAVLSDGIALGHVVLHEPRVVITNYIAEDLPKEIKRLDAALAKLRSDLDRMLERGDFAEGGEHRDVLEAYRMFANDHGWSHKLHEAVATGLTAEAAVERVQSDTRARMLRSTDPYLRDRLHDLEDLGHRLMRQLVGQDHAPSREQLPDNAILIARSMGPAALLDYDRKRLRGLVLEEGTANSHVSIVARALGIAAIGEVPNAPGIADPGDAIIVDATSGSIYVRPSAEIEAAYAERVRFRARRQAQYSALRDLPCATKDGQPIDLMINAGLTIDLPHIEDTGSSGIGLFRTELQFMVGQSLPRSSDQLALYRAVLDAAGSKPVTFRTLDIGGDKALPYMETVVEENPALGWRAIRLGLDRPGLLRSQIRALLRAAAGRYLRVMFPMISEVAEFDAAKSIIERELTYLRQHGHTLPERVDVGTMLEVPALLYQLDELFKRADFVSVGSNDLFQFLFAVDRGNSKVSERFDTLSAPILRALRDIVRKARAAKRSLSLCGEMASQPLAALALIAIGYRSLSVSALAHGPVKAMILGLDLAKAEAMIGPLLDAPAGSVSIRDKLIEFAEAHQLAL

SEQ ID NO: 62898 - protein, 359 aa, Hortaea werneckii
MAEFVRAQIFGTTFEITSRYTDLQPVGMGAFGLVCSAKDQLTSQAVAVKKIMKPFSTPVLSKRTYRELKLLKHLRHENIICLSDIFISPLEDMYVVTELLGTDLHRLLTSRPLEKQFIQYFLYQILRGLKYVHSAGVVHRDLKPSNILINENCDLKICDFGLARIQDPQMTGYVSTRYYRAPEIMLTWQKYDVEVDIWSAGCIFAEMLEGKPLFPGKDHVNQFSIITELLGTPPDDVIATICSENTLRFVQSLPKRERQPLKNKFKNADPQAIELLERMLVFDPRKRVKAGEALADPYLAPYHDPTDEPEAQEKFDWSFNDADLPVDTWKIMMYSEILDFHNVDANAEQAAHNNDTVAG

SEQ ID NO: 62899 - protein, 258 aa, Staphylococcus epidermidis RP62A
MKHQFSRNELAIGQEGLNLLKNKTVAVLGVGGVGSFAAEALARTNIGHIILIDKDDVDITNVNRQIHALTSTIGQSKVTLMEERIKLINPDCKVTSLHMFYTEETYKDIFNNYDIDYFIDASDTIIYKVHLMKECLERGIELISSMGAANKTDPTRFEIADISKTHTDPMAKVIRNRLKRLGIRKGVKVVFSDESPIVIREDVKETVGDKNAINRKGQMPPSSNAFVPSVVGLICASYVVNDILKDIPVRRIKDKGQN

SEQ ID NO: 62900 - protein, 314 aa, Gibberella zeae PH-1
MLFYGPPGTGKTSTVLALAKELYGPDMIKSRVLELNASDERGISIVREKVKNFARMQLTNPPPGYKDKYPCPPFKIIILDEADSMTQDAQSALRRTMETYSKITRFCLICNYVTRIIDPLASRCSKFRFKSLDQSNAKKRLEEIAEKEGVPLEDGAVDALIKCSEGDLRKAITYLQSAARLVGASASDKDGEGDEAMDVDKKAVTVKIVEDIAGVIPDSTIGDLVSAIRPKSSGSSYQAISDVVEKLVADGWSAGQVVGQLYQALTYDEIIPDAQKNKIVMVFSEVDKRLVDGADEHLSVLDLSVRISAILAKK

SEQ ID NO: 62901 - protein, 370 aa, Vibrio sp. Ex25
RFFLTLNKLSPIITCRCLLDSVILLPVIFNQKLSCGATIMTIKVGINGFGRIGRFVFRAAQERADIEVVGINDLIDVDYMAYMLKYDSTHGRFNGTVEVEGGNLIVNGKTVRVTAERNPADLKWDEIGVDVVAEATGLFLTDETARKHIEAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDAVVSQDFIGEVQTSVFDAKAGIALTDNFVKVVSWYDNEIGYSNKVLDLIAHISK

SEQ ID NO: 62902 - protein, 593 aa, Zea mays
MAFWWPLLVLAAAYALCRLLLFLIPPTVPSIDVDASDVLVKEDSFIYIPRRGKSTQTDKVQCYEPATMKYLGYFPVVTPDEVKEHVAQSRKAQRIWAKSNFKQRRQFLRILLKYILEHQDLICEVSSRDTGKTMVDASLGEIMTTCEKITWLLDEGEKWLKPEYRSTGRSMLHKRAKVEFYPLGVIGAIVSWNYPFHNVFNPVLAAVFSGNAAVIKVSEHATWSGCFYFRIIQAALSAVGAPENLVHIITGFAETGQALVSSVDKIIFVGSPGVGKMIMKRASETLIPVTLELGGKDSFIVCEDVDLPSVVQVATRAALQSSGQNCAGAERFYVHDDIYSAFVSQIVKTVKSISVGPPLSGRYDMGAICMIEHSEKLQNLVNDALDKGAEIAVRGSFGNLGEDAVDQFFPPTVLVNVDHTMKIMQEETFGPIIPIMKFSSDEEAIKLANDSKYGLGCAVFSGNQKRAIRIASQLHCGVAAINDFASSYMCQSLPFGGVKDSGFGRFAGVEGLRACCLVKSVVEDRLWPYIRTVIPKPIQYPVSEHGFEFQQLLVETLYGYSVWDRLRSLVNLIKMVTEQNSAPASNATTKKRR

SEQ ID NO: 62903 - protein, 376 aa, Oceanobacter sp. RED65
MSKPAILALEDGSIFKGTAIGADGHSVGEVVFNTSMTGYQEILTDPSYCRQIVTLTYPHIGNYGTTSEDAECDQIWASGLVIRDLPLVASNFRSEQALDEYLRQRNVVAIADIDTRRLTRILREKGSLNGCVMAGDDVDTDKALELAKGFAGLKGMDLAKEVTTDKTYTWNETSWQLGVGHEKKEGGQFKVVAYDYGVKRNILRMLVDRDCELTVVPAQTPAKDVLAMNPDGIFLSNGPGDPEPCDYAIAAIKEILETDIPVFGICLGHQLLALASGAKTEKMGHGHHGGNHPVQNLEDKTVMITAQNHGFAVSETGIPDNLTVTHKSLFDGTTQGIHRTDKPAFSFQGHPEASPGPHDAAPLFDHFIELMQARKA

SEQ ID NO: 62904 - protein, 294 aa, Triticum aestivum
MEQYEKVEKIGEGTYGVVYKARDRTTNETIALKKIRLEQEDEGVPSTAIREISLLKEMQHGNIVKLHDVVHSEKRIWLVFEYLDLDLKKFMDSCPEFAKSPALIKSYLYQILRGVAYCHSHRVLHRDLKPQNLLIDRRTNALKLADFGLARAFGIPVRTFTHEVVTLWYRAPEILLGARQYSTPVDVWSVGCIFAEMVNQKPLFPGDSEIDELFKIFRVLGTPNEQTWPGVSSLPDYKSAFPRWQAEDLATVVPNLEPVGLDLLSKMLRFEPNKRITARQALEHEYFKDMEMVQ

SEQ ID NO: 62905 - protein, 661 aa, Bradyrhizobium japonicum USDA 110
MQTHRAPERPSGADKLEIAVNAYSKTPLLDTIRTPDDLRKLKIEQVRQVADELRQETIDAVSVTGGHFGAGLGVVELTTAIHYVFDTPRDRLIWDVGHQAYPHKILTGRRDRIRTLRTGGGLSGFTKRSESDYDPFGAAHSSTSISAGLGMAVARDLSGGKNNVIAVIGDGAMSAGMAYEAMNNAGAMNSRLIVILNDNDMSIAPPVGAMSAYLSRLYSGKTYRTLREAAKQINKRLPKIIANRANRVEEYSRGFMMDGGTLFEELGFYYVGPIDGHNLDHLLPVLKNVRDMEEGPILVHVVTQKGKGYGPAEASADKYHAVVKFDVATGTQAKAKPNAPAYQNVFGQSLVKEAQKDEKIVAITAAMPSGTGVDIFNKAFPDRTFDVGIAEQHAVTFAAGLASEGYKPFCAIYSTFLQRGYDQIVHDVAIQNLPVRFAIDRAGLVGADGATHAGSFDNAYLGCLPNMVIMAAADEAELVHMVATQVAIDDRPSSLRYPRGEGRGIEMPEVGIPLEIGKGRMIRQGSKIALLSFGTRLAECEKAADELAAHGLSTTIADARFMKPLDTELVLKLARDHEILITIEEGSVGGFGSHVAQFLTDQGALDSGMVKFRTMVLPDVFQDHDTPAAMYARAGLDAKGIVAKVFEALGKDVKTETVKLA

SEQ ID NO: 62906 - protein, 1233 aa, Methanosarcina acetivorans C2A
MEEPEFQAYVGPRPFEQEDKFIFFGRDREARDLLSLVIAHNLVLVYAQSGAGKTSLINAGLIPLLKENRFEVFPVARVKGTPLRNIKTDEISNIYVLNTLTSWAEDEYDVERLTKMKLVDFLNEQERLQDEDGIPLPRAVIFDQFEEIFSLYQDRWKDREGFFEQISAALETDPLLRVVFVIREDFIAQLDPYVELLPERLRTRFHIERLRREAALLAIKEPLRDTGRSFAEGVAEKLVDDLLKIRVETTPGETTEVTGEFIEAVQLQVVCQNLWRELPPDVKQITFHHLKTYGNVEQELYRFYEEAIRTAAATAHIDEESLRRLFGEVLITTMGTRGMVYRAQESTGGIPNTAIDVLESMHLIRAEWRAGARWYELTHDGFIKPILSSNRVFNDELAEKERAEKERIEKERIEKEWAEKEWAEKERLEKERAEKERLEKELRAEKELAESKQLFYKRLAAISFLAILLALVAVFEWHQAKENAEEARASDLNLNSALLQGDPRNLDKSVLLAIESLKIHITSTADHLIRQGLLSMPHRVVILKHYSDVNNVVFSPDGKYVATASNDNTSRLWDVSTGKQIFVLNHTDPVRNVVFSPDGKYVATASADKTAGVWNTTTGEGISVLNHTGRVNNVVFSPDGKYIATASDDNTSRLWDTATGKQIFVLNQTDPVRNVVFSPDGKYIATASADNTSRLWDTTTGKQIFDMKHDGPVNIVVFSPDGKYVATASADKKARLWNATTGKKIFDMKHDSGINTVVFSPDGKYIVTASDDKTAGVWNTTTGKKIFDMKHDGSVNTVVFSPDGKYIATASADNTSRLWDTATGEKIFFLNHYGWVNTVVFSPDGKYVATASADKTAHLWDVSTGKQISYLRHDSGVNNVVFGPDGKYVVTASADKTADVWNTTTGEKIFVLNHTGRVNNAVFSPDGKYIATASADNTSRLWDTTTGKQIFVLNQTDPVRNVVFSPDRKYIATASDDNTSRLWDTATGKQILVLNHDGPVNTVVFSSDGKYIATASDDNTSRLWDTATGEEIFVLNHTDRVNNVVFSPDGKYIATAGDDNTSRLWGTATGEKIFDMKHDGPVNNVVFSPDGKYVATAGYDNTACLWDTATGEKIFVLNHAGRVNTVVFSPDGKYIATASADKARLWNATTGKQISYLRHDSGVNNVVFSPDGKYIATASVDKTARLWTAKLWISDTEDLIDEANNRLTRNLKPEEWKEYMGDKPYHKRFPNLP

SEQ ID NO: 62907 - protein, 560 aa, Kalidium foliatum
MWSQLSSLFYSKMDMLSTSDHASVVSMNLFVALLCGCIVIGHLLEENRWMNESITALLIGLSTGVVILLISGGKSSHLLVFSEDLFFIYLLPPIIFNAGFQVKKKQFFRNFITIIMFGALGTLVSFSIISLGAMTTFKRMDIGSLELGDYLAIGAIFAATDSVCTLQVLNQDETPLLYSLVFGEGVVNDATSVVLFNAIQNFDLTHIDHRIALQFSGNFLYLFFASTLLGAMTGLLSAYVIKKLYFGRHSTDREVALMMLMAYLSYMLAELFYLSGILTVFFCGIVMSHYTWHNVTESSRVTTKHAFATLSFVAEIFLFLYVGMDALDIEKWRFVSDSPGTSVAVSSILLGLLMVGRAAFVFPLSFLMNFSKKTHSEKVTFNQQIVIWWAGLMRGAVSMALAYNQFTRSGHTQLRGNAIMITSTISVVPFSTMVFGLLTKPLILFLLPHPKHFTSASTVSDLGSPKSFSMPLLEGVQDSEVDVDNQDEGTNNHVEGTNNRTIARPGSLRMLLNAPTHTVHYYWRKFDDSFMRPVLGGRGFVPYVPGSPIEQTTNNLLDRT

SEQ ID NO: 62908 - protein, 252 aa, Oceanobacter sp. RED65
MAKYEDLEGKIVLITGGSGDLGRASVLEFGKQKCRVYFTYNSSKDSADELVASAEESGFEAFPIRCNISDKEQVNALVNDIVEKEGKIDVLVNNAGIYKDNLFTSMTDEEFEQVIQTNLYGTFYCTKSVVDVMYRNRCGAIVNVSSIAGVTNSFGQANYSAAKGAVVSFSRTLAAELAPKNIRVNTVAPGLIDSSMVKRIPRNIMKQTLSGIPVKRLGKPEEIAKAIAFLASEDSSYVVGQTLIADGGLIMR

SEQ ID NO: 62909 - protein, 501 aa, Arabidopsis thaliana
MAILQSFLLLLSLPFLFTLIYTKKMKESKRNLPPGPAKLPIVGNLHQLQGMVHRCLHELSKKHGPVMHLQLGFVPLVLISSSEAAEEALKTHDIECCTRPNTNAARVFSRNNKNIGLGAYSDEWRELRKVAVREYFSVKKVQSFRYVREEENHLMVKKLRDLALKQSPVDLSKTLFCLAASTVFRPVFGQSFSDNKHFSEEKIEELVFEAQKSLTFKFSDLFPIPGLGWFIGFVSGQHKGLHKVFIEVDNFLNHMIDDHQKQNQPQDRSDIVGSLLDMIHNQEQDKSFKLTIDHLKGITQDIFLAGIDTSAITMIWAMAELVNNPRVMKKVQDEIRSCIGIKKERIEEEDVGKLQYLKLVIKETLRLHPAAPLLLPRETMADIKIQGYDIPRKTLLLVSAWSLGRDPKYWKNPEEFNPERFIDCPVDYKGHSFEFLPFGSGRRFCPGMASAIATIELTLLNLLYFFDWKLPEEMKDMNMEESGDVTIVKKVPLELLPVLYH

SEQ ID NO: 62910 - protein, 445 aa, Gibberella zeae PH-1
MFKLGRSRAVASALNASKFVAPAARFPGVQQRRALSIHEYLSADLLRQYGIGVPQGSVAKSAKEAKEIAEKIGNDDMVIKAQVLAGGRGKGTFDNGLKGGVRVIYSPHEAEMFAEQMIGHKLVTKQTGAGGRLCNSVYICERKFARREFYLAILMDRQNQCPVIVSSSQGGMDIEAVAKDTPDAINTNYIDINVGVTDETAREIATKLGFSEQCIEDAKDTIQKLYKIFREKDSTQIEINPLSETSDHQVLCMDAKFGFDDNADFRQKEVFEWRDTTQEDPDEVRAAESNLNFIKLDGDIGCLVNGAGLAMATMDIIKLNGGQPANFLDVGGGATPAAIKEAFELITSDPKVTAIFVNIFGGIVRCDAIATGLIKTVESLNLKIPIIARLQGTNVEKAHQLINDSGLKIFSIDDLQTAAEKSVQLSKVVKMARDIDVGVEFTLGI

SEQ ID NO: 62911 - protein, 264 aa, Frankia sp. EAN1pec
MSTPMTGLLDLTGRVAIVTGGGTGIGAATARLLAAHGADVAVAARTVDELERTAADIRAATGRRCLAVPTDVKDEEQVIRLVRRTVEELGRIDVLVNNAGGTRMGPLSSLPTRAWDASFDLNVRAAYFCTREAGRHLVAQRSGAIVNISSDAGLHGVRGGAHYASAKAALQMFTTVTAAEWGRYGVRANCLAVGPVASERAVEAWRVAGIDTSEFNTATPLGRPGTPAEVANAVLFFASDAASYITGQTLAVDGGPSLGGIRDT

SEQ ID NO: 62912 - protein, 601 aa, Pseudomonas putida KT2440
MSEQQILLSVGGIGAAALACQWLAWRLKLPAILFLLLAGILAGPALGWLDPEALFGPLLMPLVSLSVALILFEGSLTLHLSQWREIGSVVHRLVTVGALVTWLVIALATHWLLGFDWPLAILFGTLTLVTGPTVIVPMLRVVRPKAAIANILRWEGIMIDPIGALLAVVVYSFIIASAEGNGLSQSLITFAGVLFCGTTLGAAGGWLLGQIMREQWLPEYLHNLASLAAVLGIFIAANQIMHESGLLAVTVMGMWLANMRGVDVRQILHFKENLSVLLISGLFILLAARLDLHALLGLGPAVLALLLVIQLLARPLNVWLATLGSTLNWRERALLAWIAPRGIVAAAVSAIFAIRLHQAGHQDALLLVPLTFAVIIGTVVLQSATARPLARLLKVAEPAPSGFLVVGANEPARAIAKALQHLGCRVLLTDSSWENIRAARMDGLTTYFGNPASQHADAHLDLVGLGHLLGLSPAGEINALACARFRHDFGHSRLFVLASGLEKQRSDKHRAAEEHRGHLLGAKPMTYLQLANRLHQGAELYSTNLTEGFGWDAYQALHGERAHLLFARDGQGWVHVASPDNPLQPQPGWTLVALIEPAPEP

SEQ ID NO: 62913 - protein, 472 aa, Pasteurella multocida subsp. multocida str. Pm70
MNKEIKTQVVVLGAGPAGYSAAFRCADLGLETVIVERYSTLGGVCLNVGCIPSKALLHVAKVIEEAKALAEHGIVFGEPSTDVNKIRGWKEKVINQLTGGLAGMAKQRKVQVVNGYGKFSGPNTIIVAGEEGETTIKFDHAIIAAGSRPIQLPFIPHEDPRIWDSTDALKLKEVPENLLIMGGGIIGLEMGTVYHALGSKIDVVEMFDQVIPAADKDMVQIYTKRVAKKFNLLLETKVTAVEAKEDGIYVSMEGKASETRRYDAVLVAIGRVPNGKLIDAGVAGVEVDDRGFIRTDKQMRTNVPHIFAIGDIVGQPMLAHKGVHEGHVAAEVIAGMKHYFDPKVIPSIAYTEPEVAWVGKTEKECKAEGIAYEVAKFPWAASGRAIASDCADGMTKLIFDKNTHRVIGGAIVGTNGGELLGEIGLAIEMGCDAEDLALTIHAHPTLHESVGLAAEVFEGSITDLPNPKAKKK

SEQ ID NO: 62914 - protein, 632 aa, Pasteurella multocida subsp. multocida str. Pm70
MSKQIQVPDIGGDEVTVTEVMVKAGDTVAVDQSVINVEGDKASMEVPSPEAGVIKEVLVKVGDKVSTGSPMFVLETGDAKPAETPKAETAPVSAPAPAASAVVEVHVPDIGGDEVNVTEIMVKVGDKVEVEQSIINVEGDKASMEVPAPIAGVVKEILINVGDKVSTGSLIMKFETGDAPAVATPAQAPTAAPSAPAQSAVKDVNVPDIGGDEVNVTEIMVNVGDTITEEQSLITVEGDKASMEVPAPFAGVVKEILVKSGDKVSTGSLIMRFEVAGAAPSAAPAQPAPAAQAAAPQAATPAPVASAPAGDAEVTGSSVFAYATPVVRRLAREFGVNLDKVKGTGRKGRILKEDVQAYVKAAIKAVESGSVSAAPAGSGVANGAGLGLLPWPKVDFSKFGEVEEVELTRINKISGANLHRNWVMIPHVTHFDRADITDLEAFRKEQNVLAEKQKWGVKITPVVFIMKAAAKALEAYPRFNSSISEDGQRLTLKKYVNIGVAVDTPNGLVVPVFKDVNKKGIIELSRELMEVSKKARDGKLTASDMQGGCFTISSLGGLGTTHFAPIVNAPEVAILGVSKSEMAPVWNGKEFTPRLMLPLSLSFDHRVIDGADGARFISYINGVLSDLRRLVM

SEQ ID NO: 62915 - protein, 613 aa, Physcomitrella patens subsp. patens
MNPAIVTKFLEKHFSIQLTRQSSKKKCLSVLDETLDLIFSYLDPEDRASASLVCKHWHRVDGETREQVSVSNCYSVSPSALSKRFPNIEKFKIKGKPRAVEFNLLVDDWGGYASAWVEEIVRAYPRLHTLHFRRMDVSDDDLKILAQGCGSALQVLKLDKCSGFSTLGLQHIARSCRSLKTLYLEESDIEDEGHEWLLDLGRNVPGLERLNLASTGIEEGDVNDVLVVLMQNCKSLNSLKVGEMTLENFKEIMKYSTTPLLELGNGCYSMRNGVREELTFDAAFIPWVSRLKVLDLKFMNLNAAGHCQLLACCPLLEELEARIEILDEGLEVVGKTCKYLKRIRIDDQDSPGFITHRGLTAIAKGCRELEFLVMYMRDVTNSSLEAVGRYSENLNDFRIVLLKTLAHPEDLPLDKGVCSLLQGCPKLTRFSVYLRPGGLSDIGLSYIGKYGGRLKWILLGCSGESDQGLLDLAYGCQNLRRLELRGCPFSDAALAQGMMNMAKMKYLWVQGIGATEMLGRYLVGSHPCLHVEWMPSEQQLLAYYSLASHRTDTPPTVEILSQSRFDYDSEIFGDYDEECVGNLESGVFDGEYGEGPDVGDFDGEYGHGTNWDF

SEQ ID NO: 62916 - protein, 238 aa, Triticum aestivum
  misc_feature (46)..(46): Xaa can be any naturally occurring amino acid
TPQRNLKIADFGVARVEAQNPKDMTGATGTLGYMAPEVLDGKPYNXRKCDVYSFGICLWEIYCCDMPYPDLSFADVSSAVVHQNLRPDIPRCCPSAFANVMRKCWDANPDKRPDMDEVVQLLEALDTSKGGGMIPDGQSSGCLCFTKAPWSIDTFHGYPFPWATLSPVVKWTGATACSPLARPVPPLTVLQYCLAIMACQTCYPSIHFCRPPATFQYTSVLRYGVPKRIWTRYPLKKK

SEQ ID NO: 62917 - protein, 743 aa, Oryza sativa Indica Group
MARPRFEEDDEDEFFDSREVMSPASVSSPASSGRYDGPMLEVWATDPCSVHERRQRFIKSLGLSDSSPSAGGGGDRPDEEPCSRSSAAEEILPCSPTVELVSAVPSFACRGEEPGASGGGGGAEVLDCVFKNLDDGTVFVVDEMGKDGSFRSLRDRRSNRTVTAAEFERTYGSSPFICELMRRVDDSDESSAVEKALVRGRRRRRRFGWLRRLGIRGCVVDVEEDDETNSTSSSSCRSCSGKVDRVKVRHYKKRSKELSAVYRGQDIKAHEGAIVTMKFSSDGQYLATGGEDGVVRVWRVVEGERPNELDFAEDDPSCVFFTVNENSELAPVNSSEGSKSKHYKNSKVSTDPACVVIPHRTFALSQEPVHEFYGHDDAILDLSWSKNRDLLSSSMDKTVRLWQVGCNSCLKVFSHTNYVTCVQFHPTSDNYFISGCIDGLVRIWDVRRCQVVDWADTKEIITAVCYRPDGKAAVVGTITGNCRHYDASENHLELESQVALNGRKKSPLKRIIGFQYCPSDPKKLMVTSGDSQVRILDGLHVISNYKGLRSSSQVAASFTPDGDHIISASDDSSIYMWNYANQIAPVTNHVKTVWSNEHFSCHDVAIAIPWNASQTRNSISLACSITSSRQEVLDEFHNEHDSSSCSHTEDSPDGDSLYQLPSGNFTLSSAFFAESAPRGSATWPEEQLPSNSTTQSTLRKSQYKFLKASCQNAATHAWGQVIVAAGWDGYIRSFQNYGLPVQV

SEQ ID NO: 62918 - protein, 118 aa, Triticum aestivum
  misc_feature (7)..(7): Xaa can be any naturally occurring amino acid
  misc_feature (10)..(10): Xaa can be any naturally occurring amino acid
  misc_feature (16)..(16): Xaa can be any naturally occurring amino acid
  misc_feature (38)..(39): Xaa can be any naturally occurring amino acid
  misc_feature (44)..(44): Xaa can be any naturally occurring amino acid
  misc_feature (52)..(52): Xaa can be any naturally occurring amino acid
  misc_feature (62)..(62): Xaa can be any naturally occurring amino acid
  misc_feature (79)..(80): Xaa can be any naturally occurring amino acid
  misc_feature (83)..(83): Xaa can be any naturally occurring amino acid
  misc_feature (90)..(90): Xaa can be any naturally occurring amino acid
  misc_feature (98)..(98): Xaa can be any naturally occurring amino acid
  misc_feature (105)..(107): Xaa can be any naturally occurring amino acid
  misc_feature (110)..(110): Xaa can be any naturally occurring amino acid
  misc_feature (114)..(114): Xaa can be any naturally occurring amino acid
MAPAVTXSSXTTVAPXQGLKSTAGLPVSRRTSASLGSXXNGGRXRCMQVWPXEGIKKYETLXYLPPLATEALLKQVDYXXRSXWVPCLEXARWLRFRXHNSPPGXXXGRXWTMXKHGA

SEQ ID NO: 62919 - protein, 189 aa, Wolinella succinogenes DSM 1740
MTALKASQKAKLPTRHGIFTIQAFAHEGKEHLAIFSDPLPPVPLLRVHSECLTGDVFGSLKCDCGSELSIAMERIAKEGGIALYLRQEGRGIGLFHKVNAYALQDQGYDTVEANLALGFKEDERNYEVVGEILSFYGIDEVKLLTNNPKKVEAMSHFVKIHSREAILAPHNCYNENYLKTKQEKLGHLL

SEQ ID NO: 62920 - protein, 567 aa, Prochlorococcus marinus str. AS9601
MSTKSDSLKGKLTENFSEFSQLSDYSFMNSLKADPQSTKDGNDHKPRSVYSGHYVPVVPTAIPEPEYISHSNKLFKELRLSSNLTKDQNFCRFFSGDISVANYPMSPVGWATGYALSIYGTEYTQQCPFGTGNGYGDGRAISVFEGLFNGKRMEMQLKGGGPTPYCRGADGRAVLRSSVREFLAQELMDALGIPTSRSLTLFVSRSEIVRRPWYSKGSRYFEPDIMIDNQAAITTRVAPSFLRVGQIELFARRVRDNAHDEALNELKMIVQHLIDRNYKDEIEYEISIQSKVIKLASLYRSRLISLIANWMRVGYCQGNFNSDNCAAGGYTLDYGPFGFCELFDPRFQPWTGGGEHFSFFNQPSAAAINFKTFCSSLSPLLSKSKQDQEKLDQIEKDFSELMNKELMKMWANKLGLEHYNETLINEFFNLMVISKADYTILFRKLSEIPDNLDSLKDCFYLPINDELNNRWEVWLENWQSVLKKEENIKAKSASMKSLNPVYTWREWMVVPAYEEAEKGNYKKIKELQDIFSNPYVEQPAEIDQKYNRLKPSQYFNYGGVSHYSCSS

SEQ ID NO: 62921 - protein, 397 aa, Chlamydophila pneumoniae CWL029
MRRNPHFSLLKPQYLFSEISKKLAQFRKENPEISVIDLSIGDTTQPLCRSITQAIKEFCVSQEKQETYRGYGPETGLEKLRTKIASEVYENRISPEEIFISDGAKPDIFRLFSFFGSEKTLGLQDPVYPAYRDIAHITGIRDIIPLACRKETGFIPELPNQQSLDILCLCYPNNPTGTVLTFQQLQALVNYANQHGTVLIFDAAYSAFVSDPSLPKSIFEIPEAKYCAIEINSFSKSLGFTGMRLAWNVIPKELTYDNNEPMINDWKRLFATTFNGASLLMQEAGYYGLDLFPTPPAISLYLTNAQKLKKSLETAGFSVHGGDHAPYLWVELPEGISDEEAFDFFLHQYHIAVTPGHGFGSCGQGFVRFSALTQPQNIALACDRLCTASLKETMVLA

SEQ ID NO: 62922 - protein, 343 aa, Alkaliphilus metalliredigens QYMF
MTHSSITVLGAGSWGTALSLILAKKGHEVKLWMRNQEQYEEMNRQRENTKYLPGTQLHENIKLYVDIEKAVKGTDVVLLTISSQAVRGVLKNIRSIITREQIIVNAAKGLEANTLLRISQVVEEELGSHPFAVLSGPSHAEEVSKDIPTTVVVAAYERSVAECIQDLFMSSYFRVYTNPDVIGVELGGALKNVIAFGAGISDGLGYGDNAKAALMTRGIREIARLGSAMGGKLETFAGLTGIGDLIVTCTSMHSRNRRAGILTGQGKSLEETLSEIGMVVEGIKTTKAAFELAKQYQIEMPITEEIYSILYKDIPPRVAVSNLMSRDRTHEIEDIVDAEKINW

SEQ ID NO: 62923 - protein, 623 aa, Rhodopseudomonas palustris CGA009
MSDSGLSATPPAAPEQPVSASAPAGAYRVLARKYRPNSFDDLIGQEAVVRTVSNAFDTGRIPQAWILTGVRGVGKTTTARILARALNYELPDGSVKGPTIHMPVHGVHCKAIMESRHMDVLEMDAASHTGVDDVRQINDSVRYAPASARYKVYIIDEVHMLSTAAFNAFLKTLEEPPEHAKFVFATTEIRKVPVTVLSRCQRFDLRRVEADVLMNHLSNIAQKEGVEVEPEALGIVARAAEGSVRDSLSLFDQAIAHAAGVVRADAVRQMLGLADRTRVIELFDALARGDIAAAFAEFRDQYDTGADPVVVLSDLAEFVNFVTRVKIVPAIADNVAFGETERVRGREFAAKLSMRVLSRMWQMLLKGIAEVQGATRPAAAAEMVLVRIAYAADLPTPDEALRMLEQSGGGDAPALSGGGGSSSRGGASASLAPAPALSAPSAMMPRSAPTMSAGPAPTMLRGGPDGAARSPVSAPAPAPEPPALKITTFPQLVALASEKRDVMTRLALEADVRLVRIEDGRLELALEPSASRSLINDLGRKLEQWTGRRWTVIVSNAPGEPTLRQQSMAQQNERERAAENDPRVQEVLARFPGAKLTVRRLAPEPVEIESDMDDPSERIDDDD

SEQ ID NO: 62924 - protein, 355 aa, Cryphonectria parasitica
MGACMSSSSEETEQKKRSQKIDKDLEEDSKRLRRECKILLLGSGESGKSTIVKQMKIIHLKGYSDEELYNYRPTVFKNLIECAKAVVNAMRQFDIEPEKEETKTLCDFLLEYSVDSGPQVLIDTRVGEAIQAIWNDPARKQLMDRQTEFYLMDSAEYFFEQAQRIVRQDYLPNEMDVLRARTKTTGIYETRFQMGQLSIHMFDVGGQRSERKKWIHCFENVTSIIFCVALSEYDQVLLEESSQNRMMESLLLFDSVVNSRWFVRTSIILFLNKVDIFKQKLGRSPLSNYFPDYSGGNDVNKAAKYLLWRFNQVNRAHLNLYPHLTQATDTSNIRLVFAAVKETILNNALKDSGIL

SEQ ID NO: 62925 - protein, 260 aa, Arabidopsis thaliana
MDANTKTILFFVVFFIDLFSPNILFVYAREIGNKPLFTYKQKTEKGPAEWGKLDPQWKVCSTGKIQSPIDLTDERVSLIHDQALSKHYKPASAVIQSRGHDVMVSWKGDGGKITIHQTDYKLVQCHWHSPSEHTINGTSYDLELHMVHTSASGKTTVVGVLYKLGEPDEFLTKILNGIKGVGKKEIDLGIVDPRDIRFETNNFYRYIGSLTIPPCTEGVIWTVQKRVLYFFCFCYRLIIFVTPYINIFWIFVFVFWCMLM

SEQ ID NO: 62926 - protein, 509 aa, Burkholderia pseudomallei K96243
MNATPSSRKGHHVPTVKLLIAGEFVESHATEWRDIVNPATQELLARVPFSTVAEVGAAVEAAHAAFAKWKSTPISARMRIMLKFQDLVRANLPQIAKTLTAEQGKTLPDAEGDVFRGLEVVEHACSVGTLQLGEFAENVAGGVDTYTLRQPLGVCVGITPFNFPAMIPLWMFPMAIVCGNTFVLKPSEQDPLSTMQLVELAIEAGVPKGVLNVVHGGKEVVDALCSHPLVKAISFVGSTAVGTHVYRLGSEHGKRVQSMMGAKNHAVILPDANREQTVNALVGAAFGAAGQRCMATSVAVLVGAARDWLPDIVAKAKTLKVNAGAEAGTDVGPLVSRAAKQRVLGLIETGEQEGARLVLDGRGVSVPGYEHGNFVGPTIFADVRPEMSVYTHEIFGPVLCVMSVDTLDEAIALVNANPFGNGVGLFTQSGAAARKFQSEIDIGQVGINIPIPVPVPFFSFTGSRGSKLGDLGPYGKQVVQFYTQTKTVTARWFDDDATAGAVNTTIRLH

SEQ ID NO: 62927 - protein, 491 aa, Magnaporthe grisea 70-15
MTVAQEEAPKVVTVAESSETTKSSCSEDAVAPPPTQRPAGKFDVLIQGVALFSDGYNIQIIGYMNTVLAKLYPKEMTSEVKTRLSNSILIGDVFGMLLFGLCIDKFGRRVGIVLTTLFLVFGIILATASHGNTVEGMFWMMVVGRGVAGVGAGGEYTVCTSQALECADSTPEMRKRRGMLVAVSTNAAIISGFVGSSIVSLIVIAAYGSQASDGIWRICFGIGIFLPLTIFFFRMRLADSEQYQKHAIQHKVPYWLAIKFYWRALLGCCSAWFLYDFVVYPFNLLAPTLVAGFSSNQSMIESIGWSALINFFALPGSFIGALLMDRIGRRQTYALGWAIVCVFGFIIGGSMVQLQNIFPLFVVLYALFQTFLSVGPGDCNFLVSSESFPTPLRGHFLGFAAAVGKAGAAIGTTVLSQALASFDDKVKGQQAIFLIGSGISVVGTLCVWFLIPNAPKNLEDEDVRFRNYLQQNGYDTSDMGLQAKKVEGAES

SEQ ID NO: 62928 - protein, 251 aa, Pseudomonas syringae pv. syringae B728a
MRRPMVAGNWKMHGTRASVAELIEGLCKQSLPGSVDIAVMPASLFTCQVVDGLKATSIIVGAQDAAIQAEQGALTGEVASSQLADAGCKLVLVGHSERRQLIGEQDDVLNKKFAAIQAKGLTPVLCVGETLEERKAGQTLEVVGRQLDSVIAEFGVNALVNAVIAYEPVWAIGTGLTASPQEAQEVHAAIRAQLAKENAEVAQGVRLLYGGSVKAANAVELFSMPDIDGGLIGGASLNADEFGAICRAAGN

SEQ ID NO: 62929 - protein, 383 aa, Yarrowia lipolytica CLIB122
MSSGGYNTLKKITDVAVFLGATVSIYYLMKRVLADMQQGSNSADNKKKTSASLRKLQARYPGMELDLDEYERILVQSVVTPSEIKVGFKDVGGLDDIIEDLRESVLYPLTMPELFGGNRTATMDDDDQDDNDDKPASKSSFSDLLKPPKGVLLYGPPGCGKTMLAKALAAESEANFINIKMSNIMDKWFGESNKLVAAIFSLANKLQPCIIFIDEIDSFLRERQSTDHEVMSMLKAEFMTLWDGLTSDGRVLVLGATNRPNDIDNAILRRMPKRFSVKQPTSDTRRKILEIILADVELDDTEFDMDVLINYTAGMSGSDMKEICRNAAMNAVREYMRSNIEDGKLKKERDQMQVRPLKTSDFMSASVAAALLPNNRVPEVSVD

SEQ ID NO: 62930 - protein, 446 aa, Colwellia psychrerythraea 34H
MHNKHTMMSPSEQNSLLRFDKENVWHPYTSMSEPLPSYLVDSAEGVTINLASGERLIDGMSSWWSVLHGYNHPKLNAALVEQASKMSHVMFGGLTHQSAITLCEKLINLTPEGLDKVFLSDSGSVSVEVAMKMALQYQHAVAEKKKITLTKTKLLTVKNGYHGDTFAAMSVCDPITGMHQIFEQVLMQHFFAPAPTIKFGEQWSSDDVTELTALFAEHHNDIAAFIIEPIVQGTGGMRFYHPEYLKACRLLCDKYDVLLIVDEIATGFGRTGKLFACEWAGINPDIMCLGKTLTGGYITLAATLCTTHIAQTISEGAAGCFMHGPTFMGNALACAVANASIDLLLENDWQSQVQAIENTLVSHLKPLEKHARVKDTRVLGSIGAIECKQNVNVAQIQKRFVELGVWIRPFGQLIYIIPPLIITTEQLITLVNAMATVLDEDECFKC

SEQ ID NO: 62931 - protein, 575 aa, Pasteurella multocida subsp. multocida str. Pm70
MISGIPASPGIVFGKALVLKEEKIVLDMQKISESQIDSEIARFYQGRNAAVEQLSAIRDRAAKTLGEEKAAIFEGHLMILEDEELEEEIIDYLRTNKVNAGVAASKIIDQQVTMLSEIDDEYLRERAGDIRDIGNRLIKNILGMHIVDLGDINEEAILVAYDLTPSETAQLNLDKVLGFITDIGGRTSHTSIMARSLELPAIVGTNHVTSQVNTGDYLILDAVNNVVYVNPSQDEITRLKGLQQKLLEEKAELAKLKDLPALTLDGHRVDVVANIGTIRDVDGADRNGAEGVGLYRTEFLFMDREQLPTEEEQFVAYKDVVEAMNGRLVILRTMDIGGDKELPYLNLPKEMNPFLGWRAIRIALDRREILHAQLRAVLRASAFGKLAVMFPMIISVEEIRELKSVIETLKQELRNEGKAFDESIQIGVMVETPSAAVNAKFLAKEVDFFSIGTNDLTQYTLAVDRGNELISHLYNPMSPSVLSLIKQVIDASHAEGKWTGMCGELAGDEKAAVLLLGMGLDEFSMSAISVPRIKKLIRNVNYEDTKALAMKALQQPTAVEIEQLVEDFLAEKALN

SEQ ID NO: 62932 - protein, 424 aa, Glycine max
  misc_feature (394)..(394): Xaa can be any naturally occurring amino acid
MQKDTSTTAPSTTSGRVRHRKRSNEVIPEVSKANGTKLLVNDKSKYKSMLIRAYSSVWMIGGFVLIIYMGHLYITAMVVVIQIFMARELFNLLRRAHEDRQLPGFRLLNWHFFFTAMLFVYGRILSQCLVNTVTSDMVLYWLVSNLIKYHMVICYSLYIAGFMWFILTLKKKMYKYQFGQYAWTHMILIVVFGQSSFTVASIFEGIFWFLLPATLIVINDIAAYIFGFFFGRTPLIKLSPKKTWEGFIGASVTTIISAFMLANIMGRSQWLTCPRKDLSTGWLHCDPGPLFKPESYPLPGCISHWFSWKEISILPIQWHSLCLGLFASIIAPFGGFFASGFKRAFKIKDFGDSIPGHGGITDRMDCQMVMAVFAYIYHQSFVVPQTLLIKIYLXQIFNHPTFNEQEALYWRLGEILQQGFARMS

SEQ ID NO: 62933 - protein, 127 aa, Zea mays
MSWAPIENDPGVFTELLQQLQLKGLQVDELYSLDLDALNDLQPIYGLIVLYKWRPPEKDERPVIKDAVPNLFFANQIINSACATQAIVSVLLNSSGITLSEDLKKLKEFAKDMPPELKGLAIVNCES

SEQ ID NO: 62934 - protein, 197 aa, Wolbachia endosymbiont strain TRS of Brugia malayi
MVRRITLNSNFMFGASDIKSLPNESAPEIAFAGRSNVGKSSLINLLINSKKAARVSSKPGCTRQINFYSMYNDKFRLVDLPGYGCSHASKDETIQYLGLVEYYLIHRRNLRRVFVLIDSKVRLKEIDKDFIYWLTYNNINFDVVLTKIDKVDRENLDAIIESTRKWINNESVSIRQISVRVKYEMTKVRDEFFKFTR

SEQ ID NO: 62935 - protein, 207 aa, Xanthomonas campestris pv. vesicatoria str. 85-10
MSLLIEQARYHLSAHNARQLPDDGGYEVAFAGRSNAGKSSALNALTRQNALARVSKTPGRTQQLVFFQIQPERYLVDLPGYGYAKVPQDLQAHWQAFIDRYFRTREALRGLVVVMDIRHPLKDYDLQMLGYAAERGLPAHGLLTKADKLGRGQQMQTLQKVKKEVTSRFGDSVTVQTYSGESRQGVDELRAIVGAWLGLDVETTAAE

SEQ ID NO: 62936 - protein, 378 aa, Pseudomonas syringae pv. syringae B728a
MTKPAILALADGSIFRGEAIGADGQTVGEVVFNTAMTGYQEILTDPSYAQQIVTLTYPHIGNTGTTPEDAESDRVWSAGLVIRDLPLVASNWRNKLSLGDYLKANNVVAIAGIDTRRLTRILREKGAQNGCILAGDNITEEAAIAAARGFPGLKGMDLAKEVCTKDTYEWRSSVWDLKTDSHPEIAASELPYHVVAYDYGVKVNILRMLVERGCRVTVVPAQTPASEVLAYKPDGVFLSNGPGDPEPCDYAIKAIREVLETDIPVFGICLGHQLLALAAGAKTVKMGHGHHGANHPVQDLDTGVVMITSQNHGFAVDEATLPSNVRAIHKSLFDGTLQGIELTDKSAFSFQGHPEASPGPNDVAPLFDRFIEAMAKRR

SEQ ID NO: 62937 - protein, 352 aa, Oryza minuta
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDGGSLSDFLKTVKTIPEPYLAAICKQVLKGLMYLHHEKRIIHRDLKPSNILINHMGEVKISDFGVSAIIASSSAQRDTFTGTYNYMAPERISGQKHGYMSDIWSLGLVILELATGEFPYPRRESFYELLEAVVEHPPPSASADQFTEEFCSFVSACLQKKASDRSSAQILLNHPFLSMYDDLNIDLASYFTTAGSPLATFNTSNRYDDR

SEQ ID NO: 62938 - protein, 444 aa, Synechocystis sp. PCC 6803
MITSPTNLNSLPIPPGDFGLPWLGETLNFLNDGDFGKKRQQQFGPIFKTRLFGKNVIFISGALANRFLFTKEQETFQATWPLSTRILLGPNALATQMGEIHRSRRKILYQAFLPRTLDSYLPKMDGIVQGYLEQWGKANEVIWYPQLRRMTFDVAATLFMGEKVSQNPQLFPWFETYIQGLFSLPIPLPNTLFGKSQRARALLLAELEKIIKARQQQPPSEEDALGILLAARDDNNQPLSLPELKDQILLLLFAGHETLTSALSSFCLLLGQHSDIRERVRQEQNKLQLSQELTAETLKKMPYLDQVLQEVLRLIPPVGGGFRELIQDCQFQGFHFPKGWLVSYQISQTHADPDLYPDPEKFDPERFTPDGSATHNPPFAHVPFGGGLRECLGKEFARLEMKLFATRLIQQFDWTLLPGQNLELVVTPSPRPKDNLRVKLHSLM

SEQ ID NO: 62939 - protein, 460 aa, Wolinella succinogenes DSM 1740
MQNFLQVERSNPKKRQALERVKDYSEIYQPYSSDEATPQASRCVQCGDPYCHNKCPLHNFIPQWLKKVSEKDFRLAFELSHATSPFPEIMGRVCPQDRLCEGDCTLNDGYGAITIGAIETFISEKGMELGYKPKFATKSVGKSVAIVGSGPAGLSAATFLLREGFKVELFERQDRAGGLLTYGIPGFKLEKSVIERRLDQLTQAGLKLHLGKEIGKEMSFEKLLKGFDAIFLGIGATAPKKARISGEEAEGCYSAIDFLTAIQKRNFGVESSILLPELKGKSVVVVGGGDTAMDCVRTAIREGAEEVKILYRRDENNMPGSHKEYVNAKEEGVEFEFFAAPKQVILREGKATGIESYRTELCDMDEKGRQKCVVVEGSEFVVEADVIIFSLGFDPARPSFLEQHQIALHPWGGIIVDNSYETSLPNVFAGGDCYRGADLVVNAALDGREAAKAIIKKLLG

SEQ ID NO: 62940 - protein, 474 aa, Pseudomonas putida KT2440
MQTQMLINGQLVAGQGPAWTVLNPALGTALAQINEATEAQVDSAVRAADQAFDSWSQTSPKERSQALLALADAIEAHGDELARLESQNCGKPLSAALNDEIPAIADVFRFFAGAARCLGGSAAGEYLPGHTSMIRRDPLGVVASIAPWNYPLMMLAWKIAPALAAGNTVVIKPSELTPLTALRLGELAQDLLPPGVLNILFGRGQTVGNPLITHPKVRMVSLTGSIPTGAHIISATADSVKRMHMELGGKAPVLVFDDADIDAAIDGIRTFGFYNAGQDCTAACRLYVQDGIYERFVERLGKAVASLKPGLQESEETELGPLISAQHRDKVAGLVQRAIAQPHIRLVTGGKPIAGDGFFFEPTVLADALQDDEIVRNEVFGPVVSVTRFTDEAQALEWANDSNYGLASSVWTRDTGRAHRLAARLQYGCTWVNTHFMLVSEMPHGGQKHSGYGKDMSMYGLEDYTCVRHVMIKH

SEQ ID NO: 62941 - protein, 455 aa, Gibberella zeae PH-1
MEGRKVPRVPELSTEGPSSAGFKTYSAAVSADRISLVSGHLSHQTSSYNAASPALSSATQARSLSTTTANMSSQPEHATLLIPGPIEFDDDVLKSMGHYSESHVGPGFVNTFGETLSMTRKLFQSTDPSAQPYIISGSGTLGWDIVAANLVEAGEDALVLSTGYFGDGFADCLRAYGANVTKLDGEVGGRPQLPEIEKALSEKKYKILTVTHVDTSTGVLSELKNLAATVKRVSPETLVIVDGVCSVACEEIAFDEWGLDGVVTASQKAIGVPAGLSISFFSGRAVAAALENRKTPIPAYFASMKNWTPIMKNYEAKKPSYFATPSPQLVHALHTSLTQILSKPLSERFQGHIEVSNKVKKAITDLGLKIVATKPEDQAHAMTAIYLPEGVGAPDVLPKLAGKGVVFAGGIHKAIASKYIRFGHMGVSALDPSRNHMEKAINALKESLFEAGYKA

SEQ ID NO: 62942 - protein, 392 aa, Oryza minuta
MGKPGKLALPSHESTIGKFLTQSGTFKDGDLLVNKDGLRIVSQSEEGEAPPIEPLDHNQLSLDDLDAIKVIGKGSSGIVQLVRHKWTGQFFALKVIQLNIQENIRRQIAQELKISLSTQCQYVVACCQCFYVNGVISIVLEYMDGGSLSDFLKTVKTIPEPYLAAICKQVLKGLMYLHHEKRIIHRDLKPSNILINHMGEVKISDFGVSAIIASSSAQRDTFTGTYNYMAPERISGQKHGYMSDIWSLGLVILELATGEFPYPRRESFYELLEAVVEHPPPSASADQFTEEFCSFVSACLQKKASDRSSAQILLNHPFLSMYDDLNIDLASYFTTAGSPLATFNTSNYKQLLSLSLFHPFCHRHMLVPFFMIPIDEPFKGTLHSCFHRQPVR

SEQ ID NO: 62943 - protein, 142 aa, Triticum aestivum
  misc_feature (58)..(58): Xaa can be any naturally occurring amino acid
  misc_feature (80)..(80): Xaa can be any naturally occurring amino acid
  misc_feature (98)..(98): Xaa can be any naturally occurring amino acid
  misc_feature (134)..(134): Xaa can be any naturally occurring amino acid
MAPTVMASSATSVAPFQGLKSTAGLPVSRRSNGASLGSVSNGGRIRCMQVWPIEGIKXFETLSYLPPLNTEALLKQVRLXLFRSKWVPCLEFSKVGVXISREHNASPGYYDGRYWAMLEAAYFGCTNATQVINXVEEAKKGT

SEQ ID NO: 62944 - protein, 330 aa, Lactobacillus sakei subsp. sakei 23K
MSILVLGGAGYIGSHTVDQLIERGYDVAVVDNLVTGHKAAINANARFYKGDVRDKEFMRNVFQQEDVSGVIHFAAFSIVPESMQSPLKYFDNNTYGMTALLEVMNEFGVKRIVFSSTAATYGEPKAIPIKESDPQVPTNPYGESKLMMETMMKWADKAYGIKFVALRYFNVVGAKPDGSIGEDHHPETHLLPIVLQVAAGKRDQLSIFGDDYDTPDGTNVRDYVHVLDLADAHILAFEYLKDGHDSNAFNLGSSTGFSNMEIVEAARKVTGKAIPVTMAPRRAGDPSTLIAASDKARETLGWAPKYDNMEAIIETAWNWHLNHPNGYADR

SEQ ID NO: 62945 - protein, 138 aa, Glycine max
  misc_feature (121)..(121): Xaa can be any naturally occurring amino acid
LNVSSFFSAVGMLWTGEKPDAKAVEENMASYFNTLQGFLLLSHGSTVGAGPTLSSAVHASVKQVVDSSFRLMKETVSLYGYHSKDLKISVPQLVGAVWEACSALKKTPSTNITAIGRGMTXVAVSVKDVLREMKELKP

SEQ ID NO: 62946 - protein, 281 aa, Glycine max
  misc_feature (64)..(64): Xaa can be any naturally occurring amino acid
MKPKYSRFSQQELHAWQPILTPSWVVEVPFRYDDECLPPDHKNDAVAYIKDVGSNKTCTKKLTXYVKSRDDKQLRSKAAENDVGSCSPEDYTPNDMGHKPIVPCGLIAWSLFNDTYKLTSNNKDLVINKKNIAWKSDQNGKFGSDVYPKNFQAGGLIGGARLNESLPLSEQEDLIVWMRTAALPTFRKLYGKIETDIEVNDVVLVIENNYNTYEFGGRKSIVLSTTTWVGGRNNFLGMAYILIGGISLLLAAAFLLLYVMQPRPLGDPSYLSWNKNPGSLR

SEQ ID NO: 62947 - protein, 494 aa, Vibrio vulnificus YJ016
MNVLARQDRDVHRDQGVMSTHDATASELATWFSELQTAYQAEPSASYLVRKHRLLALKKQLSRYQDVLAEAMSQDFGGRSHTESIMADVLAPILDINHVLKHLKGWMKPSRRATEWLFKGNQLEVRYQPKGVVGIICPWNFPLYLSIGPMITALAAGNRCMIKMPPNCPQTTRQLRRMLAEIYPTNLVRIVEGTHPEAMDISHLPFDHLVFTGSPASGKIIMTNAAANLTPVTLELGGKSPVVVFDDYEIEKAAQRIAHGKGFNSGQICIAPDYAFVPEGKQEAFVDALKSAHQSMYGDIKANQDYTALVDDAQYQRFHSLLEDARSKGATITQCLEPGEGRKTPLYIATNLTPDMRICQEEIFGPLLPVHTFQAIEEVIDYINQRPRPLACYLFSHHPKQRETLLTQTHSGGVTINGWGWHVLNHSVPFGGVGNSGIGNYHGEEGFRELSHARTVLRMRDWFPIQLFAPPYGNWVQKLVVRVFAGKPDPTLKE

SEQ ID NO: 62948 - protein, 547 aa, Zea mays
  misc_feature (137)..(137): Xaa can be any naturally occurring amino acid
  misc_feature (177)..(177): Xaa can be any naturally occurring amino acid
MERSAESWWVLPMTLIPAISGEQHGNMATVATSFAYLAIFACLAWVGASLLYWAHPGGPAWGKYWRARGKKPSAAIPGPKGLPVVGSLGLMSGLAHRSLADEASRRPGAKRLMALSLGPVRAVVTSHPDVAKEILDXPAFAARPLNHAAYGLMFHRSIGFAEHGPYWRALRRVAGGXTLFGPRQVEAFAPYRAAVAEGIVAALMRAGSGGAVVQVRGLLRRASLYYIMRFVFGKEYDVSRVVPPSGGEEVEKLLEMVHEGYELLGMENLCDYFPGLAALDPQGVGARCAELMPRVNRFVHGVIQEHRAKAVAGGDARDFVDILLSLQESEGLADADIASVLWEMIFRGTDAMAVLMEWTLARLVLHRDVQAKAHRELDKVVGADSQTTESAAPYLQALLKEALRMHPPGPLLSWRHRAISDTYVDGHLVPAGTTAMVNQWAISRDPEVWDAPLEFRPERFLPGGEGQDVSVLGADGRLVPFGSGRRSCPGKSLAMTTVTSWMATLLHEFEWLPASDDTGDVDFSEVLRLSCEMAVPLEVRVRPRSSV

SEQ ID NO: 62949 - protein, 170 aa, Magnetospirillum magnetotacticum MS-1
MVLTRFPRAPLTEGPTPIRSLDRLSTHLGAELNGVRLFVKRDDVGPVGLGGNKLRKLEFLLGQALADRADTVITVGALQSNHARLTAAAAARMGLACELFLTRSVPRDDADYTGNGNRLLQDLFGARIHLLPGEADSLAEAEARADMLRSQGRRVCVFPSGGSSPLGWLG

SEQ ID NO: 62950 - protein, 448 aa, Staphylococcus epidermidis RP62A
MHFVAISINHRTADVTLREQVAFRDDALRLAHEDLYETKAILENVILSTCNRTEVYAIVDQVHTGRYYIQRFLARSFGFEVDDIKDMSEVKVGDDAVEHLLRVTSGLDSIVLGETQILGQMRDAFFLAQNTGTTGTIFNHLFKQAITFAKKAHSETDIADNAVSVSYAAVELAKKVFGKLKSKHAVVIGAGEMGELSLLNLLGSGISNVTIVNRTLSKAKILAEKHNVSYDSLSALPSLLETTDIVISSTSAEDYIITNSMVKTISETRKLDSLVLIDIAVPRDIEPGIDAITNIFNYDVDDLKDLVDANLRERQLAAETIAGQIPEEIDSHNEWVNMLGVVPVIRALREKAMNIQAETMESIDRKLPDLSERERKVISKHTKSIINQMLKDPIKQAKELSTDKKSNEKLELFQNIFDIEAEDPREKAKLEKESRAKEILAHRIFSFE

SEQ ID NO: 62951 - protein, 506 aa, Zea mays
MESRALLHARPAALPHRAGLRLHLPLLRPRAVSRSPAAKPALQSPLLASRGPFLQRHDAVLGNGFVKRRAASAGGDVSFRAQAAASAAVPAPQPEESTKKLLGIDVKTLKKIVPLGLMFFCILFNYTILRDTKDVLVVTAKGSSAEIIPFLKTWVNLPMAIGFMLLYTKLSNVLSRDALFYTVIFPFIAFFGAFAFVLYPLRDVIHPTALADKLLAALGPSFLGPVAILRIWSFCLFYVMAELWGSVVISVLFWGFANQITTVDEAKEFYPLFGLGANIALIFSGRTVKYFSNLRKTLGPGIDGWEVSLKGMMSIVVLLGLVITSIYWGVNKFVLNDPSLPKADRKKKKEKPKLGMKESLKVLLSSRYVRDLATLVVAYGISINLVEVTWKSKLKAQFPSPNEYSSFMGDFSTATGIATFTMMLLGRIILRKFGWGVAAKITPTVLLLTGVGFFSLILFGQPLTPMLATMGMTPLLAAVYVGAMQNIFSKSAKYLVRDHATGKRSR

SEQ ID NO: 62952 - protein, 324 aa, Glycine max
MELARPASSRRKLKDLLHQSGNRLCADCNAPDPKWASANIGVFICLKCCGVHRSLGTHISKVLSVTLDDWSEDEIDAMIEVGGNVSANSIYEAYIPEGYTKPGPDAGHEQRSKFIRSKYELQEFLKPSLRIVSGKSSLQSSSAKSSFMDSFKSTSSSQRMEGMVEFIGMLKVKVIKGTNLAIRDIKSSDPYVVLSLGQQTVQTTIIRSNLNPVWNEEYMLSVPEHYGQIKLKVFDHDTFSADDIMGEADIDLQSLITSAMAFGDAGMFGDMQIGKWLKSDDNALIEDSTVNIVDGKVKQMMSLKLQDVESGELDLELEWIPLEQ

SEQ ID NO: 62953 - protein, 482 aa, Salmonella typhimurium LT2
MQLNDSTLFRQQAFIDGDWRDARGGDVIPVSNPANGKPLGNVPKMGAEETRDAINAANRALPAWRALTAKERANILRRWFNLMMEHQDDLARLMTLEQGKPLAEAKGEISYAASFIEWFAEEGKRIYGDTIPGHQADKRLLVIKQPIGVTAAITPWNFPSAMITRKAGPALAAGCTMVLKPASQTPFSALALAELAQRAGIPAGVFNVVTGSAGDIGGELTSNPLVRKLSFTGSTEIGRQLMEQCAKDIKKVSLELGGNAPFIVFDDADLDKAVEGALASKFRNAGQTCVCANRLYVQDGVYDRFAEKLNQAVNKLAVGDGLQADVAIGPLIDEKAVAKVQEHIADALEKGARVITGGEAHKLGGNFFQPTILADVPDNAKVAKEETFGPLAPLFRFSDEADVIRQANDTEFGLAAYFYARDLSRVFRVGEALEYGIVGINTGIISNEVAPFGGIKASGLGREGSKYGIEDYLEIKYMCIGL

SEQ ID NO: 62954 - protein, 427 aa, Salmonella typhimurium LT2
MNTNNALMQRRHNAVPRGVGQIHPIFAERAENCRVWDVEGREYLDFAGGIAVLNTGHLHPGIVSAVEAQLKKLSHTCFQVLAYEPYLALCERMNQKVPGDFAKKTLLVTTGSEAVENAVKIARAATKRSGAIAFSGAYHGRTHYTLSLTGKVHPYSAGMGLMPGHVYRALYPCPLHNISDDDAIASIERIFKNDAAPEDIAAIIIEPVQGEGGFYAASPAFMQRLRALCDQHGIMLIADEVQSGAGRTGTLFAMEQMGVAADITTFAKSIAGGFPLAGVTGRADVMDAIAPGGLGGTYAGNPIACAAALAVLDIFEQENLLQKANTLGKTLRDGLMEIAETHREIGDVRGLGAMIAIELFENGDPGKPNAALTADIVTRAREKGLILLSCGPYYNILRILVPLTIEASQIRQGLEIIAQCFDEAKQA

SEQ ID NO: 62955 - protein, 173 aa, Ralstonia eutropha JMP134
MLVRYGKSIPSVGQSCFLAANATVVGAVILGDNSSVWFSAVLRADVEPITIGARTNLQDGVVVHADPGHPVIIGDGVSVGHQARLHGCSVADGALIGIGATVLDGAQIGEQSLIGAGALIPPGKVIPPRSLVLGTPGRVVRTLTDEEVRELAWAADEYVRLGMAYLQDAKQVS

SEQ ID NO: 62956 - protein, 277 aa, Chlamydomonas reinhardtii
MVGASGAGPLVLSPRPRSEWELDPSKIIIGRRLAVGGFGEVFVAKYEGTLVAVKRLLATDSDTTQRFIDEVHMLARLRHPNLLLFMGYTLTPEPSIVTEFMSRGSLFHILRQAGDKVPEARMQRVVAVSVARGMAYLHSRSPPILHLDLKSPNVLVDDRWRVKIADFGLSRVRQRTYVSSGAAAGSPEWMAPEVLRCDHYAEAADVYSYGVVLWELLTGKAPWADLNAMQVVGAVGFARRSLPDPTEGDPLLLHLCKACRAYEPSQRPSFSQIVEAM

SEQ ID NO: 62957 - protein, 466 aa, Salmonella typhimurium LT2
MGQLSESHALGGGLKSRHVTMLSIAGVIGASLFVGSSVAIAEAGPAVLLAYLFAGLLVVMIMRMLAEMAVATPDTGSFSTYADKAIGPWAGYTIGWLYWWFWVLVIPLEANIAAIILNSWIPGIPVWLFSLVITLALTGSNLLSVKNYGEFEFWLALCKVIAILAFIALGATAISGFYPYAEVSGISRLWDHGGFMPNGFGAVLSAMLITMFSFMGAEIVTIAAAESDTPDKHIVRATNSVIWRISIFYLCSIFVVVALIPWNMPGLKSVGSYRSVLELLHIPHAKFIMDCVILLSVTSCLNSALYTASRMLYSLSRRGDAPAIMGKTNRSKTPWVAVLLSTGAAFLTVIVNYYAPAKVFKFLIDSSGAIALLVYLVIAISQLRMRKILLAQGGEIKLKMWLYPWLTWLVIGFICFVLVVMLFRPAQQLEVISTGLLGLGIIGTVPIMSRWKKLIRWQKAPLQNLR

SEQ ID NO: 62958 - protein, 267 aa, Oceanobacter sp. RED65
MHSITSTLEFAQQTAREAGELIKRLRQSELRTDFKKGIELVTNADTEADRFIRQCIEREYPDHQILAEESNPDLDSIEFDGRCVWVVDPIDGTVNYAHNHAQVAVSIALIIDGNIEIGVVYNPFTDELFHAQKSKGAFLNNRPISASDKQDLERAIIATGFPYNKQAQLPILINRLHKVLQHVADVRRLGSAALDICWVACGRLDAYYESVSLWDCAAGLLIASEAGVQCGHFIKPESTQYAHLESKHLLLSNHQLYPAIEEILRNT

SEQ ID NO: 62959 - protein, 514 aa, Ipomoea nil
MGSCNSIPSSPFAATSAGGESDPPPPKNDITVLPPSQPPPPRPFLSGVGRVLGRPMEDVHSTYIFGGELGRGQFGVTYLVTHRKTRERLACKSIATRKLLSKDDVDDVRREVQIMHHLTGHRNIVELKGTYEDRNHVHLVMELCAGGELFDRIIAKGHYSERAAAGLCRQMVTVLHYCHSMGVMHRDLKPENFLFLSSDENSPLKATDFGLSVFFKPGDTFKDLVGSAYYVAPEVLRRNYGPEADIWSAGVILYILLSGVPPFWGENEQSIFDAVLRGHLDFSSDPWPSISSSAKDLVKKMLRSDPKERLSATDVLNHPWMREDGDASDKPIDIAALSRMKQFRAMNKLKKVALKVIAENLSEEEIIGLKEMFKSIDTDDSGTITYEELKAGLTKMGTKLSESEVRQLMEAADVDGNGTIDYLEFITATMHMNRVEREDHLYKAFEYFDKDKSGYITMEELEHSLKKYNITDEKTIKEIIVEVDTDNDGKINYDEFVAMMRKGTPDLVINRRRR

SEQ ID NO: 62960 - protein, 380 aa, Pseudomonas syringae pv. syringae B728a
MAKRDYYEVLGVERGSSEADLKKAYRRLAMKHHPDRNPDDKASEELFKEANEAYEVLSDASKRAAYDQYGHAGVDPSMGGGGGFGGGAGGANFSDIFGDVFSDFFGGGRAGGGGGRGGAQRGSDLRYTLELNLEEAVRGTNVNIRVPTLVNCKPCDGSGAKKGSSPVTCPTCGGIGQVRMQQGFFSVQQTCPRCHGHGKIISDPCDSCHGEGRVEESKTLSVKVPPGVDTGDRIRLSGEGEAGTQGGPTGDLYVVINVREHAIFQRDGKHLFCEVPISFTDAALGGELEVPTLDGRVKLKIPEGTQTGKQFRLRGKGVAPVRGGGAGDLMCRVAVETPVNLSKRQRELLEEFRTSLENDESHSPKASGWFEGVKRFFGDL

SEQ ID NO: 62961 - protein, 179 aa, Arabidopsis thaliana
MASPSKRREMDMMKLMMSDYKVDTVNDDLQMFYVTFHGPTDGLYQGGVWKIKVELPEAYPYKSPSVGFVNKIYHPNVDESSGAVCLDVINQTWNLINVFESFLPQLLLYPNPSDPFNGEAASLLMRDRAAYELKVKEYCEKYAKPEEILSDDDDDDSMSEDGSDSDDDDDDEIVGKADP

SEQ ID NO: 62962 - protein, 360 aa, Methanosarcina mazei Go1
MEKEYDIIIIGTGTAGRTLAGRAESSGMKFAIIDSREYGGTCPLRGCDPKKVLAGASEATDLNNRLIGKGAGTEEPLKIDWPSLIRFKRTFTEVYPREAEKMFADMGIDMYHGRARFKNENTVIVGNDELKGKFIFLATGSKPRKLKIPGEEYLTTSEEFMELMELPEKIIFAGGGYISFEFTHIARRAGAEVLILHRSERPLGTFDPDLVDMLVRASEESGIKILTNRPVVAVEKAGDGFLVRTEYKTETGSEVQVFNADMVVNGAGRVPDIEDLQLENAGVRAEKKGIIVDKHMRTSNPRVYAGGDCTAEGIQLTPVATLQGEVAAANIFDRNGAEADYTGIPSAVFTHPCACFRWNK

SEQ ID NO: 62963 - protein, 342 aa, Oryza sativa Indica Group
MANVALLSAASPSTSSAAPRLRHVARRRPSRRSACPRSAASRLSIMAALGEDPIRQWILTEGKATKITGVSSIGGGCINSAQCYKTDAGSFFVKTNGRIGPSMFEGEALGLKAMYDTNSIRVPLPYKVGSLPTGGSFIIMEFIEFGCSRGDQSALGRKLAEMHKAAKSDKGYGFYVDNTIGSTPQINTWTADWIEFYSKHRLGFQLELITQRFGDSAIYDKGQRLIENMHPLFEGAVMEPCLLHGDLWSGNISSDTDGEPVILDPACYYGHNEAEFGMSWCAGFGGEFYSSYFEVMPKQPGFEKRRDLYLLYHYLNHYNLFGSGYRSSAMSIIDDYLRMLKA

SEQ ID NO: 62964 - protein, 119 aa, Zea mays
  misc_feature (52)..(52): Xaa can be any naturally occurring amino acid
MEDLSVEELASNLSTYKEQLREVKKLIKEKKDDAGISEYIDMEKELQEVITXLSPPSYSAGVQSEGLDDLSHSHKFAVGTRVQAVWSEDGEWYNATVEALTPNGYYVAYDGWGNSEEVD

SEQ ID NO: 62965 - protein, 511 aa, Streptomyces sp. WA46
MTDKIPTITRDGVIGYDATEIVTIDQATGAEFARYPVAGKDEAFAAVSAARSVSGAWWDLGFEGRAERLRAWRRQIAASGEEGAALIHAENGKPLDDARVEVLGTLEHVQYAADNAARVLERREVPGSPTTPNQRAWVEYQPYGVVGVIGPWNFPLLTPAAILVDALAAGNAVVLKPSQITPGVAEWLVRAWQRAVPELPAVLQSLNGYGATGQALIEAGLDKLAFTGSVATGKTVAAQCAQTLTPVLLELGGKDGVIVAEDADLDEAAAHVVWGAMQNTGHGCISLEVAYVVESVHDEFVRKISELAGQVRVGSDEDAEIGPVPLPSQTSIIREHIQDALERGATATVGGLDAVGERYVAPTILVGVAPDALAATEETFGPTLAVIKVADADEAVAHINAGRYGLGSAVFSRDRGEAIARRLRVGMTSINDALVFSMNPAVPFGGRGDSGYGRKQGEEGLREFAYAHSFTAKTGPARFSASTFGRPQGAMAGALAGALNRILAESGEKSD

SEQ ID NO: 62966 - protein, 392 aa, Oryza sativa Indica Group
MAAERKDVGILAMDIYFPPTCVLQGVLILQTFACFCGCVCGGGGAQYEKEEKIGEGTYGVVYRARDKVTNETIALKKIRLEQEDEGVPSTAIREISLLKEMHHGNIVRLHDVIHSEKRIYLVFEYLDLDLKKFMDSCPEFAKNPTLIKSYLYQILRGVAYCHSHRVLHRDLKPQNLLIDRRTNALKLADFGLARAFGIPVRTFTHEVVTLWYRAPEILLGSRQYSTPVDMWSVGCIFAEMVNQKPLFPGDSEIDELFKIFRVLGTPNEQSWPGVSSLPDYKSAFPKWQAQDLATIVPTLDPAGLDLLSKMLRYEPNKRITARQALEHEYFKDLEMIQIALRCCYTHLSGVPLGLGSTGGHASLVLSKILSRLVACVRHHQTRVPQRLIMNMH

SEQ ID NO: 62967 - protein, 363 aa, Prochlorococcus marinus str. AS9601
MLKAGIIGLPNVGKSTLFNALVENAKAQAANFPFCTIEPNKGIVSVPDQRLQELGNLSSSQNIIPTKIEFVDIAGLVKGASKGEGLGNKFLSNIREVDAIVHVVRCFEDSDVIHVSGKVDPLDDIEIINLELNLADLSQLQKRRERIKKQVRTSKEAAKEDTLLEKIEEELEKGLSVRSISLNEEENLIIKQLGFLTAKPIIYATNLNENDLALGNDFSSKVQSFARNENTECIKISAQVESELIELEQEDKKDYLIGLGVEEGGLSSLIRSTYKLLGLKTYFTTGEKETKAWTIKDGMTAPQAAGVIHTDFEKGFIRAQTISYQNLIDSGSIANAKTKGLLRSEGKEYIVNEGDVMEFLFNV

SEQ ID NO: 62968 - protein, 307 aa, Thermus thermophilus HB27
MVEKPAIALVGESLVDLVLEGESPLAFTGTLGGSVLNTATVLARLGYPVRFFSEVGEDWLSAWSEVEMARRGLNPKLQRHPGPMPLALVRLDPEGNARYSFHRPFQAPFLPESGALRGVGAFHFGSLFALEARTAKGVAALLEEAARAGALLSYDPNLRGLPSPEERARVEAYLGRVDLLKLSLEDARLLFPEAPLEAVRRLPPRLKVLTLGPEGALAFLGEGEVRVPGVRVRVVDTVGAGDTFTAGLLALLLRRGGGRGVLEGLDLEGLREALEAAVALSALACTVRGAGLPEEGLAAWRARWLAG

SEQ ID NO: 62969 - protein, 385 aa, Oryza sativa Japonica Group
MSSSSSAARTLLSPAAPPVPRRGVVRPARCSGGGGAAAVETAASGAKVCTVSNRGDSLAICRVLNGMWQTSGGWGRIDRDAAVDAMLAYADAGLSTFDMADHYGPAEDLYGLFINRVRRERPPELLEEIKGLTKWVPPPVKMTRSYVEDNINRSRKRMDVSALDMLQFHWWDYANPGYLDALKHITDLKEEGKIKTVALTNFDTDRLQIILENGIPIVSNQVQHSIVDMRPQRRMAELCQLTGVKLITYGTVMGGLLSEKFLDTNVSIPFAGPPLNTPSLQKYKRMVDAWGGWSLFQALLQTLKKVSLKHGVSISTVAVRYILNQTSVAGSMVGVRLGLSEHIKDTNAIFSLELDEEDMNSITEASNKGRNLMDIIGDCGDEYRA

SEQ ID NO: 62970 - protein, 171 aa, Glycine max
QLRRPPPPSAIPNNPNSLTPIFKSKYKMKIIEVIKYLGLLSWLLYYRLSKECQTPESWESVFMNNQIGFRNSNKHALSDEDGPSEEDCSVRVKGRRKKKARKKRRTYDRHDDGDDELLDYDSASQKLVFPSNTRSWLLSTDGYSSAWSSVDLPEYLHRHCLSRWMTWLFEK

SEQ ID NO: 62971 - protein, 148 aa, Glycine max
  misc_feature (27)..(27): Xaa can be any naturally occurring amino acid
SVPTHTATPTVSALQIPSLSQSTLLIXPLDAVESISSSNRTAELVKPSFFVPPPSSAMMIPPVSSSTPTAPPLHPAVNVHRPYGAPLLQPFPPPNPPLSLAPAASPSSSPNYGSVISREKVRDALMVLVQDNQFIDMVYRALLNAHQS

SEQ ID NO: 62972 - protein, 235 aa, Wolinella succinogenes DSM 1740
MNKQETIVKMFDEIAQSYDLANRVLSFGIDVSWRKKACSLSFEHLGKKSVRILDVACGTGDMILHWQKNAKEQGIEIEKVIGIDPSSGMLKVAKEKLPEIEFIQAEAKALPLEEESVDIISIAYGIRNVIERDKALAEFHRVLKPGGILAILEFTKSENDSILDSLASFYTKKILPSIGGIISKNYAAYKYLPDSIEEFLTKSMLNRELEAIGLEPLYSRSYSANISTLFIAKKR

SEQ ID NO: 62973 - protein, 252 aa, Lactobacillus delbrueckii subsp. lactis
MSRTPIIAGNWKLNMNPKETVEFVNAVKDQLPDPSKVESVICAPAVDLDALLKAAEGSNLHVGAENCYWENSGAFTGETSPAVLKEMGVQYVIIGHSERRDYFHETDEDINKKAKAIFANGLTPILCCGESLEIREAGKEKEWVVSQIKADLEGLTSEQVSKLVIAYEPIWAIGTGKTASSDQAEEMCKTIRETVKDLYNEETAENVRIQYGGSVKPANIKELMAKPNIDGGLVGGASLVPDSYLALVNYQD

SEQ ID NO: 62974 - protein, 347 aa, Wolinella succinogenes DSM 1740
MPLNRVREAIEAIKKGEMIIMMDDEDRENEGDLVYAAAFSTPEKVNFMVSEAKGLVCVCVTSTCSDRLGLAPMVRENNSQHETAFTVSIDARECSTGISAFERDLTIRKMVDGTSKPEDFVRPGHIFPLIAKEGGVLVRTGHTEGSVDICKLAGVAPVAVICEIIKKDGHMARRDDLMEFAKEHHLKIVYISDLIEYRMQNEMLILIKERSEVEFLGKRAERYVFQDHHRREHTLYAFGKIIDNSLVKYHTVGKDLSLLESEKKYSTLMQAIKKIQEENGLIIFMDTPQNAAPQIKDFGIGAQMLRFLGIKNFRLLTSEENREYVGLSGFGLNVTEKIVLQGGPIQL

SEQ ID NO: 62975 - protein, 411 aa, marine gamma proteobacterium HTCC2143
MSLIVQKFGGTSVGTIERIEAVADKVTEFRRQGHDIVVAVSAMSGETNRLIGLAHELQSQPTPRELDVLISTGEQVTIALLSMALNKRGCPARSFTGSQVKILTDSAHNKARIKEIDGSNIRAELKRGRVVVVAGFQGSDEDGNITTLGRGGSDTTAVALAAALKADECQIYTDVDGVYTTDPRVVERARRLEHITFEEMLEMASLGSKVLQIRAVEFAGKYNVPLRVLHSFQDGPGTLISLEESLEMESPAISGIAFTRDEAKLSILGVPDTPGIAYRILGPISDANIEVDVIVQNAAADKTNDITFTVSRGDMVKAEAILHETAKELGAREVVTDAKIAKVSIVGVGMRSHAGVASKMFKTLADISTNIQLITTSEIKISVVIDENFLELAVRALHTAFDLDDTSSESA

SEQ ID NO: 62976 - protein, 242 aa, Hordeum vulgare
DARARSFVARAAAEYDLPLVGNKAPDFAAEAVFDQEFINVKLSDYIGKKYVILFFYPLDFTFVCPTEITAFSDRHEEFEKINTEILGVSVDSVFSHLAWVQTERKSGGLGDLKYPLVSDVTKSISKSFGVLIPDQGIALRGLFIIDKEGVIQHSTINNLGIGRSVDETLRTLQALQYVKKPDEVCPAGWKPGEKSMKPDLGPKRSTRCYLERTFALSCGVLSWPFLGYMCFCDPSCSYHAYN

SEQ ID NO: 62977 - protein, 482 aa, Propionibacterium acnes KPA171202
MSDTAPQTAEVGVIGMAVMGSNLARNMARKGFRVAIYNRTASRTDEVIAGHGNEGTFLPFHDLANFVASLERPRRVVMMVKAGCGTDAVIKEITPLLQPGDVLVDGGNAYFGDTRRREEEIRPTGIHYVGTGISGGEVGALEGPSIMPGGSKESYEIIGPVLEKISAHVDGEPCCAWMGTDGAGHFVKMVHNGIEYADMQFIGEAHSLLRAAGLTNAEAADAFESWNHGDLNSYLVEITSRVLRAKDPRNPDTDLLDVIRDEAGMKGTGTWTVQTALELGVDVSTISEAVFARSVSSAVPLRTVGQHVLAGPEHTITVEDRQTFLTDVRDALWSAKVVAYAQGLDEIRTAAAEYNWEVDMGQIASIWRDGCIIRARLLQRIRDEYAAGDLVSLLEAPSVKAELARCQQAWRRVVACAVEAGVPVPGFSSALGYYDQVRAPRLNAALTQGLRDLFGAHTYRRVDDEGSWHLNWSGDGREVRAN

SEQ ID NO: 62978 - protein, 449 aa, Oryza sativa Japonica Group
MARAARGKAPRPRPRPPRGLAASLRRLLAGAGGGLGVAAAAYVGVDYLRYLSPAWHGRLMPALWAALALAAAARAPFYRHWSAELRAALPFLGSIAFMLGAFLCEAVSVRFVSAVMGLQWHRSAAPLPDTGQWLLLALNEKLPQSVVDLLRAHVITLHHYLMLFIMLGFSVLFGCIKAPGLGIATRYMFTMAIGRLLRTMTFVATILPSARPWCAAARYQIPGHPHPWAQKYYVPYASDSDAIRRVIRDDVAYAAVQSYPGEYRPDWGRMSFLVDILRPTPGEGPSWYHLLKKASGGCNDLMYSGHMLVAVLTAMAWTEAYGGWISVAIWLLVLHSAQREIRERHHYTVDCVVAIYVGILLWRMTRFIWSARDASRARRLAKLDEVHNRLIHAAKDSDVDEIRGLLKEVELAGQEKQGVSQRAILAFAAATIIFTLTCVVLALTLTSDG

SEQ ID NO: 62979 - protein, 208 aa, Solanum tuberosum
GAYYGPSIPPPSKSYHRHGRGSSCNPCSCLFGCLCNCIFQIIFTILIVLGVIALVLWLVLRPNKVNFYVTDATLTQFDYSTTNNTLYYDLALNMTIRNPNKRIGIYYDSIEARGMYQGQRFASQNLERFYQGHKNTSYLHPVFKGQNLVLLGDREKTNYNNEKNLGIYEMEMKLYMRIRLKIGWIKTHKIKPKIECDFKVPLESSGRS

SEQ ID NO: 62980 - protein, 176 aa, Streptomyces avermitilis
MSKHTLSVLVENKPGVLARITALFSRRGFNIDSLAVGVTEHPDISRITIVVNVIEALPLEQVTKQLNKLVNVLKIVELEPSAGRAGGELVLVKVRADNETRSQIVEIVQLFRAKTVDVSPEAVTIEATGGSDKLEAMLKMLEPFRHQGARQSGTIAIGRGARSITDRSLRPLDRSA

SEQ ID NO: 62981 - protein, 905 aa, Zea mays
  misc_feature (298)..(298): Xaa can be any naturally occurring amino acid
  misc_feature (654)..(654): Xaa can be any naturally occurring amino acid
MPQRPLLYLVTDQCCLLCFAVLMAPAPCGRSSQRVFHFGKGKSEGNKNMKELLGGKGANLAEMASIGLSVPPGFTVSTEACQQYQEAGRALPPGLWAEVLDGLRWVEEYMGAALGDPRRPLLLSVRSGAAVSMPGMMDTVLNLGLNDQVAAGLAAKSGDRFAYDSFRRFLDMFGNVVMDIPHALFEEKLEAMKKAKGLKNDTDLTATDLKELVSQYKNVYVEAKGEPFPSDPKRQLELAVLAVFDSWESPRAKKYRSINQITGLRGTAVNVQCMVFGNMGNTSGTGVLFTRNPNTGHXKLYGEFLVNAQGEDVVAGIRTPEDLDAMKNLMPQAYKELVENCNILESHYKEMQDIEFTVQENRLWMLQCRTGKRTGKSAVKIAVDMVNEGLVERRAAIKMVEPGHLDQLLHPQFENPSAYKDQVIATGLPASPGAAVGQVVFTAEDAETWHSQGKSVILVRAETSPEDVGGMHAAAGILTERGGMTSHAAVVARGWGKCCVSGCSGIRVNDAEKVVKIGGNVLREGEWLSLNGSTGEVILGKQPLSPPALSGDLGTFMSWVDDVRKLKVLANADTPEDALAARNNGAEGIGLCRTEHMFFASDERIKAVRQMIMAPTVELRQQALDRLLPYQRSDFEGIFRAMDGLSVTIRLLDXPSTRFLPEGNVEEIVRELCSETGANQEDALARIEKLSEVNPMLGFRGCRLGISYPELTEMQARAIFEAAIAMTNQGVQVFPEIMVPLVGTPQELGHQVALIRQVANKVFTSMGKTIGYKIGTMIEIPRAALVADEIAEQAEFFSFGTNDLTQMTFGYSRDDVGKFIPIYLAQGILQHDPFEVLDQRGVGELVKLATERGRKARPNLKVGICGEHGGEPSSVAFFAKTGLDYVSCSPFRVPIARLAAAQVLV

SEQ ID NO: 62982 - protein, 405 aa, Vibrio vulnificus YJ016
MAGVLGMILAGGEGSRLRPLTESRSKPAVPFGGSYRLIDFALNNFVNADLMRIYVLTQFKSQSLFHHMKKGWNINGITDRFIDPIPAQMRTGKRWYEGTADAIYQNLRFMELSEPEQVCIFGSDHIYKMDIKQMLSFHKEKQAALTVSALRMPLAEASQFGVIEVDAEGRMVGFEEKPSAPKSIPGDPDFALVSMGNYIFEADVLFAELIEDADNENSSHDFGKDIIPKMFPRGDVFVYDFSQNRISGEKAEVYWRDVGTIDAYWQAHMDLLKTDAPFSLYNRKWPLHTYQPPLPPATFTDSDNGRVQIIDSLVCNGSYVRGSRIEKSVLGFRSNIASACDISESILLGDVKVGEGCVLRRVIVDKDVDIAPGTQIGVNLQEDKKVFHVSDDGIVVIPKGARVGY

SEQ ID NO: 62983 - protein, 329 aa, Ralstonia eutropha JMP134
MKTRTMSVPLDPELAAIVAAMREARAPAPFSGSPEHARERMRSAILAARARTPLPEVGAIEDGIAVHDGQRVPVRVYRPRTASAMLATVVFFHGGGFVLGSVELMDDIARKLCRDLDAVVVSVDYRLAPEHPFPAAHDDALAATSWAIRNVSALGGNPARIAVAGESAGANLAASTALLLRDQGETLAAQLLIVPGVDLARDTQKLEAARGEFPMLSPTDLRDISRLYMGERAALAGRFPPSPMHAVNVHRLPPAVVAVAGHDPLCEEGTRYAARLEAAGVPVCLLRFDDMFHPFFGFFEASASARRANNAICHTFKSWLHQHASPTST

SEQ ID NO: 62984 - protein, 140 aa, Pinus pinaster
ELQDLQRDPPTSCSAGPVGEDLFHWQATIMGPTESPYAGGVFFVMIHFPPDYPFKPPKVNFQTKVYHPNINSNGSICLDILKEQWSPALTISKVLLSICSLLTDPNPDDPLVPEIAHIYKSQRSRYEETARAWTQKYAMN

SEQ ID NO: 62985 - protein, 256 aa, Colwellia psychrerythraea 34H
MTRQAIVAANWKMNGDSALVDTMVSGLADIELSSHVDVVICPSFPYLSELNQKIKAANLNEAIHVGSQNVSEHESGAYTGEVSTAMLQNLAINYVIVGHSERRSIFKETSTQVAKKVHAALNAGLTPILCIGESEAERATGETETVLSAQIQPVIDEIGIEKFKDVVIAYEPVWAIGTGKTASSAMAQETHQFIRKFLAQQNEQVADKVPLLYGGSVNAANCEELFAQTDIDGGLIGGASLKAEQFKIICSAAKGK

SEQ ID NO: 62986 - protein, 245 aa, Triticum aestivum
  misc_feature (18)..(18): Xaa can be any naturally occurring amino acid
  misc_feature (72)..(72): Xaa can be any naturally occurring amino acid
SIAVIGLSVHTAPVDMRXEKLAVAEELWPRAISELTSLNHIEEAAVLSTCNRMEIYVVALSWNRGIREVVDXWMSKKSGIPASELREHLFMLRDSDATRHLFEVSAGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYLPGRPLESR

SEQ ID NO: 62987 - protein, 428 aa, Colwellia psychrerythraea 34H
MTTSNQELQNRKTKVIARGQGNMYPVYVERAENSEIWDVEGNRYIDFGAGIAVCNTGHSHPKVVAAAKAQLDKFSHTCVMVNPYEVAVELAEKLIDIAPGDSEKKAIFVSTGAEAVENCVKIARAHTGRRGVIAFNGGFHGRTNLTMALTGKITPYKNLFGPFPGDIFHAPFPIECHDITVKQSLKALENLFKVDIAPSDVAAIIVEPVQGEGGFYAAPTEFLQALRQLCDQHGIMLIADEIQTGFGRTGKMFAFEHSGVEADLMTMAKGIAGGFPIAAVVGKSEVMDAPLPGGLGGTYGGSPVACAAALAVLDIIEEESLVERSAHIGEQFNHRLSQLKTAFPELVLEVRNQGSMIAMELIQNGDAEQPNTELTQAIIAHAAKNGLVLLACGFYGNVIRFLPPLTITDEVLTEGLDAFENMFKELAK

SEQ ID NO: 62988 - protein, 352 aa, Desulfitobacterium hafniense DCB-2
MAKIAVYGAGSWGTALAVSMGKAGHEVALVGRNLSEMDLMEQRRENRPYLPGVVLPPTVRPTGDAGALEEAEMLVLSVPSHSVRETAQKIRAYLQPGTIVVNTAKGLEEGSHKRLSQVLTEELPHHPIVVLSGPSHAEEVGKDMPTTVVVASQNSQAAEAVQDMLMTPKFRVYTNPDTIGVELGGAFKNIIALCAGFADGLGFGDNTKAALMTRGIAEITRLGAAMGGNPLTFAGLAGVGDLIVTCTSRHSRNHRAGVALGEGKPLEQVLKEVGMVVEGVRTTRVAYELSRQYEISMPITEQAYQVLFQGADPRAAVSALMMRGKKHEIEEVALIAMEQGSYQENGPDDHGE

SEQ ID NO: 62989 - protein, 475 aa, Thermus thermophilus HB27
MEVKEAPTEALIGGAWRRLERRFPVVSPATGERVAEVADCGEEEAREALEEAVLAFPAWSRATAYERAQVLRRWYERILEHQEPLARLMALEMGKPLKEGRAEVAYAAGFVEWYAEEAKRVYGETVPSQFPHKRILVRYEPVGPVYGITPWNFPAAMVTRKVAPALAAGCTFVLKPAEESPLTALYLAKLFLEAGGPPGVFQVLPTSRPAEVSRPFLEDERVRKLTFTGSTEVGVRLYGEAAKTLKRVSLELGGGAPVLVFADADLDRAVEETLRAKFRNAGESCVAANRIFVQAEVAEAFAEAYARRVQALKVGDPLSEETDVGPLVNEAALRKVRTHVEDALAKGARLVAGGEAKGLFFAPTVLLDVKPESLLFREETFGPVAPLTVFREEEEAVRWANGFPVGLAAYVFTRDLSRAFRVAEALEYGIVGVNDGVPSTPQAPFGGVKRSGLGREGGKWGLLEYLEVKYVSLGL

SEQ ID NO: 62990 - protein, 482 aa, Bradyrhizobium japonicum USDA 110
MDVNLLISGRDQAASTGKVFERRNPLSQEVASRAAAATVSDADAAVAAASAALAAWSALGPNARRALLLKAADALEAKRDAFIRIMMAEIGTTEVWSAFNVKLATGMLREAASLTTQVAGEVIPSDKPGCLAMAVRQPAGVCLGIAPWNAPIILGVRAVATPLACGNTVVLKASEICPGTHRLIGEVFRDAGFPPGVVNVLTNAPADAPAVVERLIANPAVRRINFTGSTRVGRVIAELAGRHLKPVLLELGGKAPLVVLDDADLDAAVAAVAFGAFINQGQVCMSTERVIVDESVADQFVAKLAKKAGALPAGDPRSGPVVIGSMIDEAPARHVVALIDDAIGRGAVKLAGGERAGTVVPATVLDRVVPGMRIYSEESFGPVVSVIRARGVDDAVRLANDTEYGLSAAVFGRDVARALTVAQRIESGICHVNGPTVHDEAQMPFGGVKGSGYGRFGGQAGIAEFTDLRWITIETQPQHYPF

SEQ ID NO: 62991 - protein, 848 aa, Ustilago maydis 521
MSDSSSSSSWLSTLSSSNGRSALLLGSIAVGSSIATAAAILGTQRITRRKKRQDLLDTVTKSANAQGTDRLQRFDLNRDEASSSADGGTPRYLSGLQSNTLRPASHLRNSTSFYSSSNMPQSPATPSRADAMGLHDPRKRVPSVEQWDESLIREQLSRNYSFLGEEGMTAIRNSFVIVVGAGGVGSWAALMLLRSGVSKLRLIDFDQVSLSSLNRHACATLEDVGRPKVVCCAEKFAQIAPWAKLEAWVELFRGDEAERLLGGNPTYVVDAIDNIDTKVDLLRFCAERKIKVISSMGAGAKSDPSRIQISDISVTSEDPLARSVRRRLRALGLPPIPPKEIEDKAKREAEKLEKAQAQPPRHSNHAGKTKIGGKQNKLDAPLTGVDLDRTPMKAGTSDELGRRAANGNTSSGSCSPANDRFSGSLQPRQPRKLAYSASPLASRSASSTDLTCLNTSNDSTMSNAASMSSSRCVSAAEPQAPRHSRRASSVSSFGSGAYATPMTTPSDEMAALLPDEDDHETSFRPLDERDGAEHDDTAHANLDSLASSRTLVDRRTSQSSASASDATAVDLAAHTAPRTKITDSLRTRVSEVEHLSRSPSASSPALSRSSSFKRSLPSTPRIGKTETDEDEFSEPTFFIPCVYSTEKSDTRLLPLDQDEFEKGNVDELAALEDFRVRILPVLGPLPAMFGLAVATFIICEIGGQKMEPLAFKGRRKLYEKLFHDLSVSEARHPLAGSQVDSQDAQNTGPRHHIPFSINDIAYLFEEVFRGRSIVPPFESLSGAQLHRWDSTLPLSFQNVALFSRSQAKVHESEVLKKGRSPVEVWGADAAHMIKRRMASERRSGFFRF

SEQ ID NO: 62992 - protein, 816 aa, Olea europaea
PPPFPLADDGASISPRMKKAKSQALAYSLDNKNGQQSVPHVHFDPSANSSMIDEDSNDVVLDASASSNSFGRVVGGGGGVTANLARKKATPPQPAKKLVIKLVKAKPMLPTDFEENTWATLKSAIIAIFLKQPDPCDLEKLYQAVNDLCLHKMGGSLYRRIEKECESYISAALQSLVGQSQDLVVFLSLGQKKCWQDFCDQMLMIPGIALYLDRTYVKQTPNVRSLWDMGLQLFRKHLSLASEVEHKTVFGLLKMIERERLGEAVDRTLLNHLLKMFTSLEIYPDSFEKPFLESTSEFYAAEGVRYIQQSDVPGYLKHVEIRLQEEHDRCLHYLDASTKKPLIATAEKQLLEHHKSAILDKGFVMLMDGNCIDDLQRMYTLYSRINALELFRQALSQYIRKTGQGMVMDEEKDKDMVSSLLEFKASLDRTWEEGFFKNEAFSNTIKDAFEHLINLRQNRPAELIAKFVDEKLRAGNKGTSEEELEGILDKVLVLFRFIQGKDVFEAFYKKDLAKRLLLGKSASIDAEKSMITKLKTECGSQFTSKLEGMFKDIELSKEINESFKQSSQARTKLPSGIEMSVHVLTTGYWPTSPPMDVRLPHELNVYQDIFKEFYLSKHSGRRLMWHNSLGHCVLESQNFQKVERSWLFLYFRRLCCAHLTMHKTLASQDIKESTGILRIKSEEDSAIPCMRKSPRSSENSQGERCGGLCSFVFNDQFTAPLYRIKVNAIQMKETVEENASTTERVFQDRQYQVDAAIVRIMKTRKVLSHTLLITELFQQLKVPHKTSDLKKRIESLIDREYLERDKNNPQVYNYLA

SEQ ID NO: 62993 - protein, 130 aa, Pasteurella multocida subsp. multocida str. Pm70
MKKREDMTEMQVHVCLNQGTEYPFTGKLLDQQKKGLYRCVVCHSPLFVSDTKFDAGCGWPSFFQAISPEAIRYLDDYTLSRPRTEIRCGQCDAHLGHVFEDGPPPTGLRYCVNSVSMAFEDSETGELIEG

SEQ ID NO: 62994 - protein, 259 aa, Arabidopsis thaliana
MAANFWNSSHYKQLLDPEEVDVVHDLDKERGISIDDFKLIKFHMSNHIMKLAQHIKVRQRVVATAITYMRRVYIRKSMVEFEPRLVALTCLYLASKAEESIVQARNLVFYIKRLCNIFFFYPDEYNKYELKDILGMEMKVLEALDYYLVVFHPYRSLSEFLQDAALNDVNMNQITWGIVNDTYKMDLILVHPPYRIALACIYIASVHREKDITAWFEDLHEDMNLVKNIAMEILDFYENYRTITEEKVNSAFSKLALKL

SEQ ID NO: 62995 - protein, 334 aa, Pasteurella multocida subsp. multocida str. Pm70
MAIKIGINGFGRIGRIVFRAAQHRDDIEVVGINDLIDVEYMAYMLKYDSTHGRFDGTVEVKDGNLVVNGKTIRVTAERDPANLKWNEIGVEIAVEATGLFLDDATARKHITAGAKKVVLTGPSKDATPMFVSGVNFDTYAGQDIVSNASCTTNCLAPLAKVINDKFGIKDGLMTTVHATTATQKTVDGPSAKDWRGGRGAAQNIIPSSTGAAKAVGKVIPALNGKLTGMAFRVPTPNVSVVDLTVNLEKPATYAEICAEIKRASENEMKGVLGYTEDAVVSTDFNGCALTSVFDAAAGIALTDTFVKLVSWYDNETGYSNKVLDLVAHVYNYKG

SEQ ID NO: 62996 - protein, 309 aa, Desulfococcus oleovorans Hxd3
MAETDYYKILGVEKNATDEEIKKAYRKLAMKYHPDHSKGDKKAAEEKFKKISEAYAVLKDKEKRKQYDTYGANGFHERYSQEDIFRGFDFSDILKEFGFGGGGGFFSGGGRGGGARFSFDGGSPFGGGGPRQTAAVKGEDVVYELPVTIQEVVSGTTKAVSLRHGGGTETVNVKIPKGMVSGKKIRLAGKGQPSRFGGPSGDMYIQAKLVKDPVFEVDGYDLYMTTGVKLTDALKGTRITVAGVDGKDLNLRVPPGTRHKSKLRLAGQGIPHMRGAGRGDLYVEIQVEMPSKLTDQQKQLVEALAETGL

SEQ ID NO: 62997 - protein, 223 aa, Oryza sativa Japonica Group
MGKEVDVSTLEAGGVRDYEDPPPAPLVDADELCRWSLYRAVIAEFVATLLFLYVTVATVSLVRALLYMAAQCLGAICGVALVKGFQSGLYARHGGGANELAAGYSTGTGLAAEIIGTFVLVYTVFSATDPKRNARDSHVPVLAPLPIGFAVFMVHLATIPITGTGINPARSLGAAVMYNNSKAWSDQWIFWVGPFIGAAIAALYHQVILRASARGYGSFRSNA

SEQ ID NO: 62998 - protein, 506 aa, Pseudomonas aeruginosa PAO1
MRYAHPGSEGAIVSFKARYGNYIGGEFVPPVKGQYFTNTSPVNGQPIAEFPRSTAEDIDKALDAAHAAADAWGRTSVQERSNILLKIADRIEQNLELLAVTETWDNGKAVRETLNADIPLAADHFRYFAGCIRAQEGSAAEINDSTVAYHIHEPLGVVGQIIPWNFPLLMAAWKLAPALAAGNCVVLKPAEQTPLGICVLLELIGDLLPPGVLNVVQGFGREAGEALATSKRIAKIAFTGSTPVGSHILKCAAENIIPSTVELGGKSPNIYFEDIMQAEPAFIEKAAEGLVLAFFNQGEVCTCPSRALVQESIYPAFMEEVLKKVRAIKRGDPLDTETMVGAQASQQQYEKILSYLDIAQQEGAELLAGGSVEKLEGNLASGYYIQPTLLKGHNGMRVFQEEIFGPVVGVTTFKDEAEALAIANDTEYGLGAGLWTRDINRAYRMGRGIKAGRVWTNCYHLYPAHAAFGGYKKSGVGRETHKMMLDHYQQTKNLLVSYDINPLGFF

SEQ ID NO: 62999 - protein, 482 aa, Pseudomonas aeruginosa PAO1
MSLEQTGHAPATSGIDFESVDADYFQHRQLKKGAAGWVLLVGLGVAYVISGDYAGWNFGLAQGGWGGMFLATLLMATMYLCMCFSLAELSSMIPTAGGGYGFARSAFGPWGGFLTGTAILIEYAIAPAAIACFIGAYCESLFGVGGWLIYLVFYIVFIGIHILGAGEALKLMFVITAVAAIALGVFIVAMVPHFDSANLFNIPQTAATGASSFLPFGYVGVWAAIPYAIWFFLAVEGVPLAAEETKNPKRDLPRGLIGAMLVLLAFAALILVVGPGAAGAKELMGSGNPLVEALESAYKGSTWMSQFVNLVGLAGLIASFFSIIYAYSRQIFALSRAGYLPRSLSLTNRKKAPVLALVVPGVIGFGLSLTGQGDLLILVAVFGATISYVLMMAAHITLRIRRPDMQRPYRTPGGILTSGVALALACVAVVAGFLVDPRVVVGAVAIYAVLIGYFALYSRHHLVSGTPEEEFAAIQAAEQDLR

SEQ ID NO: 63000 - protein, 420 aa, Triticum aestivum
  misc_feature (255)..(255): Xaa can be any naturally occurring amino acid
  misc_feature (266)..(266): Xaa can be any naturally occurring amino acid
  misc_feature (272)..(272): Xaa can be any naturally occurring amino acid
MENMRSENNRGAAMEGVKLASEAAANTNRRALRDIKNILGAPHQPQAVSKRGLQEKPAAGAKSQAGAVGHRPVTRKFAAILQQTQPANAPLAPIGSERQKRNADTAFNAPSDMECSKASDDDLDEMMTNELKEIDMEDTEEEEEMPDIDSCDVGNSLAVVEYVDEIYSFYRRTEELSCVSPTYMAHQSDINEKMRGILIDWLIEVHYKLELLGETLFLTVNIIDRYLARENVARKKLQLVGVTAMLLACKYEEVXVPVVEDLILIXCDRAYXREDILNMERKIVDRLEFNMSVPTPYCFMRRFLKAAGSDKKLELLSFFLIELSLVDYKMLKFQPSMLAAAAIFTAQCTLNGCMSWNKCCELHTKYSEEQLMDCSTTLVELHQGAARGKLTGVHRKYSTFKYGCAAKSEPAAFLLDARKA

SEQ ID NO: 63001 - protein, 346 aa, Oryza sativa Indica Group
MGLISSAQMDPLESEGGSQKSNNKPKYSKFTQQELPACKPLLTPGIVVATFLLIGIIFVPIGLASLSASQEIVELVDRYDTNCVSTPDKVGFIQNTDTDKTCTRTLTVPKHMKSPIQIYYQIGDFYQNHRRYVKSRSDKQLRYKNAVHLTKDCDPEGNTVDGAPIIPCGLIAWSLFNDTYTISVNKKAIEVNKKDIAWKSDKTDKFGSDIYPSNFQKGSLIGGAKLNESIPLSKQEDLIVWMRTAALPTFRKLYGRIETDIMANDQLTVVIQNNYNTYSFGGSKALVLSTTSWIGGKNNFIGVAYLTIGGLCIFLAVGFVVLLYMVKPSGSHLKVKKLPYTPSIYF

SEQ ID NO: 63002 - protein, 393 aa, Chlamydophila pneumoniae CWL029
MIFEFRFPKIGETSSGGSIVRWLKNLGDHVARDEPLIEVSTDKIATELPSPKAGRLVRFCVNEGDEVASGDVLGLIELEEISEADDESTSCPPTSCETKSEAGSSSSSVWFSPAVLSLAQREGIGLDNLQKIAGTGKGGRVTRQDLEAYISESQQVSIPEIFQGEVNRIPMSPLRRAIASSLSKSSDEVPHASLVVDVDVTDLMNLISGERQRFLDTHGVKLTITSFIVQCLAQTLRQFPLLNGSLDGTTIVMKKSVNVGVAVNLNKEGVVVPVIHNCQDRGLVSIAKALADLSSRARLNKLDPSEVQDGSVTVTNFGMTGALIGMPIIRYPEVAILGIGTIQKRVVVRDDDSLAIRKMVYVTLTFDHRVLDGIYGSEFLTSLKNRLESVTMG

SEQ ID NO: 63003 - protein, 366 aa, Oryza sativa
MMADNHYRTLARLISKHAWLYTEMVVAETIVHQKDNLDRFLAFPAEQHPIVLQIGGSNLDNLAKATELANAYSYDEINLNCGCPSGKVAGHGCFGARLMFDPEFVGDAMSAIAANCNVPVSVKCRIGVDDRDSYEELCEFVDKVVSKSPTRHFIIHARKALLSGLSPAENRNVPPLKYEYYFALLRDFPDVQFTLNGGITTIDQVTASIRQGAHRVMVGRAAYNNPWNMLGHVDSEVYGMPTRRSSRRQILESYQVYGDSIMGQYGPSRPNVRQLVKPLLNLFHSEPGNGLWKRKADSTLRHCKTLESFLEETLDAIPNSVLDAPIGKEAYIEEGHFADMDSLLPPRYSSLTNGSCEIPALVTAST

SEQ ID NO: 63004 - protein, 285 aa, Triticum aestivum
  misc_feature (63)..(63): Xaa can be any naturally occurring amino acid
  misc_feature (170)..(170): Xaa can be any naturally occurring amino acid
MSSRSPPPRDRRMRTERTLYRDAPYRRDRDGRRGPNRSASDLCNNCKRPGHFARDCPNVSVCXACGLPGHIAAECSSKDLCWNCKEPGHMANACPNEGICRNCGKSGHIAKDCTAPPMLPGEVKLCNNCYKPGHIAVECTNEKACNNCRKSGHLARNCTNEPVCNLCHVXGHLARQCPKSDEINERGGPPPFRGGDALFRGGDALFRGGDAPFRGGDAPFRGGGGALFRGGYSDVVCRACNQVGHMSRDCMGGAFMICNNCGGRGHMAYECPSGRLLDRFPPRRY

SEQ ID NO: 63005 - protein, 254 aa, Fusobacterium nucleatum subsp. vincentii ATCC 49256
MRLIKTLDEIKGIKKANQIIAKIYTDIIPPYLKPGVTTREIDRIIDEYIRSCGARPACIGVEGFYSPFPAATCISVNEEVVHGIPGDRIIKEGDIVSLDTVTELDGYYGDSAKTFAIGEIDEESRKLLEVTEKSREIGIEAAVVGNRLGDLGHAIQSYVEKNGFSVVRDFAGHGVGLDLHEEPMIPNYGRKGRGLKIENGMVLAIEPMVNVGTYKVAIMPDGWTVVTRDGKRSAHFEHSVAIIDGKAVILSELD

SEQ ID NO: 63006 - protein, 598 aa, Pseudomonas syringae pv. phaseolicola 1448A
MVSFRPSRFNSVFYGVPPLDATTINSLFLVGALLVAASILVSSLSSRLGIPILVIILAVGMVAGVDGGGIIFDNYATAYLVGNLALAVILLDGGLRTRVASFRVALWPALSLATVGVLITTVLTGMVAAWLFNLSVIQGLLIGAIVGSTDAAAVFSLLGGKGLNERVTASLEIESGSNDPMAVFLTVTLIGMLASGQTGLHWGLLGHLIQEFGIGSFIGLGGGWILLQLVNRINLAAGLYPILVIAGGLAIFALTNAIHGSGFLAVYLCGLVLGNRPIRSRHGILHMLDGMAWLAQIGMFLVLGLLVTPHDLLPIAIPALGLALWMILVARPLSVMVGLLPFKAFHGREKAFIAWVGLRGAVPIILAVFPLMAGLPNAQLYFNLAFFIVLVSLLLQGTSLPWVAKLLKVTVPPDPAPISRAALEVHVTSEWELFVYRLGAEKWCIGAALRELKMPEGTRIAALFRGQQLLHPSGSTTLEVGDLLCVIGHEHDLPALGKLFSQAPQRGLDLRFFGDFVLEGDARLGEVAALYGLKLDGIDPGMPLSQFIVQKNRGEPVVGDQIEWNGTIWTVAVMDGNKIQKVGVKFPEGTRPGPGLFL

SEQ ID NO: 63007 - protein, 341 aa, Staphylococcus epidermidis RP62A
MATNIAINGMGRIGRMVLRIALNNKNLNVKAINASYPPETIAHLLNYDTTHGVYDKKVEPIESGIKVNGHEIKLLSDRNPENLPWNEMDIDVVIEATGKFNHGDKAVAHINAGAKKVLLTGPSKGGDVQMIVKGVNDNQLDIDTYDIFSNASCTTNCIGPVAKVLNDKFGIINGLMTTVHAITNDQKNIDNPHKDLRRARSCNESIIPTSTGAAKALKEVLPEVEGKLHGMALRVPTKNVSLVDLVVDLEQNVTVTQVNDAFKNADLSGVLDVEEAPLVSVDFNTNPHSAIIDSQSTMVMGQNKVKVIAWYDNEWGYSNRVVEVADKIGQLIDDKAMVKAI

SEQ ID NO: 63008 - protein, 442 aa, Chlamydophila psittaci
MEELTTDFDSLMTQLNDVHLTTVVGRITEVVGMLIKAVVPNVRVGEVCLVKRYGMEPLVTEVVGFTQNFAFLSPLGELTGVSPASEVIPTGMPLYIRAGNGLLGRVLNGLGEPIDSEIKGPLVDVNETYPVFRAPPDPLHREKLRTILSTGVRCIDGMLTVARGQRIGIFAGAGVGKSSLLGMIARNAEEADVNVIALIGERGREVREFIEGDLGEEGMKRSVIVVSTSDQSSQLRLNAAYVGTAIAEYFRDQGKTVVLMMDSVTRFARALREVGLAAGEPPARGGYTPSVFSTLPRLLERSGASDKGTITAFYTVLVAGDDMKEPVADEVKSILDGHVVSSNALAQAYHYPAIDVLASISRLLTAIVPEEQRRIIGKAREVWGKYKANEMLIRIGEYRRGSDREVDFAIDHIDKLNRFLKQDIHEKTNYEEASQQLRAIFR

SEQ ID NO: 63009 - protein, 258 aa, Pasteurella multocida subsp. multocida str. Pm70
MGITIMERVDNYEQRFGGIARLYSTEGLTRLKQSHVCVIGIGGVGSWCVEALARSGVGKLTLIDMDDICVTNINRQIHALSGNIGQLKTEVMKARVALINPECEVAIIDDFISSENLADYLSKGYDYVIDAIDHVKTKAALIAYCKRHKINMITVGGAGGQTDPTQIQITDLSRTIQDPLLAKVRSLLRKEYHFSQNPKRKFGIDCVFSTQPLIFPNVDGNCEVSASMNCANGFGAATMVTATFGFFAVSRVINKLLR

SEQ ID NO: 63010 - protein, 424 aa, Bordetella parapertussis 12822
MSDTTPAWMAQGYPHIWLPYAQMKTAAPPLPVVRSHGSLLELADGRTLIDGVASWWTACHGYNHPHIAQAVREQLDRMPHVMFGGLAHEPALNLASRLSALLGPGLERVFYTDSGSVAVEVAMKMAVQFWLNQGERGRTRFVAFRGGYHGDTFGTMAVCDPDEGMHAMFRGLLPEHDVLALPRDEAALAALQAHLERHAGRIAGMLVEPLVQGAGGMLLHDPQVLARLRELADRYGILLIFDEIFTGFGRTGTMFAFEQAGVRPDIITLSKALTGGTLPLAATVASARVFEGFWSDDPGHALMHGPTFMGCALACAAANASLDLFEREPRLRQVAALEQALRAGLEPCRDLPWVRDVRVLGAIGVIELDGIGARDDLRRRLVDAGVWVRPFGNIVYLTPAFTIAEDELQALLAAVRQVVAERRP

SEQ ID NO: 63011 - protein, 333 aa, Pasteurella multocida subsp. multocida str. Pm70
MKTLGQFIVEKQAEYPNAKGELSGILSSIRLVAKVIHRDINKAGLTNNIIGTSGAENVQGETQMKLDLFAHNTMKQALISREEVAGFASEEEENFVAFDTERGRNAKYVILTDPLDGSSNIDVNVAVGTIFSIYRRVSPIGTPVTLADFMQPGNRQVAAGYIVYGSSTMLVYTTGNGVNGFTYDPSLGVFCLSHENIQIPANGKIYSINEGQYLKFPQGVKKYIKYCQEEDKATHRPYTSRYIGSLVSDFHRNMLKGGIYIYPSATNYPNGKLRLLYEGNPMAFLAEQAGGMASDGYQRILDIQPTELHQRVPLFLGSKEMVEKAQDFMKTFG

SEQ ID NO: 63012 - protein, 261 aa, Haemophilus somnus 2336
MSEPENLAQNQPHFSKDTTHFGFQTVAKSEKQKLVANVFHSVAAKYDLMNDLLSFGIHRVWKRFTIDCSGVRKGHKVLDLAGGTGDFSAKFSRIVGETGKVILADINSSMLDVGREKLRNLGIVGNVDYVQANAEELPFADNTFDCVIISFGLRNVTDKDKALRSMFRVLKPGGRLLVLEFSKPILDPLSKIYHFYSFNVLPKIGEIVVNDSDSYRYLAESIRMHPKQDILKEMMINAGFEQVGYYNLTAGIVALHRGYKF

SEQ ID NO: 63013 - protein, 401 aa, Magnetococcus sp. MC-1
MKTYEFHPIADIFPLMSEQELNELTQDMRDHGQREPIWLHADGRILDGRNRYNACCTIGAEPSVEIYQGDDPVAFSISLNLHRRHLNESQRAMVAARLKPMFEEEARSRMLQGGSSDPMANLPQGKVGASREHAAELANVSARSVESASRVLRKGTPDLIEKVDKGNVSVSAAADVANLSENEQQVVVAKGEEAILEAAKEIRSRKAKENAAYRAQVRADALKMDLPDGKYRTIIIDPPWPMQKVERDQRPDQVGFDYPTMSEVELADLDVGGLAHEECHLFLWTTQKFLPMAMRLMEKWGFPYIFQMVWHKPGGFQPFGLPQYNCEFVLFGRKGSLEFLETKAFSTCFDAPRREHSRKPDEFYDLIRRVSPSPRIDVFSREQREGFDTWGAESGKFGEVA

SEQ ID NO: 63014 - protein, 352 aa, Candida glabrata CBS 138
MFEGFGQNKRRKINTESAAEAEHNKPWVEKYRPKKLDDVAAQDHVVNVLKKTLSSANLPHMLFYGPPGTGKTSTILALTKELFGPELMKTRVLELNASDERGISIVREKVKNFARLTVSKPSKHDLENYLCPPYKIIILDEADSMTADAQSALRRTMETYSTVTRFCLICNYVTRIIDPLASRCSKFRFKSLDSSNALQRLKYVAEEEGVKVKAGSLETILDISAGDLRRAITLLQSASKNIGYSGEDEVSKELVEELAAVVPESSIKQIVELVATRDFNKISEYIQEFTRNGWSAASVVSQLHDYYIKSSEYDTAFKNKVSIILFDTDSKLTNGTNEHIQLLNMLIKISQV

SEQ ID NO: 63015 - protein, 539 aa, delta proteobacterium MLMS-1
MNTQVRPVLLAILDGWGEAPAGPGNAVALAATPNMDRWRRQYPLTTLVAHNGAVGLPKGQMGNSEVGHLNIGAGRTVYQEFTRISLAVENGEFYDNPTLVETVERVRETGGALHLLGLLSDGGVHSHLEHLIALLELARRRGLAKVYIHAFMDGRDTSPHGGRGYMETLLAAIDRLGVGQVATVCGRYYAMDRDKRWERLQLAWEAVVEGSGQYTAAEPLAAVDEAYNRGETDEFIKPTVVVAAGAAPVKIDHGDGVIFFNFRADRARQLTAALSQDDFAGFERPRRPALSALTTMTRYEKDFELPVAFPPQTLERIMGEEVSRHGLKQLRIAETEKYAHVTYFFNGGREEPFDGEERALIPSAREVATYDLKPEMSAAEVTAELLRRLQPAAAPAAAANAAAGGPATTSPYALVVLNFANGDMVGHSGVLPAAIKACEAVDHCIGQVVEAFTAVGGAVLITADHGNAEEMLDEQGNPMTAHSCNPVPLLLIDPGARQPGTLRDDGTLTALAPTILDLMGLPVPREMDGGSLLQPAGGR

SEQ ID NO: 63016 - protein, 1050 aa, Cymodocea nodosa
MAAVEDGALPYRKLLEEVNGTVTGEGRSESTPQDGIIFVGVSLVLGIASRHMLRGTRVPYTVALLLLGIGLGALEFQTSNGLGKLGSGIRLWSHINPELLLGVFLPALLFESSFGMEVHQIKKCLAQMILLAGPGVIASTFCLGSLLKLTFPYNWDWKTSLLLGGLLSATDPVAVVALLKDLGASKKLNTIIEGESLMNDGTAIVVYQLFYDMVLGQEFSAGSIIKFLCEVSLGAVAVGLAFGIVSVLWLHYIFNDTVIEVTLTLAVSYIAFYTSQDAIKVSGVLSVMTLGMFYAVAARTAFKGETHESLHHFWELVSYIANTLIFILSGVVIGENVMSDKSSFESDGAKWGYLILLYVYVQLSRATVVGILFPFLRYFGYGLGLKEAAILIWSGLRGAVALALSLSVKRAGDSLESPSLKQDVGTSFVFFTGGIVLLTLIINGSTTQFLLHFFAMDKLPDAKIRILNYTKYEMLNKAMETFDDLGDDEDLGPVDWPTVKKYITCLNDLEGVQENPHTISESENQLHDMNLSDTRVRLLNGVQAAYWEMLEEGRITQTTGILLMQSVDEAMDTVSHETLCDWKALKAHVHFPKYYKFLQMSRIPQGLVTYFTVERLESACYISAAFLRAHRIARRQLREFIGESEIATAVINESEEEGQEARNFLEDVRISFPQVLCAVKAKQVTYSVLKNLSEYVQTLEKIGLLEEKEMLQLDDAVQTDLKKLLRKPPSVVMPKLKDLLDRHPLLGVLYKQVQVPFEKSTKEIMKTEGRTLYREGSKPKGIWLISSGVFKWASTTLSSRQSLHPDFLHGSPLGLYEVLAGKRFICDMVTDSLVHCFFIKAEKILPLLRSDPEVEELLWRESSIVIAKLLLPLVFENLPLQEVQGLLNERSRMDTYVSGESIEIPHNSVCILLEGSLESQDAHRSLIASPAVLLPSNVAPSFLNLESSGTVPASCCHRGNSYMVEAIARVVRFEIGANERRSPPQWRQSLCMPQSVGPQRLPVREQCGLLSWPENLQRARSHPQVLNAYGHQANNMSARGTGLHNFRSMV

SEQ ID NO: 63017 - protein, 174 aa, Prochlorococcus marinus str. AS9601
MKHTLSVLVEDESGALSRISGLFARRGFNIDSLAVGPAESKGISRLTMVVEGDDETLQQMTKQLNKLFNVLGVVDFTNLAAVERELMLLKVSSKEDTRSNILDIVQIFRAKVVDVSDMALTLEVVGDPGKLVALEKLLEPYGILEIARTGKVALKRSSGVNTEMLKINKYSLEI

SEQ ID NO: 63018 - protein, 304 aa, Kluyveromyces lactis NRRL Y-1140
MSMISARARLSLAQSLRINGGLRSFSNARVQLNQKQSNSDGFSGDSTTHFGSRTVLKEEKEKLVGNVFSSVASKYDVMNDVMSLGIHRLWKDHFINKLDAGKRPNSTEPLHFIDVAGGSGDIAFGLLDHAEQKFHDVESTMHIVDINADMLKEGEKRAMDQGKYYNDPRVTFLVQNGETLDQIESNSKDIYTISFGIRNFTDIQAGLNTAYRVLKPGGIFFCLEFSKIDNPLVNLIYQRWAQVLPVMGSVVANDYDSYQYLVESIERFPSQEHFKSMIEKAGFQSAGYENLSFGICAIHWGIKT

SEQ ID NO: 63019 - protein, 175 aa, Pseudomonas aeruginosa PAO1
MSYSKIPAGKDLPNDIYVAIEIPANHAPIKYEIDKDTDCLFVDRFMATPMFYPANYGFIPNTLADDGDPLDVLVVTPYPVAPGSVIRARPVGVLHMTDEAGGDAKLIAVPHDKLSVLYKDVKEYTDLPALLLEQIKHFFENYKDLEKGKWVKVEGWGNADAARAEITKAVAAFQK

SEQ ID NO: 63020 - protein, 325 aa, Oryza sativa Indica Group
MVEAEATKGPHRDLLDDAAISRRRWRRAAVAGGGSGRADTADTPHASSVVPLLCYVLPSLSDPKLACVASSFLSTSDSARRAALALIVATASSPLEQWMKRFEEAERLVADVVERIAERESVSPSLPQELQRRTAEIRRKVAILETRLDMMQEDLSQLPNKHACKSLKELNKLAAKHSTLSSKVKEVGAPFTRKRFSNRSDLLGPDDNHAKIDVSSIANMDNREIIELQRNVIKEQDDELDKLEETIVSTKHIALAINEELDLHTRLIDDLDEKTEETSNQLQRAQKKLKSVTTRMRKSASCSCLLLSVIAVVILVALLWALIMY

SEQ ID NO: 63021 - protein, 118 aa, Triticum aestivum
  misc_feature (14)..(14): Xaa can be any naturally occurring amino acid
  misc_feature (59)..(59): Xaa can be any naturally occurring amino acid
  misc_feature (101)..(101): Xaa can be any naturally occurring amino acid
VEENSFQHFQDALXHLDVKTKLTIRDGFKRVARSVKNRPVFPYAINRHVEHRDAKYTQXMETSGKFVDYRSIEIQTNPIDRCIALLLFYQPSYQVEGPVDXSSPLESHYENQKAYVNN

SEQ ID NO: 63022 - protein, 229 aa, Pseudomonas aeruginosa PAO1
MKQYGAEFFGTFWLVLGGCGSAVLAAGVPELGIGYLGVALAFGLSVLTMAYAIGPISGAHLNPAVSVGLWVGGRFPASQLLPYVVAQVLGGLAAGGVLYLIASGKAGFDLAAGFASNGYGEHSPGGYSLQAALVSEVVLTGMFLLIILGATSKRAPQGFAPIAIGLTLTLIHLISIPVTNTSVNPARSTAVALYVGDWAVSQLWLFWVAPILGAVLGALAYRLIGDKND

SEQ ID NO: 63023 - protein, 364 aa, Alkaliphilus metalliredigens QYMF
MKLGIVGLPNVGKSTLFNAITQAGAESANYPFCTIEPNIGVVAVPDYRLSNLKEMYNSQKVIPAAIEFYDIAGLVKGASKGEGLGNKFLSHIREVESIVHVVRCFEDSNVTHVDGNVDPLRDIETINLELILSDLESVEKRIPKLEKQVKLDKSLLPELELLHQLQGVLEQGLSARSQDLNEDQQKMLKEFTLLSAKPIIYVANVSEDEVGDGGSDNPHVTTLREFAMEEGSEVVVICAKIEAEISELEEEEKQGFLEDLGLTQSGLDRLVQASYSLLGLISYLTAGPKEVRAWTITRGMKAPQAAGKIHTDFERGFIRAEVVAFDKLMEAGSHTAAKEKGHVGIEGKDYIVKDGDVILFRFNV

SEQ ID NO: 63024 - protein, 511 aa, Nicotiana tabacum
MALLDLQLSTSLLFCLVPLLFLFFVKFKKTITNTLLSSNNSSKIPRSYPLIGSYFSILANHDRRIKWISDIILTTPNLTFTLIRPLNFRTIFTANPSNVQHVLKTNFQVYQKGHGSYSTLKDFLSNGIFNVDGDIWKYQRQVASHEFNTRSLRKFVETVVDTELSERLIPILATAAANKTVLDFQDILQRFAFDNICKIAFGYDPGYLLPSLPEAEFAVAFEDAVRLSTERFIVPFSLIWKIKRALNIGSEKKLRVAVEQVREFAKEIVREKQKELNDKSSLDSADLLSRFLSTGHSDEDFVTDIVISFILAGRDTTSAALTWFFWLISKHPEVESQIMKEVGEKSESLLLYDEVKNMMYTHASLCESMRFYPPVPMDSKEATKDDILPDGTFVKKGTRVTYHPYAMGRVEKVWGEDWAEFKPERWLDKDEVTGNWTFVPKDAYTYPVFQAGPRICLGKEMAFLQMKRVVAGVLRRFKVVPVVEQGVEPVFISYLTAKMKGGFPVTIEERI

SEQ ID NO: 63025 - protein, 487 aa, Nicotiana tabacum
MELGDNKILNAGLLLVATLVVAKLISALIMPRSKKRLPPVIKSWPILGGLLRFLKGPVVMLREEYPKLGSVFTLNLLNKNITFFVGPEVSAHFFKAPETDLSQQEVYQFNVPTFGPGVVFDVDYTIRQEQFRFFTESLRVNKLKGYVDQMVMEAEEYFSKWGDSGEVDLKYELEHLIILTASRCLLGEEVRNKLFEDVSALFHDLDNGMLPISVIFPYLPIPAHRRRDNARKKLAEIFANIIDSRKRTGKAESDMLQCFIDSKYKDGRATTESEITGLLIAALFAGQHTSSITSTWAGAYLLCNNKYMSAVVDEQKNLMKKHGNKVDHDILSEMEVLYRCIKEALRLHPPLIMLLRSSHSDFTVKTREGKEYDIPKGHIVATSPAFANRLPHVYKNPDTYDPDRFAPGRDEDKVAGAFSYISFGGGRHGCLGEPFAYLQIKAIWSHLLRNFEFELISPFPEIDWNAMVVGVKGKVMVKYKRRKLSTE

SEQ ID NO: 63026 - protein, 1161 aa, Oryza sativa Japonica Group
MSTRAPRSLLPLLFVAAAVAFFSRAATAADVIGQAGFITGNQTLVSSGGVFELGFFVPNGATDGRTYLGIWYASIPGQTVVWVANRQDPVVNVPAVARLSADGRLVIADAKNTTVWSSPAPARNVTAAGATARLQDDGNLVVSSGSPGSVAWQSFDYPTDTLLPGMKLGVDVKNGITRNMTSWTSSSDPSPGSYTFKLVPGGLPEFFLFRGPAMIYGSGPWNGAELTGVPDLKSQDFAFTVVSSPDETYYSYSILNPSLLSRFVADATAGQVQRFVWINGAWSSFWYYPTDPCDGYAKCGAFGYCDTSTPTLCSCLPGFQPRSPQQWGLRDASGGCVLTANLTCDGAGDGFWTVNRMKLPAATNATVYAGMTLDQCRQVCLGNCSCRAYAAANASGGVSRGCVIWAVDLLDMRQYSGVVQDVYIRLAQSEVDALNAAANSEHPSNSAVIAVVVATISGVLLLGAVGGWWFWRNRVRTRRNETAAAAAGGGDDVLPFRVRNQQHPASSVKRDQRLDVKRECDEKDLDLPLLDLKAIVAATDDFAASNKIGEGGFGPVYMGKLEDGQEVAVKRLSRRSVQGVVEFKNEVKLIAKLQHRNLVRLLGCCIDDDERMLVYEYMHNQSLDTFIFDEGKRKLLRWSKRFEIIVGVARGLLYLHEDSRFRIIHRDLKASNVLLDRNMVPKISDFGIARMFGGDQTTAYTRKVIGTYGYMSPEYAMDGVFSMKSDVYSFGVLVLEIVTGRRNRGFYEAELDLNLLRYSWLLWKEGRSVDLLDQLLGGSFDYSEVLRCIQVALLCVEVQPRNRPLMSSVVMMLASENATLPEPNEPGVNIGRHASDTESSETLTVNASACGRWRHRLLAGRSMDATQGHRVIGLEKLFPALRHDHTNVDLRPFTVQAPHMSYHRMTHRMKTLSSQCKHHLWGPQISSPTPNPQLVLLPRHPTAPALPSSAARSLAASAQVPAASAPVVSEHYGGGGGRRRCRRPRRRAPSPLRPTLPLPEGGDEEAERGGRRWRGRTTAAAAGEDSGGGGVLGLIFGKRRSGRAARDRRGQGRRLHPVRGYGARRTGWSGSGAHRAGWSAAEDLEGGLVRAAAADVLGRLVLAVVPEAEHFALSSSSFSGARLSGGGGGGSATIDVDASSSNRRRREGGERRMAAVSSSSR

SEQ ID NO: 63027 - protein, 337 aa, Fusobacterium nucleatum subsp. vincentii ATCC 49256
MMGQEKMKYLENLVGKTPMLELIFDYKGEERRIFVKNESYNLTGSIKDRMAFYILKKAYEKNEIKKGAAIVEATSGNTGIAFSAMGVILGHPVIIYMPDWMSEERKSLIRSFGAKIVLVSREEGGFLGSIEKTKEFAKNNPGTYLPSQFSNPYNSEAHYYGIGLEIVNEIKSLNLNIDGFVAGVGTGGTVMGIGKRIKENFPNVKICPLEPLNSPTLSTGYKVAKHRIEGISDEFIPDLVKLDKLDEVVSVDDGDAIIMAQKLAKCGLGVGISSGANFIGALMLQNKLGKDSVIVTVFPDDNKKYLSTDLMREEKIKEDFLSKDITLKGIKNVLRIF

SEQ ID NO: 63028 - protein, 854 aa, Oryza sativa Japonica Group
MASSSPLCCYLLLFVVVVVLTGSCRARDTVVPGRPLAANETLVSGGDANFVLGFFTPPGANSTYVGVWYNKVSVRTVVWVANREDPLPGDVADNPDATLSVSPTGTLAIVAGNSTVVWSVTPAAKLASPTARIMDSGNLVIADGAGGGVAWQGFDYPTDTLLPEMRLGVDYVKGRNRTLTAWKSPSDPSPGPVVMAMDTSGDPQVFIWNGAEKVWRSGPWDGVQFTGVPDTVTYSGFTFSFINNAKEVTYSFQVHNVSIISRLGLNSTGSYGLLQRSTWVEAAGTWNLYWYAPKDQCDEVSPCGANGVCDTNNLPVCSCLRGFTPKSPEAWALRDGRAGCVRSTPLDCQNGTDGFVAVEHAKVPDTERSVVDLGLSLEQCRKACLMNCSCTAYASANVSGGGRGHGAGTGCVMWTTGLTDLRVYPEFGQDLFVRLAAADLGLTSKSNKARVIIAIVVSISSVTFLSVLAGFLVWTRKKKRARKTGSSKWSGGSRSTGRRYEGSSHHDDDLELPIFDLGTIAAATDGFSINNKLGEGGFGPVYKPLCLVDQQGKLEDGQEIAVKTLSKTSVQGLDEFKNEVMLIAKLQHRNLVRLLGFSISGQERILVYEYMANKSLDYFLFEKSNSVLLDWQARYRIIEGITRGLLYLHQDSRYRIIHRDLKASNVLLDKEMTPKISDFGMARMFGSEETEINTRKVVGTYGYMSPEYAMDGVFSVKSDVFSFGVLLLEIISGRRNRGVYSYSNHLNLLGHAWSLWNEGKSLELADETMNGSFDSDEVLKCIRVGLLCVQENPDDRPLMSQVLLMLATTDATTLPTPKQPGFAARRILMETDTSSSKPDCSIFDSATVTILEGR

SEQ ID NO: 63029 - protein, 396 aa, Populus trichocarpa
MASASLLKSSPVLDKSEFVKGQTLRLPSASIVRCRSTAPSSLTVRAGSYADELVKTAKTIASPGRGILAMDESNATCGKRLASIGLENTEANRQAYRTLLVTVPGLGNYVSGAILFEETLYQSTTDGKKMVDVLVEQKIVPGIKVDKGLVPLAGSNDESWCQGLDGLASRSAAYYQQGARFAKWRTVVSIPNGPSALAVKEAAWGLARYAAISQDNGLVPIVEPEILLDGEHGIERTFEVAQKVWAEVFYYMAENNVMFEGILLKPSMVTPGAECKDRASPDQVAEYTLKLLHRRIPPAVPGIMFLSGGQSEVEATLNLNAMNQSPNPWHVSFSYARALQNTCLKTWGGRPENVQDAQETLLIRAKANSLAQLGKYTGEGESDDAKKGMYVKNYSY

SEQ ID NO: 63030 - protein, 194 aa, Ralstonia eutropha JMP134
MSALNKSDSRFLHSFLPNTTMPLYKLGELSPSVAETAFVAEEATVIGAAELASNVSVWPGVVIRADNEPIRVGEGSNIQEGAVLHTDPGFPIHIGKGVSVGHQAMLHGCTVGDGALVGIQAVILNKAQIGADSLVGAGALVTEGKVFPPRSLIIGTPAKVVRELTDEEVANLRANAEDYVRRAGLYKKSLTRIG

SEQ ID NO: 63031 - protein, 399 aa, Mesorhizobium loti MAFF303099
MSGSALYETFARAPLAFDHGEGTWLVTDKGERYLDFAGGIAVNSLGHSHPHLVAALTEQAAKLWHVSNLYEIPGQSRLGQRLVDATFADKVFFTNSGAEALECAIKTARRYHFVKGHPERFRVITFEGAFHGRTLATIAAGGQYKYLEGFGPKVEGFDQVGFDDIDAAEKAITPETAAILIEPVQGEGGIRPVPTQSLKRLRQLCDQHGLLLIYDEVQCGIGRTGKLFAHEWSGVAPDIMAIAKGIGGGFPMGACLATDEAAVGMTAGVHGTTFGGNPLAMAVGNAVLDVVLEDGFLEDVQRKALLMKQGLAAIADEFPDVVEDIRGTGLMLGLKCAMPNTKVNMALRDQHLLAVPAGDNVIRLLPPLTVTDAEIHEALNRIRAGAKGLADAIAVAAAK

SEQ ID NO: 63032 - protein, 303 aa, Mesorhizobium loti MAFF303099
MSVRHFTDLSTVSEGDLRFMLDDAVVRKARLKAGERTRPLEGKVLAMIFDKPSTRTRVSFDVGMRQLGGETIMLTGTEMQLGRSETIADTAKVLSRYVDAIMIRTTSHDRLLELTENATVPVINGLTDDTHPCQLMADIMTFEEHRGPVAGKTIAWTGDGNNVLHSLLEASARFRFNLNVAVPEGSEPAQKHIDWSKAHGGKLHFTRSPEEAVDQADCVVTDCWVSMGQEHRARGHNVFSPYQVNAKLMAHAKPDALFMHCLPAHRGEEVTDEVIDGPHSVVFDEAENRLHAQKAVLAWCLGA

SEQ ID NO: 63033 - protein, 349 aa, Lactobacillus rhamnosus
MKASMLEDLNKFSVKEIDIPSPKKDEVVVKVMAAGTCGSDSHKMISGWKYGYPAVMGHEFSGIVTQLGENVSNVSVGQHVAVAPFIPCFKCHYCQIGLFQMCENYSMLGQQKFGGFEQYVSVPARNVLDIGKMSFEEGALIEPMAVAAHAVMGIKPELGDTVAVFGLGTVGDLVVRLLISSGATNVIGIDIDDQKLEKGLDEGCTHVINSAKESLEEKIMEYTDGLGVDISMECAGSKITEEQTLLVTKRRGKVGFVGIAYSDVLLHQKAFENIFRHELTVTGFWNSYSAPFPGREWTNSIQLVNRGRIKIKDLITHRFELEDMQKAFNMITTRSESFNKVMFFPNGIN

SEQ ID NO: 63034 - protein, 812 aa, Oryza sativa
MAAAAARRGSSLLSRCLLSRPSAAASPAVPSALRRADGTQGLLPGILQRFSTAAVAEEPISPPVQVNYTQLLIDGKFVDSASGKTFPTLDPRTGELIAHVAEGDAEDINRAVHAARKAFDEGPWPKMTAYERSRILLRFADLIEKHNDEIAALETWDNGKPYAQAANIEVPMVARLMRYYAGWADKIHGLVVPADGPHHVQVLHEPIGVAGQIIPWNFPLLMFAWKVGPALACGNTVVLKTAEQTPLSALFASKLLHEAGLPDGVVNVVSGFGPTAGAALASHMDVDKIAFTGSTDTGKVVLELAARSNLKSVTLELGGKSPFIIMDDADVDHAVELAHFALFFNQGQCCCAGSRTFVHERIYDEFVEKAKARALKRVVGDPFKNGVEQGPQIDDEQFNKILRYIKYGVDSGANLVTGGDRLGDKGYYIQPTIFSDVQDNMRIAQEEIFGPVQSILKFNDLNEVIKRANASQYGLAAGVFTNNLNTANTLTRALRVGTVWVNCFDVFDAAIPFGGYKQSGIGREKGIDSLKNYLQICAGDGEDGRQWGSTAPWVVPRCGVRRAKAPGLVLLLCRRPAEPRPPSYPFFHLVGHGVFPGTGRSGWGAAGRKLPPNSPSISSFHSSPTSSKLAGLGGLIDPRCILSPARISPINLDDFVSPLPPPPVMPAAETVVVPAETAAVVAPLVVVSKEADSAGDEALDLRLFLQGRDGRCVVMELDFGVLCDNITFFVAMAPHPSSPPPPLLCVGGLLPSDRSGRGERRGWEGRGGAATSFLWRRPVAEPGRRRRSPPPSPVGVSRGRRGMRKGCGEKRS

SEQ ID NO: 63035 - protein, 295 aa, Pseudomonas aeruginosa PAO1
MIAAYQARCQARVDAALDALFVAPREELQRLYEAMRYSVMNGGKRVRPLLAYAACEALGGAPQRADAAACAVELIHAYSLVHDDLPAMDDDDLRRGQPTTHRAFDEATAILAADGLQALAFEVLADTRRNPQEHAVCLEMLTRLARAAGSAGMVGGQAIDLGSVGVALDQAALEVMHRHKTGALIEASVRLGALASGRAEPASLAALERYAEAIGLAFQVQDDILDVESDTATLGKTQGKDQAHNKPTYPALLGLEAAKGYALELRDLALAALDGFPPSADPLRQLARYIVERRN

SEQ ID NO: 63036 - protein, 233 aa, Moorella thermoacetica ATCC 39073
MTKEEYVRGIFDTIAHRYDLLNTLLSFNCDRGWRRFTVARTGLKPGDRALDVCCGTGMLSLELARAVTPGGRVVGVDFSPAMLQVARRRLAASPYGAAVELVEGNAMNLPFADNTFDCATIAFGLRNLPDVKGGLAEMQRVVRPGGRVVSLELAKPSRPIFKQVYYLYFDHLVPLLGRLGIGQDGPYSYLPRSLKGYPHQEEVLQYFHDLGFTGARYFELTGGIVAVHVGVKV

SEQ ID NO: 63037 - protein, 627 aa, Pseudomonas aeruginosa PAO1
MPKTLHEIPRERPATPLLDRASSPAELRRLGEADLETLADELRQYLLYTVGQTGGHFGAGLGVVELTIALHYVFDTPDDRLVWDVGHQAYPHKILTERRELMGTLRQKNGLAAFPRRAESEYDTFGVGHSSTSISAALGMAIAARLQGKERKSVAVIGDGALTAGMAFEALNHASEVDADMLVILNDNDMSISHNVGGLSNYLAKILSSRTYSSMREGSKKVLSRLPGAWEIARRTEEYAKGMLVPGTLFEELGWNYIGPIDGHDLPTLVATLRNMRDMKGPQFLHVVTKKGKGFAPAELDPIGYHAITKLEAPGSAPKKTGGPKYSSVFGQWLCDMAAQDARLLGITPAMKEGSDLVAFSERYPERYFDVAIAEQHAVTLAAGMACEGMKPVVAIYSTFLQRAYDQLIHDVAVQHLDVLFAIDRAGLVGEDGPTHAGSFDISYLRCIPGMLVMTPSDEDELRKLLTTGYLFDGPAAVRYPRGSGPNHPIDPDLQPVEIGKGVVRRRGGRVALLVFGVQLAEAMKVAESLDATVVDMRFVKPLDEALVRELAGSHELLVTIEENAVMGGAGSAVGEFLASEGLEVPLLQLGLPDYYVEHAKPSEMLAECGLDAAGIEKAVRQRLDRQ

SEQ ID NO: 63038 - protein, 271 aa, Pseudomonas putida KT2440
MNMSTEDPRFAGVARLYGDQGLQRLGQAHVAVVGIGGVGSWVAEALARSGVGEITLFDLDDVCVSNTNRQAHALEGQVGRPKVEVMAERLRAINPACTVHAVADFVTRETMAEYITEHLDCVIDCIDSVMAKAALIAWCRRRKIAIVTTGGAGGQIDPTQIQIADLNKTFNDPLASRVRSTLRRDYNFSRNVSRNYGVPCVFSSEQLRYPKGDGSVCLQKSFVGEGVRLDCSGGFGAVMMVTATFGMVAASKAIEKLVAGARRPSERVKPE

SEQ ID NO: 63039 - protein, 198 aa, Populus trichocarpa
MTSSELAEVFEEAGRVFGAEVICDRVTDRSRGFGFVTMESVEEAKEAIRMFNGSQVGGRTLRVNFPEVPRGGEREVMEPRIRSGYKGFIDSEHKIYAGNLGWRLTSEGLGDAFANQPGLLSAKVIYERDTGRSRGFGFVSFDSAENAEAALEAMNGEEVDGRPLRLNLAGERSYPPPAKENNTEDNLESSELLSSIGA

SEQ ID NO: 63040 - protein, 87 aa, Nicotiana glauca x Nicotiana langsdorffii
GQGRCPRDALKLGVCANLVGGLVGAIVGSPPTLPCCSLIAGLADLEAAVCLCTAIRANVLGINLNVPLSLSLVLNNCGRNPPTGFTC

SEQ ID NO: 63041 - protein, 268 aa, Triticum aestivum
  misc_feature (253)..(253): Xaa can be any naturally occurring amino acid
  misc_feature (257)..(257): Xaa can be any naturally occurring amino acid
HYRTSLYKKAGWYRSGIPGISSTHASGHFDCAADYKNEAEVGDALAEAFQTGLVKREDLFITTKLWNSDHGHVVEACKDSLKKLRLDYLDLYLIHFPVATKHTGVGTTGSALGDDGVLDIDTTISLETTWHAMEDLVSMGLVRSIGISNYDIFLTRDCLAYAKIKPAVNQIETHPYFQRDSLVKFCQKHGICVTAHTPLGGSTANTEWFGSVSCLDDPVIKSLAEKYGKTPAQLVLRWGLQRNTVVIPKTSRXERLXENFAVSDFDIS

SEQ ID NO: 63042 - protein, 121 aa, Zymomonas mobilis subsp. mobilis ZM4
MAQTIMTVDDSPSMRMLLRAALGKMGYTIIEAEDGIDAMEKLSNNRPDLLITDINMPRMDGFGLIESVRQDDSWRNMPILVLTTETSDEKKQRARIAGATGWIVKPFSPDKLAAAIRRVLH

SEQ ID NO: 63043 - protein, 274 aa, Zea mays
GVPPSEEHNQEELKKYGQDATNVGDEGGFAPNIQENKKGLELLKAAIEKAGYTGKVFIGMDVAASEFFSEKDKTYDLNFKEENNDGSNKISGDSLKDLYKSFVSEYPIVSIEDPFDQDDWTTYAKLTGEIGQQVQIVGDDLLVTNPTRVAKAINEKTCNALLLKVNQIGSVTESIEAVRMSKRAGWGVMASHRSGETEDTFISDLSVGLATGQIKTGAPCRSERLAKYNQLRLGSRKSSVLPQSTPERSSEHQWSPTEPRVPRAWRKKMRMFPH

SEQ ID NO: 63044 - protein, 267 aa, Populus trichocarpa
MYEQVKAIKDGTAVEKPIYNHVTGLLDPPELIKPPKILVIEGLHPMYDQRVRDLLDFSIYLDISNEVKFAWKIQRDMAERGHSLESIKASIEARKPDFDAYIDPQKQYADAVIEVLPTQLIPDDNEGKVLRVKLIMKEGVEFFSPVYLFDEGSSISWIPCGRKLTCSYPGIKFSYGPDAYYGHEVSVLEMDGQFDRLDELIYVESHLSNISTKFYGEVTQQMLKHADFPGSNNGTGLFQTIVGLKIRDLFEQIVASRAKTPVEATKA

SEQ ID NO: 63045 - protein, 452 aa, Staphylococcus epidermidis RP62A
MAENLQRELSNRHVQLIAIGGAIGTGLFLGAGQTIAMTGPSILLTYIIIGFMLFMFMRGLGEIIIQNTNFKSFADVTNTYIGPFAGFVTGWTYWLCWIITGMAEVTAVAKYISFWFPDIPNWISALFCVLILMSFNLLSAKLFGELEFWFAIIKIVTIIALIVIGVIMILFAFKTPFGNTSLTHLYQHGIFPKGASGFFMSFQMALFSFVGIEMIGVTAGETKDPEKTIPKAINSVPIRILIFYVGALAVIMSIIPWDKVDPDNSPFVRLFALIGIPFAAGIINFVVLTAAASSCNSGIFSNSRMLYGLSNQNQAPPTFASTNKHGVPHKAIIASSALLLIAALLNYIFPDATLVFTYVTTISTVLFVVVWALIIIAYINYSRKNPELHKKATYKLPGGQYMGYLILIFFVFVFALLFINVDTRRAIYCTPIWFILLGLMYLRYKKADKEAR

SEQ ID NO: 63046 - protein, 370 aa, Pseudomonas syringae pv. phaseolicola 1448A
MIKSRAAVAFEAKKPLEIVEVDVAMPKAGEVLLRVVASGVCHTDAYTLSGADPEGIFPSILGHEGGAIVEAIGEGVTSVAVGDHVIPLYTPECRQCKFCRSGKTNLCQAIRATQGKGLMPDGTTRFSYKGEPIFHYMGTSTFSEYTVLPEISVAKIDKQAPLEKVCLLGCGVTTGIGAVLNTAKVKPGDTVAIFGLGGIGLSALIGAVKAKASRIIAIDINPAKFEIAKQLGATDCVNPKDFDRPIQEVIVDMTDGGVDFSFECIGNVQLMRAALESCHKGWGESVIIGVAGAGQEISTRPFQLVTGRVWRGSAFGGVRGRTELPSYVDMAQTGEIPLDTFITHTMGLEDINKAFDLMHEGKSIRTVIHF

SEQ ID NO: 63047 - protein, 254 aa, Triticum aestivum
  misc_feature (76)..(76): Xaa can be any naturally occurring amino acid
  misc_feature (253)..(253): Xaa can be any naturally occurring amino acid
GIAQGPEDPILGVTVAYNKDPSPVKVNLGVGAYRTEEGKPMVLNVVRRAEQMLIQNESRVKEYLPITGLADFNKLXCLSGTGSLRVGGEFLARHYHERTIYIPQPTWGNHPKVFTLAGLTARSYRYYDPATCGLDFQGLLEDLSSAPSGAIVLLHACAHNPTGVDPTLEQWEQIRQLMRSKALLPFFDSAYQGFASGSLGQRCPTSAHVPSADGGELLHGSKATPRTWDLYGERVGALTSFVGNADKLLRLKXT

SEQ ID NO: 63048 - protein, 191 aa, Glycine max
  misc_feature (101)..(101): Xaa can be any naturally occurring amino acid
  misc_feature (158)..(158): Xaa can be any naturally occurring amino acid
  misc_feature (185)..(185): Xaa can be any naturally occurring amino acid
SSQLRRAPPPQAVSTVTEEAPTPLRVVQMEGLAVLKIIKHCEEFAPALVTGQLLGLDVGSVLEVTNCFPFPIREEDDEADADGANYQLEMMRCLREVNVDXNTIGWYQSCLLGSFQTVELIETFMNYQESIRRCVCIVYDPSRSSQGVLALKALKLTXSFMDLYRNNGLTGEKLREKKLSWVDIXEEIPIK

SEQ ID NO: 63049 - protein, 309 aa, Arabidopsis thaliana
MPSFNSSGNLAVAVALLFAGALYFYFSSITVSDPMSDLLHNVETRWTEYPVDELEAVLDKAAMGNNKTVIIAMVNKAYVEEVEGGRTMLDLFLESFWEGEGTRPLLDHLMLVAADQTSYDRCLFRRLHCYKMDTDGVDLEGEKDTDVMWLRSPFPRLSYNESLDMQISVDSIGLVGGHLINTGFYHVRSNNKTISLFQKWYDMRLKSTGMKEQDVLKSLLDSGFFNQLGLNVGFLNTTEFSGFCQDSHDMGVVTTVHANCCRHILAKISDLTLVLRDWKRYKASHVNSNWSPHVECGRSWSDTHYIPKL

SEQ ID NO: 63050 - protein, 187 aa, Triticum aestivum
  misc_feature (152)..(152): Xaa can be any naturally occurring amino acid
  misc_feature (165)..(165): Xaa can be any naturally occurring amino acid
  misc_feature (173)..(173): Xaa can be any naturally occurring amino acid
MEQYEVVEQIGRGAYGTAYLVHHKAEKKRYVMKKIRLTKQNDKFQRTAYQEMSLMASLSNPYIVEYKDGWVDEGTSVCIVTSYCEGGDMAQRIKKARGVLFSEERVCRWFTQLLLALDYLHCNRVLHRDLKCSNILLTKDNNIRLADFGLAXKLLMEDLASSVVXTPNYMCPXILADIPYGYKSDIW

SEQ ID NO: 63051 - protein, 322 aa, Chlamydomonas reinhardtii
MADSQPTEPATGSNPNTHFFRPNDGIYVSEGAEHRTICVSPHLPPSMSRNGTDWHVEQFELHKELYRGKTSLLYMATDRISGVQVALKLYRKRKLSVLNRYQVEREVRLHINLHHENIIHLFAAFEDEKHVYMVQEFAVCGDLFEDLKKGGGQLKEKYAVRDVIVPFLSALSYLHGMGIIHRDIKPENILLGANKTIKVADFGLSINIHHERPVTRAGTLDYMAPERLMISSVGQRAQVDSWAVGILAYELLVGYPPFEQESRAATYEHIMYKEAKFPSWMSEEARRFIGLALCKNASQRPTIADLLTHAWVQPYLVRHPPG

SEQ ID NO: 63052 - protein, 512 aa, Oryza sativa Japonica Group
MGLCSSSSARRDAGTPGGGNGAGNKDNAGRKGIVACGKRTDFGYDKDFEARYALGKLLGHGQFGYTFAAVDRRSSERVAVKRIDKNKMVLPVAVEDVKREVKILKALQGHENVVHFYNAFEDDNYVYIVMELCEGGELLDRILAKKDSRYSEKDAAVVVRQMLKVAAECHLHGLVHRDMKPENFLFKSTKEDSSLKATDFGLSDFIRPGKHFRDIVGSAYYVAPEVLKRKSGPESDVWSIGVITYILLCGRRPFWDKTEDGIFKEVLKNKPDFRRKPWPNITPCAKDFVQKLLVKDPRARLTAAQALSHEWVREGGQASDIPLDISVLHNMRQFVKYSRFKQFALRALASTLNAEELSDLRDQFNAIDVDKNGTISLEELKQALAKDVPWRLKGPRVLEIVEAIDSNTDGLVDFEEFVAATLHVHQLVEHDTEKWKSLSQAAFDKFDVDGDGYITSDELRMQTGLKGSIDPLLEEADIDRDGKISLDEFRRLLKTASMSSRNVQTPRSVHRS

SEQ ID NO: 63053 - protein, 400 aa, Bordetella parapertussis 12822
MSIVADKIKRIKLSPSVATRAIVAQLREEGRRVIDLTVGEPDFSTPAHICEAAIAAMQRGETKYPPAQGTMALRKAVRARLREETGVDYPEGHIIVGTGAKQVLYNGLAATLNEGDEVIIPAPYWVSYPDMVLVNGGVPVAVTATPATQYKLTPQALEAAITPRTKWLMMNAPSNPTGAIYTADEWRGLAEVLRRHPHVWLMTDDIYARLNFTATPTVHPLQVAPELAERTLVVNGVSKAYAMTGWRIGYGAGPEALIKAMAILQSQSTSGACSISQAAAREALAGPQDCVAEFARTFKARRDAAVAALQGAPGLSVVMPEGAFYVFPDCAGVLGKTTPDGRVLETDTDFVHYLLREAGVAVIDGTPYGVPGTFRLSFAAALEDIQQGCAAIRAACERLA

SEQ ID NO: 63054 - protein, 205 aa, Pseudomonas aeruginosa PAO1
MSVVFVAASKLPTPFGEFTMHGFLDEESGKEHVALSMGDIADGAPVLGRLHSECLTGDALFSLRCDCGFQLEGALAAIAEEGRGVLLYLRQEGRGIGLLNKIRAYELQDGGADTVEANLQLGFGADQRDYAMCQPMLAHLGVSSLRLMTNNPRKVKALESYAITVAERVPLQKGLNKHNRRYLATKAGKLGHMLGSLHQGEAETT

SEQ ID NO: 63055 - protein, 355 aa, Lactobacillus plantarum WCFS1
MNKYLTLADGTQWIGTAIGDCQLEAAGRIVFNTGMTGYQETLTDPSYLNQMIAFTYPLIGNYGIDPTVAQAPTIGAQAIIVHELATFNDHYTSRQSLASFLTIHHVAGIEGVDTRDLTIHIRQTGAQMAILSNHPITDFEAQLATFAPQVLTATPLPVATTTIRPRVAILNFGEKAAITAELQARGADVVVLPPTASLKAVAAYHPDGILLSNGPGDPTDYHTYLATIRQLAQRYPLAGICLGHQLIALAYGAQTYQLSFGHHGLNHPVQACADGRIIMTSQNHDYAVDPASIKGTPLIVTHTELNDGSIEGLRLPHQAVMSVQFHPEAHPGPQEAGQFFDDFLLTIQKEAVVNA

SEQ ID NO: 63056 - protein, 401 aa, Pseudomonas putida KT2440
MFQPSPWRADFPAIAALQRQHQTYLDSAATTQKPQALLDALSHYYGHGAANVHRAQHLPGALATQAFETSRDKVAAWLNAADSRQIVFTHGATSALNLLAYGLEHRLEAGDEIAISALEHHANLLPWQQLAHRRNLHLVVLPLDAHGRIDQDQALQLIGPRTRVLAISQLSNVLGTWQPLPALLAHARAQGALTVVDGAQGVVHGRQDMQQLGCDFYVFSSHKLYGPDGVGVLYGRAQALELLRHWQFGGEMVQLAEYHSASFRPAPLGFEAGTPPIAGVIGLGATLDYLASLDAHAVAAHEASLHQHLLRGLGDREGVRVLGAPQTALASFVIEGVHNADIAHLLTEQGIAVRAGHHCAMPLLKGLGLEGAIRVSLGLYNDSDDVQRFFDALDQGLELLR

SEQ ID NO: 63057 - protein, 248 aa, Lactobacillus plantarum WCFS1
MTKLIVIKIGGQAISQLSTTFFDQIAQWYQQHYQILIVHGGGPMINRLTTQLALPVHKVNGLRVTDAATLVLTKLALLGDAQPALLAKLTQHHLPVLGLNAADNQLLTGELIDYRQLGYVGRLTAVNQVQLMQLLAHHIGILAPLALTETGQWLNVNADMAATVLAQQLHAEKLVLLTDVPGIIHHGNVMTSLSPQQAQQLIRTAVITAGMQPKVQAAIAAIQTGVKQAIITNAIDQPGTAIIQEVAV

SEQ ID NO: 63058 - protein, 340 aa, Lactobacillus plantarum WCFS1
MNNQFEGRSFLKEIDYTPTELAYLIDFASHLKTLKAHHIPHPYLQGKNIALLFEKTSTRTRSAFTVAANDLGANPEFLCKDDIQFGTKESVVDTAKVLGSMYDGIEFRGFKQSTVEDLATYSGVPVWNGLTDEWHPTQILADFLTLKEHFGHLKGLTLAYVGDGRNNMANSLLVAGAMLGINIAIGSPVALQPAPAVVALAQQYAQAAGSTVVITADPQQAVTQADALYTDVWVSMGEQVDYGERIKQLLPFQINTALLAATGKSSTIVMHCLPALHDLKTQLGAKLGEQYGMTAFEITDDVFQSKQEVVFEEAGNRMPAIKAVMAATLGNLFIPTSIFN

SEQ ID NO: 63059 - protein, 158 aa, Pseudomonas aeruginosa PAO1
MTLKTIEGTFIAPKGRYALVVGRFNSFVVESLVSGAVDALVRHGVAESEITIIRAPGAFEIPLVTQKVAQQGGFDAIIALGAVIRGGTPHFEYVAGECTKGLAQVSLQFGIPVAFGVLTVDSIEQAIERSGTKAGNKGAEAALSALEMVSLLAQLEAK

SEQ ID NO: 63060 - protein, 226 aa, Methanothermobacter thermautotrophicus str. Delta H
MEVFMNLKKMAALRAVDEIDDGDVVGLGTGSTTHYFIEELGRRVREEGLEVMGVPTSYQSMFLAAESGIKVTSLAEHDVDVAVDGADEVDPDLNLIKGGGAAHTLEKIVDSSAASFIVIVDESKLVERLGAFPLPVEVIPAACRPVKLKLESMGASVNIRSSEGKDGPVVTDNGNFVLDAAFGVIDDPGAMESRLNNIPGVVENGIFAGIADMVIAGTSEGLKILR

SEQ ID NO: 63061 - protein, 400 aa, Erwinia carotovora subsp. atroseptica SCRI1043
MPDIADRLNNIAISASVAMTQKARDLAAQGIDVVGLSTGEPDFPTPVHAIEAAYAAALAGDTRYPPTDGTPTLRAAIQRKFKRDNHLNYDISQIITSGGARQIIFNAMMATINPGDEVVIPTPSWISYADIVKFAGGTPVPVACREEHGFKPLSQDIAHAITPKTKWLLLNYPSNPTGSVASRSELQAIADVMLDNPHVWVMTDDIYEHLIYDDCEFLTMAQVEPRLFDRVLTVNGVSKAYSMTGWRLGFCGGPVALIKAMSNVNTQNAGGIATLAQAAAIAVLDGPQDLLKERAAIYRQRRDFVLEKLAAIDGLRCHKPQGAFYLFVNIAHFIGKTSAGGRRIESDADFVMALIEEQHVVTVQGAAYGMSPYIRLSYATSMERLETGCARLGAFCNGCH

SEQ ID NO: 63062 - protein, 365 aa, Pseudomonas aeruginosa PAO1
MALNTIDELIEDIRQGKMVILMDDEDRENEGDLIMAAECVRTEDINFMVKHARGLVCMPMTRERCERLGLPLMVQRNGSGFGTKFTVSIEAAEGVTTGISAADRARTVQAAAAKNAVAADIVSPGHIFPLMAQPGGTLARAGHTEAACDLARMAGFEPSGVICEVMNDDGSMARRPELEAFAAEHGIKIGTIADLIHYRLIHERTVERIAEQPLDSELGHFNLITYRDSVEGDVHLALTLGKVCAEEPTLVRVHNMDPLRDLLQVNQPGRWSLRAAMTKVAEAGSGVVLLLGHQIGGDDLLAHVREIASAPAPAPKATTTYSTVGAGSQILRDLGVRKMRLLSAPMRFNAISGFDLEVVEYLPAE

SEQ ID NO: 63063 - protein, 143 aa, Zea mays
MWNGFLMILNRLPQGVLLIGRYHDYFTRSAQPQSHRLASQSYSHCRTHPSPSSSGLALPSRRSPRPAAATRPASIAMTTSRRLADRKIARFEKNITKRGSVPETVKKANDYPVGPILLGFFVFVVVGSSLFQIIKTASNAGLF

SEQ ID NO: 63064 - protein, 773 aa, Vitis vinifera
MGGRKSGGWKRLVKRLALMRCGESKHQKPTLRAICRGFSLRFRWWAHLPAGGLFESQVLSPGWWLWNQLSGADGQMRKQQLLEDMQRIQTNLEQRVWAAAGYKPSSLCLKRVAQCWASCLSLAVNFATFTRKCFEGAQIKKMVVLGVRLVINDRFGIVEGFMTTVYSITATQKIVDDPLMLDYNIAIPSEDMPAGTEVMAHTGVPMSIDEELRPAAAPWCPQQLIKLRCDIFVPAIDSLVLTLVHGDHASQITFSNTHYLNERRRCIQTRAPVGLVVIFRRGLTRLNLWARICNGMDAGVMLVASFDLVQEGQEHGIGNWVMVGILARGIFIWLCKKFLEQYGEVSMLDIKGAEAAKVVLVIGITTLHSFGEGEVISGKQALTPSAPSGDLDTFRFWADQIRHLKVMANADTLDDALTARNNGTQGSGLCRTEHMFFASDERMKALLLGGKGGESLNFRLLSYLRDAVTAVGCLQPVKPLRQRIVARCSGTHSFPLWWCNEIYVGHVGHPFKSCRGPQASIRKGDHEWTNAFIEDILVPVDAFRLFDRLGRRIPHEERFSIPRIPAVVELCIQAGVDLPEFPTKSEFIDADESELPDPVPEVPKTPLLTEIPDSEIEPPSSAEETALLAEETLKAWEKMKGGAKKLMRMYPAGAAVPEQYKPTMRLDVGIPTYIKEAEMCRSLKMATPARDGKKAGEAGAPKMPAAGQHSTEVLHQRSKLPHSPLKLAIGGLAFVAALSYFTLYTKKKPEASALDVAKVVAGVSTPEDTHPRK

SEQ ID NO: 63065 - protein, 455 aa, Photobacterium profundum SS9
MNARDVKTIDDAKKIITERKITHVKVGLFDNDGVMRGKYMSKSKFFSSLEHGFAFCDVVLGWDVKDQLYDNAQYTGWHTGYPDAPVRIIPESCRDVLDEDGMLLFIAEFTEDAEKVCPRATLRRVLQLADKMGFNVQAAFEYEFFLFNETPHSAREKGFSNLETITPDWFGYSMIRNSTYSGLYKSILAMGEKMDFPIESIHSETGPGVIEAAITVDQAINAADKAALFKTYMKVLAQKNDLLATFMAKWSNDYPGQSGHIHISLQNKDGSSAFFEANNDLNMSDIQRHFLAGQQRLMPEILCMIAPTINSYSRMIPGFWAPTEATWGVENRTTALRLIKGSEKSQRVEYRIGAADANPYLALAAALASGLYGIAQQWEPFEQVIGNAYDQQHPQELQLPHTLWEAAQRFKASNAAREMFGNEFVDHFAASREWEEREFRKHVTDWELNRYFEII

SEQ ID NO: 63066 - protein, 331 aa, Lactobacillus casei
MTIAVLGGAGYIGSHTVKQLLAAGEDVVVLDNLITGHRKAVDPRARFYQGDIRDYHFLSQVFSQEKIDGIVHFAAFSIVPESMKDPLKYFDNNTGGMITLLEAMNQFGIKKIVFSSTAATYGEPKQVPIKETDPQVPTNPYGESKLAMEKIMHWADVAYGLKFVALRYFNVAGAMPDGSIGEDHHPETHIVPIILQVAAGTRTGLQIYGDDYPTKDGTNVRDYVHVVDLADAHILALKYLDAGNKSSAFNIGSAHGFSNLEILNAARKVTGQEIPATMGPRRAGDPSTLIASSEKARDILGWKPNYDDIDKIIETAWNWHENHPEGFGDRN

SEQ ID NO: 63067 - protein, 583 aa, Burkholderia sp. 383
MRRLVVLTLLSAMSVCAFAASDPAVEAKNGMVVSSQHFASQIGVDILKEGGNAVDAAVAVGYAQAVTNPCCGNIGGGGFMTVHLADGRDRFINFRETAPAAASANMYLDAKGNVIPDDSLYGYRAVGVPGTVAGLDLAQRKYGKLTRKQVMAPAIRLARDGFVLTRGDTDILDTTIDRFKKDPDAARIFLRPDGTPLQPGDRLVQKDLARTLERIAEQGPDAFYHGEIPKIVEAAAKKGGGLITAADFASYRAQDIAPLTCSYRGYEFVSAPPPSSGGVTMCETLNILEGYDMRKLGYHSAAAVHYMTEAMRHAYEDRNTLLGDPNFIDNPVAKLTSKEYAAQIRKSIHSDTATPSVDVQPGVGVHEKPETTHYSIIDKDGNAVSTTYTVNGRFGAVVIAPGTGFFLNDEMDDFTVKVGAQNLFGLVQGTRNSIAPGKRPLSSMAPTIVKKDGKVFMVVGSPGGSRIITITLQTVLNVIDYGMTPQDAVTAPRIHHQWLPDEVYYETYGLSPDTLAILRNMGYKMVEQTPWGAAELIMVGLPGTEAASRQSSGNDSSVSGNVRVGFIYGYNDPRRPAGSAIGY

SEQ ID NO: 63068 - protein, 2114 aa, Gibberella fujikuroi
MGLNEDFDDRHIQTEAEQQPYIPYEYQTENNDSWAGALPVKQGLYDPSYEKDACGVGFACHIKGKPSHKIVSDARNLLCNMTHRGAVGSDARDGDGAGVMTSIPHRFFIKNFEKEEDIKLPPLGQYAVGNLFFKPDEETLQESKRQLEDVAESLGLRVLGWRRPPVDSTLLGPAAKSREPIIAQPFVVLASAYGTGNAPEMTDPEKFDERLFERQLYILRKRATQSIGLHNWFYLCSLSNKNIVYKGQLAPVQVYSYYHDLVNADYEAHFALVHSRFSTNTFPSWDRAQPLRWAAHNGEINTLRGNKNWMRAREGVMQSDIFKEELEQMYPVVEDGGSDSAAFDNVLELLTINGVLSLPEAVMLMVPEAWQGNQHMDPKKAAFYEWAACQMEPWDGPALFTFADGRYCGANLDRNGLRPCRFYVMDDDRIICASEVGTIPVEPETVIQKGRLQPGRMLLVDTQAGRIIDDKELKEAVSSRYDFRAWLDSELITLPKVVEIMEQALDLAPKLDDKAIQADPLLLSYGYTHEQVSLLLAPMAADEKEALGSMGNDAPLACLTQAPRLLYDYFRQLFAQVTNPPIDPIRESIVMSLECYVGPQGNLLEMDASQCGRLLLPSPILSIEEFNAVKNMSNKYSEWTVKTIDLTFPKNQGIQGYIKHLDEICNEASAAIESRDRVIVLSDRNTSADRVPVSAVLASAMVHHHLVSNKWRSMVALVVETAEAREVHHMCVLLGYGADAINPYLAMECILKLNREGLIKKKTTNETLIRNYKHACDGGILKVMSKMGISTLASYKGAQIFEILGLDETVVERCFRGTASRIQGMTFELPIAEEAFRFHERGFPTRETILPSGLPESGEYHWRDGGEPHVNDPTSIANIQDAVRTKNDKSYEAYSRSEYEQIKNCTLRGLLDFKFEDCTPVPIDQVEPWTDIVRRFCTGAMSYGSISMESHSTLAVAMNRLGGKSNTGEGGEDPERSQRMPNGDTMRSAIKQVASGRFGVTSAYLADSDELQIKMAQGAKPGEGGELPGHKVSKSIARTRHSTPGVGLISPPPHHDIYSIEDLKQLIYDLKCSSPRSRVSVKLVSEVGVGIVASGVAKAKADHILISGHDGGTGASRWTGIKYAGLPWELGLAETHQTLVLNDLRGRVVVQTDGQLKTGRDVALACLLGAEEWGFATAPLIAMGCVFMRKCHLNTCPVGIATQDPEVRKKFTGTPEHVINFFYYVANELRAIMAQLGFRTINEMVGHVEVLKMRDDLRTHKTANIDLSLLLTPAHKLRPGVATFNVRKQDHKLHVRLDNKLISESELTLDKGLPSRIECDIVNTDRAMGTSLSYHISKRYGEAGLPMDTVHVNIKGSAGQSFGAFLAPGVTLELEGDANDYVGKGLSGGRLIVYPPRSAVFQSEENILIGNTCLYGATTGTCFFRGVAAERFAVRNSGATAVVEGVGDHGCEYMTGGRVVVLGSTGRNFAAGMSGGIAYISDVHGDFHSKLNGEMVETSDFEDPAEIAFVRGLIEDHHHYTGSERAARILVDFNRALPRFIKILPVDYKRVLEEEAAKAAEAKRAEYNLPAVSGVQHKKSEKVAKLQDLEEAVGDNAAEKKRALVLDKTRGFKMYKRRQEKYRPVNSRLKDWAELSSRLDEDELKYQSARCMDCGVPFCQSETGCPISNIIPKWNELVFQNQWKDALNRLLMTNNFPEFTGRVCPAPCEGACVLGINEDPVGIKSIECAIIDRGFEMGWMVPQPPKVRTGKTVAIIGSGPAGLAAADQLNRAGHLVTVYERADRLGGLLMYGIPNMKLDKRIVKRRTDFMASEGIIFKTGVAVGEEGHPSLNDLRASNSAVVIATGATVARDLPIKGRQLDGIHYAMEFLHKNTKSLLDSELADNTYISAKGKDVVVIGGGDTGNDCIGTSLRHGAKSVTNFELLPQPPPERANDNPWPQWPRIYRVDYGHTEVRQHTGKDPREYCIMSEEFMDDGSGKVKGINTIRVEWTKSPSGGWDMKKVEGSQQFFPADLVLLAMGFLGPEARVLGDEIEKDARKNVKTAPGKYSTNLEGVFAAGDARRGQSLIVWGINEGRQAAREIDLYLEKYTNLPVTGGITKRTAQEIFSQIKVEA

SEQ ID NO: 63069 - protein, 415 aa, Physcomitrella patens subsp. patens
DWTLYAPDECVASVFRKLPTADRNRCALVCKRWHRVEGQGRQRLSLHAVAELGLALPGLLDRFPHITKLALKCDRRTVSIDDETLCSVGRACRQLQKVKLKACKGLSDRGLEEFAELVSGTLRKFSCGSCQFGPRGINAVLYHCSNLEDLTVKRLRGFVMPNPSTAEHVLPGSCSIKRLCVKDLPSAQLLGPLIAGSKSLHTLILSRVPGNWDLLLEIITEHTTSPVEFHMEKVGVTDRGLKAVARWSNLQVLYLVKPTECTNQGLSAVASGCPLLRKLHVDVMKSSRVGDEGLLMVARKCRHLQELVIIGVSATSASLSLVASECSRLERLAICTSDTFGDPELSCIADKCLALKKLCIKGCPISDRGMEALVSGCPSLVKMKVKKCRNVTPASVACLNSNRVSLVVTLDAPST

SEQ ID NO: 63070 - protein, 124 aa, Oryza sativa Indica Group
MATVTRAHLEQRLALAKRCSREANIAGVKAAAVATIASAVPTSSFISRAHQLASVRMLPWAKANINPTGQALIICTAAGMAYFVAADKKILSLARRHSFENAPEHLKNTSFQGTGRPHPAFFRP

SEQ ID NO: 63071 - protein, 405 aa, Vitis vinifera
MAKKSVGDLTGADLKGKKVFVRVDLNVPLDDNQKITDDTRVRAAIPTIKYLIDNGAKVILSSHLGRPKGVTPKFSLAPLVPRLSELLGIQIVKADDCIGPEVEKLVTALPDGGVLLLENVRFYKEEEKNEPEFAKKLASIADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLSLATSLLEKAKAKGVSLLLPTDVVIADKFAPDANSKIVPASAIPDGWMGLDIGPDSIKIFNEALETTKTVIWNGPMGVFEFDKFAEGTVAVAKKLAELSGKDVTTIIGGGDSVAAVEKVGVADVMSHISTGGGASLELLEGKELPGVVALDEATPVPV

SEQ ID NO: 63072 - protein, 339 aa, Pseudomonas syringae pv. phaseolicola 1448A
MSSANNTSAPSVAPKKKLTTSAMIASIASEGQATRPAPFGHALAALAEQRQDIVGLSADLSKYTDLHIFAKAHPERFYQMGMAEQLLMSAAAGMAREGFVPFATTYAVFASRRAYDFICMAIAEDNLNVKIVCGLPGLTTGYGPSHQATDDLAIFRAMPNLMIVDPCDALEIEQAVPAIAAHQGPVYMRLLRGNVPLVLDEYGYTFEIGKAKTLRTGNDVLIISTGLMTMRALEAAKALQADGVDVAVLHVPTIKPLDEQTILAEARKPGRLVVTAENHSIIGGLGEAVATVLLRNGVTPTFRQIALPDAFLDAGALPTLHDRYGISTPAVCTQIKAWL

SEQ ID NO: 63073 - protein, 482 aa, Ralstonia eutropha JMP134
MQLRDPSLFKALACIDGQWVGADSGATIEVTDPATGEIVAKVPDLRAAETERAIAAAERAQKGWARKTGKERAIILRRWFDLMIANTDDLAYLMTREQGKPLDEAKGEIAYAASFLEWFAEEAKRVDGEVLASPAADKRLVTLRQPVGVCAAITPWNFPAAMITRKAAPALAAGCAIVIKPAELTPLSAFALAELAHRAGVPAGVLQVVTGDARTIGAVLTASPIVRKLSFTGSTEVGRILMAQSAATVKRLSLELGGNAPFVVFDDADVDAAVDGAIAAKFRNGGQTCVCANRFYIQDGIYDAFATKFAQRASQLRVGNGLEQGVVIGPLIEEAAVEKVTSLVDDATSKGGRLLTGGLKHQLSGTYYAPTVIADATATMRVAREEIFGPLAPLFRFKRDEDAVAAANATEYGLAAYLYTRDIARAWRTAEALEYGMVGLNTGLISNEVAPFGGIKQSGLGREGSRHGIEEYLETKYLCLQM

SEQ ID NO: 63074 - protein, 278 aa, Chlamydomonas reinhardtii
DVEYLLGDRYLDFSLCLVFAFAFPFIRAILRKYVYEPWGRYAMGFGDPKKTDKRMDEAAQAKMRKWCESCWKMTIYIAFTTLALVVCWGEVWFTDSRYWWLGCTRFPPCNLPVSRGLLLFYCAETGFYLQAIHFLTFHEERRKDWLESMIHHVVTSGLLLYSYALNFTRVGVVVILIHDVSDIFLEMAKLARYADREATIGTPAFVVFFLSWVACRVVVFPLFVIRSTLFEPVVLVGAYLGVEPRPHWEIFNGLLILLFVLHLYWTVLIFEVIRKQLR

SEQ ID NO: 63075 - protein, 447 aa, Ralstonia eutropha JMP134
MTITSPKLPQAAELDLKAHWMPFSANRNFHDDPRMVVAAKGRWLIDDQGRKVFDGLSGLWTCGAGHARAEIQAAVASQLGTLDYSPAFQFGHPQSFMLAERIAELFPGDLNHVFYTGSGSECADTAVKMARAYWRIKGQPAKTKLIGRARGYHGVNIAGTSLGGIGGNRKMFGQLMDADHLPHTLQADCAFTKGQAETGGVELANELLKLIELHDASNIAAVIVEPMSGSAGVIVPPKGYLQRLREICTQHGILLIFDEVITGFGRLGKASGAEYFGVTPDIANVAKQLTNGAIPMGAVIASSEIYNTFMAQPTSGHAVEFGHGYTYSGHPVACAAGLATLDLLARENLIQQAADLAPHFEQAIHGIRGAKHVVDIRNCGLAGAIQMAPRDGDATIRPFEAGLALWKKGFYVRFGGDTLQFGPAFNTTISELDTMFDSVGAVIETLA

SEQ ID NO: 63076 - protein, 322 aa, Moorella thermoacetica ATCC 39073
MEVIKKQMETESGRLKIFTCNANPKLAEEIGAYLGVPLGAAKVKRFSDGEISVVIDESVRGEDVFVIQPTCEPVNDNLMELLIMIDALRRASARRITAVIPYYGYARQERKTRARDPISAKLVANLITAAGAHRVLTMDLHAAAIQGFFDIPVDHLTAVPILADYFNSKGFEKAVIVSPDLGGVTRARNFAERIGAEIAIIDKRRPAPNVAEIMNLIGDVKNKTVIMIDDLIDTAGTICLGAKALMEQGACAVYACCTHPVLSGPARERLMASPLQEVVVCNTIPVPEGKEIPKLHRLSVAPLLGEAIIRIHEDLSVSKLFD

SEQ ID NO: 63077 - protein, 418 aa, Crocosphaera watsonii WH 8501
MDLLEYQAKELFHQVGIPVLPSQPIAKLSELKHLHIPYPVVLKSQVHSGGRGRAGGIRFVQNTIDAVAAAQAIFSLPILKEYPEVILAEARYDAQEEFFLSIVLDYQLQRPVLMGSAKGGIDVETLLKHTQKVVLHQGFSPFYARRLATKMGLQGRLIHGVSIILEKMYQLFIEKDLDLVEINPLAVSSSGEFMALDGKITVNDMALSRHLDLLSFLKPRVDQPSSQTPQATIVTTPPQKPCWLPAREKGGNIGLIGNGFGLTLSSWDLMLEQKGEILGAFVIEEKSSSKSLIKQLGIAIEKMLTVPDIKVIFINIVTKHQTSELVAQALLDYCQPLVVTSGSEERLPRPTGSNSTRQRPITPSPMENPIEWVIRLPVDDLQPIEESFSGLSVNCFKEMMEAVKKTVALSSQASKRKS

SEQ ID NO: 63078 - protein, 389 aa, Coxiella burnetii RSA 493
MFEHDIVFSIFLIFAGAAVLSTFALMTRQSMLVAYMLLGILLGPWGLKLIANIDMLRTVSDVGIVFLLFLLGLNLPPQKLITMFTKIKWVALISSIVFAATGYGVAYFFNYPVVECLVIGGAMMFSSTIIGIKLLPTTILHHQHTGEVMISVLLLQDLIAIAVLFLLHGAGRQGKILVDIALVLLGFPAILIFAYLFDRFVLFPLFSKFNRIKEYLFLLAIAWCLSMAQLAASLGLSGEVGAFIAGVSLASRPVSVYISESLKPVRDFFLVLFFFSVGATFDLQFLPGVIIPALILLVLLMAIKPVIYRLLLRWVGESKQVSWEVGIRLAQISEFSLIIAYMALSNHLIANKAASLIETITILSFIVSSYWVVMKYPTPLAISDRLRRD

SEQ ID NO: 63079 - protein, 436 aa, Coxiella burnetii RSA 493
MANRIEQITVPDLGGASEVDVIEVLVKPGDTVAKEDGLITLEGDKASMDVPSPLAGTIKELQVKVGDKVKEGDKILTLEMSAEEEKPAKEEKKESEKSEKLEEEGKKEKEEKSEPKEEKKKATEIKEYEAEEVEGFGTSVHAGPAVRRIAREFGIDLTKIKGTGQKDRILKEDVQKFVKEQLKVAEGKSGIGFPPAPKIDFKKFGAIEEKPLSKIKKATGVNLSRNWMTIPHVTQFGEADITELQAFRQSQKEYAAKQNVRLTPLVFIIKAVVNALKEFPHFNASLDPTGEHLILKKYFHIGVAVDTPEGLVVPVIRDADKKGLFELAKELGEVSEKARKKGLNMNDMQGGCFSISSLGGIGGTAFTPIINAPEVVILGVSKMQWKPICNEAGDCKTRLMLPLSLSYDHRVIDGADGARFIVYLAERLSDIRTLLL

SEQ ID NO: 63080 - protein, 474 aa, Coxiella burnetii RSA 493
MTKEIKTEVVVLGSGPGGYAAAFRAADLGKKVVLVERYETIGGVCLNVGCIPSKALLHVAKVIDDAKDMSSFGIDFGKAALEIEKIRSWKENVVKKLTGGLKMMAKQRKVEIITGYGKFSSSNELAVENKEKSVTKIKFDQAIIAVGSLPVKLPFIPDDPRIMDSTGALELEDVKGHLLVLGGGIIGLEMATVYHALGTKISVVEMMDQLIPGADADVVKPLHQRIQKRYEEILLKTKVTKIEPKKDGLYVTFEGENAPKEPKKYDRILVAVGRSPNGKLIDAEKAGVKVDDKGYIAVDKQMRTNVSHIYAIGDVVGQPMLAHKATYEGRLAAEVIAGIKHYNDARCIPAVAYTDPEVAWVGLTETQAKEKGIKYEKGVFPWAASGRALSLNRSEGSTKLLFDEKGTVIGGGIVGVNAGDLISEVALAIEMGCDAEDVGLTIHPHPTLSETVMMACEMFEGTITDLIPPKKKDK

SEQ ID NO: 63081 - protein, 571 aa, Glycine max
KALNKGTAFSMTERDRLDLRGLLPPNVMSPDLQIERFMVDLKRLEVQARDGPSDPNALAKWRILNRLHDRNETMYYKVLIAKIEEYAPIVYTPTVGLVCQNYSGLFRRPRGMYFSAEDRGEMMSMVYNWPAEQVDMIVVTDGSRILGLGDLGVQGIGIAIGKLDLYVAAAGINPQRVLPVMIDVGTNNEKLLEDPLYLGLQQHRLDGDDYLAVVDEFMEAVFTRWPNVIVQFEDFQSKWAFKLLQRYRNTYRMFNDDVQGTAGVAIAGLLGAVRAQGRPMIDFPKQKIVVAGAGSAGIGVLNAARKTMARMLGNNEVAFESAKSQFWVVDAQGLITEGRENIDPDALPFARNLKEMDRQGLREGASLVEVVKQVKPDVLLGLSAVGGLFSKEVLEALKGSTSTRPAIFAMSNPTKNAECTAEEAFSILGDNIIFASGSPFSNVDLGNGHIGHCNQGNNMYLFPGIGLGTLLSGARIVSDGMLQAAAERLATYMSEEEVLKGIIFPSTSRIRDITKQVATAVIKEAVEEDLAEGYHGMDARELQKLSEDEIAEYVQNNMWSPEYPTLVYKKE

SEQ ID NO: 63082 - protein, 183 aa, Zymomonas mobilis subsp. mobilis ZM4
MLTLPNVLTLSRIFAVPVLVALLWNPGWLGYVCAFLLYCLMAITDYFDGYLARAQGTVSKLGIFLDPIADKIMVASVIVMLISRHPLIAGFHILAALIILLREIAVSGLREFLAELHVSLPVSQLAKWKTTFQLVAFGAIILSGATLSTPLVSILGLTSLWIAASLTLITGWDYLRIGIKHMD

SEQ ID NO: 63083 - protein, 584 aa, Fusobacterium nucleatum subsp. vincentii ATCC 49256
MNYSMPKYFQNMPQVGKALANIDEANENAVRDVEEAIAQSIQAMQDSGTPDEKIHDKGQMTALERVAELVDEGTWYPLNTLYNPEDFETGTGIVKGLGRIGRKWAVVVASDNKKIVGAWVPGQADNLLRASDTAKCLGIPLVYILNCSGVKLDEQEKVYANRRGGGTPFFRNAELQQLGIPVIVGIYGTNPAGGGYHSISPTILIAHKDANMAVGGAGIVGGMNPKGYIDMEGAIQIAEATMAAKKVEVPGTIHVHYDKTGFFREVYDDEIGVIDGIKKYMDYLPAYDLEFFRVDEPTEPVLDPNDLYSIIPMNQKKIYNIYDVIGRLFDNSEFSEYKKGYGPEVVTGIAKVDGLLVGVVANAQGLLMNYPEYREKSVGIGGKLYRQGLIKMSEFVTLCSRDRLPIVWLQDTSGIDVGNPAEEAELLGLGQSLIYSIENSHVPQIEITIRKGSAAAHYVLGGPQGNNTNAFSLGTAATEVYVMNGETAASAMYSRRLAKDHKAGKDLQPTIDKMNQLINEYTAKSRPAYCAKTGMVDEIVPLYDLRGYIQAFANAVYQNPKSICAFHQMILPRVIREFETYTKK

SEQ ID NO: 63084 - protein, 292 aa, Brassica napus
  misc_feature (128)..(128): Xaa can be any naturally occurring amino acid
  misc_feature (145)..(145): Xaa can be any naturally occurring amino acid
MRGMKSLTIWALFAALLSQQLFASVTSIRFEDEKTYYTPPSGGHGGYTPTPNCGSPPYDPTPSTPSHTPTPSTPSHTPTPHTPTHHTPPCNCGTPPPHDPFHTFTPFHNHDTPSTPSHPSTPPSGGYXLHNLRPPSTPVVVTPPXTPIIGGSPPTPIDPGTPGTPFVPTPFPPITGTCDYWRNHPTLIWGLLGWWGTVGGAFGTVSTSSSIPGFDPHMNLLQALFNTRTDAIGALYREGTASWLNSMVNNKFPLTTPQVRDHFVAGLSSTKAATKQAHTFKLANEGRLKPRN

SEQ ID NO: 63085 - protein, 100 aa, Physcomitrella patens subsp. patens
MADKSDPRMPTAVKHYVAPLVNPNDLPPDYSSLLAIIFGILGVMMRQKIASWFSLVFIAQSLTLMKNPENDLKQIIMALTFAGMGFFTTYFGPTPKAGKA

SEQ ID NO: 63086 - protein, 358 aa, Arabidopsis thaliana
MTMDSKVCSVRFHLRRSKEEEEDTMDLSIKQVDLLNQVEISRVYHCDGLLLCVAKDNSRVVVWNPYLGQTRWIRPRTESNIGDSYALRYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTAFISGKDGFFKPVTLGVAPNVGEPCPRTGHIPTTYRPPLVCSSTYLPSLVQVNQQRKRKERHV

SEQ ID NO: 63087 - protein, 325 aa, Pseudomonas syringae pv. phaseolicola 1448A
MAKRIQFSTVGGPEVLEYVDFEPEAPGPQAVVVRNKAIGLNFIDTYYRSGLYPAPELPSGLGAEGAGVVEAVGDEVTRFKVGDRVAYGTGPLGAYSEVHVLPEANLVKLADSVSFEQAAALMLKGLTVQYLLRQTYQVKPGEIILFHAAAGGVGSLACQWAKALGAKLIGTVSSPEKAAHAKALGAWETIDYSHEDVAKRVLELTDGKKCPVVFDGVGQDTWLTSLDSVAPRGLVVSFGNASGPVSGVNLGILAQKGSVYVTRPTLGTYANNAQNLQAMADELFDMLASGKLKVDNIQQYALKDAAKAQTELSARRTTGSTILIP

SEQ ID NO: 63088 - protein, 529 aa, Thermus thermophilus
MSALYRRFRPLTFQEVVGQEHVKEPLLKAIREGRLAQAYLFSGPRGVGKTTTARLLAMAVGCQGEDPPCGVCPHCQAVQRGAHPDVVEIDAASNNSVEDVRELRERIHLAPLSAPRKVFILDEAHMLSKSAFNALLKTLEEPPPHVLFVFATTEPERMPPTILSRTQHFRFRRLTEEEIAFKLRRILEAVGREAEEEALLLLARLADGALRDAESLLERFLLLEGPLTRKEVERALGLPPREALAEIAASLARGKTAEALGLARRLYGEGYAPRSLVSGLLEVFREGLYAAFGLAGTPLPAPPQALIAAMTALDEAMERLARRSDALSLEVALLEAGRALAAEALPQPTGAPPPEVGPKPESPPAPEPPRPEEAPDLRERWRAFLEALRPTLRAFVREARPEVREGQLCLAFPEDKAFHYRKASEQKARLLPLAQAHFGVEEVVLVLEGEKKSLSPRPRSAPPPEAPAPPGPPEEEVEAEEAAEEAPEEALRRVVRLLGGRVLWVRRPRTREAPEEEPLSQDEIGGTGI

SEQ ID NO: 63089 - protein, 451 aa, Arabidopsis thaliana
MSSSSESHLATAKTALTAVASVAAAAILARSVVQDYMPNEVHEYISHGFRRFFSYFSYQMTAVIEEFGGFEHNQVFEAAEAYLSTKISNSTRRIKVNKLEKQSNYSVTVERDEEVVDIFDGVKLSWILVCRHVDKKDFRNPRDLNSTLKSEVRSYELSFRKKFKNMVLESYLPFVVEQAASIKQKFKTLKIFTVDSYSVEWTSVTLDHPSTFRTLALDPEVKKNLVEDLDRFVQRKGFYGRVGKAWKRGYLLYGPPGTGKSSLIAAIANHLNFDIYDLDLTSLNNNAELRRLLMSTANRSILVVEDIDCSIELKDRSTDQENNDPLHKTVTLSGLLNFVDGLWSSCGNERIIVFTTNYREKLDPALLRPGRMDMHIHMSYCTPAAFKVLASNYLEIQDHILFEQIEEFIREIEVTPSEVAEQLMRSDSVDKVLQGLVEFLKAKKQIDNSKA

SEQ ID NO: 63090 - protein, 599 aa, Triticum aestivum
NQNTPPPLPPPPPPPGGKKGGGLPPGGGGALLKKRGVPPPGAAGIFPTETPPRKNPFFREKPLESFWPLFYHVQHLHHPTPSATMPSTLISLTVATAALVIAIAVACYPRKYRGLRLPPGPPGWPIVGNLFQVAFSGKKLIHYLRDLQQEYGPILTLQMGVRTVIIISGAEVAHEALVEKGAEFATRPAVESSGRNIFSHKLTVNSAVYGARWRSLRRNMVSGMLSNSRLQESQPARMRAMDRFMSRIRAEVSASPNGGSVWVLRNARFALVCILLELTFGLLDLDDQLILQVESVLKRVVLTLGMRMDDYLPCLRPFFWRKQSHVLAVRREQIDTLLELINRRRAVLRDMQRSPPDPNVAAAFSYLDSLLEGRFGGCNAMASDEELVTLCTEVLNAGADTTATAVEWAMARIIDNPRIQARLHEEITRKVGNTRPVDDKDTDNMPYLQAFVKELLRKHPPTYFLVTHAAVHPGSKLAGYDVPTDANLDVFLPTISEDPKLWDRPMEFDPDRFLSGGEKADITGSAGVRMIPFGAGRRMCPGSAMGTVHIALMVARMVQEFEWCAHPSQPALNYEEMVQFTVVMEQPLLAMVKPRKLSY

SEQ ID NO: 63091 - protein, 388 aa, Mesorhizobium loti MAFF303099
MSLIDSFRAEARAAPESGIVAVVNYGRLREGLIPLWAGEGDLPTPAFITDAASKALAGGETFYTWQRGIPDLRQALARYYARHFGKTFPEEQFIVTGSGMHAIQMSLTALAGAGDEVIYLSPAWPNFDAAAALSGAVPVPVTLDHSGNGWSCDVEKIAAAITPRTRALFINTPSNPTGWTADHETLQAILDLARAKNVWIIADEIYSLFHYGHGRAPSFLDIATEEDRILFVNSFSKNWAMTGWRVGWIKTHPSLQQVFENLIQYSNSGVAQFMQRGAVAALDEGDGFVAEQVERARKARDLVCGILGATGRARFTVPQGAFYLFFTVDGITDSRTAAFDIVDKANVGLAPGTAFGPGGEAFLRLCFHRRLDQLEEAAHRLAKWMKSI

SEQ ID NO: 63092 - protein, 405 aa, Moorella thermoacetica ATCC 39073
MALIVQKYGGTSVNGPERVKNVARRVVNTRRAGNDVVVIVSAPGDMTDDLIAMAHEISPNPPAREMDMLLATGEQTSIALLAMAIHELGEPVISLTGPQVGILTDNVHSKARIMEVSCERLRRELEQGKIVIVAGFQGKTCEGEITTLGRGGSDTTAVAVAAALKADVCQIYTDVDGVYTADPRVVPEARKLPVISYDEMLELASLGAQVLQPRSVEFGKLNHVVLEVRSSFNDHEGTLVKEVTEMERKMVVSGVAGDRNVARIALHDVPDRPGIARTLFVALARESINVDMIVQSAMRDGINDIAFTVGRDDLQKAVEVTERVRQEIGASKVTSNDRVAKVSIVGAGMITNPGVAADMFACLAEEGINIHMISTSEIKVSCIIDEEHLTRAMQALHRHFKLDRE

SEQ ID NO: 63093 - protein, 238 aa, Zea mays
MAGGDDLKLLGLWASPYVLRVKLALSLKGLSYENVEEDLRDKSELLLKSNPVHQKVPVLIHGGKPICESQVILQYIDEAFAGTGPSLLPADPYERAVARFWAAYIDDKMLPAWNQSTMGKTEEERAEGKKQSVVTVETLEGALRDCGGQGKPFFGGDSVGYVDVVLGGLLGWVRASEELHGVRPFDPERTPLLAAWSERFGALDAVQTVMPDVGRLLEFGKALMARLAAAAAAGASNN

SEQ ID NO: 63094 - protein, 348 aa, Moorella thermoacetica ATCC 39073
MNWPGVIRAYREFLPVTEATPLITLEEGNTPLIAAGNLSRELGLKLYFKYEGLNPSGSFKDRGMVMAVAKAMENGSKAIMCASTGNTSASAAAYAARCGLKCSVLIPEGNIALGKLAQALFYGARVIAIQGNFDDALTLVRNITSRYPITLVNSINPFRIEGQKTAAFEICDVLGEAPDYLAIPVGNAGNITAYWKGFNEYYQAGRSHTLPKMIGFQAEGAAPIVRGEVVPNPETVATAIRIGNPASWQPAVRAAKDSGGFIDCVSDDEILAAQRLLATAEGIFAEPASAASLAGVLKYAKKGYFHKDDRVVCVLTGHGLKDPNIAIKQVGEPISLPVDEARVLEIVL

SEQ ID NO: 63095 - protein, 495 aa, Pseudomonas aeruginosa PAO1
MSIAIDPSVSAFLRSPHGLLIDGESGPARSGADMPLYDPATGAELARVARAGAEDVDRAVAAARRAFEGNWAGQRPADRERLLLRLAERIEAHGEQLAQLETLNNGKSINLSRALEVGASVEFIRYMAGWATKIEGRSLDLSIAAVPGARYRAYTVPEPVGVVGAIVPWNFPLLMAIWKIVPALACGCTVVLKPADETPLTALRLGQLCLEAGIPPGVVNIVTGTGAEAGAALAAHPGIDKLAFTGSTPVGKLIGHAAVENMTRFSLELGGKSPVIILDDTSLDMAAAGSAGAIFFNQGQVCTAGSRLYVQRKRFDQVLERLAAIAGDLSIGPGLDPTTQINPLVSARQQERVLGMIESGVAEGASVVCGGARQGETGFYVQPTILADVTPGMQVVREEIFGPVLVATPFDDLDEAVRLANDSIYGLGASIWSNDLRQVMDLVPRIKAGTVWVNAHNLLDPSMPFGGFKQSGIGREMGHAAIEAYTENKSVCIAY

SEQ ID NO: 63096 - protein, 434 aa, Xanthomonas campestris pv. vesicatoria str. 85-10
MFISTRGGAPAANLSQAIAAGLAPDGGLYVPQTLPPARTLVAGAGLADTATVLLQPFFEGDALAAELPAICAEAFDFPAPLVALGTPGDYALELFHGPTAAFKDFGARFLAACLTRLRRAEDRPLTILVATSGDTGAAVAAAFHRQPGLRVVVLYPDGRVSPRQAHQLGCFGDNIQALRVAGSFDDCQAMVKQALNDAALQAQVPLSSANSISLGRLLPQMSYYAHAALEHHAASGSALNLVVPTGNLGNALAAIIARALGVPLGRIALASNANHVLPDYFAGDAYAPQPSVATLANAMDVGAPSNFERLRWLYNGDDAALREEFRALSVDDAAIRNTVQQRFARYGEVHCPHTATAVHVLEQLRAEGAEGGTGDWAVAATAHPAKFEGVVEPLIGRAVEVPPALAALLQRPAHAEALAPDYAALRQRLLADAA

SEQ ID NO: 63097 - protein, 98 aa, Zea mays
  misc_feature (27)..(27): Xaa can be any naturally occurring amino acid
  misc_feature (36)..(36): Xaa can be any naturally occurring amino acid
  misc_feature (69)..(69): Xaa can be any naturally occurring amino acid
  misc_feature (79)..(79): Xaa can be any naturally occurring amino acid
  misc_feature (86)..(86): Xaa can be any naturally occurring amino acid
ARVRPRVRRKFIPIYLAHGILQHGAFXDLDQRGVVXLFKLATERGRKVRPNLKVDICGEHGGQPSSDAXLANTEMDYVXSCSAFRXPIVMLAAANVLD

SEQ ID NO: 63098 - protein, 87 aa, Chlamydophila pneumoniae CWL029
MSQKNKNSAFMHPVNISTDLAVIVGKGPMPRTEIVKKVWEYIKKHNCQDQKNKRNILPDANLAKVFGSSDPIDMFQMTKALSKHIVK

SEQ ID NO: 63099 - protein, 325 aa, Methanothermobacter thermautotrophicus str. Delta H
MILIVGGAGYIGSHVNKFLSERGYETLILDNLTRGHRDFVKWGEFIEGNLGDRRLLDRTFETHDVDAVMHFAAFTDVGESVLKPGRYYHNNVVNTINLLDSMVDHGVRDFIFSSTCAVYGNPMEIPISEEHPLNPISPYGRSKLMVEEILGDYRDAYGLNYVSLRYFNAAGADPEGEVGELHNPETHLIPIVLDVALGLRDAVRIFGTDYPTPDGTCVRDYIHVMDLADAHWRALRYLEGGESGVFNLGNGNGFSVMEVIETCREVTGASINAVEDDRRPGDPPELVGSAGRARRVLGWRPEFTELEDIIETAWNWHSRIRGGIS

SEQ ID NO: 63100 - protein, 251 aa, Burkholderia sp. 383
MKRLEGKVALITGGARGQGEAEARRFVAEGARVVIADVLDEAGQRVAAELGDAARFQHLDVTREADWQIAVDATLAQFGRLDILVNNAAILKLVPIEACSLDDYRKVIDVNQVGCWLGMKSALGALKAAGGGSIVNVSSTAGMEGVAGGSAYVSSKFAVRGMTKAAALEFGRYGIRVNSVHPGGIDTVMARPPEFADFDPSSIYSGLPIARIGKPDEVASLVLFLASDESAYCTGSEFIVDGGMLAGSSFH

SEQ ID NO: 63101 - protein, 460 aa, Erwinia carotovora subsp. atroseptica SCRI1043
MATGKIIQVIGAVVDVEFPQDAVPKVYDALEVENGAEKLVLEVQQQLGGGIVRCIAMGSSDGLRRGLNVNNLGHPIEVPVGKATLGRIMNVLGDPIDMKGDIGEEERWAIHRSAPSYEELSNSQELLETGIKVIDLMCPFAKGGKVGLFGGAGVGKTVNMMELIRNIAIEHSGYSVFAGVGERTREGNDFYHEMTDSNVIDKVSLVYGQMNEPPGNRLRVALTGLTMAEKFRDEGRDVLLFVDNIYRYTLAGTEVSALLGRMPSAVGYQPTLAEEMGVLQERITSTKTGSITSVQAVYVPADDLTDPSPATTFAHLDATVVLSRQIASLGIYPAVDPLDSTSRQLDPLVVGQEHYDVARGVQSILQRYQELKDIIAILGMDELSEEDKLVVSRARKIQRFLSQPFFVAEVFTGSPGKYVSLKDTIRGFKGIMEGEYDHLPEQAFYMVGSIDEVVEKAKKL

SEQ ID NO: 63102 - protein, 358 aa, Pandanus amaryllifolius
MSCFIGKYADELIKTAKYIATPGKGILAADESTGTIGKRLASINVENIESNRQALRELLFTSPGALEYLSGVILFEETLYQKTRDGKPFVDVLTENNVIPGIKVDKGIVELAGTNGETTTQGLDSLGARCQQYYKAGARFAKWRAVLKIGATEPSELAIQQNAQGLARYAIICQENGLVPIVEPEILTDGTHDINKCAAATETVLAAVYKALNDHHVLLEGTLLKPNMVTPGSDSPKVAPEVIAECTVTALRRTVPAAVPGIVFLSGGQSEEEATLNLNAMNKLEVLKPWTLSFSFGRALQQSTIKKWAGKKENVPAAQAPFLARCKANSEATLGKYGGAAPADAAASESLHVKDYKY

SEQ ID NO: 63103 - protein, 470 aa, Zea mays
MEADSGKLFVGGISWETDEDRLRAYFGRFGEVTEAVIMRDRNTGRARGFGFVVFADSGIAERVTLDKHMIDGRMVEAKKAVPRDDQSIASKNNSSIGSPGPGRTRKIFVGGLASNVTEVEFRRYFEQFGVITDVVVMYDHNTQRPRGFGFITYDSEDAVDKALHKNFHELNGKMVEVKRAVPKEQSPGPIARSPAGGQNYAMSRVHNFLNGFNQGYNPNPLGGYGMRVDGRYGLLTGARNGFSSFGPGYGMGMNAEGGMSAYFGASSGFANSSNGRQIGSYFNSSSNRLGSPIGYVGLNDDSGSILSSMSRNVWGNGNLNYTGNPTNTNSFAPPVGGGGIPGDEISWGNLTSVHGMGNISSLGPGNLGRGTGDNNFGLPSGTYVRSNSTGTIGEPFSASANPYESNNLGAYGSSSIYGDSTWRFNSSEVDIPPFGHDLGNVDPDIKSEISANYMGNYTVNNNQTSRGITS

SEQ ID NO: 63104 - protein, 333 aa, Mesorhizobium loti MAFF303099
MRMTVLVTGGAGYIGSHMVWELLDAGERVVVLDRLSTGFEWAVAPEAKLVVGDVADKELVGSIIRDNHVDAIIHFAGSIVVPESVADPLAYYENNTSKTRTLIETAVREGVPHFIFSSTAAVYGGAGLEPVREDARLAPESPYGLSKLMSEWMLRDAGLAHDIRYTALRYFNVAGADPKGRTGQSTPGATHLIKVACETALGKRPFMQVFGTDYPTPDGTCMRDYIHVSDLAAAHRLALQRLRAGGTSLVANCGYSHGYSVLEVIDSVRRAFGRDFEVKMGDRRPGDAAAVVANSDLARAELGWTPQRDDLDQIVADALAWERILTSKNSARG

SEQ ID NO: 63105 - protein, 344 aa, Zea mays
WWIILLRAYTKTTGDLTLAETPECQKGMRLILSLCLSEGFDTFPTLLCADGCCMIDRRMGVYGYPIEIQALFFMALRCALQMLKHDNEGKEFVEKIATRLHALSYHMRSYFWLDFQQLNDIYRYKTEEYSHTAVNKFNVIPDSIPDWLFDFMPCQGGFFIGNVSPARMDFRWFALGNMIAILSSLATPEQSVAIMDLIEERWEELIGEMPLKICYPAIENHEWRIVTGCDPKNTRWSYHNGGSWPVLLWLLTAACIKTGRPQIARRAIDLAERRLLKDGWPEYYDGKLGRYVGKQARKFQTWSIAGYLVAKMMLEDPSHLGMISLEEDRAMLKPVLKRSASWTN

SEQ ID NO: 63106 - protein, 721 aa, Pseudomonas syringae pv. phaseolicola 1448A
MIYEGKAITVKALESGIVELNFDLKGESVNKFNRLTLNELRQAVDAIKADASVKGVIVSSGKDVFIVGADITEFVDNFKLPEAELVAGNLQANRIFSDFEDLGVPTVVAINGIALGGGLEMCLAADYRVISSSARIGLPEVKLGLYPGFGGTVRLPRIIGADNAIEWIASGKESSAEDALKVGAVDAVVAPEKLQAAALDLIQRAISGEFDYKAKRQPKLDKLKLNAIEQMMAFETAKGFVAGQAGPNYPAPVEAIKTIQKAANFGRDKALEIEAAGFVKMAKTSAAQSLIGLFLNDQELKKKAKGYDAVAKDVKQAAVLGAGIMGGGIAYQSAVKGTPILMKDIREEAIQLGLNEASKLLGGRLEKGRLTAAKMAEALNAIRPTLSYGDFGNVDLVVEAVVENPKVKQAVLAEVEANVGEHTILASNTSTISISLLAKALKRPENFVGMHFFNPVHMMPLVEVIRGEKSSEEAVATTVAYARKMGKNPIVVNDCPGFLVNRVLFPYFGGFARLVSAGVDFVRIDKVMEKFGWPMGPAYLMDVVGIDTGHHGRDVMAEGFPDRMKDDRRSVVDALYEAKRLGQKNGKGFYAYETDKKGKPKKVNDPAVLDVLKPIVYEQREVSDEDIINWMMIPLCLETVRCLEDGIVETAAEADMGLIYGIGFPPFRGGALRYIDSIGVAEFVALADQYAELGALYQPTAKLREMASKGQSFFGQASSEE

SEQ ID NO: 63107 - protein, 433 aa, Candida albicans SC5314
MDLRVGKKYRIGRKIGSGSFGDIYLGTNIISGEEVAIKLENTKAKHPQLEYEAKVYKALSGGVGIPFVRWYGTECDYNAMVIDLLGPSLEDLFNYCNRKFTYKTVLLLADQLICRIEYIHARCFIHRDIKPDNFLMGIGRRGSQVNVIDFGLAKKYRDPRTHLHIPYRENKNLTGTARYASVNTHLGIEQSRRDDLESLGYVLIYFCRGSLPWQGLKAATKRQKYDRIMEKKMTTPNNILCKGLPSEFLEYMNYVKTLRFDDKPDYPYLRKLFRDLFKKENYRYDYVFDWTLYKFQQEKQRAQQGKVADGDNQDQQQQQNNQNQTQTQNQQGQITAPQPPVPVSQQQQQQQQIPQHIPTPQQISQQQQQQQQQQQQLPPQQQKTSVTPQLQQYTDQRLQNQRAVYQSNQNYSGTKSAQPQAQQPPQQGNPAWL

SEQ ID NO: 63108 - protein, 263 aa, Lactobacillus plantarum WCFS1
MKIGFIGAGNMGRAIIDGWLKQQAVVPADIYIHSAHAASYQPYAQKNGLQACDTNLAVAQAADVIVLAVKPNIALAALKEVQAALTGKWVITMVSGLSLADYATVAPDLPVLRIMPNVNVAIGAGMTALVGNDALTPEQYAAGQQLFDAIGATSAIAEKDFPTFSALAGSSPAYIYFFIDAMARAGVKHGLSKDAATKIAAQATLGSAQNVLASDKIPFDLIDQVSSPGGTTVAGLLAMEEAGFMTAVVKGIDATIAKELGES

SEQ ID NO: 63109 - protein, 285 aa, Methanothermobacter thermautotrophicus str. Delta H
MKAVIPAAGLGTRFLPATKAQPKEMLPVFDKPTIQYVVEEAVASGIDDILIITGKGKRSIEDHFDRSFELEYFLRKNNKMNYLDEVEAISDLADIYFVRQKEQKGLGDAIYCARKHIDGEDAFAVLLGDTITSSGVPCTRQLMDIYERYGASAIAVEEVPRDKVERYGIIDGEEVSEGIYSIRDMVEKPPVTEAPSNLAIMGRYVLESEIFDHIREVPPGFGGEIQLTDAMRCLEEVYGCVFRGRTYDIGNRVDWLKTSLEFAMNDDEIRPELIEYLKNLIDGYR

SEQ ID NO: 63110 - protein, 124 aa, Triticum aestivum
MALRAAAARLASSSLRRRHGHLLPAAATASQSAFLHSHATSFGFKQVREDEKSKLVGNVFSSVASSYDVMNDLMSAGLHRLWKDRLISKLNPFPGMKHLDVAGGTGDVAFRVVERIKSVSHRAT

SEQ ID NO: 63111 - protein, 335 aa, Moorella thermoacetica ATCC 39073
MKESIAVLGAGSWGTALAVLLAHKGFRVNLWARRPELATALRETGENKTYLPGVRLTGTIIPTADLPAAVKGAGLVVLSVPSHAVRSTARLLKPFLPKGTVVVNTAKGLELETKKRLSQVLVEEGLDRVAVLSGPSHAEEVGRGLPTTVVVAAADRETAEYVQDVFMDPTFRVYTNPDIIGVEFGGALKNIIALATGMADGLGLGDNTRAALMTRGMAEIARLGVALGGKVLTFAGLSGIGDLIVTCTSMYSRNRRAGILLGKGQSLEEVLDAVGMVVEGVRTTAAARELACQHGIKMPITEEIYQVLYKGKPVGDCVAALMERPRTHEVESGDW

SEQ ID NO: 63112 - protein, 96 aa, Phytolacca acinosa
ATYKVTLVTPSGTQTIDCPDDTYVLDAAEEAGLDLPYSCRAGSCSSCTGKVTAGTVDQEDQSFLDDDQIEAGFVLTCVAYPKGDVTIETHKEEDIA

SEQ ID NO: 63113 - protein, 444 aa, Streptomyces avermitilis
MVPHAGDARDAEAKHDARTRGWETTMSALSPHLRQATPVVAVRGEGVHLYGEDGRRYLDFTAGIGVTSTGHCHPRVVAAAQEQAGTLVHGQYTTVLHPPLRRLVDRLGEVLPAGLDSLFFTNSGSEAVEAALRLARQATGRPNVLVCHGGFHGRTVAAAAMTTSGTRFRSGFSPLMSGVVVTPFPTAFRYGWDEETATRFALQELDYTLRTISSPDDTAAIIVEPVLGEGGYVPATRAFLEGLRERADRHGFVLILDEVQTGVGRTGRFWGHDHFGVTPDILITAKGLASGFPLSGIAASAELMGKAWPGSQGGTYGANAVACAAACATLDVVRDEKLVDNAEAMGARLRAGLAAVAATTPAIGDVRGLGLMLASEFVTEDGGPDPETAARVQRAAVDEGLLLLLCGAWNQVVRMIPALVIDEAEVDEGLRAWSAAVEVGVPAR

SEQ ID NO: 63114 - protein, 477 aa, Nostoc punctiforme PCC 73102
MKSRNNKIQKPSNLQTPMTATYNLPDGPQMPRWLRTIKFISQPVKYVDDFAKTYGDTFTIRSSRSDNHIVYFSQPQALEEIFTADSRHFEVGRGNTGLRFLLGDRSFMLVDGDRHQRQRQLLAPPFHGERMRAYGEDIRKITQQVSHEWKIGKPFNIRESMQEITLRVILRVVFGLNEGELFEELRRSLSDLLDFISSPIMSSAFFFRFIQKDFGAWSPWGRILLQRQKVDLLIYTLLRERRAQTDQNRQDILSLMMAARYDDGQGMSDEELHDELMTLLVAGHETTASALTWAFYWIDHLPEVREKLLQELNTIGVNPDLSSVAKLPYLTAVCQETLRIYPIAMTAFVRIVKTPITIMGYELREGTAIVPSIYLAHHREEVYPQSKQFKPERFLERQYSPYEYLPFGGGNRRCIGMAFAQYEMKIVLATVLSEFQVSLVNKRPVHPVRRGLTVATPAGMRMVATPQVKRANTPALV

SEQ ID NO: 63115 - protein, 153 aa, Burkholderia sp. 383
MSTTVAQLLKAKPDSGRTIYTVTKTDLVYDAIKLMAEKGIGALLVVDGDDIAGIVTERDYARKVVLQDRSSKATRVEEIMTAKVRYVEPSQSTDECMALMTEHRMRHLPVLDGGKLVGLISIGDLVKSVIADQQFTISQLEHYIHGTPAVTSA

SEQ ID NO: 63116 - protein, 216 aa, Burkholderia sp. 383
MMSSRPQSPTLGNGQADECVTLVATASLPTRYGTFTSYAFRVSGSDAEHLALVMGDVAGEQSVLTRLHSECLTGDVFGSYRCDCGEQLDLALRYIAAEDRGVLLYLRGHEGRGIGLSNKIRAYALQEQGRDTVEANLDLGLPDDAREYDSAAAILRILGVTSVRLMSNNPAKFDTLAKHGIPVCERVALAVPVREENERYIRTKQTKFGHYFEENE

SEQ ID NO: 63117 - protein, 534 aa, Helicobacter hepaticus ATCC 51449
MILLIDNYDSFTYNIYQAFYRFGFPIKVVRSDKISIEEIRELNPQYIIIGPGPKTPKEAGISIQIVQEFQGVYPILGICLGHQAIMAAFGMDIVNAKNIAHGKVEPLHHNQKGLFRHITPLTPIVRYHSLVGKANELPDCFEVSAWSEDGEIMAIEHKIHHLVGVQFHPESIGTTEGEKMLLNFLHYTREIIPIKQYLKSTLKGENLSFKQAYDVMDEITEGNMSDAQIGSILTSLEIKGVNAEELAGFASVLKKKAIAFPLPLSNEVRLDMVGTGGSPHKTFNVSTTSALLLAAAGVKIIKHGNRAITSKSGSADLLSALGVNINMEVQTCIDVYKNIGITFLFAQKFHAAMRFAAPARATLGFKTAFNLIGPLANPANVTHQFIGVFDKAYTEIMARALDILGIKRAMVVSGFDYYDEISLCAPTQITELNNGVIKSYVFNPSEIGLDFVPYTELCGGDVQENKRISLDIFSASPQSLRSPKTQLVALNTGAALYLADKAQSIKEGYFLARDIIESKRVFAILEEFVRLSNQ

SEQ ID NO: 63118 - protein, 148 aa, Populus trichocarpa
MEQTFIMIKPDGVQRGLVGEIISRFEKKGFTLKGLKLQTVEQSFAEKHYEDLAKKPFFAGLVQYIISGPVVAMIWEGKGVVATGRKIIGATNPAASEPGTIRGDFAIDVGRNVIHGSDSVESATKEIGLWFPEGPANWQSSLHPWIYE

SEQ ID NO: 63119 - protein, 228 aa, Photobacterium profundum SS9
MNQSLLTPYGTAFERVEAGLTAIREGRGVLVVDDEDRENEGDIIFAAETLTSEQMALMIRECSGIVCLCLTDERVKQLELPMMVENNTSANETGFTVTIEAAKGVTTGVSAADRVTTIKTAIADGAVPADLNHPGHVFPLKANADGVLGRRGHTEATIDLMRLSGLKPYGVLCELTNIDGTMARLPEVIVFGKKFNMPVLTIEDLAAYRLAKESNTVTNTTEEVAVIA

SEQ ID NO: 63120 - protein, 588 aa, Populus trichocarpa
MSSLSVRFLTPQLSPTVPSSSARPRTRLFAGPPTVAQPAETGVDAGRLEPRVEKKDGYYVLKEKFRQGINPQEKVKIEKEPMKLFMENGIEELAKLSMEEIDKEKSTKDDIDVRLKWLGLFHRRKHQYGRFMMRLKLPNGVTTSAQTRYLASVIRKYGKDGCADVTTRQNWQIRGVVLPDVPEILRGLAEVGLTSLQSGMDNVRNPVGNPLAGIDPDEIVDTRPYTNLLSQFITANSRGNPEFTNLPRKWNVCVVGSHDLYEHPHINDLAYMPAMKDGRFGFNLLVGGFFSPKRCAEAIPLDAWVSADDVLPSCKAVLEAYRDLGTRGNRQKTRMMWLIDELGIEGFRSEVVKRMPRQELERESSEDLVQKQWERRDYFGVHPQKQEGLSYAGLHIPVGRVQADDMDELARLADIYGTGELRLTVEQNIIIPNIEDSKIEALLKEPLLKDRFSPEPPLLMQGLVACTGKEFCGQAIIETKARAMKVTEEVQRLVSVSKPVRMHWTGCPNTCGQVQVADIGFMGCMARDEKGKICEGADVYVGGRVGSDSHLGELYKKSVPCKDLVPLVVDILVKQFGAVPREREEVDD

SEQ ID NO: 63121 - protein, 266 aa, Oryza sativa Japonica Group
MAASALDSAWEGLTGSFTEFQLATVVTFLLHETVFFLSGLPSLLFERFGLFAKYKIQKKSNTPSYQNRCVLRLILYHVCVNLPVMVLSYPAFKFMGLRSSLPLPHWTVIVSQVLFYFVLEDFIFYWGHRALHTKWLYKHVHSVHHEYATPFGLTSEYAHPAEILFLGFATIVGPALTGPHLFTLWLWMVLRVLETVEAHSGYHFPWSPSNFLPLYGGSDFHDYHHRVLYTKSGNYASTFVYMDWLFGTDKDYRNAKAIEEKDGKHL

SEQ ID NO: 63122 - protein, 309 aa, Rhizobium leguminosarum bv. viciae 3841
MRPLAVIGNVNVDLILGPAAPWPKAGTEIIVDHDELRVGGAAGNSALAWQALGVEFEIAANIGSDQFGRWLSEAFGHRSDKWPVRPEKTTLSVGITHPDGERTFFTTRGHLPRFSLADVFAVIEGARLQGGYALLCGSFLTDDLTEEYGKLFGWADSHGITVALDTGWPLDGWTDENCAATRAWLSRSGVALLNEVESTTLAGIADPIEAARHMRSHMPAGAIVVVKRGPDGALAIGPDGSLVSVAAPVVEVVDTIGAGDVFNAAFLAALASGEPLVSCLMAGTEVASRAISTLPRNYGGPTSLQEPVR

SEQ ID NO: 63123 - protein, 412 aa, Rickettsia sibirica 246
MPIKILMPALSPTMTEGNLARWLKKEGDKVNPGEVIAEIETDKATMEVEAVDEGILAKIVIPQNSQNVPVNSLIAVLSEEGEEKTDIDAFIAKNNSVSPSPKTDANLLKPQENIANVEEQVTVIKHDASKIFASPLAKRLAKMRNIRFESVKGSGPHGRIVKQDILSYTPSTAHNKIVSRNPEEYRLVPNNNIRKIIAKRLLESKQTVPHFYLSIECNVDKLLDIREDINKFFSEDKSTRISVNDFIILAVAKALQEVPNANASWGEDAIRYYNNVDISVAVAIENGLVTPIVKNANQKNILELSREMKALIKKAKDNKLTPEEFQGGGFTISNLGMYGIKNFNAIINPPQSCIMGVGASAKRAIVKNDQITIATIMDVTLSADHRVVDGAVGAEFLAAFKKFIESPVLMLI

SEQ ID NO: 63124 - protein, 84 aa, Zea mays
NPFSMTHPRIPVEHPSVQVEKDEDSLPLPPGIWFSKIVGGGPMTFFFNRGGGGGQFALFFDSFFDNSRKHFFRTAPPPPLPVQS

SEQ ID NO: 63125 - protein, 579 aa, Mesorhizobium loti MAFF303099
MHVTRRTLIAASLSITFALAPLTSVFAASPAPAKGEHGMVVTAQHLASEVGVEVLKKGGNAVDAAVAVGYALAVVYPNAGNIGGGGFMTIRFADGKSTFLDFRERAPLAATKTMYLDKDGNPVKGASLDGYLAVGVPGSVAGFEIAREKYGTLSRQDLMAPAIGYAKDGFILNQGDAASFAGSADRLAKNAAAAAAFLKPDGKPYGIGERLTQPDLAASLSAISEKGPDAFYKGAIADAIVKASGAKGGILAKQDFEQYAVRELKPVTCSYRGYEITSSPPPSSGGVIICEILNVLEGYPLSYLGAGSAETVHVMVEAMRHAYVDRNSALGDPDFVDNPVSKLLDKAYAKGIRDKIDPFRAGVSQDLMPKGFGESKETTHYSIIDKDGNAVAVTYTLNGSFGAGVVADGTGILLNNEMDDFTQKPGVPNLYGLVQGEANAIQPKKTPLSSMSPTIVARDGKPFMVIGSPGGSRIITITLEAIVNVIDHGMNIQEAIDAPRIHHQWLPDKVYVEPFGLSPDTERLLAGMGYHLDLGDQTWGQAAGILVGGKSLAEIEKGGGARYNGAIDSRAASGEALGY

SEQ ID NO: 63126 - protein, 139 aa, Moorella thermoacetica ATCC 39073
MAVERTFSMIKPEGVRRGLVGAILARLEQKGYRIVALKMLRLTPEMAAAHYAEHRDKPFYQDLINHITSGPVVAMVLEGPGVIAGLRRLMGATNPQEAAPGTIRGDFALETSDNVIHGADSPASAEREIALYFTPAELG

SEQ ID NO: 63127 - protein, 495 aa, Mesorhizobium loti MAFF303099
MNLPPNALWIDQDDYDVRGFSHGLYIDGRWRPSSDGRVIDVVDPSSGSVIAAVPDATLEDALAAVDAAAKAATAWRETAPRKRSEILRRCFELMVERSETLAMLISLENGKALRDARGEVAYAAEFFRWNAEEAVRITGEFGTAPSGANRIVVDYEPIGICVLITPWNFPAAMATRKIAPALAAGCTVILKPASETPLTAYALAALYSEAGVPAGVVNVLTTTSPGPLTSAMLADPRVRKLSFTGSTGVGRTLLGEAAKHVVSCSMELGGNAPFVVFDDADLDAALDGAMIAKMRNAGEACTAANRIYVQSGIHDAFADGLRKRMAALKVGPGMSADTECGPMITRKAVDKIDRLVKDAVGRGAKVLCGGSIPEEEGFFYPPTVLSQVPPDADMAHEEIFGPVAPVTRFETEAEVIMHANNTEYGLAAYIYTRDVGRGLRVASRIEAGMIGLNRGLMSDPAAPFGGVKQSGLGREGGQHHGIAEFMEAKYIAVTF

SEQ ID NO: 63128 - protein, 294 aa, Vitis vinifera
  misc_feature (270)..(270): Xaa can be any naturally occurring amino acid
MYQYEKVEKIGEGTYGVVYKARDRVTNETIALKKIRLEQEDEGVPSTAIREISLLKEMQHGNIVRLQDVVHSEKRLYLVFEYLDLDLKKHMDSSPDFAKDLRLIKMFLHQILRGIAYCHSHRVLHRDLKPQNLLIDRRTNALKLADFGLARAFGIPVRTFTHEVVTLWYRAPEILLGSRHYSTPVDVWSVGCIFAEMVNQRPLFPGDSEIDELFKIFRVLGTPNEDTWPGVTSLPDFKSAFPKWPPKDLATVVPNLESAGIDLLSKMLCXDPNRRITTRSALEHEYLKDIRFMP

SEQ ID NO: 63129 - protein, 595 aa, Vitis vinifera
MDSRCWSISHMSELRGTGDASPSSTSTTSASATSSFFTFSANVVVSLSLSSFSFCIQKIRLARQTDRTRRSAHQEMELISKMRNPFIVEYKDSWVEKGCYVCIIIGYCEGGDMAEAIKKANGVLFSEEKLCKWLVQLLMALEYLHMNHILHRDVKILKICVPGCCIYEMTSHKPAFKAFDMQALINKINKSIVAPLPTKYSGAFRGLVKSMLRKNPELRPSAAELLRHPHLQAYVLKIHLKSNSPRYNTLPICWSEPNHSKKFRFPEPEDAPISTYREKRQSFCNDRNLNPSISGAEQDFLSSAQRKNSNPVCLNQRLVEISFGSTHEETTIIRSVASKSTNITKTPRLTPAKASATPKRWTEPSKDRELFRASQTPVKKSAPAARRASLPLPRRSTVKESACRSKIGLLHHINSPDVSVNAPRIDRIAEFPLASYDSPFFPVPKTSSTSAQGSSNSIIGDHSITKDKCTIQVCERALARLSFTNAWPVTQGTMFEVDGEDAGNCSDQNATAGASSQASSDLRRRRFDTSSHRQRAEALEGLLEFSARLMHEERYEELGVLLKPFGPGKVSPRETAIWLTKSFKENTGKQEDQCP

SEQ ID NO: 63130 - protein, 515 aa, Ustilago maydis 521
MASSLRSSTPSRLALRALTRHDATQACAISTNIKVASTSSTSSSSASRVESRGYASPSAPASMATPIEVAQPDIRAGVGSKQGSGKSLLNDILLAAPKHSTANRPIYLDAQSTTPVDPRVVDKMMPYMTNQYGNPHSRTHAYGWESEKGVEEGREHIASLIGADPKEIIFTSGATESNNMAIKGVAHFYKSKKNHIITTQTEHKCVLDSCRRLQEEGFEVTYLPVQSNGLIDLKQLEEALRPTTALVSIMTVNNEIGVIQPIKEIGQLLKTKGAELSKQGGRGASKPFFHTDAAQAAGKIRLDVNELGIDLMSLSSHKLYGPMGIGACYIRRRPRVRLEPIINGGGQERGLRSGTLAPPLIAGFGEAARLAKQELAYDHAHISKLSQRLRNHLEANMTHVLFNGDQNGYPGCLNLTFQYVEGESLLMALKDICLSSGSACTSASLEPSYVLRALGLNDENAHSSLRFGIGRFTTEEEVDYVADKIIKVVNKLRDMSPLWEMVQEGVDLSEVQWSG

SEQ ID NO: 63131 - protein, 521 aa, Arabidopsis thaliana
MDSCCNFSLGTKTVLAKDSFKNVENKFLGEKIKGSVLKPFSSDLSSKKFRNRKLRPGVAYAIATSKNAKEALKNQPSMFERRRADPKNVAAIILGGGDGAKLFPLTKRAATPAVPVGGCYRMIDIPMSNCINSCINKIFVLTQFNSASLNRHLARTYFGNGINFGDGFVEVLAATQTPGEAGKKWFQGTADAVRKFLWVFEDAKNRNIENIIILSGDHLYRMNYMDFVQHHVDSKADITLSCAPVDESRASEYGLVNIDRSGRVVHFSEKPTGIDLKSMQTDTTMHGLSHQEAAKSPYIASMGVYCFKTEALLKLLTWRYPSSNDFGSEIIPAAIKDHNVQGYIYRDYWEDIGTIKSFYEANIALVEEHPKFEFYDQNTPFYTSPRFLPPTKTEKCRIVNSVISHGCFLGECSIQRSIIGERSRLDYGVELQDTLMLGADSYQTESEIASLLAEGNVPIGIGRDTKIRKCIIDKNAKIGKNVVIMNKDDVKEADRPEEGFYIRSGITVVVEKATIKDGTVI

SEQ ID NO: 63132 - protein, 476 aa, Xanthomonas campestris pv. vesicatoria str. 85-10
MFKQLWATKHPHASHEAADGLGLQRALGPWGLTALGIGAVIGGGIFVITGQAAADHAGPAIMLSFVLAAVCCAFCAMAYAEFAAMVPVSGSAYTYTYATFGELAAWLIGWMLVLEYGVSASAVAVSWTGYFLSLLEHFDIHLPAAFVSAPLDGKLQPTGAIANLPAAGIVLLLTWLCYVGIRKSSAMNMAMVILKTGLILLVIAVGWKYVDTSNWHPFIPANEGPGKYGMEGVLRGAAMVFFAYIGFEAVSVAAQESHRPQRDLPIGMILSLVICTVLYIAMAAVMTGLVPYTLLGTDEPVVTAVAAHSQLAWLRVVVEVGALIGLSSVVLVMIIGQPRIFMIIARDGLLPSIFTRIHPKYRTPHVNTVITGVGIALLAAVFPLDVLGELTSMGTLIAFAAVCAGVLILRRTHPELPRPFRMPAAWLICSAGVLSCLALLSAMTLHNWMLMGLWTLVGLVIYFGYGYRHSRLRDGR

SEQ ID NO: 63133 - protein, 490 aa, Xanthomonas campestris pv. vesicatoria str. 85-10
MLKSLLRVKSIEPAGHVDAGEPVEGSLQGEATLQRTLTAKHLIMLGIGAVIGAGIFVLTGQAAANHAGPAVMLSFVFAGIACAFAGLCYAEFAAMMPVSGSAYSYSYATLGEGIAWFIGWCLVLEYLFAGSSVAVGWSAYLISFITGTLGLPFPAELAGAPLAWDGHGFVSSGNLVNLPAVLIVAAVSILCYVGVTQSAFANAIVVAIKVVVICLFVGFGISYIDPANWHPFIPENTGPGQFGWDGVFRAASIVFFSYIGFDAVSTSAGETKDPQKNMPIGILVSLAICTVIYIIVCAVLTGLLPYTQLGTAKPVATALEAHPQLTWLKTAVEIGAIAGLSSVVLVMLMAQPRIFYTMAKDGLMPKLFGKVHPKFRTPYVGTLFVGVVAALLAGVIPLNVLGELVSMGTLLAFATVCAGVLVLRFTKPDLPRPFRVPLAMVICPLGALACLFLFFQAFQEHWKVFVGWTVIGLAIYFGYGIHHSRLAKRA

SEQ ID NO: 63134 - protein, 284 aa, Bacillus sp. SG-1
MDKKEVTSLVKNLQSTRKLHNGVEIPYVGLGVYKMEDHDEAVRAIKNAIEIGYRSIDTASFYNNEVSVGQAVKESGVSREDLFITSKVWNDDQGYDSTLKSFEESLKRLDMGYMDLYLIHWPVAGKYKDTWKAFERLYDEGLIKAIGVSNFNQHHLEDLMKNSNEKPVINQIELHPRLSQQALRDFCKKQDIAVEAWSPIARGRLLDEPTLNHIAGKYNKTAAQVILRWHLQNDTIIIPKSVRESRMRENIDLFNFELSLEDLNQINSLNMDERYGADPNTFDF

SEQ ID NO: 63135 - protein, 409 aa, Zea mays
MRGPWASSALSLRLRLRGARARTNTSPMSSTAARVVHPAAAAPPPPRPRRLAPARCAAGSATDTATAGPTRVTTVSNRGDSLAICRVLNGMWQTSGGWGRIDRDAAVDAMLAHADAGLSTFDMADHYGPAEDLYGMFINRIRRERPPEFLEEVKGLTKWVPPPVKMTRSYVEDNINRSRKRMDVTALDMLQFHWWEYSNPGYLDALKHITDLKEEGKIKTVALTNFDTDRLQIILENGIPVVSNQVQHSIVDMRPQQRMAELCQLTGVRLITYGTVMGGLLSEKFLDTNVSIPFAGPPLNTPSLQKYKRMVDAWGGWSLFQTLLQTLKKVSLKHGVTISTVAVKYILNQTSVAGSMVGVRLGLSEHIKDTNAIFSLELDEEDMNIITEVSKRGRNLIDIIGDCGDEYRA

SEQ ID NO: 63136 - protein, 249 aa, Coxiella burnetii RSA 493
MPTLLKGKTALVTGASRGIGASIAAELGRQGAIVLGTATTEAGAKKITQMLMEEKVEGKGYALDICDQERMKAILSDIQGDFDAPSILVNNAGITRDNILLRMRSEQWDEVINTNLNGVFHLTKACLKSMVKARSGRIINISSVVATMGNAGQANYVAAKAGLVGFTKVVAMEYAAYGITANCIAPGFIETEMTGALSEQQREAILARVPMKRMGQPNEIAQAAAFLASDNAAYITGETLHINGGMCMV

SEQ ID NO: 63137 - protein, 456 aa, Chromobacterium violaceum ATCC 12472
MSEAHTGLQRELKNRHIQLIALGGAVGTGLFLGSASVLKSAGPSMILGYAIAGFIAFMIMRQLGEMVAEEPVAGSFSHFAYRYWGRFPGFLSGWNYWVLYVLVSMAELTAVGAYVQYWWPHVPAWLTALVCFVCINGINLANVKSYGETEFWFALIKVAAVIGMILFGGYLLLSGSGGPQASVSNLWNDGGFFPHGVKGLFMMMAVIMFSFGGLELIGMTAAEANDPQKTIPKAVNQVIYRILIFYIGSLVVLLSLYPWNKVAAGGSPFVMIFEQIGAGFTAHALNFVVLTAALSVYNSCVYATSRMLFGLARQGNAPRALGKLDTRGVPVYATLFSAAATFACVILNYLLPGEALGLLMSLVVAALVTNWAMISLTHLKFRRAKGGQKLVFPSFWFPLSNWICLAFMVMILGILLFTPGMAVSVYVLPVWLGLLWLGFRLKKPSPAEARLAGENA

SEQ ID NO: 63138 - protein, 84 aa, Coxiella burnetii RSA 493
MATVEERVKKIVVEQLGVKEEEVTNSASFVDDLGADSLDTVELVMAFEEEFETEIPDEDAEKITTVQQAIDYIKEHSASESTSA

SEQ ID NO: 63139 - protein, 448 aa, Psychrobacter sp. TAD1
MSISKAIEKVEARYAHQPEFIQAVKEVAITIKPLYDAHPEYDKLKVFERLVEPDRVFGFRVNWEDDNGEIQINRGWRVQFSNALGPYKGGLRFHPTVNQSVLKFLGFEQIFKNALTGLPIGGGKGGSDFDPKGKTDSEIRRFCYAFMRELHHYVNKDMDVPAGDIGVGGREVSYMFAMYKNLTRESTGVITGKGVGFGGSLMRTEATGYGAVYFLQNMLAAQNESIEGKKVLVSGAGNVSLHAAEKATLIGAIVLTVSDSKGTIYDAKGLNQEKIDWLKVQKDQHKPLADYVEVFGGEWMADQKPWSIKADIAIPSATQNEINEEDAKLLVDNGVKYIVEGANMPLTAEAIDYIRLHRVHYAPGKAANAGGVAVSALEMSQNSVRQYQTFEQVDERLQGIMKDIHDSSAQASEMYGQTDEGYIDYMSGANMVGFKRVADALVAFGILN

SEQ ID NO: 63140 - protein, 226 aa, Glycine max
PRVRLVACGEYHTCAVTYSGDLYTWGDGAHNSGMLGHGNEVSHWIPKKVGGNLEGLRVLYVSCGPWHTAIVTSAGQLFTFGDGTFGALGHGDLSSANIPREVENLKGLRTTRVACGVWHTAAVVEVVNESVESSTRSSSGRLFTWGDGDKSQLGHADREPRLVPECVNALSTENICRVACGHSLTIALTTSGRLYTMGSTAYGQLGCPASDGKVPTCVEDIISDSF

SEQ ID NO: 63141 - protein, 216 aa, Chromobacterium violaceum ATCC 12472
MIKLHGIPLSPYYNKVKIALLEKGVNFQEVVATPSQEEALLEKSPMGKIPFVEINGHPLAESTVILEWLEDAYPTASLLPPTPNGRALARELTAMLELYVMLPASPLIRHMLKGTKPEPEKCEEIRQALARGIGAVAKLAQYRPWLAGEDFSFADLSAAGILPVVARLSQAFLGEDMTLRLEGCADYLRRLGERPSVARVWSERDASLAALMARRD

SEQ ID NO: 63142 - protein, 306 aa, Nostoc punctiforme PCC 73102
MRSKKNICQRPSNWRSTQSLPDYLKQNQVPGIYGIDTRALTRKIRMFGAMNGGISTTILDEAELLEQVQAAPNMAGLNLVREVTTSTAYEWSDPTIPAWEFNCEAAENLGEAFTVVALDFGVKRNILRRLVSYGCRVIVVPADTPPEEILNYNPDGVFLSNGPGDPAAVTGGIATAKALLLSQKPIFGICMGHQILGHALGAETYKLKFGHRGLNQPAGLQQRVEITSQNHSFAIDPDSLPTAVVEISHLNLNDRTIAGVRHKSLPVFSVQYHPEASPGPHDADYLFEQFVQAMQAARQAATAEVK

SEQ ID NO: 63143 - protein, 575 aa, Cryptococcus neoformans var. neoformans JEC21
MKGGRFLLPALFKTLLLPPLIAALFIHHFPSLFLPFSALIYLISFPALYVFRSYASLVASSWKASALGAIDIPRVNGTWPLNIDILLNWAKSGTEEEVGRMMVLMGRQYGGTYNTRVLGEDQIISSDPKVIKHVLIDDFDNFVKGQKFKERAQDFLGDGIFNSDGDNWKFHRSFMRPFFQPKYISPLHFSTNVQNFFAKLPSYGKAFDMQARIGQLALELAIMWLCGEDMSGDASNVARTEEWKKAKGEISWAMTEAQKIVGKRVKIGTIWPLFEVRHDPLERPMKVIRAFFRPIISRALNRKRQRCKLDNTEDVYMIDRLVEATDDIKLVEDQLINVLLASRDTLASLLTFSVYAIVLHPDFAARLKDEVFTIANQECEVTKDTIRQLRYCRAFINEVLRLFPPVPLNIRRTLRPSLLPTPNHLAYMPANTSIILATILMQRDPAVWGEDAQVFNPDRWLEGGGLGKEKEGFMSWNLGPRMCLGQSFALAITHTFLVYFFRHIAHVGTLVGHNTTVQLALDAQPPETVLPKEWMTPEGGDGRARGGRDKVWIVADVVLAIKGGLWIRFGAEETE

SEQ ID NO: 63144 - protein, 364 aa, Fusobacterium nucleatum subsp. vincentii ATCC 49256
MIGIGIVGLPNVGKSTLFNAITKAGAAEAANYPFCTIEPNIGMVTVPDERLNELAKIVNPQKIVPATVEFVDIAGLVKGASKGEGLGNKFLSNIRSTSAICQVVRCFEDDNIIHVDGSVDPLRDIEVINTELIFADIETVDKAIEKHEKLARNKIKESVELMSVLPKIKKHLEEFKLLKTLDLTDDEKQILKNYQLLTLKPMIFAANVAEDDLATGNKYVESVKEFAKSIGSEVVVVSAKVEAELQEMDEESKKEFLEALGVKEAGLNRLIRAGFKLLGLQTYFTAGPKEVRAWTIRIGDTAPKAAGEIHTDFEKGFIRAKVVSYDEFIKNSGWKMSQENGVLRLEGKDYIVQDGDLMEFLFNV

SEQ ID NO: 63145 - protein, 402 aa, Helicobacter hepaticus ATCC 51449
MKETGIELMKNTKSVRDIDVKDKRVLIRVDFNVPMDEDFDISDDTRIREALPTINYCIDNHAQNIVLVSHLGRPKGRNAEFSLKHVLKRVERLLGRDIAFAETIENVENLQQQSKSGSVILLENIRFYEGEEKNDEELSTKLASICDVYINDAFGTSHRAHSSTCGIAKYAKECVAGLLLKKEIDSFAKAMANPLKPVLLIVGGSKVSSKLALLYNILDVVDKIIIGGAMSNTFLKARGFDMQKSLVEDDLVSEARKILDKAKEKKVKIYLPVDVVSTDDIKEHRHIKITPAQDIPEGFMAVDMGPATSKLFSEVVRDSQTIIWNGPLGIYEIQAFSRGTFNLAHAVSDTYAFSLIGGGDTADAIDKAGERDNMSFISTGGGASLELLEGKILPAFEVLERK

SEQ ID NO: 63146 - protein, 251 aa, Fusobacterium nucleatum subsp. vincentii ATCC 49256
MRRLVIAGNWKMYKNNKEAVETLTQLKNLTKDIKNVDIVIGAPFTCLSDAVKTVEGSNVKIAAENVYPKIEGAYTGEISPKMLKDIGVTYVILGHSERREYFKESDEFINQKVKAVLEIGMKPILCIGEKLEERESGKTFEVLSKQIKGGLADLSKEEAGKVIIAYEPVWAIGTGKTATPEMAQETHKAVRNVLAEMFGKDIADKMIIQYGGSMKPENAKDLLSQEDIDGGLVGGASLKADSFFEIIKAGN

SEQ ID NO: 63147 - protein, 561 aa, Bacillus cereus ATCC 10987
MIHLKTQYTVSTYLLDRLSELEIEHIFGVPGDYNLAFLDDVVAHEKLEWVGNCNELNAAYAADGYARIKGIAALITTFGVGELSAINGVAGSYAENVPVIKITGTPPTTVMENGALVHHTLGDGKFDHFSNMYREITVAQTNLTPEHAAEEIDRVLRACWSEKRPVHIQLPIDVYNKPINKPTESILHKPVVSNKDALDKMLLHATSKINSARKPVILADFEVARFHAEEYLHQFVEKTGFPIATLSMGKGIFPEKHPQFIGIYTGDVSPSYLRKRIDESDCIISIGVKLTDTITGGFTQGFKKEQVIEIHPYTVKIMDKKYGPVVMKDVLKQLNDLIEHRKEDTLEIKPFISESLPITEEFNPKAQMITQKRFWQQIYHFLQENDVLIAEQGTPFFGSATIPLPNNTTYVAQPLWGSIGYTLPALLGTQLANLSRRNILIIGDGSFQLTVQELSTILRKNLKPIIFLINNNGYTVERAIHGQNEPYNDIQMWDYTKLANVFGTEEKSLTWKVENETELAEVLMNITVNNNQLIFIEVVMSQGDQPELLANLGKRFGMQNS

SEQ ID NO: 63148 - protein, 421 aa, Mycobacterium avium subsp. paratuberculosis K-10
MALVVQKYGGSSVANADRIRRVAERIVATKKQGNDVVVVVSAMGDTTDDLMDLAQQVCPAPPPRELDMLLTAGERISNALVAMAIESLGAQARSFTGSQAGVITTGTHGNAKIIDVTPGRLQAALDEGRIVLVAGFQGVSQDTRDVTTLGRGGSDTTAVALAAALGADVCEIYTDVDGIFSADPRIVHNARKLDTVTFEEMLEMAACGAKVLMLRCVEYARRYNIPVHVRSSYSDKEGTVVVGSIKDKPMEDPILTGVAHDRSEAKVTVVGIPDIPGYAARVFRAVADADVNIDMVLQNVSKVEDGKTDITFTCSREAGPTAVAKLDALKDEIGFTQLLYDDHIGKVSLIGAGMRSHPGVTATFCEALAQVGVNIELISTSEIRISVLCRDTELDKAVVALHEAFGLGGAETATVYAGTGR

SEQ ID NO: 63149 - protein, 878 aa, Rickettsia sibirica 246
MKKLIYYFGSNGSDGNASMKNILGNKGAGLAEMSNLKLPIPDGFTITTELCNYFYTHNNNFPKNFQSDLKKAITELEIITGKIFGSTSNPLLLSVRSGSTVSMPGMMDTILNLGMNNEVCNALADSCGDKRFALDSYKRFLEMYGSTVLSIPSDLFEQIYEKHKMQADIHKDRDITVELLEKIIDDFKRLHIKYTKQLINDPYEQLESAIKAVLHSWMSNRAVIYRKINNISEDFGTAINIQAMVFGNLGKTSATGVAFTRSPSTGEKKLFGEFLINAQGEDIVSGTRTPMPIIANDSNSMQAMMPEVFKELSQIAQKLEEHYLDMQDIEFTIENNKLYILQTRTAKRTAIAAINIAVQMVEEKLISKEQALMRIDPESLNQLLHTRIDYSKGLTSIAEGLPASPGAATGIAVFSPYDAEKLSHHHKVILVRHDTSPEDINGMHVSSGILTIRGGMTSHAAVVARGMGKPCVCGTNNLSIDEKKQILTAGDIVIKQGDIITIDGGSGKIFLGEMPLIQPTFSEESKLILDWADEISSLKVRANAETVNDALVSVKFGAQGIGLCRSEHMFFDKNKIPLVRDMIIAPDIERRKLAVQKLLPLQTEDFKALFRVMKDKPVNIRLLDPPLHEFLPTTEEDKKNLANSLNLPLSMINQRLHAMHEVNPMLGHRGCRLGICSPEIYQMQIEAIFTAIFELHKKEHIECNLELMIPLISNVGEIQKLKMDIYAVIEELEQRYRYKFSFTLGTMIELPRAALGSKKIAKEVDYFSFGTNDLTQTTYGISRDDIASFLPYYLEEKIFESDPFTTLDEEGVGELIEIAIKRGKSSNANLKLGACGEHAGNPASIEFFHRMNLNYVSCSPYRIPIARIAAAQAKIKHG

SEQ ID NO: 63150 - protein, 416 aa, Nicotiana tabacum
MAGMCCGVNLAETEATTPVEPSSEAARRRRMEIHQFRLAPPLENGTKRHKVEKVVDQSKRRKLETSVTISLTSPLSVTEKVVEKEFEAKPLDLLESDVSSVKIERPEVVSGNNNPPKFGTTSVCGRRRDMEDAVAVHPSFCKEENENSNSLHFYGVYDGHGCSHVAMKCKDRMHEIVKNEVEKGETQWKEVMTQSFSQMDNEVVHYSSGALGGSRSNCRCELQTPQCDAVGSTAVVAVVTPEKIIVSNCGDSRAVLCRNGVAIPLSIDHKPDRPDELNRIQEAGGRVIYWDGPRVLGVLAMSRAIGDNYLKPYVISEPEVTITERTEEDECLILASDGLWDVVSNETACGVARMCLQSRKPPSPHGSPENDVTVTGAGESSDQLCSDASILLTKLALARHSTDNVSVVVVDLRKDL

SEQ ID NO: 63151 - protein, 182 aa, Zea mays
NVCQPGSNLLAAGYCMYSSSVIFVLTVGTGVYVFTLDPMYGEFVLTQEKVQIPKAGKIYAFNEGNYALWDDKLKLYMDSLKEPGDSGKPYSARYIGSLVGDFHRTLLYGGIYGYPRDKKSKNGKLRLLYECAPMSFIVEQAGGKGSDGHQRILDITPTEIHQRVPLYIGSVEEVDKVEKFLA

SEQ ID NO: 63152 - protein, 422 aa, Glycine max
  misc_feature (220)..(220): Xaa can be any naturally occurring amino acid
  misc_feature (224)..(224): Xaa can be any naturally occurring amino acid
  misc_feature (232)..(232): Xaa can be any naturally occurring amino acid
MGSVSLKVGDGTARFHRATLCSSAVNILMIFSVITTNLFALYAFTASPKHPHHSLLHHNNAHKNISLISEQVSLILREIDLSQKKLAQMEKELLGYESIDLSRPNIASELKLFLQRHQLPLGKDSRTGITEMVPSVGHTCEKNSDLLSQFMNYKVFGACPDDWSVAQKLILKGCEPLPRRRCFAKTVSKVGLYPFPDSLWKPVGNKTVNWSGLNCKNFEXLNGXKLSRECVXCFDLVHGNENVRFVKAKSKNDFLVDDVLALGGGGVRIGLDIGGGSGSFAARMADRNVTVVTSTLNVEAPFSEFIAARGLFPLYLSLDHRFPFYDNVFDLVHASSGLDVGGKSEKLEFFMFDIDRVLRAGGLFWLDNFFCANEEKKQVLTRLIERFGYKKLKWVVGEKVDSVGSGKPEVVLSAVLQKPVRA

SEQ ID NO: 63153 - protein, 378 aa, Nicotiana tabacum
MAGMCCGVNLTETEATTPVEPSSEAARRRRMEIHQFRLAPPLENGTKRHKVEKVVDQSKRRKLETSVTISLMSPLGVTEKVAEKEFDAKPLDLSESDVSSVKVDGVEVVAGDNNLSKFGITSVCGRRRDMEDAVAVHPSFCKGENENSNSLHFYGVYDGHGCSHVAMKCKDRMHEIVKNEVEKGETQWKEVMTKSFSQMDNEVVHYSSGAVGGSSSNCRCELQTPQCDAVGSTAVVAVVTSEKIIVSNCGDSRAVLCRNGVAIPLSIDHKPDRPDELNRIQEAGGRVIYWDGPRVLGVLAMSRAIGDNYLKPYVISEPEVTITERTDEDECLILASDGLWDVVSNETACGVARMCLQSRRPPSPQGPPENDVTVTGAG

SEQ ID NO: 63154 - protein, 280 aa, Moorella thermoacetica ATCC 39073
MKGIAYLGPRGTYSHEAATIWGQRAGQDSFLACPDLPGVLAAVLQGQAAAAILPVENSIEGAVNLTLDLVLENPELQVIGEVVLPVHHCLISRAGDLATIREVWSHPQALAQCRHYLAQNLPGVITRPATSTAAAADQARQQPYLAAIASNFAAEVYQLPVLAAGIEDYPDNKTRFWVLGRENLHLPGPYKTSLVVAAVANRPGSLYAILKDFAAAGINLTRIESRPTKQELGEYLFFIDCEGRATEPPLREVLVGLKAKTSLLSILGSYARDGGGTSGQ

SEQ ID NO: 63155 - protein, 241 aa, Pseudomonas aeruginosa PAO1
MVFQHDIYAGQQVLVTGGSSGIGAAIAMQFAELGAEVVALGLDADGVHAPRHPRIRREELDITDSQRLQRLFEALPRLDVLVNNAGISRDREEYDLATFERVLRLNLSAAMLASQLARPLLAQRGGSILNIASMYSTFGSADRPAYSASKGAIVQLTRSLACEYAAERIRVNAIAPGWIDTPLGAGLKADVEATRRIMQRTPLARWGEAPEVASAAAFLCGPGASFVTGAVLAVDGGYLCA

SEQ ID NO: 63156 - protein, 396 aa, Staphylococcus aureus subsp. aureus MRSA252
MTKSEKIIELTNHYGAHNYLPLPIVISEAEGVWVKDPEGNKYMDMLSAYSAVNQGHRHPKIIQALKDQADKVTLVSRAFHSDNLGEWYEKICKLAGKDKALPMNTGAEAVETALKAARRWAYDVKGIEPNKAEIIAFNGNFHGRTMAPVSLSSEAEYQRGYGPLLDGFRKVDFGDVDALKAAINKNTAAVLVEPIQGEAGINIPPEGYLKAIRELCDEHNVLFIADEIQAGLGRSGKLFARDWDNVKPDVYILGKALGGGVFPISVVLADKEVLDVFTPGSHGSTFGGNPLACAASIAALDVIVDEDLPGRSLELGDYFKEQLKQIDHPSIKEVRGRGLFIGVELNESARPYCEALKEEGLLCKETHDTVIRFAPPLIITKEELDLALEKIRHVFQ

SEQ ID NO: 63157 - protein, 204 aa, Moorella thermoacetica ATCC 39073
MLLMIDNYDSFTYNLVQYFLELGQEVVVRRNDAITLEEIAELNPDYLVLSPGPCTPNEAGISLAAITAFAGKIPILGVCLGHQSIAQAFGGRIVRAGRLMHGKTSTITHDGKTIYRDLPNPFTATRYHSLIVDEETLPDCLEVTARSETGELMGLRHRQLPVEGVQFHPESILTTVGKQLLRNFLAIGPFARTRSKENGVSLDK

SEQ ID NO: 63158 - protein, 620 aa, Shigella flexneri 2a str. 2457T
MSFDIAKYPTLALVDSTQELRLLPKESLPKLCDELRRYLLDSVSRSSGHFASGLGTVELTVALHYVYNTPFDQLIWDVGHQAYPHKILTGRRDKIGTIRQKGGLHPFPWRGESEYDVLSVGHSSTSISAGIGIAVAAEKEGKNRRTVCVIGDGAITAGMAFEAMNHAGDIRPDMLVVLNDNEMSISENVGALNNHLAQLLSGKLYSSLREGGKKVFSGVPPIKELLKRTEEHIKGMVVPGTLFEELGFNYIGPVDGHDVLGLITTLKNMRDLKGPQFLHIMTKKGRGYEPAEKDPITFHAVPKFDPSSGCLPKSSGGLPSYSKIFGDWLCETAAKDNKLMAITPAMREGSGMVEFSRKFPDRYFDVAIAEQHAVTFAAGLAIGGYKPIVAIYSTFLQRAYDQVLHDVAIQKLPVLFAIDRAGIVGADGQTHQGAFDLSYLRCIPEMVIMTPSDENECRQMLYTGYHYNDGPSAVRYPRGNAVGVELTPLEKLPIGKGIVKRRGEKLVILNFGTLMPETAKVAESLNATLVDMRFVKPLDEALILEMAASHEALVTVEENAIMGGAGSGVNEVLMAHRKPVPVLNIGLPDFFIPQGTQEEMRAELGLDAAGMEAKIKAWLA

SEQ ID NO: 63159 - protein, 222 aa, Beta vulgaris
MDEEMNAVAEMNAVASKVKEEYRRAPKLNQRIISSMSRRSVAAHPWHDLEIGPNAPEICNCVVEIPKGSKVKYELDKKTGLIMVDRILYSSVVYPHNYGFIPRTLCEDGDPMDVLVLMQEPVVPGRFLRARAIGLMPMIDQGEKDDKIIAVCADDPEVRHYTDINQLPPHRLAEIRRFFEDYKKNENKEVAVNEFLPAQIAHDAIQHSMDLYAEYILQTLRR

SEQ ID NO: 63160 - protein, 350 aa, Synechococcus sp. RS9917
MNSERSRPVLVTGAAGFIGAALCQRLLERGDRVIGIDNLNSYYDPALKRARLAEVEAVTAAPGAGRWRFEPIALEDADALMALFAAERPAVVVNLAAQAGVRYSLDNPAAYIQSNLVGFGTLLEGCRHHGVENLVYASSSSVYGGNRNLPFHEQQPVNHPVSLYAASKKANELMAHTYSHLYGLPATGLRFFTVYGPWGRPDMAPMLFAKAILAGEPIKVFNHGRMQRDFTYIDDIVEGVLRCCDKPATANPSFDPLAPDPATAAAPHRLFNIGNSEPIELLRFIEVMEQAFGREAIKDFQPMQPGDVVATAADTTALEAWVGFRPSTPIAEGVQRFADWYRNVYSPLQS

SEQ ID NO: 63161 - protein, 478 aa, Synechococcus sp. RS9917
MTFPSIRTICCIGAGYVGGPTMAVIADRCPAVQVTVVDINQARIEAWNDADLSKLPVYEPGLDAVVGRARGRNLHFSTAVEEQIAAADMVFISVNTPTKTKGLGAGQASDLRWVEACARSVAKAATGHTIVVEKSTLPVRTAEAVQSILAAADPNGGARSFSVLSNPEFLAEGTAIRDLEAPDRVLIGGEDPAAIEALAAIYASWVPDERILRTNLWSSELSKLTANAFLAQRISSINSIAAFCEATGADVREVARAIGTDSRIGPKFLQAGPGFGGSCFQKDILNLVYLCRHFGLPEVADYWESVVQLNTWQQHRIARLVVQKLFGTVTGKRLAILGFAFKADTNDTREAPAIRICRDLLEEGAQLAIHDPKVEPDQIERDLRLSASEAPDAEAGPTRAALSGEGTWWSSAVVEEALAGADAVLILTEWQHYRSLDWAALAPLMRQPAWVFDARSVVDPDQVHAAGLKLWRIGEGQP

SEQ ID NO: 63162 - protein, 468 aa, Azorhizobium caulinodans
MKTAKEVLDFIKSNDVKYVDLRFTDPRGKWQHVTFDITMVDEDFFAEGQAFDGSSIAAEAINESDMLLMPDVTTACVDPFFSETTLSVVCDVLEPTTGEPYGRDPRGIAKKAMAYLQSTGIGDTVFFGPEAEFFIFDDVKFKADPYNTGFKLDSIELPTNGDTDYEGGNLGHRIKTKGGYFPVPPLDSAQDMRSEMLASMAKMGAKVEKHHHEVASAQHELGLKFGQLVTMADHLQVYKYCIHQVANIYGKTATFMPKPVYGDNGSGMHVHQSIWKDRKPLFAGDKYADLSQECLWYIGGVIKHAKSLNAFTNPLTNSYKRLVPGYEAPVLLAYSARNRSASCRIPYTNNPKAKRVEVRFPDPGANPYLAFSALFMAGMDGILNKIDPGSAMDKDLYDLPPAELKQIPTVCCSLREALESLAKDHDYLLKGDVFQKDFIESYIDLKMQEVARFEMTPHPVEFEMYYSV

SEQ ID NO: 63163 - protein, 396 aa, Populus trichocarpa
MASASFLKSSPVLDKSEFVKGQTLRLPSASIVRCRSTAPSALTVRTGSYAEELVKTAKTIASPGRGILAMDESNATCGKRLASIGLENTEANRQAYRTLLVTVPGLGDYVSGAILFEETLYQSTTDGKKMVDVLVEQKIVPGIKVDKGLVPLAGSNDESWCQGLDGLASRTAAYYQQGARFAKWRTVVSIPNGPSALAVKEAAWGLARYAAISQDNGLVPIVEPEILLDGEHGIDRTFEVAQKVWAEVFFYMAENNVMFEGILLKPSMVTPGAECKDRATPEQVAEYTLKLLQRRIPPSVPGIMFLSGGQSEVEATLNLNAMNQSANPWHVSFSYARALQNTCLKTWGGRPENVNAAQEALLIRAKANSLAQLGKYTGEGESDEAKKGMFVKNYAY

SEQ ID NO: 63164 - protein, 288 aa, Helicobacter hepaticus ATCC 51449
MSISQILNDFESFLISQAPQIPSFHPHYEQAVWEMMKNGGKRFRPALVFCVVNALAPQLIKNAFLPALSIECIHTYSLIHDDLPCMDNAPLRRGHATLHTKYDETLALLVGDGLNTYAFALLSQARLDAQVRLELIHSLALNAGIGGMVLGQMLDCAFEDKKLSLQELQIIHTNKTAKLIATSLQFGAIISNAKAHFASSIYEFGLKLGIYFQLRDDLIDACFDAQQAGKTTHNDIHKNSYVNLLGLEGAKVEFTRMKEQIQKELQTFDEAIYVHLTTLLQDYFKDIE

SEQ ID NO: 63165 - protein, 245 aa, Bacillus cereus ATCC 10987
MIKLVLIRHGQSLWNLENRFTGWTDVDLSENGLSEAREAGAILKKNGYTFDVAYTSVLKRAIRTLWIVLHEMDLAWIPVHKCWKLNERHYGALQGLNKDETAKKYGEEQVHIWRRSIDVRPPALTEDDPRYEMNDPRYKALKKGELPLTECLVDTEKRVLAYWHSEIAPSLKSGEKVIISSHGNTIRSLVKYLDNLSSDGVVSLNIPTSIPLVYELDDNLRPIRHYYLSMDGEVPEGEIPKHISF

SEQ ID NO: 63166 - protein, 347 aa, Burkholderia xenovorans LB400
MGLLVDGQWQDRWYDTKSTGGRFVRNDAAFRNWVTADGSPGPSGAGGFEAQAGRYHLYVSLACPWAHRTLIVRALKGLDAMIDVSVVHWLMLENGWTFADGPGVVPDTVNHAALLHQVYTAADPHYSGRVTVPILWDKQRATIVSNESSEIIRMLNSAFDGIGAKPGDFYPAPLRAQIDTINARVYDTLNNGVYQAGFATTQQAYEEAVTPLFETLDWLDAKLATQRYLTGAHLTEADIRLFTTLIRFDAVYVGHFKCNLRRIADYPNLSAYTRDIYQLPGIAQTVDFTHIKRHYYESHRSINPTGIVPLGPVQDFSAPHDRARPGVSGSTCALTAAAGSQPYPVKE

SEQ ID NO: 63167 - protein, 659 aa, Streptococcus pneumoniae R6
MIQIGKIFAGRYRIVKQIGRGGMADVYLAKDLILDGEEVAVKVLRTNYQTDPIAVARFQREARAMADLDHPHIVRITDIGEEDGQQYLAMEYVAGLDLKRYIKEHYPLSNEEAVRIMGQILLAMRLAHTRGIVHRDLKPQNILLTPDGTAKVTDFGIAVAFAETSLTQTNSMLGSVHYLSPEQARGSKATVQSDIYAMGIIFYEMLTGHIPYDGDSAVTIALQHFQNPLPSVIAENSSVPQALENVIIKATAKKLTNRYRSVSEMYVDLSSSLSYNRRNESKLIFDETSKADTKTLPKVSQSTLTSIPKVQAQTEHKSIKNPSQAVTEETYQPQAPKKHRFKMRYLILLASLVLVAASLIWILSRTPATIAIPDVAGQTVAEAKATLKKANFEIGEEKTEASEKVEEGRIIRTDPGAGTGRKEGTKINLVVSSGKQSFQISNYVGRKSSDVIAELKEKKVPDNLIKIEEEESNESEAGTVLKQSLPEGTTYDLSKATQIVLTVAKKATTIQLGNYIGRNSTEVISELKQKKVPENLIKIEEEESSESEPGTIMKQSPGAGTTYDVSKPTQIVLTVAKKVTSVAMPSYIGSSLEFTKNNLIQIVGIKEANIEVVEVTTAPAGSVEGMVVEQSPRAGEKVDLNKTRVKISIYKPKTTSATP

SEQ ID NO: 63168 - protein, 95 aa, Triticum aestivum
RAAARAGEGTTFSNLSNKKADSAADVTDEDDETQAAMEQAEKDADDIAKSVVSRKKRGLMEAMKISNDRKKSKVELLKQRKKAAESSASAKAKRR

SEQ ID NO: 63169 - protein, 383 aa, Ehrlichia chaffeensis str. Arkansas
MKKIQDFSCSGKTVLLRADLNVPVDNGIVLDDTRIVRLTTTIKYLLSNDAKIVIMSHYGSPKSYDKEFSLKFVVEYLNKIFATNVVFIDGVIGDYVEQTIQSVPAGTILLLENLRFYAEEEKNDLNFAKQLALLADIYVNDAFSCLHRKHASIDAITRVMPSFIGFNFQEEMKYLSCVVSNSEKPVAVIVGGSKISTKVHMLKNLIKKIDFLIVGGAIANNFLLSQGLKIGKSLYEELEKDLVTEIVDLAKRYECKIIVPVDYVVAKNYICGDSTIKDNDTLESDDMILDVGPQTVNMIAATINKCRTVLWNGPCGMFEKEPFSKGTFSVANLLSKLTKVGKLKSIVGGGDSICAIKLSGLSNEDFTYISTGGGALLHFLSIA

SEQ ID NO: 63170 - protein, 873 aa, Ehrlichia chaffeensis str. Arkansas
MSEKLIYYFSKTKCDGSLTLSHILGGKGANLAEMCNIGVDVPPGFTVSTAVCNYYYQHSKLPDNIFSLVENAIEFLNNEVNLKFGDNDNPLLFSVRSGSVSSMPGMLDTILNVGLNDNTVIGLAKKSGEFFAYDSYRRLIQMYAHTVLQIESNLFEEVICKKKREAGIPVNSQISDPNILKEIIIEFKKIVSTHTNKDFPQDVHEQLYNSIDAVFRSWMNKRAVIYRKIHNIPDNLGTAVNVQSMVFGNMSQNSATGVVFTRNPSTGEKEIFGEFLVNAQGEDVVSGTHIPLPLNKMQELMPQPYSDLEKVCQKLELHYREMQDVEFTIENGKLWILQSRPGKRSIQSAVKIAVDMVEEKLISREEAILRIDYKSFSKLFHPILENNTNINIIARGLPASPGAATGYAAFTPNDAEQFRKDGKNAILIRQETNPEDINGMNSSVGIITLRGGMTSHAAVVARGMGKPCICSANGIFIDKSEQFFYTNTGLKVHKGDNITINGCNGEVILGTIKTVTPKLSESFYKLMQWVDEIRILKVMANADTPEDTDIAMNFQADGIGLCRTEHMFFSDKRISIVQEMIVSDTKEERIAALEKLEVMQKEDFKKIFKSTINKQVTIRLLDPPLHEFLPDNDNAINEVSVRTGKSLEKLRNKVLYLSEKNPMLGHRGCRLAISYPEIYEMQVRAIFLAIKELQEETDITGIVPEIMIPLVMNEKELVIIKELISNVAQQFNNPKYSIGTMIELPKAALIADKIAQHAQFFSFGTNDLTQTTLGVSRDDSASFIEIYKDLEIIKQDPFETLDIEGVGKLISIAVDLGRKSSPNIKIGICGEHGGNFDSIQFFAKLNLNYISCSPYRIPTARLIAAQAAIMNRV

SEQ ID NO: 63171 - protein, 93 aa, Zea mays
  misc_feature (36)..(36): Xaa can be any naturally occurring amino acid
  misc_feature (71)..(71): Xaa can be any naturally occurring amino acid
  misc_feature (75)..(75): Xaa can be any naturally occurring amino acid
WTYIYVITRRRGGDDHTDTWLKSRHMFHRGCNPTIXVDMVLIDESYARGAVPSGASTGIYDALELRDGGSXYLGXGVVKAERNVNNIFVPINC

SEQ ID NO: 63172 - protein, 322 aa, Bacillus anthracis str. A2012
  misc_feature (248)..(248): Xaa can be any naturally occurring amino acid
MNILVTGGAGFIGSNFVHYMLQSYETYKIINFDALTYSGNLNNVKSIQDHPNYYFVKGEIQNGELLEHVIKERDVQVIVNFAAESHVDRSIENPIPFYDTNVIGTVTLLELVKKYPHIKLVQVSTDEVYGSLGKTGRFTEETPLAPNSPYSSSKASADMIALAYYKTYQLPVIVTRCSNNYGPYQYPEKLIPLMVTNALEGKKLPLYGDGLNVRDWLHVTDHCSAIDVVLHKGRVGEVYNIGGNNEKXNVEVVEQIITLLGKTKKDIEYVTDRLGHDRRYAINAEKMKNEFDWEPKYTFEQGLQETVQWYEKNEEWWKPLKK

SEQ ID NO: 63173 - protein, 476 aa, Moorella thermoacetica ATCC 39073
MAEREESRGKKLQKELGLPRKSAWERLEPGTREKVFAFAEGYKGFLSRAKTEREAIRAALEAARGRGFISLNDIPSGRGLDPGSRFFLTWRDKVMLLGIAGTAPLEEGIRLVGAHVDAPRLDLKPMPLYEKDGLAMFKTHYYGGIKKYQWTALPLALHGVIMLRDGRRVEVVIGEDAGDPIFSVSDLLPHLAKEQMKKNMEEALSGDDLNLVVGSLPFEGEEELKDKIRLAILQLLNQRYGLVEEDFITAELELVPAGPARDLGLDRSLVGAYGQDDRVCAYTALQAVLELENPGHTALVLLVDKEEIGSTGNTGAHSRFLEYALTELAARMGSASIVNVGRIMANSQAISADVTAGVDPTYENYFDMYNASFLGYGVVLNKYSGSRGKYDANDASAEFMGRLRDIFNHNRVIWQSGELGKVDAGGGGTIAKFLAYFGLDVADCGPALLSMHAPLEIASKVDIYMAYRAYGAFLAS

SEQ ID NO: 63174 - protein, 320 aa, Pyrococcus abyssi GE5
MVVSLKGRDLLCLQDYTPEEIWTILETAKMLKIWQKIGKPHRLLEGKTLAMIFQKPSTRTRVRFEVAMAHLGGHGLYLNAQDLQLRRGETIADTARVLSRYVDAIMARVYDHKDVEDLAKYASVPVINGLSDFSHPCQALADYMTIWEKKGTIKGVKVIYVGDGNNVAHSLMIAGTKLGADVVVATPEGYEPDEKVIKWADENAAESGGSFELLHDPVKAVKDADVIYTDVWASMGQEAEAEERRKIFRPFQVNKDLVKHAKPSYMFMHCLPAHRGEEVTDDVIDSPNSVVWDEAENRLHAQKAVLALLLGGRKDGLLTF

SEQ ID NO: 63175 - protein, 459 aa, Pseudomonas syringae pv. phaseolicola 1448A
MQRMDAPAGIARPLLVQHWFICGHKRCLSTQNKLVLWPAVCRLVTYSPSRPSTRNANVTASRIAARVLRIKPSPSSAAADRANELRRAGKSIINLVVGEPDFDTPAHIRQAASAAIENGETRYTLNAGTAALRDAIAAKLQRENGLSYAPGQIVVTSGAKAAIFNAFAATLGIDDEVLIPAPYWVSYPDMVLACDGRPVTLPCPEDNQFKLTAEQLRHAITPRTRWLLLNSPSNPSGATYSATEWRALADVLLDYPDVLVMTDDIYEHIRYDDTPLSHLLTVEPALRERVLIINGVSKTYAMTGWRIGYAAGPSDIINAMATLQSQSTSNACSVSQAAAVAALNGDQSFVGESVKVYKQRRDRCLELINAIDGLSCIQPQGAFYLYVNCAALIGKTTPSGSVLEADTDVVLYLLESQGVAVVAGTAYGLAPFFRMSTATALETLETGCTRIATAVAALR

SEQ ID NO: 63176 - protein, 225 aa, Brassica napus
  misc_feature (199)..(199): Xaa can be any naturally occurring amino acid
MAPSSSSGLTFKLHPLVMLNISDHLTRVKTQLNPPASSCATGNNNPSTGDATLLPQDFRVYGCVIGAQKGRTVEIFNSFELLLDPTTDTLDRSFLEKKQELYQKVFPNFYILGWYSTGSEANESDMSIHKALMDINESPVYVLLNPAINHAQKDLPVTIYESEFHVIDGIPQPIFVNASYAIETVEAERISVDHVAHLXKPSDGGSAATQLAAHLTGIHSAIKCL

SEQ ID NO: 63177 - protein, 511 aa, Rickettsia sibirica 246
MTINPSNIENSSSKINSYFSKLTDYIWPIKRHEVSKFLFITLLMFCILFIQNLIRALKDSIVTTMIGAEIISFLKFWGVMPSAFLMTAIYVKLVNKMKAENIFYLIISIFLTFFALFAYVIFPNHEMLHFSPVTVQNLTASLPNLKWFIWLLSKWSFSLFYIIAELWPNVVFALLFWQFVNNITTVEESKRFYPLFGLLSQTGIYLAGQFLENLSNINDYVTNKFALQSSFHTLSIQIILTIVLILGIIAIKTFWLLNHKVLDKEHMALLRFKAKKKSMTIAESFQMLLSSRHIRLIATLLICYGIAINLVEGPWKAAATKIYKTPTEYAAFIGSYLSYTGVFTILFVILGSNIVRRLGWFTAAVITPLIVFITGILFFAVNNFERFAGLIIANFILTDPALIAITIGAIQNVLSKSSKYTLFDSTKEMAYVPLDPEIKIKGKAAADVIGTKLGKSGSAFLQSLVFIILPSASYQSISTCLMIIFIITCLTWLWATKALNKEYKNSIKFSQ

SEQ ID NO: 63178 - protein, 600 aa, Blastopirellula marina DSM 3645
MTPLIQIQNVVKRFGHKVLLDGASASLIEGQKVGMIGRNGAGKSTLCRAILGDEELEKGDVILHPKLRLGYLRQHDPFEEGETVVGFLMRDSGQPDWKCGEVAGQFEIKGAMLESPVRQLSGGWQTRVKLTALLLHDPNYLLLDEPTNFLDLRTQMLLERFLLDFRGGVMVVSHDRAFLKQTCTHTLELARGKLQMFPGDVDAYLIVQEERKEHDQRVNASVKAKQKQLQRFIDKNRAAASTASQARSKAKQLDRLQLVEIEESDALAYVRVPIVERRRGTVVRCDNMVIGYPDKKIADQVTLDIEHGSRIGVVGDNGQGKTTLLRTLVGSIEPLDGDVKWGHHADVGVYAQHVYTTLPQNDTVEDYLRSAADPDVSTQQVLNVAGSFLFRGEDVKKKVKVLSGGERARLCLAGLLLGKHNVLILDEPGNHLDVETVESLVRALESYNGTIIFTSHDRYFMKSVATNIVEVRDGQVIHFPDDYDHYVYRLNQEIDEEGGAAKGGKSPGGGDHHSVGGDRSDRRDRNKQLRTMRKDLQKIEVKIAKMDDEKKAINAQLMKLTDAKEAQKTHEQLLAITQELEQLEEQWLALNEELMEADEY

SEQ ID NO: 63179 - protein, 295 aa, Zea mays
MEQVQDSPVAPALRQYSPIVAVDCTRGVSNCVVDESTPDHLTLNHIPLSPDTVIEVNGQRSSLHTEFISSSRRGDGVDKKTEEATFVSTDNLRMTGSVRFQVFDMNDLLLTGDLDLCNANGVIGESKNSSKKWNMKCQSSTSCNGFLKGKLSNGSEYVQPMIEVYVAGTFSGTPVILTKTIQLISRRKSEMKLKLDSIPENEATEQQKEESAEDTLKVSEFQDSKSETDVDVDYNSLYSRQDFLEGEDGELSWFNAGVRVGVGIGLGVCVGIGLGVGLLVRTYQSTSRNFRRRLP

SEQ ID NO: 63180 - protein, 437 aa, Archaeoglobus fulgidus DSM 4304
MEIGCITISHKNAKVEEIEKIWLTVKPRLEDVISKCSFSEYAYIFTCNRFEIYLVGENLKSCLQDIAEELGITGKAEIFVGESCLRHLLRVASGIESMIVGEEQILGQVRQCFNLCREGGQAGEVLERVFGKAVQVGRRVRRETAISKGSVSIGSAAVEVAERVLGTLKGKKALLVGAGEMGTLVAKAIAGKEVEAVLIANRTYEKAEELAKRIGGVAVKFDKLVDYLKVCDVVISATSAPHAVITRGDVERAMRERSQKLLIIDIALPRDVDESVAQLDGVELLTIDDLRRISEENLARRREEIAKVEGIIEEELEQLKLLLKDISARDAIAAMYSLAERFVGEEVEELYAKLNARYGVSEDVKEILNDFANSLIKKFLREPTVRLREAARKDEFHVIESIKYVFGDGNGRVSEGKDAKVEEGKPEVDVQRSKAES

SEQ ID NO: 63181 - protein, 225 aa, Lactobacillus plantarum WCFS1
MTELVLVRHGESTANRDNTYTGWSDVPLTAVGIAQAHQAGKRLRATGLQFGAVHTSVLKRAIVTANIMLSEIDQLWLPEYKTWRLNERHYGALRGQNKDVTRQEYGKAQVQQWRRSFYTVPPLLTPAELDHDRRYTKYGAAVEPRGESLKMAYDRIMPYWIDEIAPRLLDGQNQLVVAHGSTLRAMIKYLEHISDTGIDGVEVANGVPICYHLDRQLHVIGKEEY

SEQ ID NO: 63182 - protein, 672 aa, Moorella thermoacetica ATCC 39073
MELLAPLTGIVALLFAFYLTNKINRSDPGNPRMQEIAVAIHEGAMAFLMREYRTLIFFVLGMTALIVVAGFMTRGAESMQPATAIAYVAGTLCSIGAGYIGMQVATRANVRTANAARHSSNAALDIAFSGGSVMGMAVVGLGLLGLGIINYVFKNPSIVNGFALGASSIALFARVGGGIYTKAADVGADLVGKVEAGIPEDDPRNPAVIADNVGDNVGDVAGMGADLFESYVGSIISGIALAAALNIPNGTLVPLMIAAIGIVSSILGAFFVKTGEGANAQKALNTGTMVASILAIVGTFLATRLLPAHFTAGSMSYTSTGVFAATIAGLIAGVLIGRITEYYTSGDYEPVKEIAKASQTGTATNIIEGLSTGMLSTVLPILVIVIAIIASYRFAGLYGIAMAAVGMLSTTGTTVAVDAYGPIADNAGGIAEMAELDPKVRKITDALDSVGNTTAAIGKGFAIGSAALTALALFSAYTAAARITAIDLTDPKVVGGLFIGGMLPFLFAALTMKAVGRAAFQMIEEVRRQFKSIPGLMEGKARPDYARCVAISTGAAIKEMIVPGLLAVLVPLAVGLIPGLGKEALGGLLAGATVTGFLMAVMMANAGGAWDNAKKYIEGGQYGGKGSPAHAAAVNGDTVGDPFKDTSGPAMNILIKLMTIVSLVFAPLFMQL

SEQ ID NO: 63183 - protein, 374 aa, Xanthomonas campestris pv. vesicatoria str. 85-10
MTQPAILVLEDGTVFEGESVGANGLSVGEVVFNTAMTGYQEVLTDPSYARQMVTLTYPHIGNTGFTDQDDEARKIWAAGLIVRDVPRRPSNWRSQVALPEWLQARGVVAISGIDTRKLTRLLRQKGAQNGALMAGEIDVEKALEAARKFPGLKGMDLAKVVSTEKTYLWTEGQLDLDANAFVSVPAKYKVVTYDYGVKLNILRMLAERGCDVTVVPARTPVAEVLALQPDGVFLSNGPGDPEPCDYAIAAIKELVAKKVPTFGICLGHQLLALAAGAKTLKMTTGHHGANHPVQDLDGGRVMITSQNHGFAVDESTLPANVRVTHRSLFDGTNQGIALTDAPAFSFQGHPEASPGPRDVGPLFDRFVDLMAARA

SEQ ID NO: 63184 - protein, 206 aa, Chromobacterium violaceum ATCC 12472
MSIFQNARFYTTVNHMKDLPATRAEVAFVGRSNAGKSSAINTLANRTRLAYVSKTPGRTQHINFFELGDECFLVDLPGYGYAEVPEAVRAHWVELLGRYLQTRQSLIGLLLIMDARHPLKELDRRMLEFFRVAGRPVHILLSKADKLSRQEQNKVLAEVKRELADYPSVSVQMFSSLKKTGVDVVEQVVKGWFDALPPQDDGMAEL

SEQ ID NO: 63185 - protein, 394 aa, Coxiella burnetii RSA 493
MNDVLSVRAQQLEPSVTLAVSDLARELLNKGHDVISLSAGEPDFDTPDFIKQSAIKAIQEGFTKYTNVDGTPALKAAIVHKLKRDNHLNYEPSEILVSGGAKQSIYNVLMGTLNAGDEAIIPAPYWVSYPPMVQLAEAKPIIISATIDQNFKLTPGQLSQAITPQSRLLILNSPNNPSGVAYTESELKALADVLMEHPQILILSDEIYEYILWGQNRFVNILNVCPELRDRTIIINGASKAYAMTGWRIGYAAGPKSIIQAMKKIQSQSTSSPNSIAQVAATTALGAQRGDFAYMYEAYKTRHDLVLKALNQMKGVHCIPADGAFYLFPDVSAAIQQLGLEDDIKLGTYLLDKTKVAVVPGSAFGSPGHVRLSCATSTEKLQEALERLASVLDY

SEQ ID NO: 63186 - protein, 128 aa, Populus trichocarpa
MARLSSFFLISATVLILMVMGWPSTVQGNGDHHHHHLGWIPTTATTRSSICDKGSLAECMAEEDGEEFGMDTEINRRILATSRYVSYGALQKNNVPCSRRGASYYNCKNGAQANPYSRGCSRITRCRG

SEQ ID NO: 63187 - protein, 462 aa, Clostridium difficile 630
MKKTFDAIIIGFGKGGKTLAGDLANRGLKVALIEKSNKMYGGTCVNVACIPTKSLENSANSVKTKNINSWDEVQAEYEKAIDKKETLITKLREANYNKLNSNENVTIFTGMGTFIDEKTVQVKTENEIYELVADNIFINTGSRPFIPNIKGIENKNIVYDSESLMNLRTLPKKMTIIGAGFIGLEFAGIYSSFGAEVTILNSNNGILPNEDVEDSEEIIKLLAKRNVKIVNNANIKEIKEVSELAIVEYEVDGKSKELTSNMILVATGRKANTEGLGLENAGIELNERGFIKVSETLKTNKEHIWAIGDINGGPQFTYISLDDYRIVINQLFGDKTRTTNDRKNIPNSIFISPAFSRVGLNVKQAKEKGYEVLVAKMPVEAIPRAKQIGKADGFIKIVIDKKSNKILGASMICENSSEIIHLIQLAVDLEVEYTYLRDRVYAHPTMTEALNDILSPNMIKEV

SEQ ID NO: 63188 - protein, 195 aa, Picea sitchensis
MGQTFRKLFDNIFGNKEMRVVMLGLDAAGKTTILYKLHIGEVLSTVPTIGFNVEKVQYKNVQFTVWDVGGQEKLRPLWRHYFNNTDGLIYVVDSLDRERIGKAKAEFQAIINDPFMRNSAILVFSNKQDMKGAMTPMEVCEALGLYDLRNRRWHIQGTCATKGEGLYEGLDWLATTLKEMQASGLSTAVGGSRIG

SEQ ID NO: 63189 - protein, 361 aa, Saccharomyces cerevisiae
MKGLILVGGYGTRLRPLTLTVPKPLVEFGNRPMILHQIEALANAGVTDIALAVNYRPEVMVETLKKYEKEYGVNITFSVETEPLGTAGPLKLAEDVLKKDNSPFFVLNSDVICEYPFKELADFHKAHGGKGTIVATKVDEPSKYGVIVHDIATPNLIDRFVEKPKEFVGNRINAGLYILNPEVIDLIEMKPTSIEKETFPILVEEKQLYSFDLEGFWMDVGQPKDFLSGTVLYLNSLAKRQPKKLATGANIVGNALIDPTAKISSTAKIGPDVVIGPNVTIGDGVRITRSVVLCNSTIKNHSLVKSTIVGWNSTVGQWCRLEGVTVLGDDVEVKDEIYINGGKVLPHKSISDNVPKEAIIM

SEQ ID NO: 63190 - protein, 149 aa, Pseudomonas syringae pv. actinidiae
AETRDLLVALASEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63191 - protein, 265 aa, Zea mays
  misc_feature (65)..(65): Xaa can be any naturally occurring amino acid
MAPLGDGGAAAAAASNNLVVSFGEMLIDFVPDVAGLSLAESGGFVKAPGGAPANVACAIAKLGGXDLGLVRRARVFHYGSISLISEPCRSAHMAAMRAAKAAGVLCSYDPNVRLPLWPSPDAAREGILSIWKEADFIKVSDDEVAFLTRGDANDEKNVLSLWFDGLKLLVVTDGDKGCRYFTKDFKGSVSGFKVDTVDTTGAGDAFVGSLLVNVAKDDSIFHNEEKLREALKFSNACGAICTTKKGAIPALPTVATAQDLIAKAN

SEQ ID NO: 63192 - protein, 149 aa, Pseudomonas syringae pv. aptata
TETRDLLVSLAGEVGLKEAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63193 - protein, 422 aa, Oryza sativa Japonica Group
MADRFFPNNMPGYADEGAPPPPAAAAAAAIPSTYSSSLHHLLSLPYPDLADRFLHAALHLKQKVVHETWDKRRRAAAAAGEAVGDFTLYTGALGTALLLFRAYLVTGDRADLATCAEIVAACDAASMGAEIATFICGRAGVCALGAVVAKHAGDEAGVAHYLSAFKEIKIHSKSPDELLYGRAGYLWACTFLNKHLGDNTIPPTTTDTVMRDIIRDGRTLSTIGCPLMYEWYGEKYWGAAHGLSGIMHVLLDMDLTKDDTECVKGTLRYMIQNRFPSGNYPVTEEDKHDRFVHWCHGAPGISLTLAKASQVFPEERFLEAIAEAAEVVWNRGLLKRVGICHGVSGNAYTFLALFRLTKKKEHLYRAKAFACFLLDRAKQLIADGIMHSGDEPYSLFEGQVGMAYLFLDMINPLDSRFPGYEL

SEQ ID NO: 63194 - protein, 453 aa, Triticum aestivum
  misc_feature (190)..(190): Xaa can be any naturally occurring amino acid
  misc_feature (205)..(205): Xaa can be any naturally occurring amino acid
MRPYFDPEYENFNQRINPPRVCIDNNTCRDCTLVKVDSMNKNGILLEVVQVLSDLDLTILKAYITSDGGWFMDVFHVLDKQGHKVTDEKTIQYIEKALGPGSNIPGAAKGSNSPGRSVGMHSIGDHTAIELKGPDRTGILSEIFAVLAELQCNVMAAEVWTHRTRVACVVYVNDVSSGQAIEDACRLARXIEERLRHVLRGHGGXGDDDGGDGRGAHTNFSAGSTHVDRRLHQLMHADMDLGGDGAPQGRPAADDGTAVTVEHCEEKDYSVVNVRCRDRPKLLFDIVCTLTDMQYVVFHAAVASEGIYGVQELYIRRKDGRTLLKDEAEKVTKCLEAAISRRVSEGFTLELCGRDRVGLLSDVTRVLREHGLTVTRADVTTVGEQAVNVFYVRDASGQPVDMKTIEGLRGQVGQTVMLNVKKVPGDKAPERAAGSMAKTSFFSFGGLFAKLGA

SEQ ID NO: 63195 - protein, 149 aa, Pseudomonas syringae pv. aptata
TETRDLLVSLAGEVGLKDAINAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63196 - protein, 342 aa, Picea sitchensis
MGRWVLLALALSAQLLQSQAYNVGSSSNTNGSYGENGLVMNYYGDSCPQAEEIIAEQVRLLYKRHKNTAFSWLRNIFHDCAVESCDASLLLDSTRKSISEKETDRSFGLRNFRYLDTIKEAVERECPGVVSCADILVLSARDGVVSLGGPYTPLKTGRRDGRKSRADVVENYLPDHNESISTVLSRFKAMGIDTRGVVALLGAHSVGRTHCVKLVHRLYPEVDPTLDPGHVEHMKHKCPDAIPNPKAVQYVRNDRGTPMKLDNNYYVNLMNNKGLLIVDQQLYADSRTRPYVKKMAKSQDYFFKYFARALTILSENNPLTGNRGEIRRQCSLRNKLHTISKR

SEQ ID NO: 63197 - protein, 227 aa, Lactobacillus plantarum WCFS1
MNQDQLKQLVGQKAVEYIQDGMQVGLGTGSTVKFMVDALGERVKNEHLNIVGVSTSDRTAAQAKALGIPMKSVDEVDHLDLTIDGADEIADDFQGVKGGGAALLFEKIVAINSDKVMWIVDESKMVHQLGAFGLPVEVIPYGSQHVFEKMAARGYNPVFRKVNDELVRTDSNNIIIDLHIDPITDPHALAEDLIHMVGVVEHGLFLDMVNTVIVGHANGPEVIEARP

SEQ ID NO: 63198 - protein, 481 aa, Salmonella enterica
MSQCLYPVVIAGGTGSRLWPLSRVLYPKQFLNLVGNSTMLQTTIARLNGIKCENPIVICNEDHRFIVAEQLRQIDKLTKNIILEPKGRNTAPAIALAAFIAQKKKPKDDPLLLVLAADHSINNEQAFREAIIKAIPYADAGKLVMFGIIPSVAHTGYGYIKRSVPVDADKDSTAYYVANFVEKPNIQKAQEYIMSEGYYWNSGMFLFRASKYLGELKKFRPDIYNKCESATATANIDMDFVRINETEFINCPEESIDYAVMEKTKDAVVLPIDVGWSDVGSWSSLWDISQKDVHGNVCQGDVINHDSEDSFIYSESSLVATVGVSNLVIVQTKDAVLVADRDKVQNVKNIVDSLKQGGRAEYYMHREVFRPWGKYDAIDQGDRYKVKKIIVKPGEGLDLRMHHHRAEHWIVVSGTAKVSLGNKIKLLVPNESIYIPQGAEYSLENPGVIPLHLIEVSSGDYLESDDIVRFTDRYNSKKFLK

SEQ ID NO: 63199 - protein, 598 aa, Blastopirellula marina DSM 3645
MADFSTVSDLHKGIAVSPGVAVGTAYCILEIFVNPEKTKLEPHEITQELARYETARDQTSSDLSALQSKVESQVGKDEAAIFAAHRTILRDPAFTNKIRHWIVDERMTAQGALHRLLDEYTLLFSRMGDPYLQERLNDIRDVIIRLSAYLTDVLNDPDGGDGCLKGPLIVVADELLPSQAVALGDADVHGIVTERGSQTSHAAIIARSRGIPAVSGVPGIAARVKTGDTIVVNGREGIVVINPEAEELSAYRKLEREFFDLKDQLAANRDLPACTACGQDIELMANINNVQDAAAASAMGAGGVGLYRTEYLYLTHENVPDEAEQIGIYRQVINASPNRTVTIRTLDIGGDKTVAYLGHNHNEANPFMGWRSVRLSFEHPEFFMSQIRAILQSGVGIEGSEVRMMFPMITTVEELRKIRSFVRRAQRRLIEEKKPFADVKVGMMLEVPAAAVVIRSMLDLVDFVSIGSNDLVQYLMAADRDNPKVSNLCQPLAPAVVHTLNDVIRACNMARVPVTLCGEMAGQPRAFILLLGMGLRSFSMSPAFVPTIKQLASQITIERAESLLARALQMKTTNQVKRFLRMELEEISPDIAKLDTDG

SEQ ID NO: 63200 - protein, 512 aa, Burkholderia vietnamiensis G4
MSAGPAGLTHDVPAAPFERNATMSDSVAKPADATFDQFGLAPDILKAIVEQGYTTPTPIQAQAIPVVLAGRDVMGAAQTGTGKTASFSLPIIQRLLPHASTSASPARHPVRALILTPTRELADQVAANVHAYAKHTALRSAVVFGGVDMNPQMAELRRGVEILIATPGRLLDHVQQKTANLGQVQMLVLDEADRMLDMGFLPDLQRILNLLPKERQTLLFSATFSPEIKKLASTYLRNPQTIEVARSNSTNANVTQIVYDVAEGDKQAAVVQLLRGRGLKQVIVFCNSKIGASRLARNLERDGVVASAIHGDKSQIERMQALDAFKRGEIEALVATDVAARGLDIAELPAVINFDLPFNAEDYVHRIGRTGRAGATGDALSLCSPNERKQLADIEKLIKRPLEVQTLALDKPARHRHDERNERGERSERGGRRDRDEHRGASARRSGSAERGGHHRRHDAPVDDFFLKPYEPSTPAQQPEETTSVQQPEKKGPKRQVAALLGGFGMPRKPSA

SEQ ID NO: 63201 - protein, 308 aa, Geobacillus kaustophilus HTA426
MARTVNSITELIGDTPAVKLNRIVDEDSADVYLKLEFMNPGSSVKDRIALAMIEAAEKAGKLKPGDTIVEPTSGNTGIGLAMVAAAKGYKAVLVMPDTMSLERRNLLRAYGAELVLTPGAQGMRGAIAKAEELVREHGYFMPQQFKNEANPEIHRLTTGKEIVEQMGDQLDAFVAGVGTGGTITGAGKVLREAYPNIKIYAVEPADSPVLSGGKPGPHKIQGIGAGFVPDILDTSIYDGVITVTTEEAFAAARRAAREEGILGGISSGAAIHAALKVAKELGKGKKVLAIIPSNGERYLSTPLYQFED

SEQ ID NO: 63202 - protein, 155 aa, Oryza sativa Indica Group
MGSNSAGGGAMVPGGMGAAAGGGGGGGDGRHDDEAVLTEFLSSLMDYTPTIPDELVEHYLGRSGFHCPDLRLTRLVAVATQKFISDIASDSLQHCKARVAAPIKDNKSKQPKDRRLVLTMDDLSKALQEHGVNLKHPEYFADSPSAGMAPAAREE

SEQ ID NO: 63203 - protein, 188 aa, Geobacillus kaustophilus HTA426
MIDNYDSFTYNLVQYLGVLGEELIVKRNDEITVAEIERLRPDFIMISPGPCTPNEAGVSLEVIDRFAGQIPIFGVCLGHQAIAQAFGGRVVRAPRLMHGKTSSVYHDGETIFCGVPNPFTATRYHSLIVEKETLPDCFVVSAWTKEDEVMAIRHKTLPVEGVQFHPESIMTSHGMQLLKNFINTYKKA

SEQ ID NO: 63204 - protein, 427 aa, Oryza sativa Japonica Group
MPSPSLRLAVVGAGAAGLVAARELRREGHSPVVFERAASVGGTWLYDAAPATSDPLAAGAAHSSLYASLRTNLPREVMGFLDFPFASSAAEAGGGGDTRRFPGHDEVLRYLEEFARRFDLYGLVRFGTEVVRVRRDGGGGGGRWAVTSRKIGEKGRREEEEEVYDAIVVCNGHYTEPRVAHIPGVEAWPGKQMHSHNYRVPEPFHDQVVIIIGASASAVDISRDLAGVAEEVHVADRSAPACTCKRQPGYDNMWLHSMVNALFSCYLYDFPFLEDDSAITVDDNCVDPLYKHVFPPEVAPHLSFIGLPWKVIPFPLFELQSKWVAGVLSGRVKLPSSEEMMEDVKAFHSKMEARGWPKRYAHNFSDCQFEYDDWLAEQCGHPPIEQWRKLMYAANSENKAARPESYRDEWDDDHLVAEAAEDFKKYL

SEQ ID NO: 63205 - protein, 595 aa, Populus trichocarpa
MEPKNTNGSSRSYEHDIISWFEDISKKAGQVQTETLRRILELNWGVEYLNKWLGDINIQDMDASALESLYTSLVPPASHADLEPYISRIADGDTVPLLTKQPITLLSLSSGTTDGRQKFVPFTDHSARTTLQIFSLAAAYRSRVYPTREGGRILEFIYSSKQFKTKGGLTAGTATTHYYASEEFKIKQEKTKCFTCSPQEVISGGDYEQSTYCHLLLGLFFCDQVEFITSTFAYSIVQAFTAFEDVWRDICNDIKHGTLSERINLAKMRKAVLSIISPNPSLASKIEENCKELETQNWLGLITKLWPNSKYVYSIMTGSMQPYLQKLRHYAGGLPLVSADYGSTESWIGANVDPYLPPEDVTFAVIPTFSYYEFMPLYRENHYCGSAIDDFIEDEPVPLSKVKVGQEYEIVLTTFTGLYRCRLGDVVEVAGFHKGTPKLNFICRRKLILTINIDKNTEKDLQLVVEKGSQLLMSKARAELVDFTSHAELETQPGHYIIYWEIKGDVEEEVLGECCKKMDASFVDHGYVVSRRTKSIGPLELCIVKTGTFKKILEYFIGNGAALSQFKTPRCTSNHGLLKILNGSTIKRLYSTAYS

SEQ ID NO: 63206 - protein, 114 aa, Geobacillus kaustophilus HTA426
MQGMEFYGYHGVFREENILGQRFLVDVTLEIDLQPAGRSDCLEYTVNYADVYERCRAIVEERTFALIEAVAEAIAADLLAAFPVVERCIVKVTKPNPPIRGHYQHVAVEIDRGR

SEQ ID NO: 63207 - protein, 124 aa, Brassica napus
HQWISPYPPPPYSSSSITAALLLLLRRTRYRRMGLPPGSLGLPLIGETLQLIAAYKTENPEPFVDARVARYGSVFMTHIFGEPTVFSADPETNRFVLQNEGKLFECSYPASICNLLGKHSLLLM

SEQ ID NO: 63208 - protein, 149 aa, Pseudomonas syringae pv. broussonetiae
TETRDLLVSLAGEVNLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63209 - protein, 586 aa, Rhodococcus sp. RHA1
MSDIERDPEPPTFADLDIDDRVLKALSDVGYESPSPIQAATIPPLLAGNDVVGLAQTGTGKTAAFAVPILSKIDLTQKSPQALVLAPTRELALQVAEAFGKYSAHIPGLHVLPIYGGQSYGVQLSGLRRGAHVVVGTPGRVIDHLEKGTLDLSKLSYLVLDEADEMLKMGFQEDVERILADTPEYKQVALFSATMPGAIRKISKQYMHDPVEITMKSKTSTASNISQRYVQVAHQRKLDALTRVLEVEDFEAMIIFVRTKQATEDLAEKLRSRGFSASAINGDIVQAQRERTIGQLKSGALDILVATDVAARGLDVDRISHVVNYDIPHDTESYVHRIGRTGRAGRAGEALLFVAPRERHLLKAIEKATRQPLAEMQLPSVDDVNAQRVSKFGDSITESLTSDNLALFRKMIEDYEQEHDVPLADIAAALAVQSRDGEAFLMAPEPPPAPRREREPRERPARRFDEGPPTRSRGPEGQELATYRIAVGKRHRVVPGAIVGAIANEGGLRRSDFGHISIRPDHSLVELPADLSSETLEALRRTRISGVLIQLQPDSGPPSGRPRGGRDDRAGGKFQRDRDSRKKPRE

SEQ ID NO: 63210 - protein, 553 aa, Coccidioides immitis RS
MSAFDQATSLGAWKALEEHHSSAGKDISLKEEFQKDPQRFSKFSRTFNNPADGSEILFDFSKNLITDETLKLLVNLAKEAGVEKLRDEMFNGDPINFTENRAVYHVALRNVSNGPMQVNGKSVVEEVNSVLQHMKEFSEQVRSGEWKGYTGKKIKTIINVGIGGSDLGPVMVAEALKPYADRSLTVHFVSNIDGTHIAEALKESDPETTLFLIASKTFTTAETITNAQTAKAWFLATARDEAHIARHFVALSTNEAEVTKFGIDKRNMFGFESWVGGRYSVWSAIGLSVALYIGFDNFHQFLAGAHAMDKHFRETPLEQNIPVLGGLLSVWYSDFFGAQTHLVSPFDQYLHRFPAYLQQLSMESNGKAITRSGDFVKYTTGAILFGEPATNAQHSFFQLLHQGTKLIPADFIMAAESHNPVENGKHQRMLASNFLAQAEALMVGKSPDQVRAEGAPENLVPHKTFTGNRPTTSILAQKITPAALGALIAYYEHVTFTEGAVWNINSFDQWGVELGKVLAKKIQSELETKGAGSGHDASTSGLIAAYKKKAGLL

SEQ ID NO: 63211 - protein, 580 aa, Myxococcus xanthus DK 1622
MARTWWAARRGLPGLRQARGYQRRWFRADLLSALTIGAMLIPQGLAYAQLVGVRPAAGLYAGVVGMLAYALFGPSRHLIIGPEAGAAILTAAALAPVAAGAAPARYASLAALLALLVGVLSLLGGLLKVGALADFLSKPILIGYINGAALIIIGSQLARLFGQERQSDTFSGQVFEVATHLERTHVPTLLLGLGVITALVLLRQLLPKVPGPLILVVLTTVAGGLFQLEHGGIKVVGPLAAEPPAPGLPSLRFEDVRSLLPAAFSLALVNYASSVLTGRFYADRFRYRLDSNQEFLGQAAANLATAFSQGFPVTGSDSRTAVNVSMGGRTQLVGVLAAGVVLVFALFLTPLLHDLPMVTLGAIVFVAAVYLLEFRAIIDLWRVRRVEAVLACVTMAGVLVLGILQGILVAVALALADLIRRAARPHDAVLGEREGVPGYHDIERFENAETVPGLVIYRFDAPLFFANARHLREQARALVSSADAPVRWFVLDASAVFDMDVTAADGLEKLRREFEEEGVVLGVAEARAPLRALLRRTGLLERLGPENVHATVEAAVHHFLKDADARHARDGEPPALPPVH

SEQ ID NO: 63212 - protein, 149 aa, Pseudomonas syringae pv. coronafaciens
TETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMRIRAETTLFIVSS

SEQ ID NO: 63213 - protein, 685 aa, Magnaporthe grisea 70-15
MSRFARGSILRRLAAPTAITALGGSLVLYAYRPRNIPGFEDPAVPPPTYGADGTFKLPRFPRTKSREEQIAILQRSSDPKAADKDEGVYDMLVIGGGATGAGVALDAATRGLKVALVERDDFAAGTSSKSTKLVHGGVRYLEKAVWELDYSQYELVKEALKERKYFLQTAPHLSSWLPIMLPLDKWWKVPYYWAGTKFYDFLAGSEGIESSYFLTRSKALDAFPMLKKEGLVGALVYYDGAHNDSRMNVSIAMTAALYGATVVNHMEVTSLTKDANGRLCGATAKDLVPARDGKPAPEVNIRARCIVNCTGPFSDGIRKLDDSSVQEIVAPAAGVHIVLPGFYSPANMGLIDPQTSDGRVVFFLPWQGNTIAGTTDDPSTIVKDPIPDEKSIEWILNEIRHYLSPDITVRRGDVLAAWAGLRPLVKDPKAKNTEAIVRNHLVDISPSGLVTCAGGKWTTYRQMSEECVDAAIAEFKLKPGRVVNAPRVSGTEEIDDGADLDGSCQTHKVRLIGAHGFSKNLFIHVIQHFGVETDVAKHLTESYGDRAWTVAALSKVTDKRFPARGERIHELYPFVDGEVRYAVRHEYAQSAIDVVARRTRLAFLNAQATLEVLPKVIDIMTEELKWDKRRQEFEWKETVKFLESMGLPRPLLTVTRKEIEQGKIDLSTSLEYKMYTRHDKPVEEL

SEQ ID NO: 63214 - protein, 556 aa, Oryza sativa
GRLRGARLLLVRFCFLFKPNAPPHRLRSPPRLTQPPVAMGNRTSRHHRAAPEQPPPQPKPKPQPQQQQQQWPRPQQPTPPPAAAPDAAMGRVLGRPMEDVRATYTFGRELGRGQFGVTYLVTHKATGKRFACKSIATRKLAHRDDIEDVRREVQIMHHLTGHRNIVELRGAYEDRHSVNLIMELCEGGELFDRIIARGHYSERAAAALCREIVAVVHSCHSMGVFHRDLKPENFLFLSKSEDSPLKATDFGLSVFFKPGEHFRDLVGSAYYVAPEVLKRLYGAEADIWSAGVILYILLSGVPPFWAESEDGIFDAVLRGHIDFSSEPWPSISSGAKDLVKRMLRQDPKERLTAAEILNHPWIREDGEAPDKPLDITVISRMKQFRAMNKLKKVALKVVAENLSDEEITGLKEMFRSLDTDNSGTITLEELRSGLPKLGTKISESEIRQLMEAADVDGNGTIDYAEFISATMHMNRLEKEDHILKAFEYFDKDHSGYITVDELEEALKKYDMGDDKTIKEIIAEVDTDHDGRINYQEFVAMMRNNNPEIAPNRRRMF

SEQ ID NO: 63215 - protein, 452 aa, Geobacter metallireducens GS-15
MKSFDVVIIGGGPGGINAGIMLSKAGKNVALIQEEAVSFGGTCLNSGCMPTKSLLKAATAYRYAKQAERYGLDLQAGPVDLGKLCAVTETDLNMLRGAIKGMLAETSITAFRGNGSFASEHEVTVTMAGGEQETIWGETIIIATGSSPRELPSAPFDGLHILSSDQMLTNTDLPKKLLIVGGGAIGCEFATLYKTFGSEVVLIEAMETLLPREDRDAGKKLQAAFEAQGITVRTGTSIDRLIVVDEKIRIQFDNGDSIDSIDKVLVGIGRAPNIEGLNLEAAGLRTEHGAVKVNELMQTNVPHIYAIGDVTGGLTLAHAAQREAQLLVQNLLHGSSHALKELAVPRVAFSYPEVAAVGASQEGNGIRAYTLPQVPNGRSVVDKVAPAFVKLFLKEQTSEIAGAVIIGEAATEIIHEMALAVENGLTLQQVGNTVHVHPTHSKNILYAIQSCG

SEQ ID NO: 63216 - protein, 295 aa, Glycine max
MEIDGRFLNTGLLLVATILVAKLISAFIVPKSRKRVPPIVKGWPLIGGLIRFLKGPIFMLREEYPKLGSVFTLKLFHKNITFLVGPEVSAYFFKASETDLSQQEVYQFNVPSFGPGVVFDVDYSVRQEQFRFFTEALRANKLKGYVNQMVAEAEDYFSKWGPSGEVDLKYELEHLIILTASRCLLGREVRDKLFDDVSALFHDLDNGMLPISVLFPYLPIPAHKRRDQARKKLAEIFASIITSRKSASKSEEDMLQCFIDSKYKDGRSTTEAEVTGLLIAALFAGQHTSSITSTV

SEQ ID NO: 63217 - protein, 156 aa, Pediococcus damnosus
DTIENYSELFVQPQNATFLSIDDPDSMKDSLKNAADGRDIRLIVVTDAEGILGIGDWGTNGVDISVGKLMVYTAAAGIDPSQVMPVALDTGTNNQDLLKDPMYLGNRHERVTGDRYYKFVDQFVNTAEDLFPKLYLHFEDFGRDNAANILNTYKDK

SEQ ID NO: 63218 - protein, 421 aa, Magnaporthe grisea 70-15
MFSRRLITAARLVPVSQATSQPLRRFPLHRHFQHVRTYADQVVKVPQMAESISEGTLKQFTKQVGDFVEQDEELATIETDKIDVAVNAPAAGTIKELLASEEDTVVVGQDLIRLELGGAPAEGAEKKSEKPQETQAEKKPEPKEESKPEPTKKEEPAPSKKQESAPQPEKKETKQPAKESSPATLGNREERRVKMNRMRLRTAERLKQSQNTAASLTTFNEVDMSSLMEFRKLYKDDVMKKTGVKLGFMSAFSRAAVLAMRDIPAVNASIEGPNGGDTIVYRDYVDISLAVATEKGLVVPVVRNTESMDMITIEKSIAEMGAKARAGKLTIEDMAGGTFTISNGGVFGSLMGTPIINLPQTAVLGLHAIKDRPVVVNGKIEIRPMMYLALTYDHRLLDGREAVSFLVKIKEFIEDPRRMLL

SEQ ID NO: 63219 - protein, 409 aa, Bacillus sp. SG-1
MNAKEIRKYFPILDQEVNGHPLVYLDSAATSQKPVQVIEALDKYYREYNSNVHRGVHTLGTLATDGYEGSREKVRKFINAASTEEIIFTRGTTTAINTVAASYGRANVGEGDEIVISHMEHHSNIIPWQQLAKETGATLKYVPLQEDGTISIEDVKNTVTSNTKIVSIMKVSNVLGTMNPVKEIAKVAHDNGAVMMVDGAQAAPHMKVDVQDLDCDFFAFSGHKMAGPTGIGVLYGKKHLLENMEPVEFGGEMIDFVGMYESTWKELPWKFEGGTPIIAGAIGLGAAIDFLEEIGLDHIEKHEHELAAYAMEKMSGIEGMTIYGTKDPAKRAGLVTFNIDDVHPHDVATVLDAEGIAVRAGHHCAQPLMKWLKVSATARASFYVYNTEEDIDKLVSGLVRTKEYFSDVF

SEQ ID NO: 63220 - protein, 156 aa, Pediococcus damnosus
DTIENYSELFVQPQNATFLSIDDPDSMKDSLKNAADGRDIRLIVVTDAEGILGIGDWGTNGVDISVGKLMVYTAAAGIDPSQVMPVVLDTGTNNQDLLKDPMYLGNRHERVTGDRYYKFVDQFVNTAEDLFPKLYLHFEDFGRDNAANILNTYKDK

SEQ ID NO: 63221 - protein, 180 aa, Glycine max
MEKSREEKLSQVWDCGSTLYDSYELNSFKRQLNTAIANSPCNRRTLSMSHLPERCLSSQPQPQPPMSNNNKSFRFSRTFQKLLRFVFKSRNKLRISSTRSTSNNISTFQVAEKYSNDRFYVVYDKSEPVLSTIPELPEFEVGVLSPDITSFVRKSASERFMGHRLLSVFRVLNTIGSVFR

SEQ ID NO: 63222 - protein, 104 aa, Brassica napus
  misc_feature (5)..(5): Xaa can be any naturally occurring amino acid
  misc_feature (9)..(9): Xaa can be any naturally occurring amino acid
DYQNXTVNXDLHYTHWDTVLQQRALNLTVEDFHDMVQSGAPFAREFREDDLVLDKIDAELLGQTDGGLGLKTREVVKPTVAWKRLEKLMVKLLDHENFRAKQCK

SEQ ID NO: 63223 - protein, 482 aa, Helicobacter pylori J99
MIKQILTILTPFFVATLLYFLGAPDGLNPNAWLYFCIFMGMIIGLILEPVPSGLIALSALVPCIALKIGASSEVASANKAISWGLSGYANKTVWLVFVAFILGLGYEKSLLGKRIALLLIRFLGQTPLGLGYAIGLSELCLAPFIPSNSARSGGILYPIVSSIPPLMGSTPSNNPDKIGAYLMWVALASTCITSSMFLTALAPNPLAMEIATKMGVNEISWFSWFLAFLPCGVVLILLVPLLAYKTCKPTLKGSKEVSLWAKKELESMGRFSLKEILMLSLTLLALLGWIFGKSLGLHASATALIVMVLMAFCKIVSYEDIIKNKSAFNIFLLLGSLLTMAGGLKNVGFLNFIGNAAQNFLEHAHLDPLIAVLFIVALFYLSHYFFASITAHVSALFALFVGIGSHIQGVNLQELSLFLMLSLGIMGILTPYGTGPSTIYYGSGYIQSKDFWKWGFIFGFLYLIVFLSVCAPWVKFIAYRWL

SEQ ID NO: 63224 - protein, 332 aa, Ralstonia eutropha JMP134
MTIKIGINGFGRIGRMVFRAAAANFKDIEVVAINDLLEPDYLAYMLKYDSVHGRFDGEVSVDGNTLVVNGKKIRLTAVKDPAELKWGEVGADVVIESTGIFLTKEGAQKHIDAGAKKVIMSAPSKDDTPMFVYGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKSASYEEICAEMKAQSQGALKGVLGYTEDKVVATDFRGDARTSIFDAEAGIALDGTFIKVVSWYDNEWGYSNKCLEMARVVAK

SEQ ID NO: 63225 - protein, 81 aa, Zea mays
MVANGDAPARGSAAAAASLRRRRTTSGAAGGGGGASSMLQFYTDEAAGRKMSPNTVLIMSIGFIAVVAMLHVFGKLYRTSN

SEQ ID NO: 63226 - protein, 329 aa, Pseudomonas putida GB-1
MIEHSSLPRLSIASLGGTVSMQAGAAGCGVAPALDCEQQLLQVPQLREMAQLNVASLSLLPSASLGFVALLDLLVWARSEVERGAQAVILTQGTDSLEETAYFLDLLWPFDAPLVMTGAMRSASQVGNDGPANLLAAAQVALAQGSRGRGVLVVMNDQVHCAARVRKMASLAMAAFESPGFGPSAEVVEGVVVYRHPPGRRAVLPLPGRTDQRVALLEACLDVDTALLQAVAPLGYEGLVIAGFGAGHVSGTWSDVLEHLAPTLPVIVATRTGRGPTARTTYGFAGSEIDLQRKGVQMAGHLCPRKCRILLWLLIGTERQHELQGWLAI

SEQ ID NO: 63227 - protein, 173 aa, Triticum aestivum
AYLGDTIEQVCTKKQAGTGPEFPGYRRPTRPAKQMAESFNMSTFANREDLLGQSKKAADDMNRVAGLDNQGIVGLQRQIMKEQDEGLEKLEQTVLSTKHIALAVNEELDLHARLIDDLDDHVDGTNSRLQRVQKRLAVLNKRAKGGCSCMSLLLSTVGIVMLVVIVWLLIKYL

SEQ ID NO: 63228 - protein, 466 aa, Sinorhizobium meliloti 1021
MDTRPEPFEPPAPVPRTGIPSRLEIIRTVLRNPLELWGEPSYTLPWIETKFINQRTLIVNDPGLIRYILVENAANYEMSNVRRLILRPILRDGLLTAEGEVWKRSRKAMAPVFTPRHAQGFAGQMLRVCEAFVDRYAGASSEPFVTNVAVDMTELTFEILAETLFSGEIAVEKQGFAANVEELLHRMGRVDPMDLLVAPSWVPRLTRIGGRKVLDRFRGVVSETMSLRRRRTTEAPGDVPNDFLTLLLQLEGPDGLSTSEIEDNILTFIGAGHETTARALAWCFYCVANTPAYRETMEQEIDSVLASGADPVDWLGRMPHVLAAFEEALRLYPPAPSINRAAIEEDAWTSPEGERVPIRKGISVLVMPWTLHRHALYWQKPRAFMPERFLPENRDKINRFQYLPFGAGPRVCIGATFALQEAVIALAVLMHRFRFDLTDETHPWPVQRLTTQPRGGLPMKVSARVK

SEQ ID NO: 63229 - protein, 326 aa, Ehrlichia chaffeensis str. Arkansas
MKTTILGAGSFGTAIAFALSSNSTSVNLWGRNHTDMQSIAINRKNLKYLPTCKLPENIIVSSNIDEVLSDYSTCIILAVPTQQLRTLCLSIQDKQHIFEKTPLLICSKGIENISLKFPSEIVKEILPNNPAFILSGPSFAKEIAEDLPCTIVLAGENESLGTSIAQKISNKTFKIIYSQDILGVQIGAALKNIIAIACGIVTGKNLGNNAIATVITKGMEEIKTLYAAKNQNINLSTLIGPSCLGDLILTCTTAHSRNMSFGITIGQGADINKMLNNNSKIIEGVSTVKPLISLAKELNIELPICTSIYNLLYKNIPLEKTISDIL

SEQ ID NO: 63230 - protein, 158 aa, Geobacillus kaustophilus HTA426
MFRIGQGFDVHQLVEGRPLIIGGVTIPYEKGLLGHSDADVLLHAVADACLGAIGAGDIGRHFPDTDPRFKDADSAELLAHVWALARQEGYRLVNADCTIIAQKPKLAPYIEEMRAVIARLLEAERSQVNVKATTTEKLGFTGRGEGIAAQAVVLLQKS

SEQ ID NO: 63231 - protein, 378 aa, Saccharomyces cerevisiae
MESADFFTSRNLLKQIISLICKVGEGLDSNNQRLFEEKMTVSKIPIWLDCDPGHDDAIAILLGCFHPAFNLLGISTCFGNAPPENTDYNARSLLTAMGKAQAIPVYKGAQRPWKREPHYAPDIHGISGLDGTSLLPKPTFEARTDKTYIEAIEEAILANNGEISFVSTGALTTLATVFRCKPYLKKSVKYISIMGGGLHGLGNCNPNLSAEFNVWIDPDAANYIFRDPDVKDKCIVVPLNLTHKAIATYKVNEMIYNEKNNSKLRELFLELFQFFAHTYKDMQGFESGPPIHDPVALMPLLEFYGWDPSSAVGFRYKRMDISCIDDVFNENSGKIIIEKEYPNDSDVGTIIGLDLNIQYFWDQIFEALNRADKMSTIG

SEQ ID NO: 63232 - protein, 617 aa, Actinobacillus pleuropneumoniae serovar 1 str. 4074
MQNKYPLLSQINSPEDLRLLAKEQLQSVADELRAYLLESVSQTSGHLASGLGVVELTVALHYVYQTPFDQLIWDVGHQAYPHKILTGRRDQMHTIRQKNGIHPFPWREESLYDVLSVGHSSTSISAGVGIAVAAEKENAGRKTVCVIGDGAITAGMAFEAMNHAGALHTDMLVILNDNEMSISENVGALNNHLARIFSGSIYTTVRDGSKKVLDKVPTIKNFMKKSEEHMKGVISPESTLFEELGFNYIGPIDGHNIDELVKTLSNMRELKGPQFLHIRTKKGKGYEPAENDPIGYHGVPKFDPTCGQLPKSKTIPTYSDIFGNWLCEMAEQDSKLIGITPAMREGSGMVEFSKRFPEQYFDVAIAEQHAVTFGAGLAIAGYKPVVAIYSSFLQRAYDQLIHDVAIQNLPVIFAIDRAGIVGADGQTHQGAFDVSFMRCIPNMTIMCPSDENEMRQMLYTAYRMNTPTAVRYPRGNAQGVALAPMQALEVGKGKLIQQGQKVAILNFGPLLNEARIVAEKHNYTLADMRFVKPLDEQLVAELADSHELLVTLEENAIQGGAGSAVNEYLQKIGKIRPLVMLGIPDFFVPQATQAESYADLGLDAAGIEQRIQAVVNQ

SEQ ID NO: 63233 - protein, 224 aa, Geobacillus kaustophilus HTA426
MFKTLKEDIEVIFEQDPAARSYLEVILTYSGLHAIWAHRIAHALYKRKFYFFARLISQISRFFTGIEIHPGAKIGRRFFIDHGMGVVIGETCEIGDNVTVYQGVTLGGTGKEKGKRHPTIKDNCLIAAGAKVLGSITIGENSKIGAGSVVLKDVPPNSTVVGIPGRVVVRDGVKVKKDLNHTDLPDPIADRFRELEEEIARLKSELEALKQQERKNEYEQHPAL

SEQ ID NO: 63234 - protein, 270 aa, Actinobacillus pleuropneumoniae serovar 1 str. 4074
MNPMLNIAIRAARKAGNIIAKGYEQAASEIEVAQKGTNDYVTAIDKAAEAAIIEVIRKSYPDHAIVGEESGILAGENENVQWVIDPLDGTTNFVKRLPHFAVSIAVRENGRTTVGVVYDPIRNELFTAVRGEGAKLNEFRLRVETERRDLNGTVLATGFPFKAAKHRPAHLNMLEGLMNNGVADFRRTGSAALDLAYVAANRVDGYFEIGLKPWDCAAGDLIVREAGAIVTNFVGGTDYLKSGNVVAGQARVVKEILNAIQPTLTEDLKN

SEQ ID NO: 63235 - protein, 457 aa, Lentisphaera araneosa HTCC2155
MSIKNIVCIGAGYVGGPTMSVVAQKCPHINVTIVDLNQARIDAWNSDSLPIYEPGLEAVVQEARGRNLTFSTDIEGNIAKADMVFVSVNTPTKTFGKGAGVAANLEFIEKCARTIRANASKDLIVVEKSTLPVRTAETLEKILHAGDSKYHFEILSNPEFLAEGTAITDLHDPDRVLIGGRQNDLGKAAIQELVDVYANWVPNERILTTNTWSSELSKLVANAFLAQRVSSINAISSLCESTEADVGEVSRAIGMDSRIGSKFLKASVGFGGSCFKKDILNLVYICRTYGLTAEADYWEQVILMNDHQQSRFVDKLVGTMFNTVSDKKIAVLGFAFKADTGDTRESPAIHVVQELCEEHARVSVSDPQALGYAKTDLAGLEEFVTLEEDPYKACEGADAVCILTEWELYKDLDYKRIFDSMNKPAFLFDGRNIVNHQELYDLGFNVYPIGKGELSHL

SEQ ID NO: 63236 - protein, 479 aa, Cryptococcus neoformans var. neoformans JEC21
MPPRIAPLLSRTVRTSTRSFASTSVSMSAPVRTAAQWSDFGREHVSHGLGRVKDHVIVKGEGLNLYTADGKKLLDFTAGIGVTNLGHCHPAVSKAAAEQINNLVHLQCSIAFHQPYLELIEKLLPVMPDPSLDQFFFWNSGSEAVEAAVKLTRKATGRQNLIVFQGAYHGRTMGSGSMTRSKPIYTQNTGPLMPGVIATPYPYWHSLGASPSTSEEELVNLAKYQLDLLFRQQTSPKDVAAIFIEPVQGEGGYVPCPPAFMKHLREVCDKHGILLVVDEVQTGFFRTGKYFAVNSIPDFRPDVLVFAKGIANGFPLSGIVSTKELMSTLDVGSLGGTYAGNPVACAAGIAAQEVYASGEIEKNVAARSEQLFTALNKLASSEKTKHLIADVRGVGLMTAIEFRSASDPLTHEGLPEGTKIPKDIGKRVQAYCLEKDLMVLTTSCFDTIRFIPALVINEEEMKRAMDIFTEAVEKVALEA

SEQ ID NO: 63237 - protein, 261 aa, Picea sitchensis
MVLCHEIAESRCRDSHGASDLKLFAMAAVLVTSAGGVCLPVLFARYSRGLKFYGTLLILVKCFAAGVILSTGFVHVMPEAFRALESDCLPARPWRQFPFAGFVAMAAAILTLLVDVLAAKHGETRPYVPLKSSEAVEDSAKCRDVEMGSPATVFPVESYRVIGQDSCAARAGSHSGIESAKSMMTQEENSEELGDQRQKLVSKVLEIGIIFHSIIIGITLGISENRCTITPLVGALAFHQFFEGMGLGGCLAQINSKLQWI

SEQ ID NO: 63238 - protein, 561 aa, Aspergillus oryzae
MTASMSSSSALARRASSVTSSSPASNVAARRLHATARQMTPATTSAATTATEYPTDHKPIANPIDTANFLDNEFVASKATTWIDLHDPATNNLVTRVPQSTDEELRAAVESAEKAFPAWRAMSVIARQQIMFKFVSLIRANWDRLAASITLEQGKTFADARGDVLRGLQVAETACGITTQLTGEVLEVAKDMETRSYREPLGVVAAICPFNFPAMIPLWCIPIATITGNCLILKPSERDPGAAMILAELAKEAGFPAGVVNIVHGSAKTVDFIIDEPAIKAISFVGSNRAGEYIYTRGSANGKRVQANLGAKNHAAVLPDCNKNHTLNAIVGAAFGAAGQRCMALSTVVMVGETEEWLPEIAERAKALNVNGGFEEGADLGPVISPESKKRIEDLIASAEKEGAKILLDGRGYKPEKYPNGNFVGPTIITNVTPEMTCYKEEIFGPVLVCLSVPTLEDAIDLINKNEYGNGAAIFTCSGSTASRFQKDIEAGQVGINVPIPVPLPMFSFTGNKKSIAGGGANTFYGKPGLQFYTQQKTVTSLWRSEDAVSTKAHVVMPTHH

SEQ ID NO: 63239 - protein, 164 aa, Ceratopteris richardii
MAFDFTTKGILQEAVCGQYWRLRDCNNKPPGMIGFWSEKAVTFIENHDTGSTQQHWPFPHDKVMQGYAYILTHPGVPCIFYDHFYDWGLKDEILNLIDVRKRNRIRANSEINILAADHDLYVAAINDNVIMKIGPKFDIGDLAPNLEEWKVAAVGHEYCVWEKL

SEQ ID NO: 63240 - protein, 810 aa, Salmonella enterica subsp. enterica serovar Paratyphi B str.
MSVIAQAGAKGRQLHKFGGSSLADVKCYLRVAGIMAEYSQPDDMMVVSAAGSTTNQLISWLKLSQTDRLSAHQVLQTLRRYQCDLISGLLPADVADDLTSAFISDLERLAALLDGGVTDAVYAEIVGHGEIWSARLMSAVLNQQGLDAAWLDARAFLRAERAAQPQVDEGLSYPLLQQLLAQHPGKRLVVTGFISRNHDGETVLLGRNGSDYSATQIGALAGVSRVTIWSDVAGVYSADPRKVKDACLLPLLRLDEASELARLAAPVLHARTLQPVSGSDIDLQLRCSYTPDQGSTRIERVLASGTGARIVTSHDDICLIEFQVPASQDFRLAHKELDQILKRAQARPLAVGVHRDRQLLQFCYTAEVADSVLKLLDDVGLPGELRLRQGLALVAMVGAGVTRNPLHCHRFWQQLKGQPVEFTWQSEEGISLVAVLRTGPTESLIQGLHQSVFRAEKRIGLMLFGKGNIGSRWLELFAREQSTLSARTGFEFVLAGVVDSRRSLLNYEGLDASRALAFFDDEAVEQDEESLFLWMRAHPYDDLVVLDVTASEQLADQYLDFASHGFHVISANKLAGASASDKYRQIHDAFEKTGRYWLYNATVGAGLPINHTVRDLIDSGDTILSISGIFSGTLSWLFLQFDGTVPFTDLVDQAWQQGLTEPDPRVDLSGKDVMRKLVILAREAGYDIEPDQVRVESLVPAHCEEGSIDHFFENGDALNEQMVQRLEAARELGLVLRYVARFDANGKARVGVEAVRPEHPLAALLPCDNVFAIESRWYRDNPLVIRGPGAGRDVTAGAIQSDINRLAQLL

SEQ ID NO: 63241 - protein, 125 aa, Rickettsia sibirica 246
MLIISYKGVTPRIDKSAYIAESSSLIGDVEIGSNSSIWFNTVLRGDVASIKIGNNTNVQDGSVIHASRFNGPVEIGDNITIGHLSLIHACTIHNNAFIGMSATIMDYAVIEEYAFIAAGPAKEDN

SEQ ID NO: 63242 - protein, 84 aa, Malus x domestica
QEKKFGEMSQCSAVCGGLLGGAEDDELDRLRRYGRAVGVLYRVVDDILEEKMKGGDDGDGEGKKKGFSYVKMYGVEKAMEVAEQ

SEQ ID NO: 63243 - protein, 630 aa, Arabidopsis thaliana
MLRILGRRVVSASKELTSIQQWRIRPGTDSRPDPFRTFRGLQKGFCVGILPDGVDRNSEAFSSNSIAMEGILSELRSHIKKVLAGGGEEAVKRNRSRNKLLPRERIDRLLDPGSSFLELSQLAGHELYEEPLPSGGIITGIGPIHGRICMFMANDPTVKGGTYYPITIKKHLRAQEIAARCRLPCIYLVDSGGAYLPKQAEVFPDKENFGRVFYNESVMSSDGIPQIAIVLGSCTAGGAYIPAMADESVMVKGNGTIFLAGPPLVKFLENLTLNEKAFEQAATGEEVSAEDLGGATVHCTVSGVSDYFAQDELHGLAIGRNIVKNLHMAAKQGMEGTFGSKNLVYKEPLYDINELRSIAPVDHKQQFDVRSIIARIVDGSEFDEFKKQYGTTLVTGFARIYGQTVGIIGNNGILFNESALKGAHFIELCSQRKIPLVFLQNITGFMVGSRAEANGIAKAGAKMVMAVSCAKVPKITIITGASFGAGNYAMCGRAYSPDFMFIWPNARIGIMGGAQVNQNAPKCLNRNQTESKCVYNLSVAEQNSAAGVLTQIERATKKRQGIKWTEEEEEAFKKKTVDAYEREANPYYSTARLWDDGVIDPCDTRKVLGLCLSAALNRPLEDTRFGVFRM

SEQ ID NO: 63244 - protein, 351 aa, Rhodococcus sp. RHA1
MTTVEVPHSSRSVVLTVSGVVEETPDSLSLVFDVPADLADKFAYKPGQFLTLRIPSDRTGSVARCYSLASSPFTDDAPKVTVKRTAEGYGSNWLCDNVAVGDTIEVLPPSGVFTPKSLDHDFLLFAAGSGITPVISILKSALTEGSGKVVLFYANRDEKSVIFAEELRTLASRYPSRLVSIHWLETVQGLPGVDQLASAVAPYLGHEAFMCGPAPFMDTIHKALADAGMPRSQVHAEVFNSLAGDPFRDADVVEVTEDEAADAATVEVELDGAIHNLSWPRKQTLVDIMLAKGIDVPYSCQEGECGSCACTVLEGKVEMENSEILDPEDIESGYILGCQARPVTDYLKIEF

SEQ ID NO: 63245 - protein, 856 aa, Oryza sativa Indica Group
MAEAVDGGSWEDMLRRILPPGSPIPEAPPNLDYSIALEYDGPPVAYDLPRVDPVEIPTAEPVSGPQRLGNGGGLPVVEPIPLPVSRIARCAEPVSAQVGGGSSDSVNSVLQNEEFDDDDDDSRSLSHDSAQSSPGPQDRSRRTQEGRRGATVTFGFTPDSKCESKEFEEMSEQYVAVTKKEKRRRACYRCGKRKWESKEACIVCDARYCGYCVLRMMGSMPEGRKCVTCIGQPIDESKRSKLGKNSRTLSRLLSPLEVRQILKAEKECQANQLRPEQLIVNGCPLGPDELTDLLSCSRPPQKLQPGKYWYDKESGLWGKEGEKPERIISSNLSFTGKLQANASNGNTQVYINGREITKIELKILKVANVQCPRDTHFWVYDDGRYEEEGQNNIKGKIWESALTRFACALFSLPVPPGNSNETRDEVHYSARTVPDYLDQKRIQKLLLLGPDGAGTSTIFKQAKYLYGTRFTQEELENIKLIIQSNMFKYLGILLEGRERFEEEALSRSNCTISEDEETQQDENKANGSNSCIYSINPRLKKFSDWLLDIIAMGDLDAFFPAATREYAPFVDEMWKDPAIQATYKRKDELHFLPDVAEYFLSRAIEVSSNEYEPSEKDVIFAEGVTQGNGLAFIEFALDDRSPMSEPYIENPEAHSQPLTKYQLIRVSAKGMNDGCKWVEMFEDVRMVIFSVALSDYDQVGPPVYGSSRPLLNKMMQSKELFEATIRQPCFCDTPFVLVLNKYDLFEEKINRAPLTTCEWFNDFSPVRTHHNNQSLAQQAYYYVAVKFKDLYYEHTGRKLFVWQARARDRQTVDEAFKYVREILRWEDEKEENLYGGGEDSFYSTTEMSSSPFIRAE

SEQ ID NO: 63246 - protein, 471 aa, Acidobacteria bacterium Ellin345
MGKTTGFLEYTRELPQRRPVIERINDWFEIYQDFPEQSLQEQGARCMDCGVPFCHTGCPVNNNIPNWNDLVYRGRWREAVRRLHATNNFPEFTGRICPAPCEASCVLGINQPPVTIKQIEKTIIERAFAQGWINPEPPKAETGKKVVVIGSGPAGLAAAQQLRRAGHTVTVYEKADHVGGLLRYGIPNFKLEKHVVDRRVAQMEAEGVQFVTSAHVGVNVSVEQLRSEHDVVLLSGGAEQPRDLSVPGRELKGIHFAMEFLPQQNRRNSGLAVNDKEILATGKHVVIIGGGDTGADCLGTSHRQGAKSVRQYEIMPMPPQERAGQTPWPLWPLQLRTESSHEEGGDRQWSVATAQFTGDEHGNVKQLHGVQIGPPPKFEPIAGTEFVVEADLVLLAMGFTGPVRNGMIEQLGVALDPRGNVQTDNNSMTSVTGVFAAGDMRRGQSLVVWAIAEGRKAAAGIDAYLHANGAS

SEQ ID NO: 63247 - protein, 492 aa, Bacillus cereus E33L
MFQKIAKECLAGFTVAIVALPLAIAFGIAATGTSEGALVGLYGAIFAGLFAALFGGTPGQVTGPTGPITVIATGVIATHGLEASFIAFMMAGLFQILFGVCKLGSYVRYIPYPVVSGFMNGIALIIILGEMKHVQNSFLLVVLTIIVMIVSGKWIKAIPSSLVALVGVTALLPLFSSALEGLTVKLPVIGNLSLNKVIEKIGTIPEAMPTLHIPSLGGTGIAELVLPALSIALLGSIDSLLTSVVMDNVTGTRHKSNKELVGQGIGNMVSGLFGGLAGAGATVRSIVNIRSGGKTALSACMHSVILFIFIMGLGSVVQYIPLAVLSGILILTGIGMFDWESMKKMHVAPKGDVIVMLVTMIVTVKFDLMIAVAFGILLSFLIYMVKCKERKASIVKEKEATYKIKGPLSFLTVDRVFYALQDVKSPVVLRMKDARYMDVSGAMALLSFIEQSDKSGLSVTLEQVPAHIKKTLVTMASNEQKDKLLFAEVDAM

SEQ ID NO: 63248 - protein, 343 aa, Rickettsia sibirica 246
MNLLLQPPQNVAVAHNRIKQYLHLTPIIHSESLNEMLGHEIFFKVESLQKTGAFKVRGVLNHLLELKEQGKLPDKIVGYSTGNHGIGLAYASKLFGIKTRIYLPLNTSKVKQQAALYYGGEVIYTYTRQEAEEKAKEDEKQGFYYMHPSDSDSTIAGAGTLCYEALQQLGFSPDAIFASCGGGGLISGAYLAKELISPTSLLIGSEPLNANDAYLSVKDNKTYRFNYAPNTIADGLKTLSISARTFEYLKKLDDFYLAEEYEIYYWTAWLTHLLKVICEPSSSINMVSVVNFLKTQSKPQKLLVLISGGNIDPILYNELWKEEYLSISPKSLCSDVISAKAAI

SEQ ID NO: 63249 - protein, 472 aa, Bacillus sp. SG-1
MNKGHVLQVMGPVVDVKFESGQLPDIFNALVVKQEAKADAKGIDLTLEVALHLGDDTVRTIAMDSTDGLTRGIEVADTGAPISVPVGDVTLGRVFNVLGETIDLEEEIDKSARRDPIHREAPKFDQLSTEVEILETGIKVVDLLAPYIKGGKIGLFGGAGVGKTVLIQELINNIAQEHGGLSVFAGVGERTREGNDLYHEMSDSGVIKKTAMVFGQMNEPPGARMRVALTGLTMAEYFRDEQGQDVLLFVDNIFRFTQAGSEVSALLGRMPSAVGYQPTLATDMGQLQERITSTNVGSVTSIQAIYVPADDYTDPAPATTFAHLDATTNLERKLSEMGIYPAVDPLASTSRALSPEIVGEEHYNVARQVQQTLQRYKELQDIIAILGMDELSDEDKLIVSRARRVQFFLSQNFHVAEQFTGQKGSYVQVKDTVQDFKEILEGKYDHIPEDAFRLVGPMSDVLKAAKEMGVEV

SEQ ID NO: 63250 - protein, 1460 aa, Oryza sativa Japonica Group
MAFLFPSLLLPWLPWLLGSLLSVYLLDLLAHSRRRLPPGPRPLPFIGSLHLLGDQPHRSLAALAMAYGPLMSLRLGAVTTVVASSPAVAREILHRHDAAFASRSSPDSTGDHARSSVAWLPSSAPRWRALRRIMATELFAPHRLDAAAPRRLRREKVRELVAHVARLAAGEGGKPAVVDVGRVAFATSLNLLSRTIFSRDLTSLDDHGGSKGFQEAVARIMEAGGRPNVSDFFPVLAAADLQGWRRRLARLFARLHRVFDAEVDARLREHDAGEARKGDFLDVLLGIAARRDDAAELDRDTLRSLFTDLFCAGSDTSSSTVEWAMAELMQNPKSMSRVCDELSQVIGLGRNIKESEIGQLPYLQAVVKETFRLHPPAPLLLPRQAEMTMKIAGYTIPKGTRIFVNVWAMGRDKDIWPEPEKFIPERFLGSKIDFKGVHFELIPFGAGRRICPGMPLANRMAGLTGRSDRRPDSGPTNTSGWSDRAPSVGLTGASGRSDRWSTTGMTGLQRRFDRRVAKGDERASSSSNRVNRGHYLPPGTEPNPRWMPKDLMATQKRRLQRLRAQELREKKAEEQRDKRFNELRPPPVWRPKSIKKAKPIGVEEKEEQSVHKSESSPKEDMYINMFCAMDEAEVAQFSLGPKDAVFEIPDESNRHMKPLYLKGHVDGKPVSRMLVDGGAAVSLMPYSLFKKLGHEDDELKKTNMILNGFNGEPTEAKGIFLAELTVGNKTLPTAFFIVDVQEANLEWLQKRVQEYRSTKNDIGETIEDFDEVEKLGQGFTSADPLEEVDIGDGTKPVNKNMRADYKVKIIELLKEYVDCFAWEYHEMPGLSLKEEIDWLLKAGFIRPCRYAEWVSGIVPVEKKGSGKIRVCIDFRDLNKATTKDGYPMPIADMMINDASGHKVISFLDSNAGYNQIFLVEEDMYKTAFRCPGFVGLFEWVVMTFGLKNAGATYQRAMNLIFHDLLGIILEIYINDIVVKSDGMEGHIADLRLAFERMRRYGLKMNPLKCAFGVSAGKFLGFMVHERGVEIDPKKIEKIRDFKAPTCKKEVQKLLVMEMVGAKYMEAFGDSELVVQQVVGVYKCLDRSLNRHIASRDNSRVNDLAQQASGYNVKKGLFLIIEEPVLDIKSLCEIGKTGDQGWSDRHCTAGLTGDQGRSDRLHAAGLTGDPERSDRPCVAGLTGSGLDARGHVAINLEAELTVNSDICAQEAEEDWRIPLIRYLKDPTLKVDRKIRRQAFKYTLLDGNLYRRNIDGVLLKCLDEDQSKVAMGERMRGLSTVRQCSIGAHRRVEPHNQTMAVPRMGFGFHWSNLSFVIKRAYVRASCYGLLHQVGRSRAFEEYDSYGDYKTLMGDNLDEVIDKRLKALEEIEKEKKRVAKAYNKRVKAKLFQVEDLVWKTILPLGTRSKEFGKWSPSWEGPYRVCGIVRGNPYFLETLQGERFQRAINGKYLKKYFPSVWQDA

SEQ ID NO: 63251 - protein, 367 aa, Archaeoglobus fulgidus DSM 4304
MDIIEELRAYREKDIPYSRVLSSMCTVPHPVAVEAHRMFIETNLGDPGIFRGTVELEAKLMRLIGDILHCETPAGYICSGGTEANIQGIRAARNVQKKENPNIVIPKTAHFSFEKIGDILGVKIKRAGVDEEYKVDVGQVEDLMDENTVAIVGIAGTTELGQIDPIVELSKLAEERQVELHVDAAFGGLVIPFMDNPYPFDFQNRGVSSITIDPHKMGMATIPAGGIIFRNESYLRALEVETPYLTSKTQFTLTGTRPGTGVASAYAVLKSLGFEGMREVVKNCLKNTRILVEEMRDLGFEPVIEPVMNVVSFRTDEAERIKEELYRMRWVISTIREPKAIRFVVMPHVTEEVIKNFISDFRKVLRR

SEQ ID NO: 63252 - protein, 104 aa, Campylobacter upsaliensis RM3195
MGKYIELTSENFATAKEGVALVDFWAPWCGPCKMLSPVIDELASDFEGKAKICKVNTDEQGDLAAEYGVRSIPTLIFFKNGEVVGQLVGAQSKQTIADKINSLL

SEQ ID NO: 63253 - protein, 774 aa, Ralstonia eutropha JMP134
MTSPQQSPSQDDLKQQQREALRKAALEYHEFPTPGKISVTPTKPLSNQRDLALAYSPGVAAACEEIVADPANSFRYTARGNLVAVITNGTAVLGLGDIGAAASKPVMEGKAGLFKKFAGIDVFDIEIDEKDPEKLVQVIAALEPTFGGINLEDIKAPECFYVERKLREKMKIPVFHDDQHGTAIVVAAAVINGLKVVGKDIKSVKLVASGAGAAALACLDLLVDLGLPIENIWVTDLAGVVYEGRTELMDPEKARFCQKTDKRKLGEVIDGADIFLGLSAAGVLKQDMVQRMGEKPLVLALANPNPEIAPELVKEVRPDAIMATGRTDYPNQVNNVLCFPFIFRGALDCGATTITREMEIAAANAIAELARQEQSDIVATAYGIQDLAFGPEYLIPKPFDPRLIVWVAPAVAEAAMKSGVASRPIEDMDAYRLQLQQFVYHSGTLMKPIYAAARKVEMAKKRIVFAEGEEERVLRAVQVVVDEKLANPILIGRPAVLQHRIERFGLRLRPGVDFAVVNPEHDERFRDYSDAYYRMMAREGVTPQYAKLELRRRTTLIGAMLVKRGEADGMICGTVSNTAAHLRYIDQVLGGTSKVYAAMNGLVLPGRQIFLVDTHVNVDPTADELAEITLMAAEELKRFGIEPKVGLLSHSNFGSSEAPSARKMRDTLAILRERAPELEVDGEMHGDSALDEKLRNTLVPDGTLKGEANLLVCPNIDAANISYNLLKVAAGNNVAIGPILLGVKAPVHILTPSATVRRIVNMTSLVVVDAAAKR

SEQ ID NO: 63254 - protein, 525 aa, Campylobacter jejuni
MVEVKNLTMRFANQLLFENVNLKLVRGQRYGLIGANGAGKSTFLKILSGEIESSSGEIVFDEGLKIAVLGQDQFAFENYTIKDAVMCANKRLYEALKEKEKLYMSEEFTDEINERLGELEIITAEEDPNYDCETRCEKILSSLKIKDFDALMSTLQSADKFKVLVAQVLFLGADVLFLDEPTNNLDLEAISWLENELLRHEGTLVVISHDRHFLNKICTRILDVDFKQIRDFAGNYDDWYMASTLLAKQAELKRDKTLKEREELENFIRRFSANASKAKQATSRAKALEKLELEEIKISSRRDPSIVFRTNREIGNEVLEFKGIGKAYDKQLFSNLELKIEKNDKIALIGANGVGKSTLAKIIAHAISPDTGSMHLGATIELGYFPQDTSNLICENLKLYEWLMSEKFKDLDEIRKCLGRMLFSGSDQEKMAASLSGGEKHRLMLSRLMLERPNFLLLDEPDNHLDLESIIALGEALYNFKGVVLCISHDRELVSAFANRIWHLENGKLTDFRGTYQEFLGENDG

SEQ ID NO: 63255 - protein, 426 aa, Helicobacter pylori J99 [sequence omitted]

SEQ ID NO: 63256 - protein, 730 aa, Bacillus sp. SG-1
MRKMMALILILLIPQPAGAQSFKMPPLKEHPHQQEILIIETSTPVDPVQLKEELGQHTSLKLRYIFSDVLNGYSITGPKTELEKYVASHPQANLITASKAQTYVIKRDSTIPFVGAEKARGYFDENGNRLTGEGVKVGIIDTGMDLHHRDLSRNFKGGKDVVDGDEEPMETISGKGYSTIHGTHVAGIIGANGSLQGMAPNANLYIYRALGPGGRGTTDQVLAAIEAAVKDKVDILNLSLGSEVNGPDLPLSKALDKVFEKGILPVVASGNSGPADWTIGTPATSAKSLAVGASTPPSDVPYFIFGKEKIRLLSIDRTEKWRKKRNIRIYDGGIGSPEELEGSFGKIAIVKRGKLTFEEKIDNAERAGANGVIIYNNTKGLFSAMIQNEKEIPAAVVSMEDGKNLLKTKKPVSIAITNEQDQLAPFSSKGPVTVSWLIKPDVTAPGVDIKSTIPEGYMSLQGTSMAAPHVSGAAAILKQAHPEWGAKELKSALMLTAKDIVDEKGVPYKVFEQGSGRIQVDKALELDTFVFPSSLSMGGLQLGKKKYLEEQLTIKNQGTVAKTYSLKPSETHNALRWELPLSFVLKPGEEKTVTVRAIIKEFPEKHALWEGRLLLEEGTSIYSLPYLIAVGTPDYPRIMGFAAVPGDAPDSLRYEAYLPEGAEEFALALYDQQTLQLLAILDQRHPAGQGMINNQVKLPSYIKGKTFYAVAFARKSGDEDYQENLIEWYR

SEQ ID NO: 63257 - protein, 424 aa, Clostridium difficile 630
MQFIDVSKYIEGANLKVKTKNGETVKRIYFNNSATPLVLKNVMDNLNCEIPWLTYINAPGIISEKNTLKYENVRSTILKLIDGDEEKDSVIYVKNATEGINFLAKFFKDENPDKFVITTAMEHMANYLPFKVNFPTKVVGITEKGELDLCQLENILKNYAGNVSLVTVTGASNVTGITTPIYEIARIAHKYGAKILVDIVQVIQHKPFSMMPHECDEHIDFVVFSAHKCYSPLNGGALVGPKKFFEKFNPVLYGSGSTKFVNDNKILYADIPQRFEAGYPEYFGTLAMGKALNTLNKIGLNRISKYERELFLYVKEEMSKIPNIIIYGDKSNNVIIPNISFNISNMYYKDVAKYLVDNFGIETGAGVVGADIYVQKLLGISPKEAYVRFMRENPVGLVRISLGMYNTFDEVDSFIHAIKTLAFK

SEQ ID NO: 63258 - protein, 249 aa, Alteromonadales bacterium TW-7
MEIRKAMVAGNWKMNGSIELVKNMSDAINSIKSPEIDVILFPPFPLVSAMIASGVITGAQTVSENTPGAFTGEVDAQLLKDLGVNYALVGHSERRSIYNESSDVIADKFARAQSAGLIPVLCVGESEAEQESGQTEHVVAAQIDAVIKKLGVAALKDSVIAYEPVWAIGTGKTASPEQAQAVHKFIRDKIASLDSDLAQGLTILYGGSVNEKNSELLFAQPDIDGGLIGGASLKAASFVAICNSAKGTV

SEQ ID NO: 63259 - protein, 293 aa, Clostridium difficile 630
MNKIKIKQVDAFTTIPFGGNPAGVVTDASNISDEIKQNVAKEMNLSETAFVSESNIADFKVQFFTPGLEVDLCGHATIGTFHALLEEGKLNTNKSIFYQETKAGVLSVELKKINNENIFMMEQNTPEFENLDNCRKELAQMIGVHEDRLLEYPIIKVNTGLWWLVFGLKSLDDLKNISPDLNKIKKFSGDNNIIGITPFCIETIDKKCDYHLRSIAPYVGVTEDPVCGTGNACVSSYIVHHNILDKTSFIGEQGNFINRPGKVYVNITRENNDITSVKIGGSAYTVLSGEIMY

SEQ ID NO: 63260 - protein, 385 aa, Helicobacter hepaticus ATCC 51449
MLHQFESYPFEKLRTLLAHSSPPSGEEIFSLTIGEPQFPTPTNIIQSWQSNASLLNKYPKSSGEDELKDAQLHFINKRYNLTLTKSQIIPTLGTREVLFNFPQFYLFDLPQPTIAYPNPFYQIYEGAAIASKAQVLLMNLTSENDFTPSLTPKELKKVHLVILNSPNNPTGRILDMQALTEWVKKALEYDFVIINDECYSEIYESSPPPSILQASIQAGNTSFKNIIALNSISKRSSAPGLRSGFIAGDAEILKAYNLYRTYLGCALPLPLQKAAAVAWKDMQTPESIRHIYAKNLALAREILELSTEQISPYTFYVWLKVDNDEAFCKFAYEKKGVLTLPGSYLGRENQGKGYVRIALVYDNNTTKKALLALKEAIKLYKQECQ

SEQ ID NO: 63261 - protein, 54 aa, Malus x domestica
SLMKYPNVSSGVVANEPTWKTDAMAVRGLGLVDPKGVYKFYNELHSYLSSAGID

SEQ ID NO: 63262 - protein, 149 aa, Pseudomonas syringae pv. japonica
TETRDLLVSLAGEVGLKDAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63263 - protein, 388 aa, Aspergillus oryzae
MLSAECANGNLKSEGGPLGKPPLRIVPFPEKPAVLEERRGEIEFRVVNNDGSRDSFVVLTGLKCIFQKQLPKMPKDYIARLVYDRSHLSIAIVKHPLEVVGGITYRPFNSRRFAEIVFCAISSDQQVKGYGAHLMSHLKGMLSAIQDYVKATSPIMHFLTYADNYAIGYFKKQGFTKEITLDKSIWMGYIKDYEGGTIMQCTMLPKIRYLEIGRMLLKQKEAVHAKIRAFSRSHIIHAPPKEWKNGACKIDPLSIPAIKQSGWSPDMDELARQPRHGPNYNQLLHLLNDMQNHSAAWPFTQPVNRDEVPDYYEVIKEPMDLSTMEEKHEKDMYPTPQDFIKDAMLIFDNCRRYNNENTPYAKSANKLEKFMWQQIRNIPEWSHLADGH

SEQ ID NO: 63264 - protein, 345 aa, Helicobacter hepaticus ATCC 51449
MPYLLLTGASGYIGSHTAYCLLKNTNYHILIVDDLSTGFKENIAYLQECFEERVSFVQSNINDISKMRTLLLHYKFEAVIHFAASLIVGESVLKPLEYYTNNTLNTTNLIALCIECGITKFIFSSTAAVYGEPHTSLIPIDENAPLLPINPYGSSKMMSERILYDTSLAFKNFNYVALRYFNVAGASMDNTPQILSNHKGLGQRSKNATHLIKVACECACGKRESMSIFGTDYPTKDGTCIRDYIHIDDLASAHLEALTFLQHTQTSNIFNVGYCKGYSVKEVIDVVKEISGMDFKVIESARREGDPIELSAKNEKILSLTQWKPKYNDLRVIVKSAYEWECSLK

SEQ ID NO: 63265 - protein, 829 aa, Salmonella enterica subsp. enterica serovar Paratyphi B str.
MEFTCELPNGVHARPASHVETLCNTFTSQIEWHNLRTDRKGSAKSALALIGTDTLAGDHCQLVISGADEQVACQRLSQWLRDEFPLCDAPLAEIKNSELEPLPASLTQLNPQIYRARSVCSGSAGGVLTPLSSLDLNALGELPTANDTETEQAALDNGLAMLIKHVEFRQLDSDGAASAILEAHRSLAGDASLRQHLLDGVLRGLSCAQAIVESANHFCNEFARASSSYLQERALDVRDVCFQLLQHIYGEQRFPAPGQLTRPSICMAEELTPSQFLELDKTFLKGLLLKSGGTTSHTVILARSFNIPTLVGVEIEALTPWRQQTVYIDGNAGAIVVAPDEPVTRYYQQEARVQDALREQQRIWLTQEARTADGIRMEVAANIAHSVEAQAAFSNGAEAVGLFRTEMLYMDRACAPDENELYNIFCQALESAKGRSIIVRTMDIGGDKPVDYLNIPAEANPFLGYRAVRIYEEYASLFTTQLRSILRASAHGNLKIMIPMISSMEEILWVKEKLAEAKQQLRNEHIPFDEKIPLGIMLEVPSVMFIIDQCCEEIDFFSIGSNDLTQYLLAVDRDNAKVTRHYNSLNPAFLRALDFAVQAVHRQGKWIGLCGELGAKGSVLPLLVGLGLDEISMGAPSIPAAKARMAQLDSRACRQLLNQAMACRTSLEVEHLLAQFRMSQQDAPLVTAQCITLDSDWRSKEEVIKGMTDNLLLAGRCRYPRKLEADLWAREAVFSTGLGFSFAIPHSKSEHIEQSTISVARLNAPVRWGDDEAQFIIMLTLNKHAAGDQHMRIFSRLARRIMHEEFRNTLVNAASADAIASLLQHELEL

SEQ ID NO: 63266 - protein, 815 aa, Gibberella zeae PH-1
MPTAVAHSHRPTTKVTHKSFKSRAASKHELRDRAKGRVSNEKGNRKTPHQQVMSKFDRRNQAKQARLNKHKEQVKDTLVFAGKDGAPRHVALIPLCAGTDLNATIKQLNSSVDIEDNADGGNYRVTVDRFKQKLQYIPIDRDLNACLDAARVADFVIVVLSASVEVDGLGELILRSVESQGMSTLFTVVEGLDKVEPAKQRQSVLGSLRSFITHFHPEQEKLYSIENRQECANLMRSLCNTTPKGIRWRDDRSWMLAEDIKFAYSESEPTVITGIVRGKGLKADRLVQVGDWGTFQIEKIESAPLPKQVKKKGEEMTIDPEEAGKVLDEPSADRDELVELAPEEVMMDADVAEMEADASEKKGVLLDDHHYFTDEEAEAAKIKKRVPKGTSNYQSAWYLEDVSDSESDMEDYEMPDDDAEQARPEDGIEGYAPAPGTEGAPSEYPQSEMMIEPDEEEDLKQLEQYRAGKRTEEEDDMEFPDEIELHPGVLARERLARYRGLKSLRTSRWEESEDRAHEPEDWRRLLQVPNYQSSKSQATREALVGGVEPGTRVHIYIKGISPTQEKTYDPKKPLTLFSLLRHENKKTAVNYLFNLSSDFTQSIKAKEELIVQCGPRRMVIKPLYSQPGQTPNDVHKYCRFIHPGQSAIATFMGPLTWGAVPVLFFKRTTAEDVEKNEEEDGPHIGMSLIGTGTAIPPSTSRVIAKRIILTGHPYHIHKRIVTIRYMFFNREDVEWFKALPLWTKRGRSGFMKEPLGTHGYFKATFDGRINPQDSIGVSLYKRVWPRTAVPVEGPLLDIATSRIQADGDMMMDDQA

SEQ ID NO: 63267 - protein, 607 aa, Saccharophagus degradans 2-40
MTNKLLLAASFSAVLATAAATHAATEQNQSSSAVLLQGFHWNSHDYDWYSVMQANVNSIDNLGATHVWFAPVSDAASDEGYLPRELYDVTTNYGTEQQLRTLVASLNAKGIDSVADIVINHRVGTTDWADFTNPTWGSWAVTCNDEWPGATGACDTGEGYAAARDIDHTNGTVQGDLISWIRDFLFNDIGFKGLRYDYSKGYDAYYAGLYANAVSPSFCVGEVWTDLNINDVNPHRQQLVDFVSGTGGACGVFDFTTKGMLNEALHNNDYGRLSINGVPSGAIGWWPQKMVTFVDNHDTGPSEGCGIGQNHWPVPCDKVMQGYAYILTHPGIPTVYWAHAYDWGMYDAIKALVDIRKSEGLTSTSSVDIKAAQNGLYAAVIDGKVAVKIGPNSWAPSGANWELKASGTNYAVWVIGEQPPASRTVIFVYGQTQAGQDMFIRGGIDHGYAAANLGKNCTSSNYECAIPIIHNNLNNATTAGWKANDNYLDWYGVEASQSSAAEGSAADWTTNVWPSSWGAERTVAVDGYGVTPLNVYGQHYWMLDVEMDCSATVNGWFELKTYISNGPGWEADVNQSGTPYASGNHFAQCGKINVFSRGSSNATIVDF

SEQ ID NO: 63268 - protein, 308 aa, Coccidioides immitis RS
MFGIIADLLSSVLTVLFPIFASYKALRTSDVSQIAPWLMYWVVLSIVLLVESWTFFIVGWFPFYSWIRLFALSYLVLPQTQGAKKLYLERVDPFLHQYERQIEEFIGETHERAKEAGLNYLYQAIDLIREKVLGLPPVLAAEAAPPPPASGPASYAQTLFSRFNLPAGTGTNLAGPASDLFSMLGSAVTAVTSTGKNRDTQAEELSATGLLPHNLASASKNEQASYIASQKEKLRILLSALDREHRNLGLEGREEDDLAYGTSYDSDSRGLKKNQSENSFENIDHEELGASSAFYKDGSGRRRPGRHD

SEQ ID NO: 63269 - protein, 478 aa, Campylobacter upsaliensis RM3195
MGNVRGFLDFTKKSNAKIAPKERIKNFKEFINPLDKKEREIQAGRCMDCGVAFCHVGRVSEGRDIGCPLNNLIPEWNDLLYRSLWEEAFKRLELTNPFPEFTGRVCPAPCEDSCVCAINGESVSIKDNELALAENAFKEGFITPQKPQKYNGKKIAIIGSGPAGLACAYSLNLLGYKVSVYERSDKAGGLLMYGIPDMKLEKSVVQRRITLLEKSGVEFKLNQNINSKEKANKLLKEFDALILCTGASEPNALNIKGKDLNGVKFAMDFLSENTKSLLKNSKPATTAKGKNVLVIGSGDTSVDCIAVALRQGAKSITRFERSPKKSELRSKDNPWPLKADIFTTDYGLEEAKAVYQKDVREYQKLTKEFIGKDKLEGVLASDLKRENGKNVEIKGSEKLYKADLVLLAMGFSGSEKAISANFGVKFDTKNNIATTNYQSSHEKIFSCGDARMGQSLVVWAIKDGLLCALNVHKKLSKE

SEQ ID NO: 63270 - protein, 314 aa, Geobacter metallireducens GS-15
MPFSEPGKTKFQVDLRRHLRNQGICDNLVHLICEIAEASKYVINAVRTGDLGVAGTSNLYGEEQLALDVLSDRIIKKRLIHSGVVCNIASEEMDEIFQAQADADGLYSVAYDPLDGSSLVDVNLAVGTIVSIYEGCNLLQKGRNQVAALYILYGPRVSMVYSVGRGVHEFTMNHLMEFTLSRENIVMQEEGNIYAPGGLRNKYQEGTEQFVRYLEEKGAKLRYSGGFVPDINQVIMKGKGIFMYPALNGSPNGKLRLLFELNAMAYLVENAGGAATDGKQPILDLEPHSLDQRAPVYIGCKADVVKAMEFVSRN

SEQ ID NO: 63271 - protein, 415 aa, Oryza sativa Indica Group
MSSTNKSSPARNESGGDGDGDIAVDLFPFLRVYKDGRIKKFVRHATVPASPVERSPSGVVTKDVVAVHDETGVSVRLFLPVDAAVAAVAAGRRLPLVVYVHGGAFCSGSASAPPFHRYAESLAARAAAVVVSVDYRLAPEHPMPAGYDDAWAALRWAASSRHSDPWVSNYADTACVFLAGESAGANIVHNVALRAAAAAAAGEDDDDGGGGIDIEGIILLQPCFWGTERLPCERPAAWRRAAPPMFLPERLDALWPFATAGAAGNGDPRIDPPAEAVASLPCRRALVSVATEDVLRGRGRRYAAALMRGGAWGGEATLVESGGEDHCFHLSPRPNPNAAALMDHVAEFIAKGNTSTSSPMAKRRRRRRRCTLHGAGAEKTTSMHALRGQTAPKVQHAGSGIMANKADKYVVRSCL

SEQ ID NO: 63272 - protein, 187 aa, Thermus aquaticus
MSLVGKKVQPFRAQAYHNGEFIEVTEQDFMGKWSIVCFYPADFTFVCPTELEDLQDHYATFKELGVEVYSVSTDTHYTHKAWHDTSPAISKIEYVMIGDPSHQLSRMFDVLDEEQGLAQRGTFIIDPDGVIQAVEINADGIGRNASTLIDKIKAAQYVRNHPGEVCPAKWKEGAETLKPSLDLVGKI

SEQ ID NO: 63273 - protein, 212 aa, Bixa orellana
IGDGAMTAGQAYEAMNNAGYLDANLVVVLNDNKQVSLPTATLDGPATPVGALSSALTKLQASTKFRKLREAAKNITKQIGGQAHEVAAKVDEYARGMISASGSTLFEELGLYYIGPVDGHNIEDLVTIFEKVKAMPAPGPVLIHLVTEKGKGYPPAEAAADKMHGVVKFDPTTGQQFKTKSSTLSYTQYFAESLIREAEVDDKIVAIHAAMG

SEQ ID NO: 63274 - protein, 122 aa, Bacillus sp. SG-1
MNIVDKIKVNEMEFYGYHGVFPEETKLGQRFRISLSLEIDLSEAGRSDDIQDSVNYGDVYSLCKEVVEGKPYKLLEALAEKLAERILHDFTKVKNCTIEVIKPDPPIPGHYRSVSVEITRGR

SEQ ID NO: 63275 - protein, 311 aa, Oryza sativa Indica Group
MRTSKSSPAHGNIAVDLRPFLVEFNDSRRWVLVRHETVAASSDENARSASGVATKDVVIDDETGVSVRVFLPVDAAAAGRRLPLVVYVHGGAFCTGSASARMFHDYAESLSARAAVVVVSVDYRLAPAHPVPAAYDDAWAALRWAASRRRRRRLSDDAWVGDYADRSCVFLAGESVGANIVHNVALRAGAAIRNTGEMFDDDIDIEGMILLQPYFWGTERLPCETPGAASWRTRDPPPMLLPERIDALWPYVTAGAAANNGDPRIDPPAEAIASLPCRRALVSVATEDVLRGRGRRYATALRGGAWAARRR

SEQ ID NO: 63276 - protein, 183 aa, Shigella flexneri 2a str. 2457T
MTATAQQLEYLKNSIKSIQDYPKPGILFRDVTSLLEDPKAYALSIDLLVERYKNAGITKVVGTEARGFLFGAPVALGLGVGFVPVRKPGKLPRETISENYDLEYGTDQLEIHVDAIKPGDKVLVVDDLLATGGTIEATVKLIRRLGGEVADAAFIINLFDLGGEQRLEKQGITSYSLVPFPGH

SEQ ID NO: 63277 - protein, 488 aa, Oryza sativa Indica Group
MAAAAATAAAHLLSTPPSASPVHPPPHARILCAHRTKGVATLSCRASLGPDGSLAGLAAAAAAAPRVEPRGRPYLREHSCLIFPPSPRGRRPLAVVKFLGGAFIGAVPEVTYSHFLKLLAQEGFLVVSVPYNVTFDHEAAAREVYERFHGCYGALLSSGLPAAGLSAMDIAELPLYSVGHSNGALLQLLVGSYFSEKIPKANAIVSFNNRPASEAVPYFEQLQGYNFENGEENKPFLVYASAFRSPKGDAWKALFDLAGGLIQVYDQEAMLSLSKFVDQLPSVMNQVTEGVSEFKPTPPENREFCKNSYNVPNTLLVKFSIDAIDDTEIVEDVLKPRVESICGQIKKVILSGTHLTPCIQALTKTILQDVKWQVGSEYTPADALAQGLKSLALNETRAVPKISDQDWGAWARVFPLGLLSQHLLYNAFNPWSKETYPVSAPSSIKVSVRYQLSSPKPTKPQRTGQAQDLLRLAPVKSDILGTNQDANQ

SEQ ID NO: 63278 - protein, 256 aa, Glycine max; identical to SEQ ID NO: 1084

SEQ ID NO: 63279 - protein, 169 aa, Triticum aestivum
  misc_feature (41)..(41): Xaa can be any naturally occurring amino acid
  misc_feature (48)..(48): Xaa can be any naturally occurring amino acid
  misc_feature (79)..(79): Xaa can be any naturally occurring amino acid
MAAAATTMLDSLPAPLLRALRLKTKQQEMLLRVSALALVYXLAFAVRXLFSVLRYESMIHEFDPYFNYRTTLYLTEHGXSEFWNWFDHESWLTDQPPSTREHIFPPALTAHPQEMTARAILPRTFSPLRTKLREKDCASTNGAHILRGAKERKSSRKPSARSAPLTKSG

SEQ ID NO: 63280 - protein, 525 aa, Alteromonadales bacterium TW-7
MELIYFATAFVCGFAIYQLKLPPLIGFLLAGFALNLAGYKSTELLDTIAALGVTLLLFSIGLKLKVKSLIKPQVWAPASLHIIFSSAIFSGFMLLLGVFALPLFVDLSWQSALLVGFALSFSSTVFAVKVLEERGEMASLHGKIAIGILVMQDIFAVIFLAISTGKVPNIWALAIIIALPLIRPIMYFMLNRSKHGELLPLFGFFFALVAGYNAFEFAGLKGDLGALIIGMMFAPHKKAGELSKSLLNLKDILLVGFFLSIGLNAELTVDSLIIAIVLIFVLPIKVILYYVFTNAFKLRARTSLLTAFTLSNYSEFGLIVCAVAASTGIITPEWLAVMAIAVSITFVIASPLNKRSNELYVKVESWLVKFESKTRLAEELPVNLNDTKIVIFGMGRIGTGAYETINMTHPNLVAGIDIKPEVVDKHISRGRKVLIADATDPDFWQRVNHSHVEMVMLAMPKHMQNIFALEQLQASGYTGQVTAIANYPDQQKELESMGVHSTYNFYLEAGSGFAEHVKQELFGEK

SEQ ID NO: 63281 - protein, 149 aa, Pseudomonas syringae pv. maculicola
AETRDLLVALAGEVGLKDAIKAQYDGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63282 - protein, 891 aa, Bdellovibrio bacteriovorus HD100
MKKNHVIVIMALWGLTGCDRLSLDESSKVKITFPSTQTLSSKVEAMTTSGDSRPVPTGFSGDRPINCYIIGASGPEESMRRNVCTRDDGTMTPKHIGEWVGGVPAGGSITMDVTSGKDRVITVVGFYAPEGTCKDFKSTSGPSDLMSKPYILGEVGKLQLYAGEEKKVDIDITYDPEKWFDSCDGPDFPDDGPHDGPGGNVIPTKLAIHKDYFPANTLTANTCSSFGVSLRDNENREGSLASETVFSVAANGTPLEIYNSYDECSQNIGGYSTAVIPMGARYQDVIVKGPSSPGALTISTTILSSSAVLANPTANFQNISSGDKGFELEGARSILPDLCYPYNISRRYVTGSYDYGTSSAPITLAPSSGFTVYSDSTCSTPTNSATIAPYAKSVNVWVKMTGAQGQNTLTLSGSGYLSLTQSVYRGSGTNAPWGFEVRGHRDGPTRGQCYNSAYEAILVNQYHTAVLAPAAMEVNLGPVNTEFFADSGCMTPTSSTVSLPAGQYSLPFYIKTHVSMMVPLSATSPGLSLGLYDVNVRGPLGMGANNIHVSNYNGVCAKSPYGTYCWGNDNGSRILNGASSMPQYVSPAGVDWDYIKMGSNFACGMTLSGEIKCWGQGTQGQLGNGSTAAVTTPTAISGGDYYMQLSVGPSHACGITMSNVLKCWGANSASQLGDGTTTTRLSPVIIDSGTSYKFVSTGGTHTCGITMADDLKCWGNNLGGKLGNGTTTNSMTPILIDSSIKYMTISAGTVSTCGITLPGSLKCWGENSFGNVGNGTSGGNVLNPVEIDTGVNYTSVSVGEQMACGIGDGQVKCWGLNSYGRLGLGGAAGDQNTPVPVSMLSAWGAPMQVSTGSGTTCATTSNRVVCWGEGMEGELGINTPTNATSPMELIY

SEQ ID NO: 63283 - protein, 601 aa, Coccidioides immitis RS
METTYDEKKAPSPPLPALQDKELQTADFPREETQSKSILGKKSPGVQRVEAISKHFQFSDRVLFFFGIFLLAYAYGLDGIIRFTYQTHATASYNTHSLLATVNVLRSVIAAAAQICSQPTAAKIADVFGRAEVIFVTIVFYIVGTIVEACSTDVQAFAGGAVLYQIGYTGIMLLVEVLIADVTSLRSRLIFSYIPATPFIINTWVSGDITSSVLGQTTWQWGIGMWAIIYPVCAIPLLLSLYIVHRRAKKAGSLADYKSPYELLGFRGLAVSLFWQLDVIGIILLIGVFALILVPFTLAGGAQLQWRTAKIIAPLVIGVLLIPVWVYWEMKCKHPMVPFRLLKDRAVWGALGLAVALNTAWYMQGDFLYTILVVAFDESIKSATRITSLYSFCSVITGCITGLVVFKVRRLKPFIVAGTILFLVAFGLLIHYRGGTGSASHSGIVGAQVLLGIAGGLFPYPAQASIQAATKHEHVAVITGLYLACYYIGSAIGNSISGALWNQVLPKTLETRLGNATLAAEIYGDPLKWANANPVGTPDRDIVIEAYRHIQRLLCITGICLSVLIISFALVLRDPILTNEQSLANAEKYDGETSSSEDADN

SEQ ID NO: 63284 - protein, 529 aa, Shewanella oneidensis MR-1
MSADHTVTQLDSFSATTHSHATHSVQPELNFWQIFNMCFGFLGIQFGFALQNANVSRIFQTLGASIDEIPILWIAAPLTGLLVQPIIGYLSDNTWGCLGRRRPYFLIGAILTTLAIFVMPHSPTLWIAAGMLWIMDASINIAMEPFRAFVGDNLPPSQRTQGYAMQSFFIGIGAVVASALPYILSNFFNVANTAPAGEIADSVRYAFYFGGTVLFLAVTWTVISTKEYSPEELAAFHAKTKTDVEEQCKRSRTHKDYQFASFVWMGLGALLTFTVWAQDLDKQLYILSIGIFAFGPLQLYCALRLSQSQPSQRAQLGMVFNVVDDLFHMPKAMHQLAIVQFFSWFALFAMWIYTTSAVTSYHFGSSDVLSQAYNDGADWVGVLFASYNGFSAIAALFIPLLAKRIGIKLTHTFNMFCGGFGLISFYFIKDPNLLWLAMIGVGIAWASILSIPYAILSGTLPPKKMGVYMGIFNFFIVIPQLLAASVLGLILNGLFDGQPIYALITGGVFMLCAGIAVLFVEQPKALTPH

SEQ ID NO: 63285 - protein, 550 aa, Acidobacteria bacterium Ellin345
MVFAHLTLCMGVSTCVRAPIPAKRFDVVVIGGGIVGVAIARTTALAGKSTLLLEQHDFASGATCRGPRIVGDVFSDLERGDFAIARETLRERDRLLVERPHLVRPMTGIIALGAESRRSKLEVRFGLWLRRRLGNASQWRPNDAEIDLAKQALGPQRAASVFAFDDATCDFPERLVAEWLREAVAAGAIARNYCRALEVVVKDGTAVGVRTRDLCTDMEQEINAEWVVNATGPFAEQFCSDSHIETPRTIAPLRAIHLALQRFPAAPEATIHFEGVDGNEVMLSPWNGQLLLSAVRPNSNALPFAGPSEAEQDYLRLSLNSILPGVEIRVNTAFAAPVAAFGEGALESPGERNRSLVLNHPGTGKFLTVISGSLTASAFAVAECGRQLGLRTRPDSECVYLPGRGNGIEATLQHWAHAVASSSRIPERVARSIAAWHGRGALCIARLAAGNAELRTTLCPHTDHIVAEAIDAVRYEGALTLADILMRRLPVALSSCWSEECTRTAAQRIGKWMNWSAAQNDLQVECVEAERAAFLVKPGPLRDLSDQLAA

SEQ ID NO: 63286 - protein, 206 aa, Bdellovibrio bacteriovorus HD100
MQRPHIIGVAGGSGSGKTHFAKELQQLLGEDNCSIIYQDNYYIDQSAKFDGDGGSVNFDHPSSLDFTLLAQGLRALKSGQSLNIPIYDFVTHSRKKETLPGEPKKVIIIDGILILHSEEVRQELDEAIFFDTPESLRFERRLKRDVHERGRTPEGVRKQFELQVRPMHNQFVEPSKDHAHTIIKDLGDYSQALKQYQQKLSKAFLQ

SEQ ID NO: 63287 - protein, 149 aa, Pseudomonas syringae pv. maculicola
AETRDLLVSLAGEVGLKEAIKAQYDGELVNSSEGRPALHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63288 - protein, 60 aa, Malus x domestica
KQETADRYGKEQVHKWRRSYDIPPPNGESLEMCAQRAVAYFKDQIEPQLLAGKNVMIAAH

SEQ ID NO: 63289 - protein, 779 aa, Oryza sativa Indica Group
MPPLHAYLGLLLLLLSMHTPSCYATNDTLAAGQLLAIGKKLISRNGKFVLGFFKPTLPEDTGSKYKNIASPGWYLAIWFNKIPVCTTVWVANRERPITDHELKLAQLKFSQDGSSLAIIINRATESTAWSTQIANRTAQAKTSMNTSEILLDSGNLVIESLPDVYLWQSFDDATNLVLPGAKLGWNKITGLHCTGISKENLIDPGLGSYSVQLNERGIILWRRDPYMKYLTWSSTLMSGQLKLSIWSQANQYWQEVYAHPTYPCASFATCGPFSFCIATCGPFGICNGNSEQFCDCMESFSQKSPQDWKLKDRSAGCIRNTPLDCPSNRSSTDMFQTIARVTLPANPEKLEDATTQSKCAEVCLSNCSCNAYAYKDSVCSVWHSELLNVKLRDNIESLSEDTLYLRLAAKDMPASTKNKRKPVIAVVTTASIVGFGLLMLVMFFLIWRIKFNCCGVPLHHNQGNSGIIAFKYTDLSHATKNFSEKLGSGGFGSVFKGVLSDSTTIAVKRLDGLHQGEKQFRAEVSSLGLIHHINLVKLIGFCYEGDKRLLVYERMINGSLDAHLFHSNGTILDWSTRHQIAIGVARGLFYLHESCHKCIIHCDIKPENILLEASFAPKIADFGMAAFVGRDFSRVLTSFRGTKGYLAPEWLSGVAITPKVDVYSFGMVLLEIISGRRNLSEAYTSKHYHFDYFPMQAMSKLHGGSVQDLLDPKLNGDFNLEEAERICKVACWCIQENEFDRPTMGEVVHILEGLQEVEMPPTPRLFADITEKVSYVVSM

SEQ ID NO: 63290 - protein, 1211 aa, Arabidopsis thaliana
MADGEDIQPLVCDNGTGMVKAGFAGDDAPRAVFPSIVGRPRHTGVMVGMGQKDAYVGDEAQSKRGILTLKYPIEHGIVNNWDDMEKIWHHTFYNELRVAPEEHPVLLTEAPLNPKANREKMTQIMFETFNTPAMYVAIQAVLSLYASGRTTGIVLDSGDGVSHTVPIYEGYALPHAILRLDLAGRDLTDHLMKILTERGYSFTTTAEREIVRDMKEKLSYIALDFEQELETSKTSSSVEKSFELPDGQVITIGAERFRCPEVLFQPSMIGMENPGIHETTYNSIMKCDVDIRKDLYGNIVLSGGTTMFGGIGDRMSKEITALAPSSMKIKVVAPPERKYSVWIGGSILASLSTFQQMWIAKAEYDESGPSIKQKLRRRIHFSRSSPLKSAISLLIGEDKSLIRMSDSVAGDFPPDPLLASGAFISSAGDGTLDSSAKRRPIQGGIGISGSGESVRIGMANGTDQVNHQTESKSRKRAAPGDNWLPPGWRVEDKIRTSGATAGSVDKYYYEPNTGRKFRSRTEVLYYLEHGTSKRGTKKAENTYFNPDHFEGQGSNRVTRTATVPPPPPPPLDFDFKNPPDKVSWSMANAGEEGWIPNIGDVKVQDSVRRDWSTAFTFITSRNPRKDLVLCETSVVIQELMLDMSHLLSFKMEKNQQKQEFLAETSEMKNTKNNDDCSVQQQQRFVWPWVGLVANIPTEVEPSGRRVGKSGSTLRDEFTMKGFNPTRVQPIWDFKGHSGFALVEFAKDFEGFESAMNFERSFNLDRHGKRDWEKGHRLRDNKLYGWVAREDDYNRSDTVGKNVKKKRDLKSISQIVEEDERKMVHLVENMSQTIEKKKQSKQELEQKVDETSRFLESLELHNVLLNKNYQEGFQKMQMKMEELYQQVLDGHEKSLAELEAKREKLDERARLIEQRAIINEEEMEKSRLEREMNQKAMCEQNEANEEAMKLAEKHQASSSLKEKEKLHKRIMEMEAKLNETQELELEIEKLKGTTNVMKHMVGSDGDKDIVEKIAKTQIQLDAQETALHEKMMTLARKERATNDEYQDVLKEMIQVWNANEELMKQEKIRVKRMGQLNPAPFLPAVMKKHKVTQSKAENKAMKLCSVWEANIGDVQWTPFRVDESDGTPKRVVDENDEKLRTLKNQYGEEVYNEVVRTKLEIEEHNASGSYVILELWNYEENRKATMEEATDVMLKIRSKLAAMKNKRKRLEV

SEQ ID NO: 63291 - protein, 819 aa, Oryza sativa Indica Group
MSPLHTHLGFFLLLLFSLHNPSCSAAANDTLAAGQVLAVGEKLVSRNGKFALGFYKPALPEGIASKYGNITSPGWYLAIWFNKIPVCTTVWVANRERPITDLEIKLTQLKFSQNGSSLAIIINRATEYTVWSRQIANRTAQAKTSMNTSAILLDSGNLVIESIPDVYLWQSFDEPTDLALPGAKFGWNKVTRLHRTGISKKNLIDPGLGPYSVQLNERGIILWRRDPYMEYWTWSSVQLTNMLIPLLNSLLEMNAQTKGFLTPNYTNNNEEEYFMYHSSDESSSSFVSIDMSGQLKLSIWSQANQSWQEVYAQPPDPCTPFATCGPFSVCNGNSDLFCDCMESFSQKSPQDWELKDRTAGCFRNTPLDCPSNKSSTDMFHTITRVALPANPERIEDATTQSKCAESCLSNCSCNAYAYKDSTCFVWHSELLNVKLHDSIESLSEDTLYLRLAAKDMPATTKNKQKPVVVAVTAASIAGFGLLMLMLFFLIWRNKFKCCGVTLHHNQGNSGIIAFRYTDLSHATKNFSEKLGSGGFGSVFKGVLRDSTTIAVKRLDGSHQGEKQFRAEVSSLGLIQHINLVKLIGFCCEGDKRLLVYEHMVNGSLDAHLFHSNGAVLDWNTRHQIAIGVARGLSYLHESCHECIIHCDIKPENILLEASFAPKIADFGMAAFVGRDFSRVLTTFRGTKGYLAPEWLSGVAITPKVDVYSFGMVLLEIISGRRNLSEAYTSNHYHFDYFPVQAISKLHEGSVQNLLDPELHGDFNLEEAERVCKVACWCIQEDEIDRPTMGEVVRFLEGLQEVDMPPMPRLLAAITERSHI

SEQ ID NO: 63292 - protein, 257 aa, Salmonella enterica subsp. enterica serovar Paratyphi B str.
MNPLIIKLGGVLLDSEEALERLFTALVNYRESHQRPLVIVHGGGCVVDELMKGLNLPVKKKDGLRVTPADQIGIITGALAGTANKTLLAWAKKHHIASVGLFLGDGDSVNVTQLNEALGHVGLAQPGSPKLINMLLENGFLPVVSSIGVTDDGQLMNVNADQAATALAATLGADLILLSDVSGILDGKGQRIAEMTASKAEQLIDQGIITDGMIVKVNAALDAARALGRPVDIASWRHAEQLPALFNGTPIGTRILA

SEQ ID NO: 63293 - protein, 614 aa, Staphylococcus aureus subsp. aureus MRSA252
MEFLSLVIVVLAAFLTPIIVNRLNINFLPVVVAEILMGIVIGNSFLNIVERDSILNILSTLGFIFLMFLSGLEIDFKAFKKDKRARQGQNDDESSIPGHLNLALTVFAFIMIISILLAYVFKWLGLVDDVLLMVIIISTISLGVVVPTLKEMNIMRTTIGQFILLVAVLADLVTMILLTVYGAINGQGGSTIWLIGILVVFTAISYILGVQFKRMSFLQKLMDGTTQIGIRAVFALIILLVALAEGVGAENILGAFLAGVVVSLLNPDEEMVEKLDSFGYGFFIPIFFIMVGVDLNIPSLIKEPKLLIIIPILIVAFIISKLIPVMFIRRWFDMKTTIASAFLLTSTLSLVIAAAKISERLNAISAETSGILILSAVITCVFVPIIFKKLFPVPDEFNRKIEVSLIGKNQLTIPIAQNLTSQLYDVTLYYRKDLSDRRQLSDDITMIEIADYEQDVLERLGLFDRDIVVCATNDDDINRKVAKLAKTHQVERVICRLESTTDDTELVDSGIEIFSSYLSNKILLKGLIETPNMLNLLSNVETSLYEIQMLNYKYENIQLRNFPFGGDIIFVRIIRNNESIVPHGDTQLRYGDRLIVTGAKEYVDELKQELEFYF

SEQ ID NO: 63294 - protein, 559 aa, Geobacter metallireducens GS-15
MSTEGNKIIYTMMRVSKYYDKKPVIKDISLSYFYGAKIGVLGLNGSGKSTLLRIMAGVDKDFNGQAVLSSGYTVGYLEQEPRLDEAKTVREIVEEGCQETVNLLNEFNEITAAFADPDADMDKLLDRQAAVQEKLDHLDAWDLDSRLEMAMDALRCPAGETPVKVLSGGERRRVALCRLLLQKPDILLLDEPTNHLDAETVAWLEHHLQGYPGTIIAVTHDRYFLDNVAGWILELDRGEGIPWKGNYSSWLEQKQNRLAQEEKSESERQKTLQRELEWIRMSPKGRHAKSKARISSYEQLLSLESEKRAKDLEIYIPPGPRLGDIVIEADNVSKAYGDRLLVEGMSFRLPPGGIVGIIGPNGAGKTTLFRMITGQEAPDSGSIRIGDTVKIAYVDQSRDALSPDKSIWEEISGGQETLQLGKVSVNSRAYVSRFNFSGSDQQKKVGMLSGGERNRVHIAKMLKEGGNVILLDEPTNDLDVNTMRALEEALENFAGCAVVISHDRWFLDRIATHILAFEGDSQAVWFDGNYSEYEEDRRKRLGAAADMPHRIKYRQLTRA

SEQ ID NO: 63295 - protein, 195 aa, Bacillus sp. SG-1
MILMIDNFDSFTYNIVQYLGELGEEIVVKRNNEINIAEIELLAPDYLMISPGPCTPNEAGISLEAIQYFSGKIPIFGVCLGHQAIAQVFGGEVVKAEKLMHGKTSSVTHDGKTTFEGLSNPFQAGRYHSLIVKKETLPDCLEITAETDAEEIMAIRHKHLPIEGVQFHPESIITEEGKQLLANFLNTYKKTAMPV

SEQ ID NO: 63296 - protein, 432 aa, Oryza sativa
  misc_feature (323)..(323): Xaa can be any naturally occurring amino acid
MVGKRVAVVVGGSVAGLACAHAVAEAGWEAVVVEKAAAPGAGSGTGAGLGLDAQSMETLARWIPGRLDAATLPLAVDLNRATDGETKAGRTLTRDEGFGFRAAHWGDLHRRLHEALPAGVTVLWGHQFVSFEMAPEGDGDGGVVVTARVLRTGETVEVAGDLLVAADGCTSAIRRRFLPELKLRYSGYCAWRGVFDFSGKEGCTTMVDIRRAYPELGNCLYFDLAYKTHAVLYELPKNRLNWLWYINGDEPELMGSSVTMKVNEATVSEMKEKAERVWCPELARLIGETAEPFVNVIYDAEPLPGLSWAGGRVALVGDAAHPXPPPHGLRSTNMSILDARVLGCCLARWGGDGNAEPTSTPRRALAEYEAARRPVVAAQVLHARRLGRLKQGLGMGSAGDGEGFDARTATEEEISQLRQSSMPYFSGAPTIE

SEQ ID NO: 63297 - protein, 279 aa, Bacillus sp. SG-1
ADVYLKLEYMNPGSSVKDRIALAMIEAAEESGNLKSGDTIVEPTSGNTGIGLAMVAAAKGYKAVLVMPDTMSMERRNLLRAYGAELVLTPGSEGMGGAIRKAEELAKEKGFFMPQQFKNEANPEVHRRTTGKEIVDQMDSLDAFISGIGTGGTITGAGQVLKENFPNVKIYAVEPADSPVLSGGSPGPHKIQGIGAGFVPDILNTNVYDEVITIQNEEAFDYARRAAKEEGILGGISSGAAISAALKVAKELGKGKKVLAVIPSNGERYLSTPLYQFEN

SEQ ID NO: 63298 - protein, 453 aa, Gibberella fujikuroi
MVSNGISNGTNGTNGTTTNGTNGVNGHAALSPLEVLVQDLNKNTTTLNGYLRANKLPEPSFERDAPIINLSPDAPEEAQVAKEKVLDSALQIFQLVSGPGEYLQNVITGYHYMEILRWMSHFKIFELVPLEGKISYTELASKAGVLKLRLKTLARMGMTNHLFAEPEPGFIAHSATSAALVTNNRFSDQRVWMTSIIAPVIASMVTAHERWPDSTAPNKAAFNAAFNTDLRMYEYISKQPDVYKLFGRVMDAIATSPKSDLKHLVSGFDWAGLGKANVVDIGGNIGHSCVKLAEAFPDLNFIIQDIPHVVEEGAKVIKENNEASIANRIQFQEYDFFQKQPVVGADIYLLRQIFHNWDFENSVKILKNTVESMGQNSHVLIMDFVVPEPGTVSSVNERVLRSRDVGMMQLFNSLERDLEGWKAILEAVDSRLKINAVNTPYGSFMSVIDVVLG

SEQ ID NO: 63299 - protein, 395 aa, Lentisphaera araneosa HTCC2155
MKKTVDDVNFEGKRTFIRCDFNVPVVDGAISNDLRIVSALPTIKKVLADGGRAVLASHMGRPKGQRDEKFSLKLVAARLTELLDQDVALLNDCFGADVETAVNALENGQVVLLENVRFHAAETSKDAADIEGMAAEFAKFTDIFVGDAFGSAHRAHASVVGLSKHVEAVSGYLMAKELEYFGKVLESPEKPVVAILGGAKVSDKIMLIENMLDKVDKVIVGGGMAYTFQYAQGRDVGNSLLEKDKAELALSLIEKAKAKGVELILPLDTVIADDFSADANTEVVTGDIKAGWEGIDVGPAAVEQFSAAVADAKVVVWNGPLGVFEIEPFSHGTRGMGEVLAKSSATTIIGGGDTASAVVKFGIADQMSHISTGGGASLELLEGKVLPGVDCLNEK

SEQ ID NO: 63300 - protein, 506 aa, Aspergillus oryzae
MSTPAVPLLKPPVPGNRNNSNGPRPPKLTLGIPPSPNARPVTGNGIPAPAPVPAPALAPEVPQLQRPSTRPAPPQLRLATPMGSSKNIQQVNGRPAPPPLATSGLNEPNGHSRSGSFNYLDGKASGPASASSSNYSALSFAMGLRQPQGSTPDPSSAISSVYSDREGGVQMERDNSVNGLIPDLDKLSLEKGRPLDVDDLDDEGWLAASEQKKIVELGSLGEGAGGAVTRCKLKEGKTVFALKIITTDPNPDVKKQIVRELNFNKDCASEHICRYYGAFMDKSTGTISIAMEFCEGGSLDSIYKEVKKLGGRTGEKVLGKVAEGVLNGLTYLHSRKIIHRDIKPSNILLCRNGQVKLCDFGVSGEFGTKGDANTFIGTSYYMAPERITGQSYTITSDVWSLGVTLLEVAQHRFPFPADGTEMQPRAGLIDLLTYIVRQPIPKLKDEPGNGIRWSDSFKYFIECCLEKEPPRRATPWRMLDHPWMLDMKNKKVNMANFVRQVWGWDN

SEQ ID NO: 63301 - protein, 303 aa, Actinobacillus pleuropneumoniae serovar 1 str. 4074
MKKLCVLGSVNADHVIRVPYFPKAGETLKGGHYHIAYGGKGANQAVAAARVRNTSLVEVDFIACIGADDIGRAMKQAFVQDGINPEHIVEVADQMTGIAMIQVADSGENSIVISAGANANLDESVVAQHQATIERADCLLVQLETPLQAVEKALKIAKANHTQVILNPAPAQPLSDEILANIDMITPNETETALLTGIQVVDEQTAQQAANVFHQKGIQTVLITLGAKGAFLSENGNGEIIAGFKVTPVDTTAAGDTFNGALAIALLEGKSMRDAVMFAHKASSISVTRMGAQSSIPTRAELV

SEQ ID NO: 63302 - protein, 507 aa, Rhodococcus sp. RHA1
MTVYARPGSPDAVMSFQSRYDNWIGGQWVAPVKGQYFENPTPVTGQPFCEVARSTSEDIELALDAAHAAAPAWGKTSVAERAIILNKIADRIEENLESIALAESWDNGKPIRETLNADIPLAVDHFRYFAGAIRAQEGALSEIDSDTVAYHFHEPLGVVGQIIPWNFPILMAVWKLAPALAAGNAVVLKPAEQTPASILHLISVIGDLLPAGVVNIVNGFGVEAGKPLASSPRIRKIAFTGETTTGRLIMQYASQNLIPVTLELGGKSPNIFFSDVLSSNDDYQDKALEGFTMFALNQGEVCTCPSRSLIQEDIFDEFLAMAAIRTKAVRQGDPLDTDTMIGAQASNDQLEKILSYIEIGKGEGAKVVTGGERAELGGDLSGGYYVQPTIFTGQNKMRIFQEEIFGPVVSVTSFKDYDQAIEIANDTLYGLGAGVWSRDGGVAYRAGRDIQAGRVWTNTYHQYPAHAAFGGYKQSGIGRENHLMMLEHYQQTKNLLVSYAQKAQGFF

SEQ ID NO: 63303 - protein, 78 aa, Caulobacter crescentus CB15
MSDILERVRKIVIEHLDADPEKVTEKASFIDDLGADSLDNVELVMAFEEEFDIEIPDDAAEHIQTVGDAVKFITEKTA

SEQ ID NO: 63304 - protein, 181 aa, Malus x domestica
LENFIDPDIPATWRAMETLYDSGKARAIGVCNFSTKKLSDLLDIARVPPAVDQVECHPSWQQNKLRSFCKSKGVHLSGYSPLGSPGTTWIKSEVLTNPILATVAEKLGKTPAQVALRWGLQKGHSVLPKSTNEARIKENIDVFGWSIPDDLFAKFSEIEQARLIRWLSPVHHTSGPYRSLE

SEQ ID NO: 63305 - protein, 209 aa, Listeria monocytogenes str. 4b F2365
MTKKPIVVGVTGGSGSGKTSVTKAICDHFSGHSILMIAQDVYYHDQANISFEDRLKVNYDHPLAFDTDLLISHIAALRRYETIEKPIYDYAKYTRKKEVEIQEPREVIILEGILILEDKRLRDLMDIKVYVDTDDDIRFIRRLLRDMKERGRTMDSVIEQYLSVVKPMHNEFIEPTKKFADIIIPEGGENHVAIDLMTTKIESILQKHV

SEQ ID NO: 63306 - protein, 386 aa, Rickettsia sibirica 246
MNIHEYQAKEILRKYGVPTSTGLVVTKTEKINETIDKLNTEVYVVKAQIHAGGRGKAGGVKVVKSKEEAKKVAHDMFGINLVTHQTGPQGQKVNRLYIESGCDILKEYYFSIVFDRLASCITFIASTEGGVDIEAVAEKTPDKIIKFSVDPATGLQDFHMRGIAYELGFKDNQAKQMKEIVKSVYNAFIETDAAQIEINPLIVNSDGNLLALDAKITFDDNGLFRHPNITAMRDHDEEDPLETRAANAGLSYVKMDGNIGCMVNGAGLAMATMDIIKLYGASPANFLDVGGGADRERVKEALKIILSDKEVQGILVNIFGGIMRCDIIAEGIIAAAKDIGIKVPLVVRLAGTNVEKGKEILSNSGLAIIPAHDLADAANKIVEAIR

SEQ ID NO: 63307 - protein, 572 aa, Gibberella zeae PH-1
MASPPHIGSLSRLPANLRGSIESVKRGGHNVSWPLLNLDLLRNVLLFLFFWRWSRRAFWQLRGRGIIGSVVELYTNIRRILYGYFLRAPGVRGKVQQQVNESLVKLSDKLVPKDQIRYLTLPKEGFSHDVVRSELENLANMDHTRWEDGYVSGAVYHGEDELLALQTEAYGKFTVANPIHPDVFPGVRKMEAEVVSMVLSMFHAPPGAAGTSTSGGTDSILMACLAARQKAYAERGVTEPEMILPETGHTAFRKAAEYFKIKLHLVACPAPEYQVDVNAVRRLINPNTVILVGSAPNFPHGIIDDISALSKLALRKNIWLHVDCCLGSFLVPFLERAGFETLLFDFRLKGVSSISCDTHKYGFAPKGNSTVLYRTAEHRKFQYFVSPDWSGGVYASPGMAGSRPGALIAGCWASLMTMGESGYIDSCTKIVGTAKKIAEAIQTTPALGGELEIMGKPLVSVVAFTARNLNVYDIADGMGTKGWHLNALQSPPAIHVAVTLPITKVWEKLITDLEAVVEEEREKERVRLVEGKGTHGKAMGDASALYGVAGSLPNKSVVVDLASGFLDLLYKA

SEQ ID NO: 63308 - protein, 625 aa, Geobacter metallireducens GS-15
MTAILDTIESPCDLKGVTQRELAQLAAELREKIITVCARNGGHLAPSLGVVELTLALHRVFDSPADKIIWDVGHQAYAHKLLTGRRDRFATLRTLGGISGFPKRCESSHDAFDTGHTSTSISAALGFAVARDLRGERNKVVAVIGDGSMTGGLAYEGLNNAGHLNKDLVVVLNDNEMSIAENVGALSNFLNRTVTSEFVHTMKKDLEGFLGGLDRIGHGVLKVAKRAEESLKGLFTPGMLFEAFGFEYIGPIDGHDTARLMETFEKVKRFDDAVLIHVLTKKGRGYPPAEEKPALFHGVGPFELETGKVIKGKGGAASYTGVFGEAIRKIAAEDERVIALTAAMPDGTGLTPFAADYPTRFFDVGIAEQHGVTFAAGLAAEGYRPVFAVYSSFLQRAYDQVFHDVCLQNLPVTFAIDRAGVVGSDGPTHHGLFDLAYLRHLPNMVVMAPKDENELQHLLLTAIEHDGPAAVRYPRGNGYGVSLDQTCSVLPIGKGEILREGLDGALLAIGSTVYPAREAAEALAAEGIDLAVVNARFVKPLDRDLILSLARTTGRLIIVEENVIQGGFGTAVLELLEEEGINGVKVLRLGYPDRYVEQGEQHELRAQYGLDAPGITARVRTFMKG

SEQ ID NO: 63309 - protein, 479 aa, Bacillus cereus E33L
MTTSNTYKFYLNGEWRESSSGETIEIPSPYLHEVIGQVQAITRGEVDEAIASAKEAQKSWAEASLQDRAKYLYKWADELVNMQDEIADIIMKEVGKGYKDAKKEVVRTADFIRYTIEEALHMHGESMMGDSFPGGTKSKLAIIQRAPLGVVLAIAPFNYPVNLSAAKLAPALIMGNAVIFKPATQGAISGIKMVEALHKAGLPKGLVNVATGRGSVIGDYLVEHEGINMVSFTGGTNTGKHLAKKASMIPLVLELGGKDPGIVREDADLQDAANHIVSGAFSYSGQRCTAIKRVLVHENVADELVGLLKEQVAKLSVGSPEQDSTIVPLIDDKSADFVQGLVDDAVEKGATIVIGNKRERNLIYPTLIDHVTEEMKVAWEEPFGPILPIIRVSSDEQAIEIANKSEFGLQASVFTKDINKAFAIANKIETGSVQINGRTERGPDHFPFIGVKGSGMGAQGIRKSLESMTREKVTVLNLV

SEQ ID NO: 63310 - protein, 297 aa, Geobacter metallireducens GS-15
MDLKNYLKERCAIVDEALERSLPGEGDLPVSVHRAMRYSVFAGGKRIRPVLMLAACEAVGGTPDLALPAACAMEMIHTYSLIHDDLPAMDDDDFRRGRPTNHKVFGEAIAILAGDALLTEAFILMSSPEYAAKAGHARILPVIHEIGICAGSRGMVGGQVVDMESEGKKDIDLATVQYIHTHKTGALMKASVKAGAILGGAEGDALAAMTRYGEAIGLAFQIADDILDIEGTTEQIGKDAGSDEARGKATYPAVMGLADSKRRAQELVDLALEALSPFGEKAEPLREIARYIVSRKS

SEQ ID NO: 63311 - protein, 279 aa, Campylobacter upsaliensis RM3195
MQEYLQKAHILIEALPYIRKFASKIVLIKYGGSAMENEELKHCVMQDIALLKLVGLKPVIVHGGGKDISKLCENLGVKSEFKNGLRISDQETTKIAEMALLQINKNLVQNLECLGVKAIGICGKDAGLLHCVKKDEDLGFVGEISKVKVGILNELLEKDFLPVIAPVGMDENLNTYNINADDAACELAKALKAEKLVFLSDIAGLYRNYEDKSSLISKISLREAKELLGSLQGGMLVKLRSCIDACESGVKKVHILDGRVKHSLLLEIFTDEGIGTLVV

SEQ ID NO: 63312 - protein, 386 aa, Campylobacter upsaliensis RM3195
MLLEIYNKFELTLARGEGVHLYDDEDREFLDFASGIGVCALGYNHKLFNEALKRQIGQILHTSNLYHNKEVQKAARNLAKVSKLHRVFFTNSGTESVEGAMKVAKKYAFNKGIKNPSFIAFKNSFHGRTLGALSLTANEKYKKPFKPLISGIKFATFNDLESVKKLLNEKTCAIVLESVQGEGGINPATPEFYKGLRKLCDERDLLLISDEIQCGMGRSGKYFAYEHSQIVPDVAVFAKALGCGVAVGAFGVSEKVAQNSLKAGDHGSTYGGNPLACAAVNAVFEIYAKEKILSRVAKLTPYLEKALYELTSEFDFCEERRGLGFMQGLSLNHKIKVADVLKKCRENHLLLLSCSKNDLRFLPPLIIEKEHIDVMAEKLRKVMRSF

SEQ ID NO: 63313 - protein, 355 aa, Arabidopsis thaliana
MGTYLSSPKTEKLSEDGENDKLRFGLSSMQGWRATMEDAHAAILDLDDKTSFFGVYDGHGGKVVAKFCAKYLHQQVISNEAYKTGDVETSLRRAFFRMDDMMQGQRGWRELAVLGDKMNKFSGMIEGFIWSPRSGDTNNQPDSWPLEDGPHSDFTGPTSGCTACVALIKDKKLFVANAGDSRCVISRKSQAYNLSKDHKPDLEVEKERILKAGGFIHAGRINGSLNLTRAIGDMEFKQNKFLPSEKQMVTADPDINTIDLCDDDDFLVVACDGIWDCMSSQELVDFIHEQLKSETKLSTVCEKVVDRCLAPDTATGEGCDNMTIILVQFKKPNPSETEPEDSKPEPSEDEPSSSS

SEQ ID NO: 63314 - protein, 648 aa, Enterococcus faecalis V583
MILLQANQVARHFGSETLFENIHLEIATKSRIALVGRNGAGKSTFLKIIAGIDAPDSGTIAKNKTATLGYLAQNTGLESDKTVWEEMTKAFADILEMEQRMRELETKISEMEPTTSVYEGILKEYDQLQHTFSEKNGYGYENEIRSVLHGFGFDESFYTKDIQTLSGGQKTRLALARMLLQKPDILILDEPTNHLDIETLSWLESYLPSYAGALLIVSHDRYFLDKVVNEVYELSRKKMTHYKGNYSKYLELKAEQLASEWKAYEKQQEEINKLEDFVAKNLVRASTTKRAQSRRKVLEKMDRLDRPQGDEKSAHFLFDSEKVSGNVVLQVEDAAIGYDQEHILSEPIHLDIRRKEAIALVGPNGIGKSTLLKSIIDRIPFIKGSKTFGTNVSVGYYDQEQANLHGNKTVLAELWDEHPTTPEKEIRSILGGFLFSGDDVEKTIPLLSGGEKARVALAKLAMDRDNFLILDEPTNHLDIDNKEVLENALIDYEGTILFVSHDRYFINRIATKVVELSEKGSKLYLGDYDYYLEKKQEEEEIAALLANEEAAKKPEPVTAKNTFYQNKEQQKLLRTLQRKITQVEENLAQLDTTIAQLEAQMSQPDILENHVELLALNQQLDEVRQQQDELLEQWENFSLELEEMENNN

SEQ ID NO: 63315 - protein, 232 aa, Staphylococcus aureus
TGASRGIGRSIALQLAEEGYNVAVNYAGSKEKAEAVVEEIKAKGVDSFAIQANVADADEVKAMIKEVVSQFGSLDVLVNNAGITRDNLLMRMKEQEWDDVIDTNLKGVFNCIQKATPQMLRQRSGAIINLSSVVGAVGNPGQANYVATKAGVIGLTKSAARELASRGITVNAVAPGFIVSDMTDALSDELKEQMLTQIPLARFGQDTDIANTVAFLASDKAKYITGQTIHVN

SEQ ID NO: 63316 - protein, 591 aa, Arabidopsis thaliana
MTMMSDLSLDLVEEILCRVPITSLKAVRSSCKLWNVLSKNRILCKTEARNQFLGFTIMNHRLYSMRFNLHGIGLNENSEEFIDPSIKPIGNLLNQVEISKVFYCEGLLLCVTRNHSSKLVVWNPYLGEIRWIKTRNDYHIGVTYALGYDNNKNHMILRFFSEQGYYEIYDMNSSDSWDCFYGIPNKGLKCYQPGASLNGNAYFLTEGREVMEGYDCLLGFDFTTKKFGPLLSLSFSHDFIETGRLSCVKGEKLAVLYQRCYTYEMEVWVTTKIEPNAVSWSKFLAVEMEPLTSLKFNDDSGSFFIDEEKKIVVVFDIDESERNNTAYIIGDYGCLKEVDLDEVVNPQESVEVGDRIYSFSPFVCSCSYVPSLVKFKEDAEHERKDKKRKSKRKRTNKDGYDFILCFDFTTERFGQILPLPFKHSFRDTWTLSSVKEEKLAVAVLYWKNTCVMIEIWMTIKIDPNVESWSKFLRVDRKPCIDLRFDDRNDSFFIDEEKKVVVFFSSDKVKTSTAYVIGDNRYLRTVDLEKAANSQESVEVGERVYCFSPLVCSCSYYVPSLVKINHNAGRKRKEKKTKRKSKDKQMKLSNKV

SEQ ID NO: 63317 - protein, 377 aa, Marinobacter sp. ELB17
MKIRAAVLQAIGVQRPYSDTQPLIIEELVLDPPGDHEVLVQIKAAGLCHSDLSVIDGNRPRPVPMTLGHEAAGVVKALGNGVHDLKRGDHVITVFVPSCGHCAPCAEGRPALCEPAAKANNAGILIGGSHRMHRTDGTPINHHLGVSAFADHVVVSRNSLIKVDASLPFHHAALFGCAVLTGVGAVINSADIKAGQTVAVIGLGGVGLNSVLGALVAGAGEVIAIDLDNSKLALAKELGASHTFNSAEDGCVDTIKALTNGGVDCAIEMAGSEKALEFAYQVTRRGGTTVTGGLAHPDKKVAIQQVSLVAEERTLKGSYVGSCVPVRDVARYVSLFRQGKLPVDKLLSATLRLEQINEGFEALAAGKAIRQVILFND

SEQ ID NO: 63318 - protein, 654 aa, Zea mays
MQLLLLLILASFLLRPPAAAASAADSSSGCWPKTCGDLNVTYPFWVEEPGRPPCGPPTFQLKCDSSGAFLIRSVYQASQVLGIFPENNSFHVVDHNLPLATGCPAPTVNLSLLFPGTFVLSRANKELLFLGKCTGFPPAESAGFRSLPCDNSSFVRLGDGRNFSSQSIQGGVPQGCLFTVLPTLGAPDGNGDDDYVASMRNGFLVDWKAVPGDCPKCMARGGECTYGGPDAEFACDCSGGKCGTKGNGRKIPLIVSISVAASLLLPCIYVLVWHRKKLEFFLCRKTSSAIEENIEALILAHGSLAPKRYRYSEVTKITSSFNIKLGEGGYGMVFKGRLDDGRLVAVKFLHDSKGDGEEFVNEVMSIGRTSHINIVSLFGFCLEGSKRALIYEYMSNGSLDKYIYTENPKAVLGWDKLYTIAIGIARGLEYLHHSCNTRIVHFDIKPHNILLDQNFHPKIADFGLAKLCHMKESKLSMTGARGTPGFIAPEVHSRTFGVVSTKADVYSYGMMLLEMVGGRKNVNSAAQESSEKYFPHWIYDHFGQEDGLQACEVTRENEGIAKKLSVIGLSCIQILPMHRPTIGKVMEMFERGSDELDMPPRQNFSQIFQDPVHSLNAETMSMISGTKAKASSEVLKMKGISVVNSKTIQRLPTL

SEQ ID NO: 63319 - protein, 809 aa, Pneumocystis carinii
MYASEDATRDENPTTEDLGAEEYQGGETYEDSTASFDEAKFSVPELDSSPFRSSVTQYSDGFSHKDQDLEELGAIPSTLFDSPVSKNGKETGQENRAIKRTHSERLSNTPLGGKSPKLWQEGSGSGLASFYSSNLSTYAIAGKSIVEKNVARSGKTQGNHTSSSIGISSSRSKYCESGVNFESTQETEKSTKLFDYSFTESLGSYAKQKLVQENVTNTSHLAYSEKWTSIPSRYLQVTNLPKTMETWMLKEIFEKFGDIQGILSKNLRSDGSVIVGFYDVRDCIRIQKQLRHYRFFNDRYLEAQFCSKTTLIAMSKGGTSLPFLSENEGEIIISLQGSGDLSKNVLFNLLSSYGDIRVIKSPSTTMKKTIICEYFDIRDAMLAVDELNGRVVQNNKLHATFYESGFISWKIVSNELQHLQDKNTVLDQFKSLDISEGGLNNVSNEYLINHESANVVSRSKLSPPLELFLNKKGSNGPIMDRSNSVPCYFLQNEKPPYTASMSNGSGNIDYYKHHNVRKPTNLHISDNTSYVHLNDRYTKINSYLHSSAVKEALEEAKVEPHNPAFIPGSPSNQRQIYSANMKRSITHDGVWMEHSPPITEHLPLNLKYPFDVLKMIGNSSPRANLITEKNKVNYDRITRGLDMRTTIMIKNIPNKFTQQMLQEYIDATNPKTYDFLYLRIDFRNRCNVGYAFVNFIDPISIVTFGQARVGTKWNRFHSDKICDISYANIQGKECLIEKFRNSCVMDEDPSYRPKIFISHGPATGEEQEFPAPNNPRRKLRSIVSAQQIGLFPPVGSRAPWCAHEEQAFL

SEQ ID NO: 63320 - protein, 445 aa, Sinorhizobium meliloti 1021
MTRVAVIGAGPSGLAQLRAFQSAAQKGAEIPEIVCYEKQSDWGGLWNYTWRTGLDEYGEPVHGSMYRYLWSNGPKECLEFADYTFEEHFGKPIASYPPRAVLWDYIKGRVEKANVRDWVRFNTPVRMVHFDEETKKFTVTAHNRLEDRMYDEEFDYVVVASGHFSTPHVPYFEGVKTFNGRVLHAHDFRDALEFKGKDVLIVGRSYSAEDIGSQCWKYGAKSVTTSYRSKPMGFNWPENFEERPLLTKLENKTAHFADGSTKEVDALILCTGYQHHFPFLPDELRLKTANRLWADHLYKGVVFDKNPQLFYIGMQDQFYTFNMFDVQAWWARDVMMGRIALPPEEELKANFDMWRAREETLEHAEEMIWYQGDYVKELLAETDYPSFDIEGVNRTFMKWEHHKAENIMGFRDNAYRSLMTGNMSPKHHTPWVEALDDSLEEYLRA

SEQ ID NO: 63321 - protein, 201 aa, Alteromonadales bacterium TW-7
MGVLVGRQAPDFTAAAVLGNGEIVDSYNLHETIKGKKAVIFFYPLDFTFVCPSELIAFDKRFEEFKKRGVEVIGVSIDSQFSHNAWRNTPVADGGIGKVQYALVADVKHEICKAYDVEHPEAGVAFRGSFLIDEEGNVRHQVVNDLPLGRNIDEMIRMVDALAFHSENGEVCPAGWTEGKKGMDASPEGVAKFLSENEGEL

SEQ ID NO: 63322 - protein, 324 aa, Lentisphaera araneosa HTCC2155
MNKLLILISSLFFIQSFCFAETKKTDSPDKGKEIMSYNKLTPEEAYVIEQKGTERPFTGEYNKNKAKGTYICRKCNAPLYKSDSKFDSRCGWPSFDDEIKDAVRRETDADGRRTEILCKNCDGHLGHVFLGEGFTAKNTRHCVNSLSMKFVKEGEEMPKVVPRPKTAKAIFASGCFWGTEYWLQQAPGVLSATSGYIGGHVKKPTYKQICTGLTGHYEAVEVVYNPDVTDFETLAKLYYETHDPEQTNGQGPDIGSQYLSAVFYFDEEQKATIEKLMKTLKDKGLKPATELKEATIFYPAEVYHQDYYFKHRKTPYCHKYKKLF

SEQ ID NO: 63323 - protein, 434 aa, Myxococcus xanthus DK 1622
MAPLDLTSLPRPSKDDATVGTMARGIVGSEILRIAAEIRERIAKGQKVCNLTVGDFNPREFPIPDPLREHITAALQAGETNYPPADGVLELRQAVQRFYERSLGLKYPLEGIVIAGGARPIIYGTYRSVLDAGETVVYPVPSWNNNHYAHMMDAKSAVVVTDAARGFMPTVEQLAPHLGAARLLCLCSPLNPTGTMIEPDALGAICERVVAENREREKQGRKPLILMYDQIYWVLSFGAARHVTPVSLVPEVAPYTVFVDGISKAFAATGVRVGWGVGPPTIIARMRDVLGHVGAWAPKAEQVAVARYLDDTAATETFLEGMRKSVEARLEALHKGFTRMREAGLPVQHIAPQGAIYLSVRFDLVGKGGLRSNNDIRKLLLEKANLGVVPFQAFGLDADTGWFRLSVGATSVKEIEEALPRVEAALREVLSSGA

SEQ ID NO: 63324 - protein, 457 aa, Actinobacillus pleuropneumoniae serovar 1 str. 4074
MATGKIVQIIGAVIDVEFPQDAVPKVYDALKVESGLTLEVQQQLGGGLVRCIALGTSDGLKRGLKVENTGNPIQVPVGTKTLGRIMNVLGEPIDEKGPIGEEARWDIHRAAPSYEEQSNSTELLETGIKVIDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPADDLTDPSPATTFAHLDSTVVLSRNIASLGIYPAVDPLDSTSRQLDPLVVGEEHYNVARGVQGTLQRYKELKDIIAILGMDELSEDDKLVVARARKIERFLSQPFFVAEVFTGSPGKYVSLKDTIRGFKGILEGEFDHIPEQAFYMAGSIDEVVERASKM

SEQ ID NO: 63325 - protein, 326 aa, Streptococcus pneumoniae R6
MAILVTGGAGYIGSHTVVELLNLGKEVIIVDNLSNSSILVLDRIEAITGIRPVFYELDVCDKPALRKVFEQESIDAAIHFAGYKAVGESVQKPVMYYKNNIMSTLALVEVMSEFNVKKIVFSSSATVYGINNQSPLIETMQTSATNPYGYTKVMLEQILKDVHVADSEWSIALLRYFNPIGAHESGLIGEDPSGIPNNLMPYIAQVAVGKLSELSVFGNDYDTLDGTGVRDYIHVVDLAIGHIKALEKVSEKTDVYIYNLGSGEGTSVLQLVNTFESVNKIPIPYKIVPRRSGDVATCYANADKAYKELNWRTTKSIEDMCRDTWN

SEQ ID NO: 63326 - protein, 216 aa, Oceanicola granulosus HTCC2516
MSYDDIRARIAAAESAAGRPAGAVELIAVSKLQPESRVADVLEAGHRLFGENRVQEAAGKWPDFRAQFEGVAVHLLGPLQTNKARQALELFEAIHSLDRPKLAGTLARLAQETGRCPDLFVQVNTGEEPQKAGILPGEADGFIAECRGMDLPVRGLMCIPPVDEEPALHFALLAKIAARNGLEGLSMGMSGDFERAIAQGATHVRVGSAIFGARPS

SEQ ID NO: 63327 - protein, 396 aa, Parvularcula bermudensis HTCC2503
MNIHEYQAKDLLKSYGAPVAAGAIVLDADDAATAAQGLPGPLYVVKAQIHAGGRGKGHFKEAEAGEKGGVRLAKTVDDAAAQVKAMLGHTLVTKQTGDEGKVVGRVYIEDGADIDRELYLSLLVDRGTGKVAFIASTEGGMDIEEVAASTPEKILTLPIDPAGMTAEDAIKLVEALKLEGAAREDGLKLMPILYTAFVEKDMSMLEINPLIVMTDGHLRVLDAKVGFDPNASFRHPDIEQLRDESEEDPLERRASEFDLSYIKLDGNIGCMVNGAGLAMATMDIVKHYGAEPANFLDVGGGATKEKVTEAFKIITSDPGVEGILVNIFGGIMKCDVIAEGVIAAVKETGLKVPLVVRLEGTNVDAGKKIINESGLDVIAADDLDDAAKKIVAAVSK

SEQ ID NO: 63328 - protein, 421 aa, Burkholderia xenovorans LB400
MDTPARLNDLQRTTLAIVLAGGRGTRLGPLTNKRVKPAVHFGGKYRIIDFALSNCLNSGIRRIAVVTQYKAHSLLRHLQRGWSFLRGEFGEFIDLWPAQQRVEGAHWYRGTADAVFQNLDIIRSIRPKYVVVLAGDHIYKMDYTRMIADHAESGADCTVGCIEVPRMDAVAFGVMHVDENRRVTGFVEKPADPPAIPGRPDTALASMGIYVFSADYLYSLLEENISSVDTDHDFGKDILPRVVTQGTAIAHPFSMSCVSSDPNVEPYWRDVGTIDAYWAANLDLASTIPTLDLYDRSWPIWTYQEQLPPAKFVRDMKGLQGSGNNLIVCGGCVISGSQISRSVLSSNVKVSSFCNINEAVLLPQVTVGASCRLQKVVIDRGCAIPDGTVIGEDPVSDAERFYRTDDGVVLVTPEALRQMPK

SEQ ID NO: 63329 - protein, 340 aa, Oceanicola granulosus HTCC2516
MGVPVVLEGAAGAALVLAAETLGPARLAAAQALGRPVLAITGRRAATLKARAYDGDVARVVLPAEADTAWIAAVADPADDLSAPMKGPLRTEREGDATLHRAAIRLAKAARLLPAALVLPLADPAALAAEGLTTVSAAAVAPHELSPFDEIVAARVPLELAEASRLHIFRPDDGAEEHYAIEIGAPDRAKPVLSRLHSACFTGDLLGSLKCDCGPQLRAALGQMGREGEGILLYLNQEGRGIGLANKMRAYSLQDQGFDTVEANHRLGFEDDERDFRIGAALLRELGFGRVRLMTNNPAKVARLESCGIAVTERVPLKVGETRFNHHYLATKAKKSGHLL

SEQ ID NO: 63330 - protein, 351 aa, Bifidobacterium longum DJO10A
MRKKLILDLDTGIDDALAIAYALGSADEIDLIGITATYGNVAVPLAARNALAVVHLFGRDDVPVYPGVDHPIAPATLPKMRGTTPDERTQAYARWQNGGADGWQTDASWAPTPGSVAVHHPNGIGGAIIPDSPRAPEAPGSAVDFIIAAAHEYGPDLTIVPTGAMTTMATVFRNAPDLKDSGVNVTLMGGALTLPGNVSPAAEANISQDPESADYLFKCGARTTMIGLDVTHQTALAREKAHEWASLGTPAGDFLVTMTDYYIDFYLKNQPEIHGCGLHDPLAVAAALDPSLVTTFGFNLQVDLEGPFRGRTIGDRSRLQDFDKHTQVALGVDVSEFLDRFMARVTAAARG

SEQ ID NO: 63331 - protein, 404 aa, Shewanella oneidensis MR-1
MRPIIKSNKLDTVCYDIRGPVHKEARRLEDEGHRILKLNIGNPAPFGFEAPEEIVRDVILNLPSAQGYCESKGLFSARKAIVQHYQAQGIYDVDIEDVYIGNGVSELIMMAMQGLLNTADEILIPSPDYPLWTAAANLAGGKAVHYRCDEEADWFPDLDDIKSKISSRTRGIVLINPNNPTGAVYSKELLLQVVELCREHNLILFADEIYDKILYDEAKHIPAASLSDDILTVTFNGLSKAYRAAGFRIGWMMLSGNLKAAKSYIEGLDMLASMRLCANVPNQHAIQTALGGYQSINELILPSGRLTVQRDTCYELLNQIPGVSVKKPKGALYAFPKLDMKKFNLRDDERLVLDLLRDKKILLVHGTAFNWPEPDHLRVVFLPYKEDLTKALTEFGNFLETYKQ

SEQ ID NO: 63332 - protein, 529 aa, Rhodococcus sp. RHA1
MALSGTTAREGYRAEHTKLVDELKSRLAVAALGGSEKSRERHVSRGKLLPRDRVDTLLDPGSPFLEISPLAANGLYDDECPGAGVIAGIGRVSGRECVIVANDATVKGGTYYPMTVKKHLRAQEIALQNQLPCIYLVDSGGAFLPRQDEVFPDREHFGRIFYNQATMSAQGIPQIAAVLGSCTAGGAYVPAMSDEAVIVRNQGTIFLGGPPLVKAATGEVVTAEELGGGDLHSKVSGVTDHLAEDDQDALRIVRNIVATLGPRAERPWDVISAVPASAPQTDLYDVVPTDPRTPYDVHAVIDRIVDGSEFQEFKAEYGKTLVTGFAHIEGHPVGIVANNGVLFAESAMKGAHFIELCDKRKIPLLFLQNIAGFMVGRDYEAGGIAKHGAKMVTAVACARVPKLTVVIGGSYGAGNYSMCGRAYSPRFLWMWPNARISVMGGEQAASVLSTVRSEQLDSAGNPWSAEDEEAFKAPIREQYEAQGNPYYSTARLWDDGIIDPADTRTVLGLALSVCANAPVEPVSYGVFRM

SEQ ID NO: 63333 - protein, 421 aa, Coccidioides immitis RS
MASSSSSPSIFTANVVPKAPEDPLFGLMRAYRADPSDKKVDLGIGAYRDDNAKPWILPVVRKADEAIRNDPTVNHEYLPIAGLPDLAPAAQKLILGADSPAITEKRVTTFQTISGTGAVHLGGLFLSKFYPANPKPAIYLSSPTWANHQQIFTNVNLTTAYYPYYSAQTKGLDIDGMLAAIRAAPQGSIFVLHACAHNPTGVDPTQDQWKQIAAAMRERNHFPFFDTAYQGFASGDLARDAWSIRYFVEQGFELCVAQSFAKNFGLYGERAGAFHFVSAPGPHAADSTAHIASQLAILQRSEISNPPAYGARIASLILNSEELFAEWEADLRTMSGRIMEMRKGLRERLEQKGTPGTWEHITNQIGMFSFTGLTEQQVGILREKWHVYMTKNGRISMAGLNTHNIDYFAEAVDSVVRETSS

SEQ ID NO: 63334 - protein, 390 aa, Oryza sativa Indica Group
MATAGKVIKCKAAVAWEAGKPLSIEEVEVAPPQAMEVRVKILYTALCHTDVYFWEAKGQTPVFPRILGHEPEVLYYFLSFDVLSIVESVGEGVTELAPGDHVLPVFTGECKECDHCKSEESNMCDLLRINVDRGVMIGDGKSRFTIKGKPIFHFVGTSTFSEYTVIHVGCLAKINPEAPLDKVCILSCGFSTGFGATVNVAKPKKGQTVAIFGLGAVGLAAMEGARLSGASRIIGVDLNPAKFEQAKKFGCTDFVNPKDHSKPVHEVLIEMTNGGLDRAVECTGNINAMISCFECVHDGWGVAVLVGVPTKDDVFKTHPMNFLNEKTLKGTFFGNYKPRTDLPNVVELYMKKELELEKFITHSVPFSEINTAFDLMLKGESLRCVMRMDE

SEQ ID NO: 63335 - protein, 392 aa, Glycine max
MDVIDNGVPAPLSMFSESDSDMKSVNIDDLLPKEKLQRKLPKPSAGRRKNGYLQNGGSVHPYADPEQCADTKQSFGASSSGVTSLDSIQKHKLNIDSDSLGCIQTQIPMTRPDYSHAPNHTSLFPTLSGSRSEHDGHLSPSLKESSYASNMESSHGHSLEAAALKTKENREKLYNCCDGPLNSSFKNENTPNQMPFCSPGSAQQVGHHFENENEGHSEFRGVGLGFSPEIDSSTVQESSSMGSALDQASLEATSFCHLQQIMDQLDIKTKMCIRDSLYRLAKSAEHRHNNSNANGCIGDDETCKAMMAQDANRCAGLMDMETDTNPIDRSVAHLLFHRPSDPSVLLPNETLPFKSSATMHHGSVINPPVKTEKQVCQEDSTGVEKKVLRGNT

SEQ ID NO: 63336 - protein, 774 aa, Gibberella zeae PH-1
MTVPSDLTHRGANGQHLSLEDRFEVLKEIGDGSFGSVVLGRVRTAGANVARRGTVVAIKTMKKTFESLQPCLELREVVFLRTLPHHPHLVPALDIFLDPYSKKLHIAMEYMEGNLYQLMKARDHKCLDNGSVKSILYQIMQGLEHIHSHHFFHRDIKPENILVTTSGHNDAGNTFRRYSSLVTPPSTPPTYTVKIADFGLARETHSKLPYTTYVSTRWYRAPEVLLRAGEYSAPVDIWAVGAMAVEIATLKPLFPGGNEVDQVWRVCEIMGSPGNWYNKSGNRVGGGDWRDGTRLAGKLGFSFPKMAPHAMDTILQTPQWPASLAQFVTWCLMWDPKNRPTSSQAIAHEYFVDAVDPTRPKSSASRILGRKQSDLSRSSKEASTTPTSVKQSWFRKSLIGRSESTDLATMQTQTKEPAGPRPAPEPVAAKARPAAGKRATWTNGPSNVAPMPILPTARPISPIPDAVNARANNAYDDAYANGHGQGKTKKLGRQLSVASSTNNYTEMHRQQAERALNGNSGLASPPSGQKESFFSHLRKRARRFSGRHQTPVSPSYDDDDLEAQVGCGPWGSNRSSMVIDQSQQPAPVPKSEVYESLDKALRDVQTNLDSRPPVPPAHQVSPTSTLKRHHSLPQQQARSVDNLIGAARGGPISSRTRRAQATHGVHQYEAPDEEEELMDEAMTTTQRAMKRMEQNQNKPLRQSASNIGLMNPYPTPSPSANGNQVLFADGQAITPKPLDLNKRTDQYKWPTPPYEESEWAASASASIWAAGSRI

SEQ ID NO: 63337 - protein, 331 aa, Geobacter metallireducens GS-15
MALRVAINGFGRIGRSVLRAAIKEKGIEFVAINDLTDAKTLAHLLKYDSVHGPFPGKVEAGNGEIIVNGKPIKILAVRNPEELPWKKEKIDVVLESTGLFTSREKAELHLKAGAKKIIISAPATNEDITIVMGVNSNLYDPKKHNIISNASCTTNCLAPVAKVLHETFGIEKGLVTTVHSYTNDQQILDLPHKDLRRARAAAMSMIPTSTGAAKAVALVLPELKGKLDGMAIRVPTPNVSVVDLVVTLSKKADADKVNAALKKASKGSLKGVLGFSEEPLVSIDFNGNPLSSIVDAGCTKVIEGNMVKVLSWYDNETGFSHRVVDLMKLIA

SEQ ID NO: 63338 - protein, 223 aa, Oryza sativa
MKPAVEVEEGDERAAELARKKAAAAAAAAAKKAEEAAVEEEEVVNGEEEVEEEAVDGEEGDGDEEGDGEEEGDDEEEDAEEGEKGAAGHTVVEISDEEDEEDGEEGDGGDDDDDDDDDDDDDDDDEEEEEEVEGDEQEELGTEYLVKPLGDAEDEEHSSDFEPDENGEGAEDEEIDEDDDGDDDSAKAQSSSKRKRSGGDDEDDDDDDDDGGDDDDDGRPSKR

SEQ ID NO: 63339 - protein, 398 aa, Geobacter metallireducens GS-15
MAIRYIDEIESLKGKKVFIRVDFNVPLDEHQNITEDTRIRAVLPTINFALDAGAKVILASHLGRPKGERKPKYSMAPAAKRLSRLLNKEVQLAPDCIGDEVKKMIDAMKPGEVLLLENVRFYEGEEKNDADFAKALANDCEIYINDAFAVSHRAHASVEAITKFFPVVAAGFLMNNEINYFEKAMQKPIRPLVAILGGAKVSGKLEVLESLVNKVDKIIIGGGMAFTFLKALGYNVGKSLVEEELLEIALTTYTKAREKGVKFYLPVDCVAADRFNPEAETKVTTIQEIPEEWMALDIGPATVTLFTEALQNAKTIIWNGPMGVFEMDAFSRGTFAMVSAVANSYALTIVGGGDTDSAVHRAGEYAKISYISTGGGAFLELLEGKHLPGIKVLEENGK

SEQ ID NO: 63340 - protein, 460 aa, Zea mays
RKGLEVKKKKKKKKKKKKKKKKNHPRRHAYASMMYMGTPRDYEFYVATRVMMLSLRRLSPNADRVVIASLDVPPLWVQALKNDGVKVVSVKNLKNPYEKQENFNRRFKLTLNKLYAWSLVSYERVVMLDSDNIFLQNTDELFQCGQFCAVFINPCIFHTGLFVLQPSMDVFKNMLHELAVGRENPDGADQGFLASYFPDLLDQPMFHPPANGTKLWGTYRLPLGYQMDASYYYLKLRWSIPCGPNSVITFPSAPWFKPWYWWSWPVLPLGLSWHEQRRENLGYSSEIPLVLIQAVLYIGVIAVTRLARPSLSKMCYNRRMEKNTMFLLSLLRIVAAWSILAAYTIPFFIIPRTVHPLLGWPLYLLGSFSLSSIVINIFFLHPITVLTTWFGFIGALVVMAFPWYLNGVVRALAVFAYAFCCAPLIWASLVKTMSSLQVLIERDAFRLGEPNQNAEFTKLY

SEQ ID NO: 63341 - protein, 251 aa, Geobacter metallireducens GS-15
MRTPIIAGNWKLFKKSSEAQDFVAELIPLVQKTTDVEIVIAPVFTVLSAVKRAIADCNIMLSAQDCFWEEEGAFTGEISPGMLVDAGCSHVIIGHSERRQYFGETDETVNRKIKAAITAGLTVLFCIGETLAEREADKTFEVLRTQIENGLAGLARGDLAKIVIAYEPVWAIGTGKTATDEQAQIAHAFIRKVVGELFTVQIAETIRILYGGSVKPENVRGLMNQPDIDGALVGGASLKADSFGAIVNYKA

SEQ ID NO: 63342 - protein, 313 aa, Bacillus cereus E33L
MKNRVNPALLPGLEMYPDQDLRPECLPVMREEASKVFPPTIVDETLSVTNEVIEGPDANPLRLKIYRPKSNNESLPALLWIHGGGYILGSINDNDDLAVKIAKEANCMVVSVDYRLAPEHPYPAPIEDCYAALKWIADNAETLNIDSNRIGVAGVSAGGGLTAALTLLARDRQYPSICFQMPLYPMIDDRNNTPSANEIKEGFVWNQKSNEAGWKMYLGELHGTDHIPAYAAAARAEDYRNLPRTYTCVGQLDPFRSETLTYVTKLAEAGVDVEFHLYPGAYHGFEMMHPDTDISIHAWNDYVRAVKTGFARK

SEQ ID NO: 63343 - protein, 119 aa, Zea mays
LSYITGYRLKTYWGFFNFMLAGSTSALRFGIILGLALLALGISSLRSQRDGGRRPRLLVKGQAAIASVIFFREFSVLLQNGWFPKIFMVLLSGVVAGFYFYRIAAGSPKELSSNSDSVN

SEQ ID NO: 63344 - protein, 234 aa, Helicobacter pylori J99
MTKIAMANFKSAMPVFKSHAYLKELEKTLKPQHFDRVFVFPDFLGLLPNAFLHFTLGAQNAYPRDCGAFTGEITSKHLEELKIHTLLIGHSERRVLLKESPSFLKEKFDFFKGKNFKIVYCIGEDLTTREKGFRAVKEFLSEQLENIDLNYSNLIVAYEPIWAIGTKKSASLEDIYLTHGFLKQILNQKTPLLYGGSVNAQNAKEILGIDSVDGLLIGSASLELENFKTIISFL

SEQ ID NO: 63345 - protein, 501 aa, Saccharophagus degradans 2-40
MNQTLQPRPRPELNFWQIWNMCFGFIGIQFGFALQTANVSRIFQTLGAEIDAIPILWIAGPITGLLVQPIIGYMSDRTWNRFGRRRPYFTIGAVAATACLFIMPHSPALWMAAGMLWIMDASFNIAMEPFRAFVGDMLPPKQRTQGFATQSFFIGVASVVASALPWMLTNWLGMENTAPEGEIPSTVVYAFYFGGAVLVTTVMWTVFRTKEYTPEEIAAFNQYEQHNDSQADTSDDHKNYVAGGIGFAAVAIASTIAIHYFELREELYILAGLAAMFGGLQLIAHILQSKGRIHNAIYQITHDLFNMPRTMVQLAIVQFFSWFALFALWIYTTPAVTAFHYGTSDTTSAMYNKGADWVGIMFAAYNAFAALAAFFIPIMARRWGQKTTHCINLMLGAAGYISMMLIKDPSWLWVSMIGIGFAWASILSLPYAMLSGALPSSKLGLYIGIFNFFIVIPQILAASVLGIAVSGLFDGQAIYALVLGGVFLIIAALATLKVNDQ

SEQ ID NO: 63346 - protein, 197 aa, Geobacter metallireducens GS-15
MPDTNAKTIWNIPNILTLLRIALIPVLAVLLLSPSREAGFWAAAVFAVASTTDWLDGYLARRMGIVTVFGKFLDPIADKLMVMAALIMILPYNRVPAWMVLVILGREIIITGLRGIASSEGIVISASDLGKFKTIFQMVAIIGLLLHYDYHWFFGVDNPYLIVNMHNAGMFYLWIATIMTVWSGADYLAKFMRVIAR

SEQ ID NO: 63347 - protein, 137 aa, Helicobacter pylori J99
MKQRTLSIIKPDALKKKVVGKIIDRFESNGLEVVAMKRLHLSVKDAENFYAIHRERPFFKDLIEFMVSGPVVVMVLEGKDAVAKNRELMGATDPKLAQKGTIRADFAESIDANAVHGSDSLENAHNEIAFFFAAREF

SEQ ID NO: 63348 - protein, 322 aa, Thermobifida fusca YX
MRAIVVEETGGPEVLRPTETADPVPGPGEAVVDIAARGVNFIEIYQRTGIYPVSLPWIPGSEGAGVVSAVGEGVTEVSVGDRVASVALRGSYAERAVAAAKDLVPVPDEVTLDQAAAVLLQGLTAHYLTHSTYPIQQGDTVLVHAAAGGTGQLIVQLAKRRGARVIGTVSTEAKERQARAVGADEVIRYTEQDVTTEVRRLTGGEGVPVVYDGVGAATFDVSLACLRPRGMLVLFGQSSGVVPPFDPQRLNAAGSVYLTRPSLGHYTRTREELLERASAVLGLVASGELAVQIGGRYPLAEASRAHTDLASRATMGKLLLVD

SEQ ID NO: 63349 - protein, 255 aa, Geobacillus kaustophilus HTA426
MIRCKTAQEIALMREAGKIVSLTLKELQKHIRPGITTKELDAIAEEVIRSHGAIPSFKGYQGFPGSICASVNEELVHGIPSSRALREGDIITIDVGAQYEGYHADSAWTYPVGEIDAETKRLLDVTEQSLYVGLAEAKPGARLTNISHAIQTYVEAHHFSVVREYVGHGIGQHLHEDPQIPHYGPPNKGPILRPGMALCIEPMVNAGSRYVKTLADDWTVVTADGKRCAHFEHTIVITEDGCEILTHCGNESPTS

SEQ ID NO: 63350 - protein, 490 aa, Shewanella oneidensis MR-1
MGKTTSGAKACDFVLFGTKGDLARRKLLPSLYQLDKAELLDKDTKVIGVAKDEFSQDEYRDLVILALKTFVKEPLCEDTLNRFVSRCYYVGTNFTESAGYGAFHELLKPEERVMVSYFATPPSIFGDICRCLHEQNLIHSDSRVVLEKPIGSDLASSRIINDQVSAYFKESQVYRIDHYLGKETVQNLIALRFANSLFASKWDNRTIDHVQITVAEEVGIEGRWGYFDKAGQMRDMIQNHLLQVLTLVAMDPPVNLDADSIRDEKVKVLKSLRPINADNVYENTVRGQYSAGFLKGSPVPGYLEEEGANVQSHTETFVALRVDIDNWRWAGVPFYLRSGKRMPFKSSEIVVYFKNPPHNLYRSSYRNLPPNKLTIRLQPHEGVEIQMMNKVPGLEQKQRLQTTKLDLSFSDTFKNERIADAYERLLLEAMLGNQALFVRRDEVEQAWTWVDGIIQAWEQSNEKPKPYPAGTWGPVASVALITKDGRSWDE

SEQ ID NO: 63351 - protein, 621 aa, Caulobacter crescentus CB15
MLQINDLTFNAWGRRFFDKATVSLPPGAKVGLIGRNGVGKSTLFKLILGQLHAGDDEISLPKSARIGSVDQEHPATPVSLLETVLEADIERHTLMTRLETADPEEMGEIWARLIEIDSDSAPARASEILVGLGFTQEDLRRPMSEFSGGWRMRVALAAALFAEPDMLLLDEPTNYLDLEGALWLEARLQKYPHTALIVSHDRELLNNSCTHMLHLAGGKLELYTGGYDDFEKRRAEKARLQLSAKAKQDAERAHLQAFVDRFKAKASKAAQAQSRMKRLAKMEPVATTIEERVAPFTLPSPPKPLPPPLIRLEKASVGYEAGRAILKNLNLRMDLDDRIGLLGVNGAGKSTFAKMIAGALGVQAGEFHRDKKMKVGWFHQHQIEAMDPNDTPLEIIRRAMPEASESSRRSKLAQFGLGFEKQETKVESLSGGERARLLLNLVAMDAPHMLILDEPTNHLDIDSRRALLDALNDYMGAVILITHDRSLMELVADRLWLAADGTVKSFDGDMDDYARFVLERAKQAVKPTQVSREPEKPVAPPTKKAAVEPLRRKVEAAEQVMTRRTRDLAELEGQLGDPDLYVKNPGKVAELTKRRDNAQAKLNEAEEAWMSLAEELAEAEG

SEQ ID NO: 63352 - protein, 479 aa, Shewanella oneidensis MR-1
MFRRTKIVTTLGPATDRDDNLRRIIAAGANVVRLNFSHGSPEDHLKRATQAREIAKELGVHVAILGDLQGPKIRVSTFKDNKKIQLKLGQTYILDAELAKGEGDENQVGIDYKQLPDDVNVGDILMLDDGRVQLRVERVEGRKVHTTVTVAGPLSNNKGINKQGGGLSAAALTEKDKADILTAAMIQVDYLAVSFPRSGADLEYARSLAQQAGSNALIVAKVERAEAVASDEAMDDVILASDVVMVARGDLGVEIGDAALVAVQKKLIARSRQLNKIVITATQMMESMISSPMPTRAEVMDVANAVLDGTDAVMLSAETAAGDFPEETVKAMANVCVGAESHPSVKVSKHRLDARFTSVEETIALSTMYAANHLEGVKAIIALTESGATPKLMSRISSSLPILGLSRHDTTLAKMALYRGVLPIYFDSTIYPADELAQKALESLTKAGYLHSGDLVLMTKGDAMETIGGTNTCKVLIVA

SEQ ID NO: 63353 - protein, 139 aa, Caulobacter crescentus CB15
MTERTFSIIKPDATRRNLTGAINAVIEAAGLRIVAQRRVKLTEAQAKKFYEVHAERPFYGELVGQMTAEPVVVQVLQGDNAVLKYREVMGATNPENADEGTIRKLFALSIGENSVHGSDSLENAGIEIAQFFTEDEIVG

SEQ ID NO: 63354 - protein, 127 aa, Picea sitchensis
MAEAVNPKAYPLADSQLSITIMDLVQQAANYKQLKKGANEATKTLNRGIAEFVVMAADTEPLEILLHLPLLAEDKNVPYVFVPSKQALGRACGVTRPVIACSVTTNEGSQLKSQIQQLKDAIEKLLI

SEQ ID NO: 63355 - protein, 513 aa, Solanum melongena
MVILPSELIGATIIYIIVYIIIQKLIATGSWRRRRLPPGPEGWPVIGALPLLGGMPHVALAKMAKKYGPIMYLKVGTCGMVVASTPNAAKAFLKTLDINFSNRPPNAGATHMAYNAQDMVFAPYGPRWKLLRKLSNLHMLGGKALENWANVRANELGHMLKSMFDASHVGERIVVADMLTFAMANMIGQVMLSKRVFVEKGKEVNEFKNMVVELMTVAGYFNIGDFIPQIAWMDLQGIEKGMKKLHKKFDDLLTKMFEEHEATSNERKGKPDFLDFIMANRDNSEGERLSITNIKALLLNLFTAGTDTSSSVIEWALTEMMKNPTIFKKAQQEMDQIIGKNRRFIESDIPNLPYLRAICKEAFRKHPSTPLNLPRVSSDACTIDGYYIPKNTRLSVNIWAIGRDPDVWENPLEFIPERFLSEKNAKIEHRGNDFELIPFGAGRRICAGTRMGIVMVEYILGTLIHSFDWKLPNDVVDINMEETFGLALQKAVPLEAIVTPRLSFDIYQSSEPF

SEQ ID NO: 63356 - protein, 325 aa, Solanum lycopersicum
MSFLRFIFPLFFLISIFVASNAQLSATFYASTCPNVTEIVRGVMQQSQSTVVRAGAKIIRLHFHDCFVNGCDGSLLLDNAAGIESEKDAASNVGAGGFDIVDDIKTALENVCPGVVSCADILALASEIGVALVGGPTWQVLLGRRDSLTANRSGVDSDIPTPFESLDVMRPQFTNKGMDITDLVALSGAHTFGRARCGTFQQRLFNFSGSGSPDPTINSTYLPTLQATCPQGGNNGNTFENLDKTTPDNFDNDYYINLQNQEGLLQTDQELFSTSGSDTIAIVNRYASSQSQFFDDFASSMIKLGNIGVLTGTNGEIRTDCKRVN

SEQ ID NO: 63357 - protein, 329 aa, Rhodococcus erythropolis
MQMRAATYHKSGEASDVLSIIQCEKPEPGPGQVLVRVSFSAVNPSDVKTRSGKTPRPIDDFQIPHMDGCGRIVAVGPGVHEGRIGQRVWLWLAALGSRWGTAAEYTLVPANQAVALPDSASDELGACLGIPAMTAHECLLHAGPVTHKKVLIAGGAGAVGHFAIELARWAGATVIATVSTPDKAKLARQAGADFVVNYRDDDVADQITAFTNGVDIFVEVAIVDNWNIDLAVAAPGASIATYATDGRELSIPIRECMAAGLGLRFFLLYTHSRSALSLAAQSITDALAEQALTPLPHLTFPLDEIALAHEAVENGESRKVLLDLRDSDT

SEQ ID NO: 63358 - protein, 142 aa, Arabidopsis thaliana
  misc_feature (27)..(27): Xaa can be any naturally occurring amino acid
GLDFRVRPHPSGVILGNSERRAFLKEXTKSAGAKVAYALAKGWKGMAGVGETLEEREAGPPLVVGVAQTKVLAVRWPNGPKVALAYDPGWAIGPGKAVGPPQAQKVHNELRKWLAKNVRAVVVVPTRIIYGGSSNGGNCKEL

SEQ ID NO: 63359 - protein, 492 aa, Arabidopsis thaliana
MSDFSSSVKLKYVKLGYQYLINNFLTLLLIPVIATVAIELLRMGPEEILSVLNSLHFELLHILCSSFLIIFVSTVYFMSKPRTVYLVDYSCYKPPVTCRVPFSSFMEHSRLILKDNPKSVEFQMRILERSGLGEETCLPPAIHYIPPTPTMESARNEAQMVIFTAMEDLFKNTGLKPKDIDILIVNCSLFSPTPSLSAMIINKYKLRSNIKSYNLSGMGCSASLISVDVARDLLQVHPNSNAIIISTEIITPNYYKGNERAMLLPNCLFRMGGAAILLSNRRSDRWRAKYKLCHLVRTHRGADDKSYNCVMEQEDKNGNVGINLSKDLMTIAGEALKANITTIGPLVLPASEQLLFLSSLIGRKIFNPKWKPYIPDFKQAFEHFCIHAGGRAVIDELQKNLQLSGEHVEASRMTLHRFGNTSSSSLWYELSYIEAQGRMKRNDRVWQIAFGSGFKCNSAVWKCNRTIKTPTDGAWSDCIERYPVFIPEVVKL

SEQ ID NO: 63360 - protein, 450 aa, Pseudomonas putida GB-1
MQPDHRATGNGQLRKTLRLWHVIIIGLAYLTPMTVFDTFGIVSGITAGHVPSAYILALAGILFTAVSYGTLVKRFPQSGSAYTYTQKAINPHVGFLVGWSSLLDYLLLPMVNALLAKLYLSAMFPEVPEWMWVAGFVTLISLINMRSVNLVAHFNLLFVGVQVAIIAVFIYLCVRGLDHGEGLGTAWSLMPFADSQTQFSALAAGATILCFSFLGFDAVTCLSEETRDPAKTIPRAIFLTALIGGVVFITVSYFIQAYFPTMARFHDQEAALPEIALYVGGKLFQSIFIACTVINTIASGLASQTSVSRLLYVMGRDNVIPASVFARLHSRYKTPVLNIAVVGIISLSAIFFDLVTATSIINFGALVAFSFVNLSVINHCYLREGNRKGLANQLKYLVLPTIGFCIIVSLWLDLNAHSLMFGGIWAALGLIYLGWLTKAFRAAPPNYIAE

SEQ ID NO: 63361 - protein, 540 aa, Triticum aestivum
FLKDVATDKVLSLLEFESLVGVSRSVQKLLRRAYCQSPALATEAKEAIGGKKKDIKSLCKNLMKKRSSHASGKTDVHVKSCTTSIPSRTKVQHRKKKNVEFSAVYMAQEIRAHNGLIRVMKFSPSGWYLASGGEDCVVRIWQITEVDAHSKMYGGENHPHEHVEKIKILKPKLAEGQGRALAVMPSKGFHITESPLHELHGHTGDVLDMTWSNSDCLLTSSKDKTVRLWKVGSDVCLGVFRHKDYVTCVQFNPTDERYLASGSIDGKVRIWDVLHKRVVNWADTRNVISAVSYQPDGKNFVVGTTGGVCRFYDQSGEDIQLDKELFMQGKKKSAANRIKSLQLCTSDSPRFLVTSTDSKIRVADGADIVQKFKGPWKSKALSSPSLTSDGRYLISTGMDSNVYIWNFDNSSSASQKGEAKSVRSCEMFFSKDVTTAVPWPGVHQDRHVKPSRLPEKSASASALRRHGGESRSPGTWFFADGMRGSVTWPEEKLTSAKPVNGPRLADCLSAISAAWNMVIVTASHGGVIRSFHNYGLPVTL

SEQ ID NO: 63362 - protein, 414 aa, Gordonia westfalica
MREVMASARPRLARARSGSLLLGPAFVAAIAYVDPGNVASNISAGAQFGYLLVWVIVVANVMAGLVQFLSAKLGVVTGRSLPETVRLRASRTARLSYWVQAEIVAMATDLAEVVGGAIALNLLFDLPLLIGGVITGSVSMVLLLVQDRRGQQPFERVIIGLLAVIAIGFLTSTVVAPPPPGAVVGGLLPRFDGTESVLIAAAMLGATVMPHAVYLHSGLVRDRHGHQPEGPIRSRLLRVTKIDVGLAMLLAGAVNLSMLLVAATTLRGREGVDSIDGAHAAVADTLGQVVALLFALGLLASGLASTSVGAYAGAMIMDGLLQRRIPLILRRLITLIPAITVLAIGIDPSRALIVSQVVLSFGIPFALVPLVRFTSDRMLMGEDVNNRLTTSLAWLTAAVIIVLNVALIYLTVTG

SEQ ID NO: 63363 - protein, 199 aa, Zea mays
MAFDCNKERGVSSPDRCSRICTEGTLVQANPLSHYWKPKRLENFNKLENQKSSYESAPSGSDPKQDAEASDEATASLCGFRCFTDLPASLVCEVLARLDAKDLGIVSCVSTLLHALATDHQGWKKLYCERWGLPDLPTTLNGPLLPGVPLDGKFWKTFFVERKFRSKSFMGRFNLDILRGHNEDVRAVSLLVSANLIFT

SEQ ID NO: 63364 - protein, 280 aa, Alkalilimnicola ehrlichei MLHE-1
MFKRIKEDIRCVMDRDPAARNAFEVLTTYPGLHALLFHRCNHWLWRKRLRWLARFFSTIARWLTGIEIHPGARIGRRFFIDHGMGVVIGETAEIGDDVTLYHGVTLGGTSWEQGKRHPTLGDDVVVGAGAKILGPLQVGSGARVGSNAVVLRDVPEGATMVGIPARMAGVRPRTDSADDRRRAAVARKIGFDAYGTTDMPDPVANAVNAILDHIHVTDARLEQMCRAIRGMGGDVEDTRIPDVEVDELDCGEPAPEAGEQGVDVTAGSGQVRGRQDRTGS

SEQ ID NO: 63365 - protein, 394 aa, Zea mays
MGSFVKLARRAVETDAPVMVKIQELLRGAKDVMSLAQGVVYWQPPESAMAKVEKIIREPTLSKYGSDDGLPELREALLEKLRRENKLTKSSVMVTAGANQAFVNLVLTLCDAGDSVVMFAPYYFNAYMSFQMTGVTDILVGGSDHKTLHPDVDWLEKVLKENDPIPKLVTVVNPGNPSGAFIPRPMLERISDLCKNAGAWLVVDNTYEYFMYDGMKHYCLEGTHIVNLFSFSKAYGMMGWRVGYIAFPNEVDGFHDQLLKVQDNIPICASIIGQRLALYSLEAGPEWIKERVRDLVKNRALLVDALSPLGDGNVRGGQGAIYLWAKLPDTCSDDFEVVRWLANRHGVAVIPGSASGGPGHIRVSFGGLKEEDTRLAAERLRRGLQELVADGTVQ

SEQ ID NO: 63366 - protein, 455 aa, Prochlorococcus marinus str. MIT 9301
MYPLLAELSAHDLEVAETLIGVIRFLLIFLAARALAEVLVRLSLPTIVGELLAGVVIGASGFHLLIPPSAGTELNEGLVNVISSLASIPPEAVPDVYFESFPSLQAVATLGLYALLFLTGLESELEELVAVGAQAFTVAMAGVILPFAFGTLGLMFIFQVDLIPAVFAGASMTATSIGITASVFGELGYLKTREGQIVIGAAVLDDILGIVILAVVVALAAGGTLEIAPIVKLVAAAVVFVIAAIALSRTAAPGFDWLLDRLKAPGAVVVASFVILVLCCFVATAIGLEAALGAFAAGLILSSSKNNHAIQQSVLPLVSLFATIFFVLVGAGMDLSVINPLDPTSRSALVVAGFLLVVAIIGKIAAGWVFSSDKPTNRLVVGLGMMPRGEVGLIFLGLGTSAKLLTPSLEAAILLMVIGTTFLAPVLLRIVLKDKPPNDGNKISDDVAADPVGLL

SEQ ID NO: 63367 - protein, 273 aa, Azoarcus sp. EbN1
MSITIKTPEEIGKMRVAGRLGAEVLDYITPYVQPGVTTGELDRLCHNYMVNVQHTVPAPLNYAPPGYPPYPKSICTSVNHQICHGVPGDKALKKGDIVNLDITVIKDGYHGDTSRMFIVGDGSILAKRLCQVTLECLWLGISVVRPGARLGDIGHIIQKHAESNGFSVVREFCGHGIGLKFHEEPQVLHYGKAGTGIELRPGMTFTIEPMINAGKAAISELPDGWTIVTKDRSLSAQWEHMVLVTDTGVEVLTLSADCPPPPALVAPLFPALA

SEQ ID NO: 63368 - protein, 141 aa, Alkalilimnicola ehrlichei MLHE-1
MAVERTLSIIKPDAVAKNIIGEIYNRFEKAGLKIVAARMVHLSREQAEGFYAVHKERPFFNDLVGFMISGPVMVQVLEGENAIVKNREIMGATNPAEAAAGTLRHDYAETIDANAVHGSDAPETAKQEIEFFFKADELCSR

SEQ ID NO: 63369 - protein, 227 aa, Streptococcus pyogenes M49 591
MEALKKIAGVTAAQYVTDGMTIGLGTGSTAYYFVEEIGRRVKQEGLQVVGVTTSSVTSKQAEGLGIPLKSIDDIDSIDLTVDGADEVDKDFNGIKGGGAALLMEKIVATPTKEYIWVVDASKMVEHLGAFKLPVEVVQYGADRLFRVFEKAGYKPSFRMKGDSRLVTDMQNYIIDLDLGCIKDPVAFGHLLDGTVGVVEHGLFNGMVDKVIVASKDGVTVLEAPKAG

SEQ ID NO: 63370 - protein, 338 aa, Geobacillus kaustophilus HTA426
MLTETEVRAILEKMKDPFLNKTFKETNAIQEIKIKEEKNHVSVKIALAKTGTPEQLRVQTAIVEQLKDAGAATVGLRFAELPRDVVEKYSENKQKTTYIAIASGKGGVGKSTVSVNLAVALARLGKKVGLIDADIYGFSVPDMMGITERPTVRGDKIIPVERFGVKVISMAFFVEDNAPVIWRGPMLGKMLNNFFKEVEWGDLDYLLLDLPPGTGDVALDVHTLLPSCKEIIVTTPHPTAAFVAARAGAMALRTEHEIIGVIENMSYYESRKTGEREYVFGKGGGEKLAKELQTELLGQLPLQQPDWNDDDFAPSVYAEDHPIGKIYMDIARKIVAKY

SEQ ID NO: 63371 - protein, 336 aa, Rhizobium sp. NGR234
MLHTTVTQLIGQTPVMSIDVPERDATLVLKIEKNNPGGSMKDRMARSMVVAALEDGRLAPGGTIVESSSGNTGTGLALAALEFGLRFIAVVDHHAAPDKIRMMRALGAEIRYVEGDFAEDQVAVVERQRLAAQLGAQLPGAMFMNQSDNPANPDGYAGLVDELIAQLPGGIDAFVGCVGTGGSMTGIAQRLKRHNPAVRTIAVEPAGSIVFGKPGHPYYQSGTGTPAGDEVGKVLDYGCIDEGVQVTDVQAFETARYIARRKGLLVGGSTGGAIFKALEFIVEGKLTGTVVTTVADGGEKYLGTIFDDEWMAKRRLLEPAIAAQLDGWLAGRARAA

SEQ ID NO: 63372 - protein, 322 aa, Arabidopsis thaliana
MGGVKRKISIELIEKKDSRAVAFSKRSRGLYSKASDLCLLSDAQIAIIATPVSSKSNVSFYTFGHSSVDNVVAAFLTNQRPREGLGLDYWWEDERLSKSEDLEELRDAMDSMSKMLKDLKDLQNQRDCEEDVKKKGVLHGTHQKQTFNPESCSVNFDGFNKNTEEFDLDEIFDYVSTAEALSMNLDMDDVSVVTTNQNPVSASETVEDRELVVHKNMDEDNIHVSDMDDKDTMLMISDKNNVLPENLDEFDQELDLDQLLDFETNYESLLKSCEMEDYASMVTTKQNLCSNPEAVEDGGLMIQKDLPEDNLCFSDYFSDLHC

SEQ ID NO: 63373 - protein, 373 aa, Oryza sativa Japonica Group
MVKASMKPYFVAIIVQLIYTGMFVISKAAFNHGMNTYIFIFYRQAVGSLILLPAALLQRKSARQVMTLGVPHKLFFCALIGITLGVNLYHVSLKFTSATVASAVDSSLPAITFFLAVLLRTEYVKLRSSSGIAKVTSVALCLAGVFTIAFFTGPSISPINHHRAFASDAGSKNVVPRGVWIKWTFLMVIANMCWSLWIIFQAAVQKEYPDKMIVTLTQCLFSTVQSFVVAVVAERDFSKWKLRFDISLLAILYSGVMVTGVSYYLQTWCLEMRGPMFFASWTPLCFVFTIFCSSFFLGEIVHLGSILGGILLVGSLYTMLWGKSKEGNETDDVTDDDIEKSTHIYPREQQHTTTDQDKESTLTGSAALHVQEL

SEQ ID NO: 63374 - protein, 173 aa, Listeria monocytogenes str. 4b F2365
MEIKDLQDYVAIVNDWPKKGIVFKDITPLMNDGEAYRFATDKIVEYAKELKIDIIVGPEARGFIIGCPVAYALGIGFAPVRKPGKLPRETIEMEYDLEYGTNKLSMHSDAIKPGQRVLITDDLLATGGTIEATIKLVEELGGIVAGCAFLIELKELEGHKKLNGYDRLILMQL

SEQ ID NO: 63375 - protein, 107 aa, Zea mays
TRPAIAEKIKDWSNVVVAYEPVWAIGTGKVATPAQAQEVHASLRDWLKTNVSPEVAESTRIIYGGSVTAANCKELAAQPDVDGFLVGGASLKPEFIDIINAATVKSA

SEQ ID NO: 63376 - protein, 512 aa, Arabidopsis thaliana
MFPLISFSPTSLDFTFFAIIISGFVFIITRWNSNSKKRLNLPPGPPGWPVVGNLFQFARSGKPFFEYAEDLKKTYGPIFTLRMGTRTMIILSDATLVHEALIQRGALFASRPAENPTRTIFSCNKFTVNAAKYGPVWRSLRRNMVQNMLSSTRLKEFGKLRQSAMDKLIERIKSEARDNDGLIWVLKNARFAAFCILLEMCFGIEMDEETIEKMDEILKTVLMTVDPRIDDYLPILAPFFSKERKRALEVRREQVDYVVGVIERRRRAIQNPGSDKTASSFSYLDTLFDLKIEGRKTTPSNEELVTLCSEFLNGGTDTTGTAIEWGIAQLIANPEIQSRLYDEIKSTVGDDRRVDEKDVDKMVFLQAFVKELLRKHPPTYFSLTHAVMETTTLAGYDIPAGVNVEVYLPGISEDPRIWNNPKKFDPDRFMLGKEDADITGISGVKMIPFGVGRRICPGLAMATIHVHLMLARMVQEFEWCAHPPGSEIDFAGKLEFTVVMKNPLRAMVKPRI

SEQ ID NO: 63377 - protein, 178 aa, Brassica napus
MNSVVRRNQVDSAHHIKKHDGEDHRHQLAKKLTAVDLVAIGVGTTIGAGVYILVGTVARQHTGPALAVSFFIAGVAAALSACCYAGLASRCPSAGSAYHYAYICLGEGIAWLVGWALVLDYTIGGSAIARGISPNLASFFGGSDKLPVFLARQTIPGLGIVVDPCAALLIMIVTILLC

SEQ ID NO: 63378 - protein, 152 aa, Nicotiana attenuata
MAEVEYRCFVGGLAWATTDQTLGDAFSQFGEILDSKIINDRETGRSRGFGFVTFKDEKAMRDAIEGMKGQDLDGRNITVNEAQSRGSGGGGGGGGYRGGGGGGYGGGGRREGGYGGGGGYGGGRREGGYGGGGGGGYGGGRREGGYGGGSEG

SEQ ID NO: 63379 - protein, 724 aa, Rhodococcus sp. RHA1
MTDSTIRYEKDADGIVTLVLDDPAQSANTMNEGFIVSLGEVVDRLTTERDTIAGVVVTSAKKTFFAGGDLNDILKSRAGQAEAVMANVDRIKEPLRRLETLGRPVVAAIGGAALGGGLEIALATHHRIALNAAGVQIGLPEVTHGLLPGGGGVVRTVRLLGVVSALTQVLLQGQRHTAEKAHGLGLIDELVDDVDHLVPAARKWIAENPDAVQPWDVQGYRIPGGTPASPALAANLPAFPANLRKQLKGAPYPAPIAIMSAAVEGALVDFDTAQKIENRYFAGLATGQISKNMIRAFFFDLQKANSLVNQYGGADRAPVGTVAVLGAGMMGAAIAYVCAESGMNVVLKDVSLAAAEKGKGYSKTLLDKAVAKGRTSAGKAETILARILPTDRPEDTAGAQLVIEAVFEDPAVKNTVFAEIDGFIAPDALLCTNTSTLPITLLGENLSRTEDFIGLHFFSPVDKMPLVEIIKGEKTSDDALGRALAVVRQIGKTPIVVNDSRGFFTSRVIGTFTNEGIAMLGEGVSPVSIEQAVSQAGYPAPVLALMDELTLTLPRKIREETKAAILAEGKTWEPHPADAVVDRMIDEFGRKGRSTGAGFYEYADGRRVGLWSGLEMFRRDGAHTEIPFEDIKERMLFIEAVETVRCLEEGVLESTTDANVGSILGIGYPGWTGGVARYIDQYPGGIQGFVSRAQLLAARYGVRFLPPQLLLDKAATGGTFEEVN

SEQ ID NO: 63380 - protein, 326 aa, Physcomitrella patens subsp. patens
MSDYLSPSARAIKPSGIRRFFDLANSRKDVITLGVGEPDFVTPWHVRDACVASLEAGKTQYTSNAGTPELRGAIGQYLNDSFSVAYDPAKEILVTVGGSEAIDLALRALISPGDEILVPEPSYISYSPITTLSGGVAVGVETFAEHAFKLQADTLRAAITPRSKILILSYPSNPTGGIMTYEDWLPIAKVVEEHDLVVISDEIYAELTYGSKHVSFASMPGMKDRTILVSGFSKAFAMTGWRIGYACGHPELIGTMLKIHQYTVMCASNMAQVAALEALTNGMEEMYRMMESYNQRRRLVVKGLRDIGLQCHEPQGAFYAFPSIAS

SEQ ID NO: 63381 - protein, 396 aa, Saccharophagus degradans 2-40
MALETLILNPQAERRIRKGHLWVYSNEVDGKKNPLTGYELGQQVQVVSAKGQVLGAATLNPQSLICGRIYSRNGDQELSKSFLAKRIEQALTLREAYFDKPYYRLVYGDSDFLPGVIADRYGDYLVVQIATAGMEAVKDELLRAFDKVLAPKGIVLANDHSARSLEGLPEYVETVGEVPEYLRVEENGTQFDIPSSGGQKTGWFYDHRVNRAELQKWVKGKTVLDVFSYAGGWGVEAANAGAESVTCVDASEQALDLVERAAELNGCDDKVMAIQGKAIHVLKLLIEEQQKYDVVVLDPPAFIKRKKDQKSGEAAYRHINELAMRLLKRGGLLVSGSCSMHLANSTLTDIVRAAAVHLDRDVQLVYSGVQAPDHPQHPAIPETHYLKAQFFRVLHR

SEQ ID NO: 63382 - protein, 431 aa, Ralstonia eutropha JMP134
MEPSVELTLRIGCLLAVIAACNVAAIKLRLPDALTLTAAGLALGTGLLITSTVAPTFTAQTIQPFLSPSLRPEGYLWIFLPPILFQAALEADAGAMARDLLPILVLAIGAVFAATLLVGVTAHAISGANLAVCLLVGAIVSTTDPSAVIDLFRSSGVPARMVRLVEGESLLNDAAAITLASHLMARIVGQPAHAMTGSVLGDLFGSLFAGGLLGALAGALLARACRAIPAAPLSRFTLSLALPNLLYPIADLWLHVSGVVTVVSAGLTAGTLLRRSSTPEEHAIFRHLWRSMGGMAGGMVFLLAAMHVPDLLRGLRGSDLWLILGVLVAALFSRWAVLGSSLPLLSRLGMCAPLPRAHRLAITWGGVRGPVTLVLALCAAQATSLPPEARHLASVVAVGFVLVNLTCNGLTLRPLVRRLGIGGDVNAGNHA

SEQ ID NO: 63383 - protein, 335 aa, Saccharophagus degradans 2-40
MKVLVTGAAGFIGYHLSERLLARGDTVVGIDNINDYYDPNIKLARLERLNKHEAFEFQKLDLADRGGMETLFSNHQFDRVVNLAAQAGVRYSIENPHAYVDSNIVGFLNILEGCRHTNVPHLSYASSSSVYGANTLQPFSEHHNVDHPVALYAASKKANELMAHSYSSLYKLPTTGLRFFTVYGPWGRPDMALFLFTKGILEGKPINIFNNGEMYRDFTYIDDIIEGVVRVTNKIAEPNPLWTGDKPDPATSYAPFKVYNIGNNNPVKLMDFVEAIENELGIKAIKNMMPMQAGDVPGTSADVQSLMDDVGFKPEITVQQGIKQFVGWYKEYFKV

SEQ ID NO: 63384 - protein, 427 aa, Saccharophagus degradans 2-40
MHNRKISVIGLGYVGLPVAVAFGKSQQTIGFDINQGRVEELQKGTDRTLEVTSEELAQTDILFTCTPADLQKADFHIVAVPTPINDSKQPDLRPLIGASKTLGPQLKKGDIVVYESTVYPGATEEDCVPVLEAESGLKCGVDFFVGYSPERINPGDKEHTFTKITKVVSGQTPEVLEIVAAVYGSVVTAGVHKATSIKVAEAAKVIENTQRDLNIALMNELSVIFNRMDIDTIDVLEAAGTKWNFLPFRPGLVGGHCIGVDPYYLTHKAERMGYNPEVILAGRRINDSMGAYVVQQVIRQLAQADKPIKGAKVAVMGLTFKEDCPDLRNSRVIDVIKECQTWGIEPLVHDPMADPAEAQHEYGVQLVGDDAIKNVDALIFTVAHKHYKQWSTEQIIARLAPEGSVFDVKGMLNREAFAQAGTTLWRM

SEQ ID NO: 63385 - protein, 140 aa, Oryza sativa Indica Group
MAHATSPQDAVATSHRPPPTAPSYNSLHVLLRKKPTSAQLCGGRVGGSRRPPEIMDSFSSPSSAGSTASTEHLMEQIKAQLAQAYAQEFLETVGNKCFAKCVTKPGTSLSGSESSCISRCVDRYIEATGIVSRALFSSQR

SEQ ID NO: 63386 - protein, 180 aa, Oryza sativa Indica Group
MARDGASAAAAGGGGPPQQHPDVPRELLGVALHERPGLYFSILRAHRLVLQADSAFPQVMEKLQSYKARVTLNFEGFQYQLGDFCLRIGKCVPNNSETLRGIMMEVEYYPLSSIEKSRAAMEDFFDIWQETVAKKSLPGHFIHVESNFSEYGLSDHYSFQHTAVQYATCLQQLMAAVRPQ

SEQ ID NO: 63387 - protein, 412 aa, Marinobacter sp. ELB17
MTLFEIVAILLSLSALFSYINARFIGLPTSIAVMAFSLAFSLVLVGINHLGGQDLTRWAEQLIAQVDLGETLLNGLLSFLLFAGALHVNLDDLADQKWLVALLATLGVVVTTFLVGCAMWLVLGWLAIPLPFIYCLLFGAVVAPTDPVAVLAILKSVDTPKALSTKIAGESLFNDGVAVVMFIAILGIAQGDREASFQGIGLLFLEEVVGGLVLGFVLGWVGYRLLRRLDNYQVEILVTIALVAGGYALASRLHMSGPLAVVVAGLMIGNHGRRYAMSEKTEQQLDTFWELIDEVLNAVLFLLIGLEVLIVTFELPVLLAGLAAIPLVLLARLVAVGVPVMALKPFQEHTSSSILALTWGGLKGGISVALALALPAGPERDLILPMAYVVVVFSILFQGLTVKRFLGRAVAK

SEQ ID NO: 63388 - protein, 387 aa, Helicobacter pylori J99
MLQRIYLDNNATTRIDPKVKEIMDPFLRDHYGNPSSLHQFGTETHPAIAEALDKLYKGINARDIDDVIITSCATESNNWVLKGVYFDECLKKGKNHIITTVAEHPAVRSTCNFLESLGVEVTYLPINEHGSITADQVKEAITEKTALVSVMWANNETGLIFPIEEIGAICKEKGVLFHTDAVQAIGKIPVDVLKANVDFLSFSAHKFHGPKGIGGLYIRSGVGLTPLFHGGEHMNGRRSGTLNVPYIVGMGEAMKLAVEHLDYEKEVVGKLRDKLEEALLKIPDVMVVGDRVHRVPNTTLISVRGIEGEAMLWDLNRSNIAASTGSACASEDLEANPVMVAIGASKELAHTAIRLSLSRFNTEAEIDKTIEVFSQAAVRLRNISSSY

SEQ ID NO: 63389 - protein, 396 aa, Triticum aestivum
VVALSWNRGIREVVDWMSKKSGIPASELREHLFMLRDSDATRHLFEVSSGLDSLVLGEGQILAQVKQVVRNGQNSGGLGKNIDRMFKDAITAGKRVRCETNISAGAVSVSSAAVELAMMKLPKSECLSARMLLIGAGKMGKLVVKHLIAKGCKKVVVVNRSVERVDAIREEMKDIEIVYRPLTEMYEAAADANVVFTSTASESLLFTKEHAEALPPISLAMGGVRLFVDISVPRNVGACLSEVEHARVYNVDDLKEVVEANKEDRVRKAMEAQAIITQELKRFEAWRDSLETVPTIKKLRSYADRIRASELEKCLQKIGEDNLNKKMRRSIEELSTGIVNKLLHGPLQHLRCDGSDSRTLDETLENMHALNRMFNLDTEKAVLEQKIKAKVEKTQS

SEQ ID NO: 63390 - protein, 146 aa, Theobroma cacao
TEDVVTGYRMHNRGWKSVYCVTKRDAFRGTAPINLTDRLHQVLRWATGSVEIFFSRNNAFLASPRMKSLQRIAYLNVGIYPFTSIFLIVYCFLPALSLFSGQFIVQTLNVTFLTYLLTITVTLCLLAVLEIKWSGIELEEWWRNEQ

SEQ ID NO: 63391 - protein, 226 aa, Glycine max
MNIFKSPLDHDLNCGGIFHDSAEASYSSETRSTPSDEEVILASARPKKRAGRRVFKETRHPVYRGVRRRNKNKWVCEMRVPNNNSRIWLGTYPTPEMAARAHDVAALALRGKSACLNFADSRWRLTVPATTNAEEIRRAAGEAAEAFAVADGDDVNIEQQQSVMATNDDEVQEPLQQEEVQDLHDLLLSIANEPLMSPPPCARDGRDWNDVDIFDDDEISLWNFSI

SEQ ID NO: 63392 - protein, 306 aa, Photobacterium profundum SS9
MEFIMTKTSLVRKAVIPVAGLGTRMLPATKAIPKEMLPIVDRPLIQYVVNECVAAGIKEIILVTHSSKNSIENHFDTSFELEATLEKRVKRQLLEEVQSICPKDVTIMHVRQGQAKGLGHAVLSARPLVGDEPFAVVLPDVVLDDAASDLRTENMAAMIAAFNETKISQVMVEPVPMADVSSYGVADVNGVGLKPGETAAMTKVVEKPALEDAPSNLAIVGRYVLPAEIWGMLERTPVGAGDEIQLTDAIDMLMESQQVNAFHMSGKSHDCGTKLGYMQAFVEYGMRHNSLGDDFKAYLKDMVKTL

SEQ ID NO: 63393 - protein, 236 aa, Triticum aestivum
  misc_feature (33)..(33): Xaa can be any naturally occurring amino acid
TFRTFPCGKPLKLATHPFLDWNLSGYFGETREXVARIPSTGGITLNEKPNIKALVFAEGNGHAILSGELTQVRINIPNGDMIGHPGDVKATLVACKAADEAVKMVLDPVEQVGGIYFVTADHGNAEDMVKRNKSGLPMLYKSGSIQISTWHTPQPVPVVIGGHGLIPGVRFRSDNQTTGLAYVASTVMNLHGFQAPADYEATLLEVIDKYQFNTAPFGAEIGAADFVAIFLGWGKE

SEQ ID NO: 63394 - protein, 157 aa, Vibrio cholerae O1 biovar eltor str. N16961
MIQIGQTLPDVQLSQRTSEGTLTHSVTTLFANKKVVLFAVPGAFTPTCSEAHLPGYVVLADKFKEKGVDMIACVSVNDAFVMKAWGEAQNASEIAMLADGDASFTKALGLEMDTGNFGGVRSQRYAMVIENNVVTLLNVEPPKTFELSKAETVLASL

SEQ ID NO: 63395 - protein, 248 aa, Bacteroides thetaiotaomicron VPI-5482
MKKIVLLRHGESAWNKENRFTGWTDVDLTEKGVAEAEKAGVTLREYGFNFDKAYTSYLKRAVKTLNCVLDKMNLDWIPVEKSWRLNEKHYGDLQGLNKAETAEKYGEEQVLIWRRSYDIAPNPLSESDLRNPRFDYRYHEVSDAELPRTESLKDTIDRIMPYWESDIFPALKDAHTLLVVAHGNSLRGIIKHLKHISDEDIIKLNLPTAVPYVFEFDENLNVANDYFLGNPEEIRKLMEAVANQGKKK

SEQ ID NO: 63396 - protein, 567 aa, Nostoc sp. PCC 7120
MSINPINKIHFRNWRGDLFGGLTAAIVALPLALAFGVASRAGAIAGLYGAIIVGFFAALFGGTPAQVSGPTGPMTVVVTTVITTLMARYPDTGLEIAFTVVMLGGLMQILFGVMRLGQYITLLPYTVISGFMSGIGVIIILLQLPPLLGHAGTGGVVTTLQKLPAYLSNPNWVAVGLGLLTLIIVFAAPPKLNRVIPSPLLALVAVTIISVVVFKDADIARIGKIPSGFPTFHKPTFNLRELADMLRYGLMLGVLGSIDSLLTSLVADNISRTQHDSDKELIGQGIGNMLAGLFGGLPGAGATMRTVVNVQAGGKTPLSGMIHALVLLLVVFWASPLTAQIPNAVLAGLLFKVGIDILDWGFIKRAPRLSLKGTGLMYLVLFLTVFVDLITAVLVGAFIANVLTIKRLSDVQSDNIQVITDPTGNQNLTPTEQEILTQAGGDILLLKLGGPMSFGAAKSISRRMSFVQNYQAIVLDFSEVPSIGITAALAIESIVEDAIAHHRHVWIVVTRGQVQRRITHLDLQRFCQPQKTQDASSGKLSAQINQVESRIQALESAFAVIQLESLA

SEQ ID NO: 63397 - protein, 282 aa, Listeria monocytogenes str. 4b F2365
MKIAYLGPAASFTHAAAAKAFPKEEMIAKSTIPDCIMAIEKEDVDVAVVPIENTIEGSVNITLDYLFHFSSVPVVAEIVLPIAQHLMVHPAHVSAWKSVQKVMSHPQALAQCHTFLQAELYGVEREVTPSTAYAAKWVSNNPTELVAAIAPRMAANEYGLEIVKENAQDLELNQTRFFVLSRKPVSILLPKEEEKTSISVILPNNMPGALHKVLSTFAWRDIDLSKIESRPLKTSLGEYFFLIDVLSEGKETLVTNALDEITLLGGTANKLGTYHVHRLQTT

SEQ ID NO: 63398 - protein, 246 aa, Nicotiana attenuata
DLALASGKIYGGEGFKYVKGCFEKGTLHLIGLLSDGGVHSRLDQVQLLLKGAAEHGAKRIRVHALTDGRDVLDGSSVGFMEDLENSLAQLREKGIDAQVASGGGRMYVTMDRYENDWDVVKRGWDAQVLGEAPHKFKDPVEVVKKLRQEPNAHDQYLAPFVIVDDNGKPVGPILYGDAVVTFNFRADRMVMLAKALEYENFDKFDRVRVPKIRYAGMLQYDGELQLPSHYLVSPPEIDRTSGEYLV

SEQ ID NO: 63399 - protein, 256 aa, Saccharomyces cerevisiae
  misc_feature (180)..(180): Xaa can be any naturally occurring amino acid
  misc_feature (220)..(220): Xaa can be any naturally occurring amino acid
  misc_feature (222)..(222): Xaa can be any naturally occurring amino acid
STGITYDEDRKTQLIAQYESVREVVNAEAKNVHVNENASKILLLVVSKLKPASDIQILYDHGVREFGENYVQELIEKAKLLPDDIKWHFIGGLQTNKCKDLAKVPNLYSVETIDSLKKAKKLNESRAKFQPDCNPILCNVQINTSHEDQKSGLNNEAEIFEVIDFFLSEECKYIKLNGLXTIGSWNVSHEDSKENRDFATLVEWKKKIDAKFGTSLKLSXGXSADFREAIRQGTAEVRIGTDIFGARPPKNEARII

SEQ ID NO: 63400 - protein, 426 aa, Caulobacter crescentus CB15 [sequence omitted]

SEQ ID NO: 63401 - protein, 481 aa, Coccidioides immitis RS
MSSAPKSRWVEDDADTQAYLEQKKREKEKKKQAKAEKQRQLEEAQRRANPPTLASEAADANGAAESRVREGSAERPVKRRRLSIDRGDTQRVVAEDKPGALLQFPGSEWGPCRHVDNYERLNAIEEGSYGWVSRAKEVTSGEIVAIKKLKMDNTYDGFPITGLREIQTLQESRHPHIVRLREVVMGDTMDDVFLVMDFLEHDLKTLLDDMREPFLPSETKTLLLQIMSAAEFLHSHWIMHRDLKTSNLLMNNRGEIKLADFGMARYYGDPPPKLTQLVVTLWYRSPELLLGAEKYGPEIDMWSIGCIFGELLTKEPLLQGKNEVEQLSEIFKLTGPPNSQIWPGFRSLPNAKSLRLPPSSTTSSKRSTNVPLLPRSKFPYLTTAGLTLLSDLLALNPASRPTAKDCLSYPYFREDPKPKPKEMFPTFPSKAGMEKRRKRDTPEAPKRGEEAPSLDFANVFGGGGGAESGMEAGAGFTLRLG

SEQ ID NO: 63402 - protein, 398 aa, Solanum tuberosum
MATEEDAVRRRTALADYRKKLLQHKELDARVRTVRENLRATKKEYAKTEDDLKSLQSVGQIIGEVLRPLDNERLIVKASSGPRYVVGCRSKVDKEKLTSGTRVVLDMTTLTIMRALPREVDPVVYNMLHEDPGNISYSAVGGLSDQIRELRESIELPLMNPELFLRVGIKPPKGVLLYGPPGTGKTLLARAIASNIDANFLKVVSSAIIDKYIGESARLIREMFNYARDHQPCIIFMDEIDAIGGRRFSEGTSADREIQRTLMELLNQLDGFDQLGKVKMIMATNRPDVLDPALLRPGRLDRKIEIPLPNEQSRMEILKIHAAGIAKHGEIDYEAAIKLAEGFNGADMRNVCTEAGMFAIRAERDYVIHEDFMKAVRKLNEAKKLESSAHYSADFGKE

SEQ ID NO: 63403 - protein, 342 aa, Gibberella zeae PH-1
MGDHVDKIRLQPTEDGSFVRPTSSFRHFISNEPDSQFPPEKNRYVLYLSPGCPWSHRAMIIRSLKGLDDMIDLYMCSLHMGKEGWMFEDNPEAAKYGSLPKDPLYGFDTLKQLYLKANPNYQGRYTVPVLWDTKTHTMVSNESSDIVRMLSTEFDRLLPEERREINRPGGGLYPEHLRQGIDELNEWVYETVNNGVYMTGFAMSQAAYEDNVDKVFKSLDRLERVLDKGPFLLGEHITEADLRLYPTIIRFDAAYVPIFMCNLGTIRDHYPNLHLWMRRLYWDNSVRTFGTFKSTTSTWIDQYKILYLKARRRVLGLNDLDIIPKGPLVSIHELKEGEALEG

SEQ ID NO: 63404 - protein, 336 aa, Debaryomyces hansenii CBS767
MTSFDPESISYFNPNVDRRVALITGGNSGVGWYTVLHLYLHGYIVYIAARSKTRVNTSINELKEEAMVIRLKYTSQQSSNERFLGELYFLDIDLLSLSSVLNAVKTFKSREKHLNILINNASVMALPYSITKDGFEIQMQTNYISPFLLTTKLLPLLESSSELFPKSGPPKIIYLSSIGHQLAFKYFNLNSTFNYRPNIVFTWFRYGLAKTCGIHFMKMLALRNPKILCMSVHPGFVMNTNLFSYWTRLPIIGILFWCLFQIFGFLFGVSSEQGSYATVRCCLDPKLSLEEDNGKYFATNGAEAEPSKIARNMNFAARTWIWTVQELSERKISIPN

SEQ ID NO: 63405 - protein, 477 aa, Methanosarcina barkeri str. Fusaro
MQIPDHKTKIVCTIGPASSSEEVIRKLVLAGMNVARINFSHGSFESHSEVIQRVRKVAEELDRTVAILADLPGPKIRIGKLEKEPIMLHKGNSVTLTVAETTGNETRIPVSYKQLPESVVPGSLIYLSDGFIQLRCLEVSGKDVLCEVLIGGQLYSHKGLNLPGAKILVDSVTGKDLEILGFALSKGIDTFSISFIESAEDIRNVRNFAAARGKSVYIVSKIERRQAVENIQDILKETDALMIARGDLGVEIPIQEVPSVQKELIHSAKLLGIPVITATQMLASMTDNIRPTRAEATDVANAILDGTDAVMLSEETAVGNYPVEAVEMMAKIAKTTEDWRSGTKWGLDAIIKGITARDMSVDEVITLQVHEALQKLPVAAVLTPTRSGATPRRISRFKPDTWILAFSRVPRTCGFLSLSYGVYPITVNENIESWEKETTEKAKDLGFVKSGEIVIFTQGPSSGSPGGTNMLKILTLK

SEQ ID NO: 63406 - protein, 211 aa, Solanum tuberosum
LGLRYSPFSHRVEWALKIKGVKYEFIEEDLQNKSPLLLQSNPIHKKIPVLIHNGKCICESMVILEYIDEAFEGPSILPKDPYDRALARFWAKYVEDKGAAVWKSFFSKGEEQEKAKEEAYEMLKILDNEFKDKKCFVGDKFGFADIVANGAALYLGILEEVSGVVLVTSEKFPNFCAWRDEYCTQNEEYFPSRDELLIRYRAYIQPVDASK

SEQ ID NO: 63407 - protein, 89 aa, Glycine max
  misc_feature (13)..(14): Xaa can be any naturally occurring amino acid
  misc_feature (17)..(17): Xaa can be any naturally occurring amino acid
  misc_feature (22)..(23): Xaa can be any naturally occurring amino acid
  misc_feature (28)..(29): Xaa can be any naturally occurring amino acid
  misc_feature (33)..(34): Xaa can be any naturally occurring amino acid
  misc_feature (36)..(36): Xaa can be any naturally occurring amino acid
  misc_feature (40)..(41): Xaa can be any naturally occurring amino acid
  misc_feature (44)..(44): Xaa can be any naturally occurring amino acid
  misc_feature (46)..(47): Xaa can be any naturally occurring amino acid
  misc_feature (49)..(49): Xaa can be any naturally occurring amino acid
  misc_feature (52)..(53): Xaa can be any naturally occurring amino acid
  misc_feature (65)..(65): Xaa can be any naturally occurring amino acid
  misc_feature (67)..(67): Xaa can be any naturally occurring amino acid
  misc_feature (71)..(71): Xaa can be any naturally occurring amino acid
  misc_feature (76)..(76): Xaa can be any naturally occurring amino acid
  misc_feature (83)..(83): Xaa can be any naturally occurring amino acid
  misc_feature (85)..(85): Xaa can be any naturally occurring amino acid
RHAYSSEFGSTPXXPHXLHKVXXISGVXXLGLXXYXAHVXXPQXPXXKXVWXXASLYHLVHTAAXVXAPIXKHPNXFGGLLTXGXLATL

SEQ ID NO: 63408 - protein, 295 aa, Chlamydia muridarum Nigg
MVPCMKRNDPCWCGSQKKWKHCHYPTKPERPSDNLRQLYASRYDIIIKTPDQIEKIRKACQVTARILDALCKAAKEGVTTNELDQLSCNLHKQYNAIPAPLNYGQPPFPKTICTSLNEVICHGIPNDTPLQNGDIMNIDVSCIVDGFYGDCSRMVMIGEVPEIKKKVCEASLEALNAAIAILEPNLPLYEIGEVIENCAARYGFSVVDQFVGHGVGVRFHENPYVAHHRNSCKIPLAPGMTFTIEPMINVGKKEGFIDPTNHWEARTCDHQPSAQWEHTVLITDSGYEILTLLDN

SEQ ID NO: 63409 - protein, 278 aa, Brassica napus
VDPRVRSGLWGKEGEKPYQIISPHLNVGGPISAEASNGNTQVFINGREITKVELRMLQLAGVQCAGNPHFWVNEDGSYQEEGQKNTKGYIWGKAGTKLLCAVLSLPVPSKSISNASGDQLHSANSRSILDHLEHRTLQKILLVGNSGSGTSTIFKQAKILYKDIPFLEDERENIKVIIQTNVYGYLGMLLEGRERFEEEALGVMNAKHSLIEDEEGEAKTNVKTLYSIGPRLKAFSDWLLKTMAAGNLGVIFPAASREYAPLVEEVWRDAAIQATYKR

SEQ ID NO: 63410 - protein, 359 aa, Helicobacter pylori J99
MKILSYLKKFYLFLLIGAIMQANESMGAKLPKTDERVIYLAGGCFWGLEAYMERIYGVIDASSGYANGKTSSTNYEKLHESDHAESVKVIYDPKKISLDKLLRYYFKVIDPVSVNKQGNDVGRQYRTGIYYVNSADKEVIDNALKALQKEVKGKIAIEVEPLKNYVRAEEYHQDYLKKHPGGYCHIDLKKADEVIVDDDKYTKPSDEVLKKKLTKLQYEVTQNKHTEKPFENEYYNKEEEGIYVDITTGEPLFSSADKYDSGCGWPSFSKPINKDVVKYEDDESLNRKRIEVLSRIGKAHLGHVFNDGPKELGGLRYCINSAALRFIPLKDMEKEGYGEFIPYIKKGELKKYIQDKKSH

SEQ ID NO: 63411 - protein, 269 aa, Oryza sativa Japonica Group
MAGGGEELKLLGMWASPFALRAKLALSFKGLSYDYVEEDFKNKSDVLLSSNPVHKKVPVLIHKGKPICESQVIVQYIDEVFPDAGVTLLPADPHDRAVARFWAAYIDEKLFSAWILVFRSKTEEEKAEAVKQTFAVVEKLEGALSECSKGKPFFGGDTVGYVDVVLGGFVAWVHAIEEVFGLNQFDAAKTPLLAAWLERFDELDAVKEVMPDIGRLVELAKMRQAQAAGAAAAAAVRIAAPCIFAMYRRSCQVGSGYSTKMMYDVLRLY

SEQ ID NO: 63412 - protein, 385 aa, Helicobacter pylori J99
MLEKIQKEWLSNIQKDLLSGFVVGLSVIPETAGFAIMVGLDVGVAFYTTFYMAFVLSLFGARKAMISAAAGSVALILVGVVKNYGLEYAGVATLMAGILQILLGYLKIGNLLKFIPQSVMYGFVNALGILLLTEQFKFLQNQNLGVFVLLAIGILIIYLFPLITKKIPSNLICILAVSAIALIFDTHAPNLGSIEQGVSGFHFIIIPKNLDFKMVLGLLPYALSLALVGTIESLLTAKTLDVILKDGVSDKNKETKAQGLGNIISGLLGGMTGCALVGQSIINAKSGAKTRLSTFFAGFSLMVLILVFNEYVVKIPIVAVVAVMVIISFTTFNFQSIMNIKTIKLYDTLNMLLVVAVVLYTHNLAIGVVVGVLINALWIKFKGMG

SEQ ID NO: 63413 - protein, 407 aa, Xanthomonas oryzae pv. oryzae KACC10331
MIEAAEQRGDLTPGATLVEGTAGNTGLGLALVAQQKGYQLILVVPDKMSREKIFNLKAMGANVVLTRSDVAKGHPEYYQDLAAKIAAETPGAYFINQFGNPDNPAAHEFGTGPEILAQMDGQLDAIVFGCGSSGTMTGLSRAFASASPHTELVLADPVGSILTQYIEEGTVSEKSGSWLVEGIGEDFLPDISDFSRVKKAYSISDAESFHTARELLAKEGVLGGSSTGTLLAAALKYCREQTTPKRVLVFVCDTGNKYLSKMYNDYWMLDNGFLERPQYGDLRDLILRPYNKRDTVVVGPKDLLTTAYQRMKLYDVSQLPVIDDGELVGIVDESDVLLHVYGDEARFRDPISTAMVSKLDRLDVASPIEALLPVFDRGQVAIVMNGKQFLGLITRIDLLNYLRRRVQ

SEQ ID NO: 63414 - protein, 312 aa, Physcomitrella patens subsp. patens
MAACLFPLSQALRSYHGEEACTSFVDYAQLDAFTSEAFRGNPAAVCLLPIARSVEWMQIVAAEFSAPMTAFLVKRSKTKDTAGNGQASEFDVRFFTPTAEVDLCGHATLASAYLMFKSGLAPGPHVFFHTLKATLKVNMVMGSDGNNEWQDQVELCLPFMDATPISIDMDSIFPQTLQRCQVMSSHKSAWDRVILELPSATEVETLKPCFEEINACRFRGGLIVTGKGSSGSPFDFVSRYFAPQFGIPEDPVCGTAHCSLAPLWAAKLGKQKLLAYQASQRGGVLELSVDNDAKCVLLRGAAVIVTAGVLLS

SEQ ID NO: 63415 - protein, 187 aa, Zea mays
YICFMQIGPLFRQLMPMMEASPVYSVARNASGDYAWKALFDLAGGLLREYDQEATVSLSKFIDQLPSVMNQVTEGVSEFKPTPPENREFCKNSYSVPNTLLVKFTVDAIDDTDIVEDVLRPRVDSIGGQIKKVILSGTHLTPCIQDVKWQVGSEYTPADAIAQGLKSLALSETRVLSRTIADWFTSL

SEQ ID NO: 63416 - protein, 388 aa, Photobacterium profundum SS9
MKITVVGTGYVGLSNAVLLSQHNDVIALDIVKDKIELINKRQSPIVDKEIEEYLTDKNLNLIATTDKALAYADAEFVIIATPTDYDPINNYFDTSSVEAVIKDVIAFNPNAVMVIKSTVPVGYTQRIKEELGCENILFSPEFLREGRALYDNLYPSRIIVGERSERAERFANLLANGAIKENIEVLFTDSTEAEAVKLFSNTYLALRVAYFNELDTYAATHGLDSRQIIEGVGLDPRIGSHYNNPSFGYGGYCLPKDTKQLLANYQEVPNNIIGAIVDANSTRKDFIANSIIQKNPTVVGVYRLVMKAGSDNFRASSIQGIMKRIKAKGIKVVVYEPVLNEKEFYRSEVIKNLEQFKQMSDVIVSNRMDAELSDVADKVYTRDLFGSD

SEQ ID NO: 63417 - protein, 816 aa, Oryza sativa Japonica Group
MAFHVACPITWFMPNGFSVLLTLCFFIWGVDTHDYDVVKLEEGDEEDWGQEDVGNAAVKVMCRICFSGENEGSTKAAKMLPCKLCNKKYHRSCLKNWGEHRDLFHWSSWVCPSCRSCEVCRRPGDPNKLMFCKRCDGAYHCYCQQPSHKNVTHGPYLCPKHTRCHSCGSGVPGSGHSTRWFLGYTCCDACGRLFVKGNYCPVCLKVYRDSEVIPMVCCDVCEKWVHIECDGISEEKYQQFQSDQNLQYTCGACRGECSQIRDTEDAVRELWKRRDVVDHDLMASLRAAAALPSLEDVSPSHPNSDDEKLGAYVMKNDGRNTLKFSFKSNSTKPALDSSEQEKNAIKSSGSNKKHSKKKGNQNNKTVSEQDEIFLEKRNETKSLGSLGDQIADVTRDKSSFKNDADAFVLSSAQSAEKALKLQSAKAAAHNADMIPKVKIKGTKVPSLHFKDVGEENAAKSDTGKGTKLVIHIGSRHKSRSGSPKSEMSNSQKEQELVSMHGGKVDVTSQFKSSRSEIKEKSVMKLVRETGVQQNSLLGDLGASKKHATGKRSNAIVSAMENASESGTRSRSFGQKQSVNHLTENQGNASFSVNNSPDSLKPSLLKLKFKRPIFEQPSTQSSQPEEPGTWASPQEELNVAKGQRSKRKRPSLDKMDGSESKAPAAKRHEQSTGEEAMDANWILRKLGKDAIGKRIEVQLASDGKWHQGVVSNVINGTLCLQLDNGRSENIELGKRAIRLIAQSQLPATRVVSRPLQAPAFGSSQSLIHGRLGGLKRIGFILTSGSVGTNNWEGFLGATLDVEEMPDDGHVHVAVAAE

SEQ ID NO: 63418 - protein, 212 aa, Nicotiana attenuata
SAAYYQQGARFAKWRTVVSIPNGPSALAVKEAAWGLARYAAISQDSGLVPIVEPEILLDGEHGIDRTFEVAQKVWAEVFFYLAENNVMFEGILLKPSMVTPGAECKDRATPQQVADYTLSLLKRRIPPPVPGIMFLSGGQSEVEATLNLNAMNQAPNPWHVSFSYARALQNTCLKTWGGQPENVKAAQDALLTRAKANSLAQLGKYTGEGES

SEQ ID NO: 63419 - protein, 238 aa, Bifidobacterium longum DJO10A
  misc_feature (221)..(237): Xaa can be any naturally occurring amino acid
MAINPPVDATQTPEWAALQKHYDELQVEGVSLKKWFAEDAERVEKLSFDAGDLHFDLSKNLIKPETLQLFANLAKAVKLDERTKAMYTGVHINNTEDRAVLHTALRRPVEDEGKYIVDGQDTVKDVRETLDKIYAFADDVRSGKWTGVTGRKIETVVNIGIGGSDLGPVMVYEALKPYADAGISARYISNIDPNDLAEKTKGLDPETTLFIIVSKTFTTLXXXXXXXXXXXXXXXXXP

SEQ ID NO: 63420 - protein, 265 aa, Bifidobacterium longum DJO10A
MIFGPARFEEFLHGFHEIDEYFANTPFEKNVVVLLGMLNVWYRNFFKVASHAVLPYDQYLHRFPAYLQQLTMESNGKSVRWDGTPVTSETGEIFWGEPGTNGQHAFYQLIHQGTQLIPADFIAFVNTPNPTKDGDQDVHELFLGNYFAQTKALAFGKTADEVRAEGTPEEIVPARVFSGNRPTTSIFGVALTPFALGELIALYEHITFVEGTVWGLDSYDQWGVELGKQLAKQITPAISQDDDALAAQDASTQSLIKFYRANREF

SEQ ID NO: 63421 - protein, 855 aa, Ostreococcus tauri
  misc_feature (1)..(1): Xaa can be any naturally occurring amino acid
XRRRAEDGRRSRVRTRRGDVALGAYCDVGSAHEKPWQRVFAHALERAAFKSTSNRSAFRVTRECEVIGANLSASASREQFCFAADALKTRAAETTELLLDCAMNASLHDYEIEEVVKSLKEEVKELNENPQAMLMEAAHATAYSGGLGAPLVAPGGDLSHIDGDSLREFVRENMKASRIVLAASGIDHDELVRIAEPLLLTADGSSTGSPQEASTYTGGDFRQKTDAPIASMILGFEFKGGWRDVKASTAMTVLTMLLGGGGSFSAGGPGKGMYSRLYTRVLNRYSWAQNCTAFHSIFNDTGIVGISAMANSAHVGDMAKVMASELQAVAAKGGIDAKELERAKNATVSSILMNLESKAVIAEDIGRQMLTYKYRKSADDFIAEVRAVTAADVAQAASNLLASEPTFAASGDLYAAPRFDEIKAMFNTICKRKISRDSIEKFNLEVEPPRLDSRFQTPPQTRDDFRRATLTSSSSTHLRLGRLLLLLLGRAFNRLADGFVAVVTVHFHELGEVKLRRLENLDLANVHVLKRVNARARLFNLLANDLRDELEDEFLQVARRALTGDDFNHLGANATNLRALRVARALGLVDAALGETDAEHSQGVAIRRLDVDEALDEGEPLANERADLIRGEVHAGKVGQDILALHVFALELHLAERLIFVVVQIGERDLEDATLQSVGRDLRERKMDTISSVLGLSPSLASFRTLVPCVRVTSVLPMFLTENMLGALMSYQSFFVNGSTLRSSRARTQSVIRRAANPRGSTRVVKRSRRARARPPTTYAFFLPPFLPLDMRLFLPCAIGVECARASRKGGRRDARAGVVGAGGHHRSVCPYTPCVHTTHTRAHGSSGRAYITVL

SEQ ID NO: 63422 - protein, 332 aa, Zea mays
MSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKGKGEGRTTTRTHRQSLQAAQSLSPSYPQGEELRGGGGPSAAVLVSPLSKMSSPSKRREMDLMKLMMSDYKVEMVNDGMQEFFVEFKGPAESIYQGGVWKVRVELPDAYPYKSPSIGFINKIYHPNVDEMSGSVCLDVINQTWSPMFDLVNVFEVFLPQLLLYPNPSDPLNGEAAALMMRDRPVYEQKGKGTVVH

SEQ ID NO: 63423 - protein, 428 aa, Caulobacter crescentus CB15
MSIDILMPALSPTMEEGTLAKWHVKVGDTVKAGDVIAEIETDKATMEVEAVDEGVVEAILVPAGTENVKVNALIAKLAGEGDSPAPAPKVEAPKAAAAAPVPAAAPAPAVPAPAAPVAADGSRVLASPLARRLASAAGLDLKALKGTGPHGRVVKSDVEAAKSGAPAAKAAPASAPAAVAPTAAAPRQIQSLEQMGIPAGSYDLVPLDGMRKTIARRMTESFRDVPHFPLTIDLEIDALLAARAKINSLLEKQGVKVSVNDIVIKAAAVALKQVPEANASYTPEGIAMHHHADIAVAVAVDGGLITPIIRKAETKGLAQISAEMKDLAQRAKDKKLKPEEFQGGTFSISNLGMFGIKSFASIINEPQGAIMSVGAGEQRPVVKNGEIKVATVMTVTLTCDHRVVDGSVGAKFLAAFRPLIEEPLTLIV

SEQ ID NO: 63424 - protein, 474 aa, Actinobacillus pleuropneumoniae serovar 1 str. 4074
MSKEIKTQVVVLGAGPAGYSAAFRCADLGLETVIVERYSTLGGVCLNVGCIPSKALLHVAKVIEEAKHAEKNGITFGEPNIDLDKVRAGKEAVVSKLTGGLAGMAKARKVTVVEGLAAFTDPNTLVARDRDGNPTTIKFDNAIIAAGSRPIQLPFIPHEDPRVWDSTDALKLKEVPKKLLIMGGGIIGLEMGTVYNALGSEVEVVEMFDQVIPAADKDVVAIYTKQIEKKFKLMLETKVTAVEAKDDGIYVSMEGKACNDTKRYDAVLVAIGRVPNGKLIDAGKAGVNVDDRGFIAVDKQMRTNVPHIFAIGDIVGQPMLAHKGVHEGHVAAEVIAGQKHYFDPKVIPSIAYTEPEVAWVGKTEKECKQEGLNYEVAKFPWAASGRAIASECSEGMTKLIFDKDTHRLLGGAIVGSNGGELLGEIGLAIEMGCDAEDIALTIHAHPTLHESVGLAAEVFEGSITDLPNAKAKKR

SEQ ID NO: 63425 - protein, 632 aa, Actinobacillus pleuropneumoniae serovar 1 str. 4074
MSKQINVPDIGSDEVSVTEVMVKAGDTITVDQSIINVEGDKASMEVPAPEAGVVKEVLVKVGDKVTTGSPMLVLEAAESAPALVAEAPVQAVAPVATASAVVEVNVPDIGSDEVNVTEIMVKVGDSVEVDQSIINVEGDKASMEVPAPIAGVVKEILINVGDKVTTGKLIMKFETVSAAPAAEEAPAQAAAPVATASAIKEVNVPDIGGDEVNVTEIMVNVGDTVSEEQSLITVEGDKASMEVPAPFAGVVKEILVKSGDKVSTGSLIMKFEVAGAAPAAAPAPAVQAAAPAPAAQPAAQPAQSGNVSGLSQDVVAAAGAYAHATPVIRRLAREFGVNLDKVKGSGRKGRIVKEDIQTYVKTAVQVFEKQGGTAAAATGAANGAGLGLLPWPKVDFSKFGEVEEVELSRINKISGANLHRNWVMIPHVTHFDRTDITDLEAFRKEQNKLAEKQKLDVKITPVVFIMKAVAKALEAFPRFNSSISEDAQRLTLKKYINIGVAVDTPNGLVVPVFKNVNKKGIVELSRELMEVSKKARDGKLTASDMQGGCFTISSIGGLGTTHFTPIVNAPEVAILGVSKSEMAPVWNGKEFEPRLMLPLALSFDHRVIDGADGARFLTYINGVLADIRRLVM

SEQ ID NO: 63426 - protein, 419 aa, Bacteroides thetaiotaomicron VPI-5482
MQTIDKFNFAGKKAFVRVDFNVPLDENFNITDDTRMRAALPTLKKILADGGSIIIGSHLGRPKGVADKFSLKHIIKHLSELLGVEVQFANDCMGEEAAVKAAALQPGEVLLLENLRFYAEEEGKPRGLAEDATDEEKAAAKKAVKESQKEFTKKLASYADCYVNDAFGTAHRAHASTALIAKYFDTDNKMFGYLMEKEVKAVDKVLNDIQRPFTAIMGGSKVSSKIEIIENLLNKVDNLIIAGGMTYTFTKAMGGKIGISICEDDKLDLALDLIKKAKEKGVNLVLAVDAKIADAFSNDANTQFCAVDEIPDGWEGLDIGPKTEEIFANVIKESKTILWNGPTGVFEFENFTHGSRTVGEAIVEATKNGAFSLVGGGDSVACVNKFGLASGVSYVSTGGGALLEAIEGKVLPGIAAINE

SEQ ID NO: 63427 - protein, 466 aa, Caulobacter crescentus CB15
MSTEFDVVVIGAGPGGYVAAIRASQLGLNTAIIERENLGGICLNWGCIPTKALLKSGEVYEQLSHLGGYGLSVEKASFDFGKIIERSRGVAKNMSGGIAFLMKKHKIEVIEGEAKLEKGAPAPKVVVALKAGGSRTVQAKNVILASGARAREIPAIGAVSDGDKIWTYRDALAPKSMPKSLVVIGSGAIGIEFASFYRALGAEVTVVEAIDRIMPVEDEEVSKAAQKAFEKRGIKFRVGAKVSKIEKTKDGVAVTVEAGGKIEQLTAEKCIVAVGIAPNNDGLEALGVSLDRGHVVTDKHCRTNVPGLYAIGDIAGAPWLAHKASHEGIHAAEAIAGYKTPNVLSPIPGCTYANPQVASVGYTEAGAKAAGIEVKAGRFPFRVNGKAVASGETEGFVKTVFDAKTGALIGAHMIGHEVTEMIQGFVTAITLEATEEDLHGVVYAHPTMSEAMHEAALDAYGRVLHI

SEQ ID NO: 63428 - protein, 440 aa, Oryza sativa Japonica Group
MGKQMAALCGFLLVALLWLTPDVAHAQTQILFQGFNWDSWKKQGGWYNMLKDQVGDIASAGVTHVWLPPPTHSVSPQGYMPGRLYDLNASKYGTKAELKSLIAAFHAKGIKCVADIVVNHRCADDKDGRGVYCIFKGGGPRGCLDWGPSMICCDDTQYSDGTGHRDTGADFAAAPDIDHLNPLVQRELSDWLRWLRRDVGFDGWRLDFAKGYSAAVARTYVQNARPSFVVAEIWNSLSYDGDGKPAANQDGQRQELVNWVKQVGGPATAFDFTTKGILQSAVQGELWRMRDKDGKAPGMIGWYPEKAVTFVDNHDTGSTQRMWPFPSDKVILGYAYILTHPGVPCIFYDQVFDWNLKQEINALAATRKRNGINAGSKLRVLAAESDMYVAMVDERVITKIGPRIEVGNIIPSDFHIVAHGNDYCVWEKSGLRVPEPEGRR

SEQ ID NO: 63429 - protein, 210 aa, Aegiceras corniculatum
NGKYELGCILGHGTFAKVYLARNVPSGKNVAMKVVGKEKVIKVGMMEQVKREIAVMKRVKHPNIVELHEVMASKTKIYFAMELVRGGELFAKVAKGRLKEDVARHYFQQLISAVDFCHSRGVYHRDLKPENLMLDDDGNLKVADFGLSAFADHLRQDGLLHTTCGTPAYVAPEVLGKKGYDGAKADIWSCGVILYVLLAGFLPFQDENLV

SEQ ID NO: 63430 - protein, 437 aa, Oryza sativa Japonica Group
MAKHSTTMSCLLFFVLLCLGSHLAQAQVLFQGFNWESWNKQGGWYNFLHSHVDYIAATGVTHVWLPPPSHSVAPQGYMPGRLYDLDASKYGTGAELRSLIAAFHSKSIKCVADIVINHRCADYKDSRGIYCIFEGGTPDSRLDWGPDMICSDDTQYSNGRGHRDTGADFGAAPDIDHLNTRVQTELSDWLNWLKSDVGFDGWRLDFAKGYSATVAKTYVDNTDPSFVVAEIWSNMRYDGNGEPSWNQDGDRQELVNWAQAVGGPASAFDFTTKGELQAAVQGELWRMKDGNGKAPGMIGWLPEKAVTFIDNHDTGSTQNSWPFPSDKVMQRYAYILTHPGVPCIFYDHVFDWNLKQEISTLAAVRSRNGIHPGSKLNILAADGDVYVAMIDDKVITKIGTRYDVGNLIPSDFHVVAHGNNYCVWEKSGLRVPAGRRH

SEQ ID NO: 63431 - protein, 484 aa, Saccharophagus degradans 2-40
MKALSDIGLVGLAVMGENLVLNMESKGFTVTAYNRSAEKVEKFLSGRAAGKNIRGASDVKDLVASLEKPRKVMLMVKAGQPVDDMIEQLVPHLEDGDIIIDGGNTHFPDTIRRAKALEPKGIHFVGSGVSGGEEGALKGPSIMPGGSQHAWQAVKPIFQAISAKVDDGSPCCDYVGQDGAGHFVKMVHNGIEYGDMQLICEAYQVMKELLGLSADEMHQVFAEWNNTELDSYLVEITRDILAYKDEDGAPLVDKILDTAGQKGTGKWTGVSALELGVPLTLIGEAVFARCLSAQKAERVEASQVLNGPAVSFDGDKKQLIEDLRQALLGAKIVSYAQGYVLMREAAKEYNWDLNYGGIALMWRGGCIIRSAFLGDIKAAYDANPELTNLMVAPYFKEKLEAAQAGWRRVVAAAVTNGVPAPALTSALSYFDGYRSARLPANLLQAQRDYFGAHTYERTDRERGEFFHTNWTGRGGDTASTTYNV

SEQ ID NO: 63432 - protein, 671 aa, Methanosarcina barkeri str. Fusaro
MEGLIFIAPSAGIISLAFATFFANNVLKEHTGSKRMQEIAGAIQEGSVAYLSRQYRTIAMVSTMLMVLILFLFDDGLKVAVSFLAGAISSTAAGYIGMSVSVRANVRTAYAASSGIEKALSVAFRGGAITGLAVVGLALLGTSGFYILYGDVNLVVGFGFGASLISLFARVGGGIFTKAADVGADLVGKIEVGVPEDDPRNPAVIADNVGDNVGDCVGMGADLFETYVVTSLAAMLLGSLIVNVYENAILYPLVLGSTAIFASIISMFFVKLGREGNVMKALYKGVAGSVIISLVSFYFVTNSLMGNPGLYYAAFIGIIIMVLMVVITEYYTSTRYRPVKSIASFSETGAATNIISGLSIGFESTLLPTVVIVVGILASYFIVGGTTNPEIGLYGIAISAVAMLSTTGMVVALDSYGPITDNAGGIVQMAKLPAHIRKVTDALDAVGNTTKAVTKGYAIGSAALGALALFADYRNKVNLGGQSLNLDDPVVLAGLLLGALLPFIFSAVTMRSVGRAAFEIVNEVRRQFREVPGIMDGTARPDYGRCVDIATKAALQKMTLPGFLAILAPLLVGFLLGPKALAGLLIGLIVVGFMVALLMDNGGGAWDNAKKLIEDGAHGGKGSEAHKAAIVGDTVGDPFKDTAGPALNALIKVVNMVAILFSSLIMGKGLF

SEQ ID NO: 63433 - protein, 829 aa, Methanosarcina barkeri str. Fusaro
MEIITRSKVVKATLQSLFCLTIMSLTSAIAAASEANLKIPNLSQEQNNLLLWGIVVCVLGMLFGLYQFMKVKKIRAHKSMLDVADTIYETCKTYLIQQGKLLCILFVFIGLCIAFYFGFLQKMPLSGVLLIMAWTILGILGSYTVAWYGIRMNTLANSRTAFVSLEKKPLKLLNIALDAGMSIGVLLVCVELIMMLIILLFVPRELAGASFIGFAIGESLGASALRIAGGIFTKIADIGSDLMKIVFGIKEDDPRNPGVIADCTGDNAGDSVGPTADGFETYGVTGVALVSFIVLAVQPDLTGILLTWIFVMRILMIITSVASFYINKAISQARLSGKDDFDFEQPLTSLIWITSIFSIIGTFAVSYYLLGPKSGVPVELEHLWLVLSIIISCGTLGAALIPEFTKVFTSPNSKHVAEVVKASREGGPSLNILSGLVAGNFSSFWIGMVFFLLMFVAYYASGYGLSEIMIYPSIFSFGLVAFGMLGMGPVTIAVDSYGPVTDNAQSIYELSLIETIPKIKEQIQKEFNFKPDFDKAKHYLEANDGAGNTFKATAKPVLIGTAVVGATTMIFSLILVIKDVLGVQPEEILTLLNPYTIFGLLAGGCVIYWFTGASIQSVTTGAYRAVEYIKRNIQLDENASQKASTEKSKEVVKICTQYAQQGMFNIFIAIFSFTLAFSCLSAPISRNDSVSLFVSYLISIAVFGLFQAVFMANAGGCWDNSKKVVEVDLQEKGTDLHEATVVGDTVGDPFKDTSSVALNPIIKFTTLFGLLAMEIAISESFRNIAPYVGGVFLLVALFFVWRSFYGMRIPLRNENPNMEKMKEPVADQE

SEQ ID NO: 63434 - protein, 482 aa, Physcomitrella patens subsp. patens
MEVDVEKKKKKKKRNKKSKKKQKSEVGSVAKTSAVAAEVVANEKLSVVVTGSGSDNPKFKKQENFKLEGVPPTVLQCCQGFEKPSPIQGHAWPFLLAGRDLIGIAATGSGKTLAFGIPAMKHVLDKITKTKGKKAAPVCLVLAPTRELAQQIADVLEESGSACGVGVVCVYGGTPKGPQRSALKAGARVVVATPGRLQDLMEEGVCSLDQVTYVVLDEADRMLDLGFEPAIRAILSTCCQVRQTVMFSATWPMAVSKLAMEFMNEKDPVKVMVGSQDLAANHDVTQIVEVIEDRARDARLETLLQKYHKSRTNRVLVFVLYKKEAVRVETALQRRGWKVSAVHGDKGQSDRTRAVNSFKDGTRPLLIATDVAARGLDIPDVEYVINYSFPLTTEDYVHRIGRTGRAGKKGLSHTFFTQADRARAGELVNVLREAGQTVPEELLKFGTHVKKKESKLYGAHFKEIGADSGKAKKITFGDSDDE

SEQ ID NO: 63435 - protein, 220 aa, Oryza sativa
RKAGSPRSRRSTSTPSPSRSTRSWRPSWPGLKDEVMKITPVQKQTRAGQRTRFKAFVVVGDNNGHVGLGVKCAKEVATAIRGAIILAKLSVVPVRRGYWGNKIGQPHTVPCKVTGKCGSVTVRMVPAPRGSGIVAARVPKKVLQFAGIEDVFTSSRGSTKTLGNFVKATFDCLMKTYGFLTPDFWRDTKFVKSPFQEYTDLLAKPTKALMIDAPVENVEA

SEQ ID NO: 63436 - protein, 330 aa, Physcomitrella patens subsp. patens
MEEKRGVALELNDTVIKRMCVGAAFKDYGGRVNSLDFHRADDLLVTASDDESIRLYDTANATLLKTIHSKKYGVDQICFTHHTSSVFAIMILSGYFAESLRYLSLFDNRYLRYFKGHRDRVVSLCMSPKNDCFMSGALDHTVRLWDLRTNVCQGLLRVRGRPAVAYDQQGLVFSVAMENGAIKLFDVRSYDKGPFDTFLVGGDTVEVSGMKFSYDGKLMLLSTSNGHIYVLDAYTGRKVHAFTVEPNPDGAVLEASFSPDSQFVIAGSGDGSLRAWNTVSGAEVACWTNNAGVPACVKWAPRRFMFATASVALSFWVPDLSKLQKADNGS

SEQ ID NO: 63437 - protein, 1042 aa, Oryza sativa Indica Group
MAGSFDGRMPTRGVEQAIVALKKGAHLLKFGKRGKPKFCPFRLSSDEKTLVWYSKDREKHLSLNSVSTVVLGQKTICRDRDQAECWFLGLTALTSSPYSPLPLAGSKSGRQINSCAISPRSYLQRKCRLSAALDTPRHTQVYPSYGSPKIIQKKIFGGNLDSSEALFYPRHPTFCDIDSYIEKLNPKIATPVKHGLKDIMVANRRAQNITHTPKLKTFEGPRVACRLDSLKDVFLWGSVLGSMLGSEDIPKSLPRLVGSAKMLDVQSIACGENHAAIITKQGEVYTWGSYSSGRLDQKVNVNASCPKMVESLASVHVKAVAFGSKHTCAITVSGELFEWGEGAHSLGLMNDWYGRNQWFPHKFLGPMDNISVSKIACGEWHTAIITSSGQLFTYGDGTFGVLGHGDTQGVARPKEVESLKGSRVKSVACGPWHTAAIVEVMSSFKGNAPSGKLFTWGDADRGKLGHADRKMKLLPTCVDSLTAYDLIQVSCGTAVTVVLTVTGMVFTIGSSRHGQLGNPKADGESICSVEGPLKTEFVREISSGSSHVAVLTMSGKVFTWGKGAEGQLGLGDYSNRSSPTLVEALEGRDVESVVCGFNFTAAICLHKTMSMKDQSVCSSCQMVFGFTRKKHNCYNCGSMFCSSCTSNKITMAALAPDTNRRYRVCDACFYQLQKVVDSSKDKSRLKISKGEMFKLELKAYTPKLSRLFKEANFFAEKMASVQGTNQRNEEPATAVQTKTERWGQVECPALFISAQDSFQTQPVSNSEGCAISFSQRMHDSAVLKSGVSLRFTDAQREEIEMMQTELQGQVKQLHSQVAVLTEQCQQKSVMVQLYKQKLDDTWLVVRDEAARCKAAKDIIKVLTDQCNALSEKLSIGQLSENSKITPNSIPMQPTKIELQGNTGRNLVTRKLGQLNNTQNHGSSIQTEKECVPLSNAVVPEDVPFSQQNGARKFSSDGYTTEAPLAAPPTDSVTEQIEHGVYVTFSTSSCGKKDIKRIRFSRKHFGEKEAQHWWEHNKTRVYDNYKVEQMATPSVTLSCSSTR

SEQ ID NO: 63438 - protein, 487 aa, Marinobacter sp. ELB17
MVLTLKDAALLRQQAFINGEWCAAANGRSYTVTNPSTGDRVGDVPDMGAVETTRAIDAAAAAQPAWSALTAKARAKALRKWFELILAHQEDLAQLMTSEQGKPLAEARGEVAYGASFIEWFAEEAKRVYGDVIPSHGPDKRIIVLKQPIGVVAAITPWNFPIAMITRKVAPALAAGCTVVVKPGEDTPLSALALAELASRAGLPAGTFNVVTSQDAATVGQTLCNDSRVRKLSFTGSTPVGKLLMRQCADTVKKISLELGGNAPFIVFDDADLDAAVAGLMASKFRNAGQTCVCTNRILVQDSVYDTFVEKLASAVAQLKVGDGLTEGVTIGPLINAKAVAKVKGLVAEAVEQGAILHQADNAEGLGENFYAPVILTQVTTAMSIANAEIFGPVATVFRFSNEAEAVQTANDTPFGLAAYFYARDIGRIWRVAEALEYGMVGINEGIISTEVAPFGGVKESGIGREGSKYGIDDYVEIKYLCMGGLG

SEQ ID NO: 63439 - protein, 537 aa, Pseudomonas putida GB-1
MSGKFKKQLSLLDLTFIGLGAIFGSGWLFAASHVSAIAGPAGILSWFLGGFAVLLLGIVYCELGAALPRAGGVVRYPVYSHGPLLGYLMGFITLIAFSSLIAIEVVASRQYAAAWFPGLTKAGSSDPTVLGWLVQFALLGLFFFLNYRSVKTFAKANNLVSVFKFIVPLLVIGVLFTFFKPENFEAQGFAPFGLSGVEMAVSAGGIIFAYLGLTPIISVASEVKNPQRTIPIALILSVLLSTAIYALLQLAFLGSVPTEMLANGWASVTKELALPYRDIALALGVGWLAYLVVADAVISPSGCGNIYMNATPRVIYGWAQTGTFFKYFTRIDAESGIPRPALWLTFGLSVFWTLPFPSWEALINVVSAALVLSYAVAPVTVAALRRNAPDMPRPFRVKGMGVLGPLSFIIAALIVYWSGWNTVSWLLALQIVMFVLYLLCGRFVPTQHLSLAQQVRSSAWLIGFYAVTILLSWLGSFGGLGVLAHPFDTLAVAACALGIYYWGAVTGVPAHLVRLEGEDESEASAETYPSRPAAVAS

SEQ ID NO: 63440 - protein, 122 aa, Desulfovibrio vulgaris subsp. vulgaris str. Hildenborough
MSKHILIVDDSKTVRNLVAFIMKKEGFKVTTAEDGLDGLEKLYSSEGVDLIISDVNMPRMDGFTFIKTVREQDTYRNLPIVVLSTEGQEKDIQMGMSLGANLYMVKPAQPEKMVKNIKMLLG

SEQ ID NO: 63441 - protein, 574 aa, Physcomitrella patens subsp. patens
MSGIVRQALRASKCRGYQHIGSQLLNGSKVCSRNAALFRSAVVGAARPDAVIASSRVPWDYSSFSTSAVKAVKETPALKAKNYVGGKFVESQSTEHIDVLNPATQEVVSRVPLTTHEEFETAVAVAKEAYKTWRKTPVTARQRVMLKLQELIRRDMDKLAMSVTLEQGKTLADARGDVFRGLEVVEQACGMANQQMGEFVENVSSGIDTYSIRQPLGVCAGICPFNFPAMIPLWMFPMAVTTGNTFVLKPSEKDPGAAMLLAELATEAGLPPGVLNIVHGTYDVVNQICDHPDIKAVSFVGSDVAGMHIYSRASATGKRVQCNMGAKNHAVIMPDADPEATLNALVGAAFGAAGQRCMAISTAVFVGDSKRWEEGLRERGVKLKVTGGTEPGADLGPVISKQSKERICRLVESGAKAGARIVLDGRGIKVPGYEQGNFVGPTILADVTEDMECYKEEIFGPVLLCMEAASLQDAIEIVNRNKYGNGTAIFTKSGAAARAFQHEVDAGQVGINVPIPVPLPFFSFTGSRGSFAGDLNFYGKAGVHFFTQIKTVTSQWKEKDLHGVAMAFPTSGKV

SEQ ID NO: 63442 - protein, 500 aa, Zea mays
MATNGSSVRVRDTESSLEKVKRQLSSGSGRYLLQGPLLKRSETLRKWNERWVILDPTSGKMEYKLRRNETVIKGTILFDASSTITLSPVNFQGMPKYDGCCFYIGTPQKKEYFLCAETPGAAKAWVSTLHATQLVLRAHKEAVNSLAGNGSPATLGTVATAVANANATAMEATKEIEAALKVSMRAALGLGTNNSNDGQLDDLTIMKETLRVKDEELQHLAKDIRSRDATINEIADKLTETAEAAEAAASAALTMDEQRRLLCLEIERLKQALERQVEQSMLKLRQSEEKVISLSKEKEQLMKERDAAFQEAHMWRVELGKAREQAVIQEATIARTEEKARVSEADAAARIKEAAEKLRTVEKEKEELLALVGVLQSQVQREQSSTKQVCGERSESCSGADSPPPLTKHVDASDDDVDKACVSDSRSVLVSSDSTEVQLAVDGVDIRPVGDAEWGGFQQSDALIADVREVSPEADGGSLDIPVVNPPPVSDHVQGGATHP

SEQ ID NO: 63443 - protein, 449 aa, Helicobacter pylori J99
MELETHLSKYFTLAFTHKSMSLEMREKLAINSPIMLKELLQTIKTHCPNIKECMVLSTCNRFEIYASLKHGANTHEQKSALLKILAQNKKMSVSDLEKCVLINTDESAVHHVFSVCSSLDSLVVGETQITGQMKNAYKFAFEEKFCSKDLTRLLHFAFKCAAKVRNLTGISKQGVSISSVAVKEALSIFEKERIKDKKALVIGLGEMAQLVIKHLLNKQFEVLILGRNAAKFEDFVKELEEPKKVGFQNVENLNAYINEYELLFCATSSPNFIVRNSMLKETIFRRFWFDLAVPRNIEKPTLNHIFLYSVDDLEPMVKENVGNRQESRTKAYEIVGLATMEFYQWIQSLEVEPLIKDLRELARISAQKELQKALKKRYVPKEYEGNIEKILHNAFNTFLHHPTIALKKNAQKEESDVLVGAIKNLFNLDKSNANHAQNLNLYKCEYYEE

SEQ ID NO: 63444 - protein, 443 aa, Azoarcus sp. EbN1
MHAPSLLERSLRSVWHPCTQMKQHEALPLVPIVRGEGPWLIDAEGRRLLDGISSWWVNLFGHCNPRINAALRAQLDTLEHVMLAGFTHEPVVELSERLAALTGHRLGHAFYASDGASATEIALKMSAHYWRNLGLAEKSRFVSLAGSYHGETVGALAVTDVAIFRDAYAPLVRAGTTVPTPDARLALPGESAADVARRAAAALEAHLAEHHAQTAALIVEPLVQGASGMVMYDPEYLRLARALCDRYRVHLIADEIAVGCGRTGTFFACEQAGIWPDFLCLSKGISGGYLPLSLVLATNTVYAAFYADSATRAFLHSHSYTGNPLACRAALATLDIFEQDGVLAANRVLARQLGDAVRARFGAHPAVRQLRQRGMILAFDVATERPDFARNFFRAGLDHGVLLRPIGNTVYFMPPYILDAAHVAHLVDGAAAALAEALEPAPG

SEQ ID NO: 63445 - protein, 321 aa, Alkalilimnicola ehrlichei MLHE-1
MGLLVDGVWQEDWYDTERTGGRFERPETRFRDWVTADGRSGFPAEPGRYHLHVSLACPWAHRTLILRHLKGLEDVIDVSVVDPYMGEGGWHFSNYPGASEDRVNGCRYLHQVYLKARPDYTGRVTVPTLWDKVAGTIVNNESAEIVRMLNSAFDAFGRADRDFYPAALREQIDRVNAFVYDRINNGVYKAGFATRQDAYEEAVGALFAALDELEERLSRQPYLAGDRVTEADWRLFTTLVRFDPVYVGHFKCNVRRLVDYPNLWAYTRQLYQVERVAETVNLDHIKRHYFTSHPMINPTRIIPAGPAVDYSIPHDRGPVPL

SEQ ID NO: 63446 - protein, 467 aa, Xanthomonas oryzae pv. oryzae KACC10331
MSDVLPIILSGGSGTRLWPLSRESYPKQFLPLVGDKSMLQSTWLRAAPVAAHAPILVANEEHRFMAAEQLQQLGVKPSAILLEPKGRNTAPAIAVAALEATRDGADPLLLVMPSDHVIQNEAAFQAAVTAAAAAAEQGKLVTFGIKPTAPETGYGYIKAGTGNGVSAVERFVEKPDLATAQSYLASGEYYWNSGMFLFRASRYLEELRKFHPAIVDACQKAWENGKRDADFTRLDKDAFAASPSDSIDYAVMEKTADAVVVPLDAGWNDVGSWSSLLDVSKQDAQGNAHHGDVIQLDCKNTYAYGSRLIAMVGLEDVVVVETPDAVLVGHRDRIQVVKDVVSQIKTAGRSEATWHRKVYRPWGAYDSIDMGQRHQVKRITVKPGAVLSLQMHHHRAEHWIVVSGTAEVTRGEEVLLLTENQSTYIPLGVTHRLRNPGKLPLELIEVQSGSYLGEDDIVRFEDTYGRA

SEQ ID NO: 63447 - protein, 316 aa, Actinobacillus pleuropneumoniae serovar 1 str. 4074
MPDIKLFAGNATPELAKRIAERLYTSLGDATVGRFSDGEIQVQINENVRGGDIFIVQSTCAPTNDNLMELIVMVDALRRASAGRITAVIPYFGYARQDRRVRSARVPITAKVVADFLSSVGVDRVLTCDLHAEQIQGFFDVPVDNVFGSPVLIDDILKKSDLVNPIVVSPDIGGVVRARAVAKLLNDTDMAIIDKRRPKANVSQVMHIIGDVTDRDCILVDDMIDTGGTLVKAAEALKERGARRVFAYATHAVFSGTAASNLANPALDEVVVTDTIPLSDEIKALNKVRVLTLSSMLAEAIRRISNEESISAMFDA

SEQ ID NO: 63448 - protein, 382 aa, Caulobacter crescentus CB15
MTFSVVIVAAGSGTRAGPGQAKQWRVLAGRPVLRWSVEAFLAAGAAEVVVVTTADGEAFLPRMLEGLQGWRSTLGGATRALSVQAGLAALSERPGAEPVMIHDAARPFVSRNVILALLGALSDADLALPALAVADTLKRQPTGEAAQTVSREHLWRAQTPQAARRDTLIAAYAAWTHGEPTDDAQVVEAAGGRIALTAGDPLLTKLTYPEDFAMAEHLAGVARVTRVGQGFDAHRWGPGEEVWLCGVAIKHDETLVGHSDADAGLHALTDAILGAIGEGDIGDHFPPTDPKWKGAASDQFLKHAVDLVTAKGGALVNVDVTLICERPKIKPHRQAMRERLAEILSIPVDRVSVKATTTEKMGFTGRGEGLAASAVVAVETPA

SEQ ID NO: 63449 - protein, 301 aa, Bartonella quintana str. Toulouse
MYEFTTLLAKHAHSVERRLDTLLSDQVQNGEISRPEALIKAMRYGVLNGGKRLRPFLVIQSGALFDIPAEYCLDVASALECVHCYSLIHDDLPAMDNDTLRRGQPTVHIAFDEATAILAGNALLTFAFEIIAHKASTLPFETKIKLITTLAQSAGLGGMIGGQMLDLEAEKKPQDSAISILTLQHMKTAALISFACQAGAIIGNASKELTEKLAAFGTYLGLAFQLTDDLLDITASTEILGKTAGKDETAQKATFVRLYGIQETQKKRDGLIAKAEALLLPFGTKAKPLQQAAHFSATRKN

SEQ ID NO: 63450 - protein, 244 aa, Prochlorococcus marinus str. MIT 9301
MLKTFKSDIEIIRERDPAARGIIEIFLCYPGFQSIVIHRFTHKLWQLNIPLVPRLMSHLNRLVTGIEIHPGAKIGKRVFIDHGMGVVIGETAEVGNNCLLYQGVTLGGTGKSHGKRHPTLKENVVVGAGAKILGSITVGSNTRIGAGSVVVRNVEGNSTVVGVPGRVVHQSGVKVNPLAHSALPDAEANVIKNLMDRIDSLENEILKLQKTLQCLANSESIDISKLGDSQNLKDKEIFEFLGDD

SEQ ID NO: 63451 - protein, 435 aa, Listeria monocytogenes str. 4b F2365
MFILTMGLNHHTAPIDIREKLVFKESEEEMALVTLQQEKSILENVIISTCNRTEIVAVVDQIHTGRYYLKRFMANWFQMDMEKIEPYLFFHEETDAVNHLYKVTAGLDSLVLGETQILGQVKHAFEIAKQTATTGTLLNKLFREVVTFAKKVHHHTKINENAVSVSYAAVEVAKKLYGSLDNKKIVLVGAGEMSELALQNLAGSGIADITIINRTKSNAELLANQFQAKVGAYENMNEHLMLADIVLVSTSAAEPIIKQAAMQDLMEQKASSMLVIDIGLPRNVEHDCSYIPNFHLYDIDDLAGVVSANSLERQRIVLELENTIEAEVRNFFEWEKQLGVVPVIRALREKALDMQEVTMTSLENKLPGLTEREYIQIGKHMKSIINQMLKQPISELKEMSVEEDATTSIEHFKRIFGLSETDVTVIEKEQAETRS

SEQ ID NO: 63452 - protein, 493 aa, Frankia sp. EAN1pec
MKTIGHWINGKSAPSASGRVGRVFDPARAVQTGQVTLASTAEVDDVVRVARDAAVSWGASSLSNRSTLLFRLRELLDASRDELAAAVAAEHGKVHSDALGEVARGIECVEFACGIPHLLKGSHSSEVSRGVDVHTELHPVGVVAGITPFNFPVMVPLWMLANAVATGNTFILKPSEKDPSASLILADLVTRAGFPDGVFNVLQGDAEAVRALLTHPGVDAVSFVGSTPVARSIYETGTAAGKRVQALGGAKNHMVVLPDADIESAANAAISAGYGSAGERCMAISVVVAVGAVADPLVDAIAARIPDVVVGPASDESSQMGPLITAEHRDRVRSYVQGATDEGARVVVDGSAGRDEGYFVGCSLLDGVKPGMRVYDDEIFGPVLSVVRVDSYDEAIELINSNQYGNGVALFTQDGGAARRFTRQVDVGMIGINVPIPVPVAWHSFGGWKASIFGDAPIYGPEGIRFYTRPKVVTSRWPESTPTAVDLVFPANR

SEQ ID NO: 63453 - protein, 517 aa, Bacteroides thetaiotaomicron VPI-5482
MSNQLEKIKELIERRAVARIGGGEKAIAKQHEKGKYTARERIAMLLDEGSFEEMDMFVEHRCTNFGMEKKHYPGDGVVTGCGTIEGRLVYLFAQDFTVTAGSLSETMSLKICKIMDQAMKMGAPCIGINDSGGARIQEGINALAGYAEIFQRNILASGVIPQISGIFGPCAGGAVYSPALTDFTLMMEGTSYMFLTGPKVVKTVTGEDVSQENLGGASVHSTKSGVTHFTAKTEEEGLALIRTLLSYIPQNNLEEAPYVDCTDPIDRLEDSLNDIIPDSPNKPYDMYEVISAIVDNGEFLEIQKDYAKNIIIGFARFNGQSVGIVANQPKFLAGVLDSNASRKGARFVRFCDAFNIPIVSLVDVPGFLPGTGQEYNGVILHGAKLLYAYGEATVPKVTITLRKSYGGSHIVMSCKQLRGDMNYAWPTAEIAVMGGAGAVEVLYAREAKDQENPAQFLAEKEAEYTKLFANPYNAAKYGYIDDVIEPRNTRFRVIRALQQLQTKKLSNPAKKHGNIPL

SEQ ID NO: 63454 - protein, 194 aa, Listeria monocytogenes str. 4b F2365
MDVNNVELIISAVRPEQYPETDLPEYALAGRSNVGKSSFINTMIRRKSMARISQKPGKTQTLNFYKIEEALFFVDVPGYGFAKVSKTEREKWGVMIETYITSREQLRGVIQIVDLRHKPTEDDRMMYEFLKYYDIPVIVVATKADKIPRSKWQKNAKIVRETLDFDPDDKFVLFSSETKMGKDEAWQFIKEGME

SEQ ID NO: 63455 - protein, 110 aa, Aegiceras corniculatum
HLFPKNPDLVIVCNKTSSIYLMTLQGQVVKSFSSGKREGGDFVAACLSPKGEWIYCVGEDRNLYCFSHQSGKLEHLMKVHEKDVTSITHHPHRNLVATCGHDCTMKLWKP

SEQ ID NO: 63456 - protein, 607 aa, Zea mays
MNSHKFLLAVLLLLLLNYASYAATSKEDDDFLKSCPSHRCHKHGPEIRFPFRLPSHPPSCGTPGMQLSCSGHDTILDHPVLGSCRVTAIYYRHRVMNVIPPEDSSSHCQLQKLVKRNQSTDVYTPVVNPVSVLVGCSREATNQDGIVGPSSCLSLINNASQLWYLVDPSTDMSTLPMGCEVVAKGIPVPYTYDKNGPNYNTFSGRSLFNEKANRTINFGETSFNWNLNNITGSCQTCEQEGKHCGFSSNRRQAFCLHHGSHVILIAATTSVATFVVLVVTALYLSLKKRYNEAIHLKVEMFLKTYGTSKPTRYTFSEVKKIARRFKEKVGQGGFGTVYKGQLPNGVPVAVKMLENSTGEGEDFINEVATIGQIHHANIVRLLGFCSEGTRRALIYEFMPNESLGRYIFLPQELLVPEKMLDIATGIARGMEYLHQGCNQRILHFDIKPHNILLDYSFNPKISDFGLAKLCARDQSIVTLTAARGTMGYIAPEIYSPNFGGVSYKSDVYSFGMLVLEMVSGRRNSDPGIENQNGVYLPEWVYERVVTGQDLTLSKKIADQEKETVRQLAIVALWCIQWNPKNRPSMTKVVNMLTGRLQNLPIPPKPYA

SEQ ID NO: 63457 - protein, 530 aa, Zea mays
MQDWRVREFEGKFTDEFAHSSSNEHKGGVEASGVISSKKLKHAVANEKIQGVIPGTNSSGSLKRNSENIQHANGVLSQNISCAGDYKNGSIAFPLREENTITETRCPDDNWNSCQFALNNGSSILNNHSAPQDSLTYGDNDLNYIEWPGIDNFEDVDTLFRSFDSTYGQQQLENADGLSWIPSSDAVYSTDVALQQGLDSSYSDYGILDDLSAFQCAEDKSLPLVDPSSALCDNQFNDTYLFSEQKNVNAYGEQIYQEDLMELLPTDQICSGHENIDMVGNQYPSENAIQGTEDKKFSIASTSQLSSQNLLNQRHHLDSSSPSNITSESYPGKFGPSSCSSAQRNSKVQKKTVNIQPRQPANDNVMNTSRASYPCENYETERRGLGKRTLGDPQVTMGSSMVVDGSFVSSMSSDNSVEESSFQQLQDAVSQLDVQTKLCIRDGLYRLARSAQHRQVFPNTMNSNGGSEDGKELENAETSCKFMDPRSIETQTNPIDRSIALLLFRESSGGHVHVAVAADDASSLKSPAGV

SEQ ID NO: 63458 - protein, 266 aa, Oryza sativa Japonica Group
MAMTGYKYQAQELMRDYLLADPLVPYTSVLVGIALCKMAYDLTRVLSSFYFKGYSSLTKIQRVEWNNRGMSSAHAIFITAISLYLVMSTDLFSDRLKGPITFRNSIISTFALGVSVGYFIADLAMIFWLYPSLGGMEYIVHHTLSLVAIAYTMLSGEGQFYTYMVLISETTTPEINLRWFLDTAGLKKSSAYLVNGILMFVAWLVARILLFIYVFYHIYLHYSQVMQMHAFGYYLTFIVPSVLFVMNTMWFMKILKGVKKTLGKWS

SEQ ID NO: 63459 - protein, 180 aa, Bradyrhizobium sp. BTAi1
MNQPASAYFLEDRHDPNETHTLSVLVQNEPGVLARVIGLFSGRGYNIESLTVSETESQKHLSRITIVTTGTPMVIQQIKHQLDRMVPVYRVVDMTLTKRAIERELAMIKVRGTGEPRVEALRLADAFRARVIDATTESFVFEITGNTDKISQFIDLMRPLGLVEVARTGIAAIGRGPEGM

SEQ ID NO: 63460 - protein, 714 aa, Arabidopsis thaliana
MMSIPMELMSIRNPNSTLLYRAHSRPPVKLCAPPRSLLPSRRHFSAPRAVVSYPGIRFGFTSPEVLLNRSVVAFAASHEDSGESGVEVGKEKSDIDVEDDTSKEAWKQTLESFKEQVSKMQSVSSEAYSVNSQKAMTVLKETSEQLRIQAEKAKEELGTKAKVVSEEGREYILKAAEESPSDVKEIVEAFASTEDLKNVSRANDFHVGIPYGLLLLVGGFINFMVSGSIPAIRFGVILGGALFALSLASLKSHRKGESSTKFLKGQMAIVAIIFLRELRLLLSQKSTFLGFFTTLTSGGVLGFYLYKMVVKREKGPTLEDGGEDESSDGFLGIVGTMESDLIDLFEGAKKAADAAALDGVTSSGPEVSQCIDALKQLKKFPVTYDTLVATQVGKKLRSLAKHPVEDIKSVATDLLEIWKKVVIEETAKAKKTEGTNGCKEAKVNKMDVEKPSNPAPVKVQKLQRGDSAKSIKVERKEPDNKVVTGVKIERKVPDIKVTNGTKIDYRGQAVKDEKVSKDNQSSMKAPAKAANAPPKLTAMLKCNDPVRDKIRELLVEALCRVAGEADDYERESVNASDPLRVAVSVESLMFEKLGRSTGAQKLKYRSIMFNLRDSNNPDLRRRVLTGEISPEKLITLSAEDMASDKRKQENNQIKEKALFDCERGLAAKASTDQFKCGRCGQRKCTYYQMQTRSADEPMTTYVTCVNCDNHWKFC

SEQ ID NO: 63461 - protein, 511 aa, Mycoplasma penetrans HF-2
MSLLKISNLNYSIGEKTLYNDCSFVLNPKEHLGIVGKNGAGKSTLIKIINNKVSPDTIEMDWMQNIKIGHLDQYAEVPKEISVLDYLKTAFTYLYEIEAKMIELYEKSVEDPNLFDKAVEYQNILEHKDFYNLDVLIEKVSSGLGVIAIGLDKKISELSGGQRAKVILAKLLLEKPDVLLLDEPTNFLDKEHVDWLTEYLVNFDKTFVVISHNENFLSKITTHILEISNHKFTKFTGNYDSYLKQKELMVDDYAKRYEKQQKQIEKTEDFIRRNIAGSNSKNARGRRKQLERMEKMPPPSKERPKPDFSFKQLHCSMQQKLIIKDLSIGYNNQPLIKNINLTINGEERVIIKGFNGIGKTTLLKTLLNKIKPIEGSFEFSDTIKPIYYEQDLNWENGSLTPIDVIRQTYPNLNEREVRNLLAKNGLSNKDVMQPISTLSGGEQAKVKLAILSLKPTNFLILDEPTNHLDVQAKEVLKNTLLNLQITILLVCHEESFYKDIANKVIDISKLA

SEQ ID NO: 63462 - protein, 334 aa, Prochlorococcus marinus str. MIT 9215
MNFIQPNSIKNIHKLSIAPMMDCTDKHFRMIMRKITSKALLYTEMIVAQSLVYTKKKEKFLDFNSEEHPISIQFGGDDPKILKEAARMAQDWGYDEINFNVGCPSPKVCSGNFGASLMKDPEKVAKCMESLKNNSSLPVTIKHRIGLDNDDSFVTLNNFVRVIANAGADRFTVHARKAILKGLNPKQNRTIPPLNYDIVKKLKKSNPELLIEINGGLANINESLKALNDFDGVMIGRSVYQHPLRWSEIDQKIYGINTRPKSASDIIFSLIPYIEAHLSKGGKSWDICKHLINLVEGIPKAKIWRNQISKKSIKKELSIEYLFKLTTELKEMGF

SEQ ID NO: 63463 - protein, 164 aa, Prochlorococcus marinus str. MIT 9215
MNKFLSRRTFILIPTMSILKIIFKPMQVLASSIVSKEEWKFSKDEWKAKLSPESYYILREEGTERAFSSQLNNEKRKGIFHCLGCNLPLFSSDKKYDSGTGWPSFWDSIQGSVETKVDFKLIVPRTEYHCSRCGGHQGHVFNDGPLPTGKRYCNNGLALRFVPE

SEQ ID NO: 63464 - protein, 316 aa, Photobacterium profundum SS9
MDNKMNKITKAVIPVAGLGTRMLPATKAIPKEMLPIVDKPLIQYIVNECVAAGIKEIVLVTHSSKNAIENHFDTSYELEATLEKRVKRQLLDAVQSICPKDVTIMHVRQGHAKGLGHAVLCAKPLIGDAPFVVVLPDVILDEYTADQSRENLAAMLARYESTQASQIMVEPVPMHDVSKYGVVDCNGAALKGGESHPMTAMVEKPAMEEAPSNLAVVGRYVLSAKIWEKLAKTPPGAGDEIQLTDAIDMLMADETVEAFHMTGKSHDCGDKLGYLKAFVEYGIRHESLGDDFKDYLVSSLLVSSAEVASIEVASVE

SEQ ID NO: 63465 - protein, 388 aa, Photobacterium profundum SS9
MKIAIAGTGYVGLSNAMLLAQHNDVIAVDIIEEKVKLLNDKISPIVDAEITEFLNNDALSFTATLDKELAYKDAEYVIIATPTDYDVETNYFNTSSVEAVIKDVMAINPTAVMVIKSTVPVGYTARIKQELGCDNLMFSPEFLREGRALYDNLHPSRIVVGERSERAKVFANLLVQGAIKQDINVLFTDSTEAEAVKLFSNTYLALRVSYFNELDTYAESHGLNTRQIIEGVSLDPRIGNHYNNPSFGYGGYCLPKDTKQLRANFADVPNNIIGAIVDSNTTRKDFIADSIIKRNPRRVGIYRLVMKSGSDNFRASSIQGIMKRLKAKGIEVVIFEPAMKEKEFFRSLVLTDLDQFKSSCDVIVSNRMAEELADVVDKVYTRDLFGSD

SEQ ID NO: 63466 - protein, 335 aa, Photobacterium profundum SS9
MNFLVTGAAGFIGAAVCKKLILDGCNVIGLDNKCDYYDVNLKEARLSELSQYGDFTFLKEDLCNNDGINSIFLENKFDRVIHLGAQAGVRYSIENPMAYADSNIIGHLNILEACRHHKIEHLVYASSSSVYGLNEKTPFETSDSVDHPVSLYAATKKSNELMSHSYSHLYNIPTTGLRFFTVYGPWGRPDMAPFIFTKKILDGDTIDINNNGEMWRDFTYIDDIVEGVIRIADVIPTRNDEWKVETGTPASSSAPYAVYNIGHGSPINLMEFISEIENTLGIEAKKNYRGMQAGDVYKTYADTSDLFEAIGYTPKVGVKEGVAAFVKWYKEFYNK

SEQ ID NO: 63467 - protein, 158 aa, Prochlorococcus marinus str. MIT 9301
MAIFEGSFTNASTLKVGIVIARFNDLITNKILSGCLDCLKRHGLDTSELSNQVDIVWVPGSFELPIAAKTLMKKKSYDVVIALGAVIRGETSHYDVVISEASKGISQVSNENNIPIIFGVLTTDTMQQALERAGIKNNLGWNYALQAIEMGSLIKNLN

SEQ ID NO: 63468 - protein, 669 aa, Shewanella oneidensis MR-1
MVEKITGMLALIGVLSLFCQWLGWKLRLPAILPLLVCGLLLGPVFGILNPDAIFGDLLFPIISLGVAVILFEGALTLNFKEIKDHGRMVTHLVSIGMLITWGCISTATYYLLDFSWEVALLFGALVVVTGPTVIVPMLRSIRPKSQLASILRWEGIVIDPIGALLAVLVFEYITVSGNQTSHVLYALGSMLTMGLGLGAAAGYLVGQVIRHNLLPHYLRNTAVLTLMLGIFVGSNLLQEESGLLTVTVMGIWLANMRGVDIAEILEFKETLTVLLISALFILLAARLDSNAMMDLGWGGVGVLAVTMLIARPLSIWASGIGTSLSKADKWFLCWIAPRGIVAAAVSSLFAIKLEASNVQGADAIVPLVFLIIIGTVVIQSLTAGRWAKHLGVTSGAAQGLLIFGASKFSRELAKILRAKDVKVLLADSNWDNIRLARMDNIPVYFGNPASEHAETYMDLTGIGRVLIMSPYKQLNPLVTFYFQDVLGSKKVFGLNNAEQGSARHQLSESYKQRLCLFGDAVSYAKIASQMAKGAQLKVTNLTENFTFEHFRKRYGETALPLVYLTKEGKVVIVSGNETQFPNGIELISLLPVEALEEAKIQQMIAEQEAIAAQTKAAEEATLAKAKAEEKAEVERQRLDQQAQMKAKQSQSEHEPQDAIDRSDETLAKG

SEQ ID NO: 63469 - protein, 298 aa, Rhodopseudomonas palustris CGA009
MTDAPVISPLDQARILSEALPHMQRYDEETIVIKYGGHAMGAEDTAKAFARDIVLLEQTAVNPVVVHGGGPQIAQMLKRLGIKSEFAAGLRITDAATIEIVEMVLAGSINKQLVGYINEAGGKAVGLCGKDGNMVSASKATRTMVDPDSRIEEVIDLGFVGEPEKVDLTLLNQLIGHELIPVLAPLATSASGQTFNVNADTFAGAVAGALRAKRLLLLTDVPGVLDQNKKLIPELSIKDARKLIADGTISGGMIPKVETCIYALEQGVEGVVILDGKVPHAVLLELFTNQGTGTLIHK

SEQ ID NO: 63470 - protein, 216 aa, Rhodopseudomonas palustris CGA009
MTDAIDPDLIERGRKMFAGDWHFIWASPSIETLPPMGSVEIAFAGRSNVGKSSLINALTGRNALARTSHTPGRTQELIFFEGPPNAGLRLVDMPGYGYAAASKAKVASWTSLIHHFLQGRATLARVYVLIDGRHGLKDVDLDILKTLDKAAVSYQIVLTKADQVKAAELAERVTATVAALAKHPAAFPEVLTTSSRTGAGMPELRAAMIRLLDERR

SEQ ID NO: 63471 - protein, 586 aa, Prochlorococcus marinus str. MIT 9301
MALLVKKFGGTSVGDIRKIKNIASSICQSKEAGNEIVVVVSAMGQTTDDLNCLAESISKNPNRRELDMLLSTGEQVTIALLSMALNEYGIPAISMTGSQVGIITESIHGKARILDIKTERIQNYINQGFVVVVAGFQGTTLSHTGSMEITTLGRGGSDTSAVALSTALGAETCEIYTDVPGVLTTDPRIVPNAKLLDEISCEEMLELASVGASVLHPRAVEIARNYGIKLCVKSSQSDSSGTLLESQIKALPLKRGSLELTKTVNSLEVLENQAVFSLSNIPDRPGIAAQIFEKLSEASISVDLIIQATNDGNKNDITFTVSELEVKKTAEQCELITSQLGGEYNLKTNMTKLSIQGAGIMGRPSVSADLFDTLSQANINVRLIATSEIKVSCVIEINNIPKAIRFVAEKFKLSDTQIFVNPINKKQDQPEVRGIALDKNQVQVSFRKLPDRPGVAASICLALAENNLLIDTIVQSERISSLKTKDISLTMNKQDREKANLVFEALTKKLPGSYIEDGPAIAKVSTVGAGMAFKVGTAGKIFRALADQKINIEMIATSEIRTSCIVLEKDCDKAVNAIHNHFELDK

SEQ ID NO: 63472 - protein, 416 aa, Brassica napus
  misc_feature (333)..(333): Xaa can be any naturally occurring amino acid
  misc_feature (352)..(352): Xaa can be any naturally occurring amino acid
MSSTHQLTSSMISSSSSTFLAPSLLNLRARNACLPMAKRVNTCKCVATPQEKIEYKTNVSRNQNMSKLQAGYLFPEIARRRSAHLLKYPDAQIISLGIGDTTEPIPEVITSAMAKKAHELSTIEGYSGYGAEQGAKPLRAALAKTYYSGLGIGEDDIFVSDGAKCDISRLQVMFGSNVTVAVQDPSYPAYVDSSVIMGQTGQYNTDVQKYGNIEYMRCTPENGFFPDLSTVGRTDIIFFCSPNNPTGAAATREQLTQLVQFAKKNGSIIVYDSAYAMYMSDDNPRSIFEIPGAEEVAMETASFSKYAGFTGVRLGWTVIPKQLLYSDGFPVAXKDFNRIVCTCFNGASNISXQAGALACLTPEGLEAMQKVVGFYKENTNIIIDTFTSLGYDVYGRKNAPYVWVHFPNQSSWDVFA

SEQ ID NO: 63473 - protein, 289 aa, Bifidobacterium longum DJO10A
MTNGHINPANVPDIALKDGHSIPQVGLGVLRIDDEGVVPVVESALEAGYRHIDGAAGYNNEAGVGRALAASGYNKGTKRETLWVTTKLRDSQQGYDSALKAFDNSLKLLQLDYVDMYMIHWPTPFDWRSTDTWKAFVKLRDEGMARTLGVCNFMPADLKRLHEETGAWPAVNQIELHPTWQQREVVAFCKEHGIAVEAYSPMARGADLNAGDGTIEKIAAAHEVSPAQVILRWHIENGTIIIPKSVHADRQKENLNLFGFALTADEHAAIDALDGPTRAGHDPLTFTYA

SEQ ID NO: 63474 - protein, 129 aa, Triticum aestivum
MAAAALRPAILRHIRLSPATAAPLAAAGRPLALAPWLARPMSSHDAHLTRDEVVGRVLDVLKCHPKVDPSKVTPEAHFEKDLGLDSLDTVEVVMAIEEEFKLEIPDLEADKINSLPLAIEYVANHPMAG

SEQ ID NO: 63475 - protein, 140 aa, Parvularcula bermudensis HTCC2503
MALERTFSIIKPDATRRNLTGQIIAKLEDGGLRVVAQKRIRLSEDQAKSFYAVHKERPFYSDLVSFMTSGPVVVQVLEGENAISRNREIMGATNPSEAAPGTIRAEFAENIEANSVHGSDGPDTAAEEIKFFFTDDEIVG

SEQ ID NO: 63476 - protein, 178 aa, Glycine max
MASSMISSPAVTTVNRAGAGMVAPFTGLKSMAGFPTRKTNNDTISIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGF

SEQ ID NO: 63477 - protein, 229 aa, Bartonella quintana str. Toulouse
MNTQATPYIPSVEAWKNLQKDIIETCQNMNRPLEEVQLIAVSKTVSADHIFPLLQAGQSVFAENRVQEAAEKWPRLRQQFKFIELHLIGPLQSNKTAEAVKIFDVIQTVDREKIAKSLSIEMQKQKRILPCYVQVNIGLELQKSGIPPQEVIPFVAQCKNHYGLDIIGLMAIPPVKENPGPYFALLAKLAKKAGLPKLSMGMSNDFKIALQFGSNTLRIGSALFGKRSM

SEQ ID NO: 63478 - protein, 420 aa, Listeria monocytogenes str. 4b F2365
MSQKIQVENGVLKTPNNPVIPFIEGDGTGPDIWAAAKRVLDAAVKKAYNGEKEIAWKEVLAGEKAFKQTGEWLPQATLDTIDEYLIAIKGPLTTPIGGGIRSLNVALRQELDLYVCLRPVRYFKGVPSPVKRPEDTDMVIFRENTEDIYAGIEFKEGSEESKKLIDFLKSEFGVDKIRFPETSGIGIKPISKEGTERLVRSAIEYAIKEGRKSLTLVHKGNIMKFTEGAFKNWGYDLCEREYGDKVFTWNEYDRIKEAEGTEVADAKQKEALAAGKILVKDSIADIFLQQILTRPAEFDVVATMNLNGDYISDALAAQVGGIGIAPGANINYLTGHAIFEATHGTAPKYAGLDKVNPSSVILSGTLLLEHIGWGEAAALINQSMEKTIAAKTVTYDFARLMDGATEVKCSEFADELIKNF

SEQ ID NO: 63479 - protein, 178 aa, Glycine max
  misc_feature (178)..(178): Xaa can be any naturally occurring amino acid
MASSMISSPAVTTVNRAGAGMVAPFTGLKSMAGFPTRKTNNDITSIASNGGRVQCMQVWPPVGKKKFETLSYLPDLDDAQLAKEVEYLLRKGWIPCLEFELEHGFVYREHNRSPGYYDGRYWTMWKLPMFGCTDASQVLKELQEAKTAYPNGFIRIIGFDNVRQVQCISFIAYKPPGX

SEQ ID NO: 63480 - protein, 328 aa, Physcomitrella patens subsp. patens
MAEYVEVSKNPARKRVIIDTDPGIDDMMAIFMAFEAPGIEVIGLTTIFGNVDIDLATKNALHLCEMTGHPEIPVAEGPSEPLKRVKPRIAYFVHGSDGLGNTFQANPKGQKSSKSAADFLLEKVAEFPGEVTVVALGPLTNIALAIQKDPNFVKNIGQLVVLGGAFNASGNVNPAAEANIFGDPEAADLVFTSGMDTLVIGISLTTQVIFNDQDLSEIRDSGGKYGKYIYDCCRFYHDFHLESDHFDGIFLHDPTCMAALLDPSLFTYRKGAVRVETEGLCVGYTLLDMGLKNWVGKNHWTGVPLIDVGMTVDADGVRSLVKKLLCSP

SEQ ID NO: 63481 - protein, 369 aa, Physcomitrella patens subsp. patens
NVEERKAVRTAWEKLVRWSRSWQLLNERRKNALKKTKKIVVLGGGSFGTAMAVLLARNKADMNVTLLLRDHAICQAINDHHMNLKYFPRHQLPKNVTATTDPREALQDAQYCVHAVPVQSSSEFLRSIAEHVPATLPILSVSKGLELSTLEMMSQVIPRALGNPRQPVAVISGPSFAIELMDELPTAMVAASRDKELARACQQLLASRYLRVNISTDVIGVEMAGALKNVLAIAAGIVEGMNLGNNCMAALVAQGCSEIRWLAEKMGAKSHTLSGLSGSGDIMLTCFVNLSRNRSVGVRLGSGEKLEDILSSMSQVAEGVATAGAVISLAKKYRVQMPVLTAVARILDNELTPKTAVLALMSLPQVEEV

SEQ ID NO: 63482 - protein, 98 aa, Anabaena sp.
ASYQVRLINKKQDIDTTIEIDEETTILDGAEENGIELPFSCHSGSCSSCVGKVVEGEVDQSDQIFLDDEQMGKGFALLCVTYPRSNCTIKTHQEPYLA

SEQ ID NO: 63483 - protein, 265 aa, Arabidopsis thaliana
MAESTRNLTGLGGEAAKEEDDEYMGDLSQFIPQELSQTSKRKESEKKTVIVEPSRKKLKNLNWHERRRLEKERKQIEEDEQTLARIVDTPIGESNIGFKLLKQMGYKPGSALGKQGSGRAEPVTMDIRRSRAGVGREDPHKEKKKKEEIEAENEKRKVDEMLEDFGSRQKSQWRKKRVLINFRKAKAALDQLENVEVVPEKKNEEDEDGKPDEEEEEEEEITEEDLQEILMKLRAEHWYCLFCGFQYETTEALLSNCPGVNEDDH

SEQ ID NO: 63484 - protein, 213 aa, Desulfovibrio vulgaris subsp. vulgaris str. Hildenborough
MRGPIVSLFEDGVSRYLEPSLRDRLRKATVGIAGAGGLGSNCAVLLARSGVGRFVLVDHDVVEPSNLNRQHYLAADVGRPKAEALADVLRAINPAVDLVVHVQQLEDGNIIGIFGGCDVVVEAVDDAATKRMLAETLMGAGRPVVCASGMGGWGGPPMRERHLGESMVVVGDFTNEVGPGLPPLAPRVVMAAAMQADAVLARLLGPCPAMNHR

SEQ ID NO: 63485 - protein, 264 aa, Triticum aestivum
  misc_feature (224)..(224): Xaa can be any naturally occurring amino acid
  misc_feature (244)..(244): Xaa can be any naturally occurring amino acid
HSRTSLYKKAGWYRSGIPGISSTHASDANKNGHDEGYPKGLILSFKLKRILADGDTEQNGGDKVDNSDDAKKEGASDSSEESGKASEEKAPENTDAKEEKSADAEELKGSDAQSVKKDDKSLSENDKEPVSREDFKEYFAKFGTVRYVDFSKGDISGYLRFEESTAAEKARAFAALADEGGLVMKGHLVTLEPVSGQAEKDYWSGIKGGQGRFNNNIRSNRGRXRDWKNNRGGGGRHHGGGKPXGRHSDNHERAYKVQKLDSSP

SEQ ID NO: 63486 - protein, 332 aa, Xylella fastidiosa Ann-1
MIPVINQEKQGISGDFRLSVAPMMNWTDRYCRVFHRVLAPSARLYTEMVHAKAVIYGDRERLLGFASVEQPVALQLGGSEPALLAKAARIAVDWGYSEINLNCGCPSDRVQAGSFGACLMREPALVADCVAAMAAVVSVPVTVKCRLGVNEDDDYGRFAKFVDWVIGASSSRMIVVHARNAWLQGLSPKENREIPPLRYDWVYRLKRECPELAVVLNGGITSVEAGLDHLLMVDGVMLGRAAYQDPYILHQFYCALSNAPLLPRALLLRALRPYVEAWLEQGLTLRHIVRHLLGLFHGQPGGRVFRQVLTQGGQRSDADWSLVEQALSIIEG

SEQ ID NO: 63487 - protein, 340 aa, Prochlorococcus marinus str. MIT 9215
MTLRVAINGFGRIGRNFMRCWLSRGAYTNIEVVGINVTSDPKTNAHLLKYDSVLGKLDGVDIQYTDDSFVINNKTIKCFSDRNPLNLPWKDWGVDLVIESTGVFNTDVGASKHLEVGAKKVILTAPGKGDGVGTYVVGVNADTYKHKDYDILSNASCTTNCLAPVVKILDQTFGINKGLMTTIHSYTGDQRILDNSHRDLRRARAAATNIVPTSTGAAKAVALVYPEMKGKLTGIAMRVPTPNVSAVDFVFESSKSVTTEEVNHALKEASLGSMKGIIKYGDEPLVSSDYAGTDESSIVDSDLTMCIGDNLVKVLAWYDNEWGYSQRVVDLAEVVAKNWE

SEQ ID NO: 63488 - protein, 224 aa, Triticum aestivum
ASLAPDQNPNPRSTYGLAVDWRASPATLLGISSGRGGRGEAMGGAISGGAAATGEYPVVLNVYDLTPLNNYVHWCGLGIFHSAVEVHGSEYSFGAHDLPTSGLFEVEPKSCPGFLYRSSIFIGHTSLHPLEFRDFIQRMASEYHGDTYHLISKNCNHFTDDLSTRLTGKPIPGWVNRLAKLGAFCNCLLPESMRLESTETKNLTDYHFSESSVSENAIVKEVHR

SEQ ID NO: 63489 - protein, 250 aa, Mycoplasma penetrans HF-2
MKKLIIANWKMFKTLNDIKTFKEEFDKNIKNVKVNADYSVGVPSIYLNQAKEILKGIKVIAQDAHFKNEGAYTGNISWSQLKDCGIDGSIIGHSERRQMFNETDETVNLKTISLVENNMQAVVCVGETLEEYEANKSFDVVWNQTKKALANVSEAQLKNVVIAYEPVWAIGTGKVPTGKEVDDLIQKVRDELSKLYSKQAVESLVVLYGGSVNDKNAEEFFKQKNINGALVGSFCLKAENFVKLIELGGN

SEQ ID NO: 63490 - protein, 506 aa, Mycoplasma penetrans HF-2
METKMKKGPVLLAVLDGYGFSKDTKGNAILNAKTPFMDNLVKEYDHCYIEASGEYVGLPDGQIGNSEVGHLTIGAGRIVYTGLSLINQDIKTKKFDSNKTLLEAINHAKKNNSNIHIMGLLSPGGVHSNEQHIFEMIRIVSENGLKPVIHVFGDGRDVAPQSIISSLERLNDVLKKYPGTIATISGRFYSMDRDKRWERTKQAYDNLLGISNNYFDNPIDYVNKQYSENIFDEFLVPARINDSNVVIKDNDAVIHANFRPDRARQISHLFCGSTVYEEKNDHPLKNLYYAIMMTYEGITPTSILFPTVVVKNTFGEVVANSGLTQLRIAETEKYAHVTFFFDGGVEVDLKNESKILVDSKKVKTYDEVPAMSAVEITDKLIENLDKFDVIVLNFANADMVGHTGKYNEAVLAIEALDSQLARIDQKIKELNGTMFITADHGNAEVMLDDDNNPVTKHTTNPVIFISNNKDVKFNKPGSLGNVAPTILDFMGLEIPADMDKKSLLKK

SEQ ID NO: 63491 - protein, 450 aa, Mycoplasma penetrans HF-2 [sequence omitted]

SEQ ID NO: 63492 - protein, 217 aa, Zea mays
MPAMATAPVKFSVATNSPCVQPSLPLRRTPAAISFPCRPWSAAMNSCTGLLRRSDVVAAAGHQKLMGSLTTNEGLRFGVVVARFNEVVTNLLLQGALETFERYSVKEENITVVSVPGSFEVPITAQKLGKSGKFDAILCIGAVIRGDTTHYDAVANSAASGVLNAGLSAGVPCVFGVLTCEDMDQALNRAGGKAGNKGAETALTAIEMASLFRHHLG

SEQ ID NO: 63493 - protein, 292 aa, Prochlorococcus marinus str. MIT 9215
MKSPASTLSNRNKFLILGCGFSGSFFAKTIRQLGCTALTSSRSEKKDPYSFVFNSDSDVVPHKKIFDGVTHILSCIPPDKNGNDPVLKCLKNRLKSLSLEWVGYLSTTGVYGHTKGDWVSEIDEPNPLQKRSHKRLNCEKEWIDSGLPVQIFRLPGIYGPGRSTFEAIKNKKIRVISKKNQVFSRIHVADITNAIIYLLQNKNSLKFYQIINIADDKPCSQIEVIQYCYDLLGLTMPKPILFEDAKEELSPIAQSFWMENRKVSNKLLCQTLGYKLIYKNYKKGLKNCYQNI

SEQ ID NO: 63494 - protein, 171 aa, Zea mays
MEHKETGCQAPEGPILCINNCGFFGSAATMNMCSKCHKEMIMKQEQAKLAASSIDSIVNGNDAVMEPVVAGNTVVAAAPIELQTMNVQPADVAGPSEGAAVISKGKVGPNRCSTCRKRVGLTGFNCRCGNLYCALHRYSDKHDCKFDYRTAARDAIAKANPVVKADKLDKI

SEQ ID NO: 63495 - protein, 456 aa, Glycine max
  misc_feature (46)..(46): Xaa can be any naturally occurring amino acid
  misc_feature (185)..(185): Xaa can be any naturally occurring amino acid
  misc_feature (196)..(196): Xaa can be any naturally occurring amino acid
MEPRVANKFRLGRKIGSGSFGEIYLGTNTQTNEEVAVKLENVKTKXHPQLLDESKLYKILQGGTGIPYVRWFGVEGDYNVLVMDLLGPSLEDLFNFCTRKLSLKTVLMLADQMINRVEFIHSKSFLHRDIKPDNFLMGLGRRANQVYAIDFGLAKKHRDTSTHQHIPYRENKNLTGTARYASMNXHLGIEQSRRDXLESLGLVLMYFLRGSLPWQGLKAGTKKQKYEKISEKKVSTSIESLCRGYPSEFASYFHYCRSLRFDDKPDYAYLKRLFRDLFIREGFQFDYVFDWTILKYQQSQIATPVRVIVPAAGQSSGLPPAVVNADRQTGGVNSRHTGWSSSDPARRRNSRPIANDGMSSRQKAPVPSDSTGSKDVMLSSSNFRSSGSTRRGAVSSSRDAAVGNETEPSHPLTMDASPGALRKISNAQRSSPIMSFEHNRTSSGRNTSNMKNYEST

SEQ ID NO: 63496 - protein, 289 aa, Glycine max
MEGKEEDVSLGANKFSERQPIGTAAQSQDDGKDYTEPPPAPLFEPSELTSWSFYRAGIAEFVATFLFLYITILTVMGVNRSSSKCATVGIQGIAWAFGGMIFALVYCTAGISGGHINPAVTFGLFLARKLSLTRALFYMVMQVLGAIVGAGVVKGFEGKTFYGQHNGGANFVAPGYTKGDGLGAEIVGTFILVYTVFSATDAKRSARDSHVPILAPLPIGFAVFLVHLATIPITGTGINPARSLGAAIIFNKDLGWDDHWIFWVGPFVGAALAALYHQVVIRAIPFKSS

SEQ ID NO: 63497 - protein, 378 aa, Candida albicans SC5314
MNFGTSHSSSSKNSHNNNVVGLHYKIGKKIGEGSFGVIFEGVNILNNAQVAIKFEPRKCEAPQLRDEYRAYKQLQGSKGIPNAYYFGQEGVHNILVIDLLGPSLEDLFDWCGRRFSIKTVIQVAIQMIRLVEQVHQQNLIYRDIKPDNFLIGKPDTPEANQIFFVDFGMAKQYRDPRTKQHIPYREKKALSGTARYMSINTHLGREQSRRDDLESLGHVFMYFLRGALPWQGLKAPTNKQKYEKIGMKKQTTSINELCYGFPIQFAQYLTYVRNLKFDETPDYQYLVGLMEKASISAGIELDGHFDWMDLNGGKGWDAALNKKANLHGYGNPYPHPSQGQRRAAATTAGTISTTTIITKISTIQFTPSTITWEFSFKR

SEQ ID NO: 63498 - protein, 777 aa, Brassica napus
GTSVICEIWFAFSWILDQFPKPFPVNRETYLDRLALRYDREGEPSQLAAVDIFVSTVDPLKEPPLVTANTVLSILAVDYPVDKVSCYVSDDGAAMLSFEALAETSEFARKWVPFCKKYSIEPRAPEWYFAAKIDYLKDKVQTSFVKDRRAMKREYEEFKIRINALVSKALKCPEEGWVMQDGTPWPGNNTRDHPGMIQVFLGQNGGLDAEGNELPRLVYVSREKRPGFQHHKKAGAMNALVRVSAVLTNGPFILNLDCDHYINNSKALREAMCFLMDPNLGKQVCYVQFPQRFDGIDKNDRYANRNTVFFDINLRGLDGIQGPVYVGTGCVFNRTALYGYEPPIKVKHKKPSLLSKLCGGSRKKNSKSKKDSDKKKSGRHTDSTVPVFNLDDIEEGVEGAGFDDEKALLMSQMSLEKRFGQSAVFVASTLMENGGVPPTETPENLLKEAIHVISCGYEDKSDWGMEIGWIYGSVTEDILTGFKMHARGWRSIYCMPKLPAFKGSAPINLSDRLNQVLRWALGSVEILFSRHCPIWYGYSGRLKFLERFAYVNTTIYPLTSVPLLFYCTLPAVCLFTNQFIIPQISNIASIWFLSLFLSIFATGILEMRWSGVGIDEWWRNEQFWVIGGVSAHLFAVFQGLLKVLAGIDTNFTVTSKASDEDGDFAELYLFKWTTLLIPPTTLLIVNLVGVVAGFSYAINSGYQSWGPLFGKLFFAFWVIVHLYPFLKGLMGRQNRTPTIVVVWSVLLASIFSLLWVRIDPFTKRVTGPDILECGINC

SEQ ID NO: 63499 - protein, 292 aa, Zea mays
  misc_feature (201)..(201): Xaa can be any naturally occurring amino acid
  misc_feature (268)..(268): Xaa can be any naturally occurring amino acid
  misc_feature (270)..(270): Xaa can be any naturally occurring amino acid
  misc_feature (276)..(276): Xaa can be any naturally occurring amino acid
TQRVREEPSRWFQGTADSIRKFIWVLEDYYSHKSIDNIVILSGDQLYRMNYMELVQKHVEDDADITISCAPVDESRASKNGLVKIDHTGRVLQFFEKPKGADLNSMRVETNFLSYAIDDAQKYPYLASMGIYVFKKDALLDLLKAVLDHSVQACIFTGYWEDVGTIKSFFDANLALTEQPSKFDFYDPKTPFFTAPRCLPXTQLDKCKMKYAFISDGCLLRECNIEHSVIGVCSRVSSGCELKDSVMMGADTYETEEEASKLLLAGKXPXGIGRTXKDKDCIIDMNARIGKN

SEQ ID NO: 63500 - protein, 564 aa, Synechocystis sp. PCC 6803
MQITNKIHFRNLQGDLFGGVTAAVIALPMALAFGIASGAGATAGLWGAVIVGFFAALFGGTPTLISEPTGPMTVVQTAVIASLVAADPDNGLAMAFTVVMMAGLFQIAFGLLKLGKYVTMMPYTVISGFMSGIGIILVILQLAPFLGQASPKGGVIGTLQALPNLVSNVRPVETLLALMTVGIIWFMPSRWKKFAPPQLVALVLGTIISITLFGDLDIRRIGEIQAGLPALQLPVFQADQLQRMLIDAAVLGMLGCIDALLTSVVADSLTRTEHNSNKELVGQGIGNVMSGLFGGLGGAGATMGTVVNIQSGGRTALSGLIRAMVLLVVILGAAKLAATIPLAVLAGIAFKVGVDIIDWGFLKRAHHVSIKGALIMYAVIVLTVLVDLIAAVGIGVFIANILTIDRMSALQSKAVKSISDADDEILLSANEKRWLDEGNGRVLLFQLSGPMIFGVAKAIAREHNAIQECAAIVFDLSDVPHLGVTASLALENAIEEAAEKGRAVYIVGATGQTKRRLEKLQVFRFVPESNCYDDRSEALKDAVLALGPHESEDSPSSSSVQTTY

SEQ ID NO: 63501 - protein, 161 aa, Methanosarcina barkeri str. Fusaro
MKHTLAVLVENRSGVLSRVASLFSRRGYNIESLAVGVTEDPKTSRMTIVVDGDDHVLEQVTKQLNKLVDVIKVSDIGGDDSVERELALIKVSADVSARTEIIQIANIFRARIVDVAPKSITIEVTGDEAKIQAIEKLLRQFGIKEMVRTGKIALVRGPKKV

SEQ ID NO: 63502 - protein, 330 aa, Physcomitrella patens subsp. patens
MAIAAASNPLQELHIRLQGSTAWMEGVLKGAQQSVEKLGYLLHSGRGDSTNQIRSILGVKDSPVAETAAAKVEQSFQDRLERQLAAWRRNSSWVDEIPVLEVTVPKGALCKFDSHFELGIPPDAVYNILTDPGNKRVFKNIEEVKYRKVLQDDGDHQLVELEQLASWRFLWLSGTLSACVLVDQDRSTHMVKYKLAKTGFMKRFEGTWKIEPLFLDDSGAPVQVHERGTERVASMVTLQQIWQPMIIPPPPFGGYVRNISTKTTTDMIQELQAEAKRLREGTPEPDNSFKSQESPRPQKAVLFSEQWKLSKKSAPGRRRSRKSQWRIRSE

SEQ ID NO: 63503 - protein, 144 aa, Oryza sativa
  misc_feature (101)..(101): Xaa can be any naturally occurring amino acid
  misc_feature (116)..(116): Xaa can be any naturally occurring amino acid
MMASTTSATAAGGAFAAAKTRAGSSAAGGGACARVAAGGRRRSGVVVRCDAGVEAQAQAQAVAKDASVAALEQFKISADRYMTERSSIAVIGLSVHTEPVXEMREKLAVAEELWPXDISEITSLNTIEEGVFLVAAKNGNLWSL

SEQ ID NO: 63504 - protein, 347 aa, Triticum aestivum
LLISLRALFKQRPLHDVADITKGEERVRIPIVNEFGSDSCPPLFYYIRKNLIFQSAYVNTSLARIGDEDCCADCSGNCLLESHPCACARSTGGEIAYTPEGLVRAELIDECIAVNHFPEKDNKFYCKACPLEIYKTKPSPDPCKGHLARKFIKECWSKCGCGMQCGNRVIQRGITCNLQVFFTNEGKGWGLRTLDGLPKGAFICELVGEVLTSSELHERKAKNSKHVDQVLLDASWGSEGVLRDEEALCVDPTFYGNVGRFVNHRCYDANLVIIPVEVETPDRHYYHLALFTAKKIEAFEELTRDYGIDFDGTDDLNKAFDCMCGSKYCRGGPNNSRKRTRASASQN

SEQ ID NO: 63505 - protein, 387 aa, Prochlorococcus marinus str. MIT 9215
MAIQQKLSLMIPGPTPVPEKVLQALSKHPIGHRSKEFQDLVESTTKNLQWLHQTQNDVLTITGSGTAAMEAGIINTLSKGDKVICGENGKFGERWIKVAKEFGLEVIKIDSEWGTPLNPEEFKKVLEEDKQKEIKAVILTHSETSTGVVNDLETISSYIRSHSRALSIIDCVTSIGACNVPVDEWELDIVASGSQKGYMIPPGLSFISMSQKAWEASEKSNLPKFYLNLKSYRKSLLSNSNPYTPAVNLVFALDEALKMMREEGLDKIFLRHNKHKLAMSNAIKALNLELFADEKYLSPSITAIKTGEMDAEEFRKTIKNKFDILLAGGQDHLKGKIFRVGHLGYINDRDIISVISAISTTLLEIGKITAQQAGEALVVASRYLEGK

SEQ ID NO: 63506 - protein, 365 aa, Dimocarpus longan
MAPATLTALAQEKTLNASFVRDEDERPKVAYNEFSKEIPVISLAGIDEVDGRRAEICKKIVEACEDWGVFQVIDHGVDTKLISDMTRLAREFFALPPEEKLRFDMSGGKKGGFIVSSHLQGEAVQDWREIVTYFSYPMRTRDYSRWPDKPEGWIDVTKEYSDKLMGLACKLLEVLSEAMGLEKEALTKACVDMDQKVVVNYYPKCPQPDLTLGLKRHTDPGTITLLLQDQVGGLQATRDNGKTWITVQPVDGAFVVNLGDHGHYLSNGRFKNADHQAVVDSNCSRLSIATFQNPAPEATVYPLKIREGEKPILEEPITFAEMYRRKMSKDLELARLKKLAKEQKLQLQDNEKSKLEAKPIEQILA

SEQ ID NO: 63507 - protein, 235 aa, Medicago truncatula
MASSENLAASIESWMYRPAMTDTWLSDYISRDAETLTKALHKSLSSSSSPEDALSPFLNLIKTDSATTTTTTTPTVSSLSASDDSAPKRQRVAAGKISKRKSRASKRSQTTFITADPANFRQMVQQVTGVRFGSGSNVSMAPLVKPEPHRAVGVNGGGRFTTGGGCLPTLDTSAFLLQHHQQQQQTMVGPNSDGPEMTGLGPLSFGQPIGEDAAGYDFETFSSCFPTLESSWKVM

SEQ ID NO: 63508 - protein, 528 aa, Prochlorococcus marinus str. MIT 9215
MSQTSLKKERDPSILILDFGSQYSELIARRIRETNVFSLVVSNCISIKEINNINPKGIILSGGPNSVYEQNAPKCDEKIFNLGIPILGICYGMQLMVKELGGSVIPATKKAEYGRAPINIDQESDLLSDVQDKSIMWMSHGDSIKCLPVGFNKIAHTENTLHAAISNDLKKLFGVQFHPEVIHSEYGMTVIKNFVYKISCCAADWTTETYIEETIPRIREQVGNKKVLLALSGGVDSSTLAFLLNKAIGNQLTCMFIDQGFMRKGEPEFLMNFFDKKFHIKVEYINARKRFISKLKGITEPEQKRKIIGEEFIRVFEEESNRLGPFQYLAQGTLYPDVIESAGTNIDPKTGERIAVKIKSHHNVGGLPKDLQFKLVEPLRKLFKDEVRQVGAALGLPAEIIKRHPFPGPGLAIRILGEVNNEKLDCLRDADWIVRDEIKKAGLYNEIWQAFAVLLPVKTVGVMGDKRTYAWPIVLRCVSSEDGMTADWSKIPFKILERIANRIVNEVISVNRVVYDITSKPPGTIEWE

SEQ ID NO: 63509 - protein, 586 aa, Alkalilimnicola ehrlichei MLHE-1
MAVQAKHNGGAAHWLPLLGWLRAYRPEYLAGDLIAGAVVAVMLVPQAMAYAMLANLPPHVGLYASIIPPVAYALFASSRALAVGPVAIVSLMVASVAGAVAAPGSAEHLGAAVVLALLSGIVLLVMGMARLGFVTQFLSHPVLSGFITAAAVLIGFSQLRHVLGVEGGGDNLPAMVVALWQSLGQVNGVTLAIGLTSIGLLLWMQGPLKGLLVRSGLSAPVAGIAVKTAPLVVVVLGSLAVALPGLDEHFGVSVVGRVPEGLPDFALPAVDLPLWRELVWGAVLIALVGFLESASVAKSLAARDRERIDPDRELKGLGLANIGASLSGGYPVTGGISRSVVNYSAGARTPMAGVLSALLIVLVLLFLTPWLAWLPHASLAAIILVAVVGLVDLHTPRRIWQYSRSEAVTLLTTAAVVLVVGVEAGIVVGVLLSLGLYLWRTSRPHMAVVGRVPGTEHYRNVERHKVETDPRVLLVRVDESLYFPNTRYLEDRLQELVWGRDGVEHVVLICSAVNFIDASALESLEELAGQFADSGVTLHLAEVKGPVMDGLEQAGFTRHLRGGRVFLSTHEAMKALGPRRRWVVPT

SEQ ID NO: 63510 - protein, 518 aa, Arabidopsis thaliana; identical to SEQ ID NO: 1245

SEQ ID NO: 63511 - protein, 104 aa, Xanthomonas oryzae pv. oryzae KACC10331
MSMQFSSPYGSVADSYKARPTYPTELFDWLAGQVSQCVLAWDCGCGSGQGSQDLARYFDGVVATDVSHEQISRASSNSKVEFRATPAHISGLDDASVDLVLLCY

SEQ ID NO: 63512 - protein, 890 aa, Rhodopirellula baltica SH 1
MTATMAKKDKMVYYFGKTKTEGKGGSKAILGGKGLNLAEMTSIGLPVPPGFTITTEVCDGYYKAGKKLPKGLMDEIQDAVKILEKELGKNFGDNENPLLVSVRSGAAVSMPGMMNTILNLGLNDEATEGLAKATKNERFAYDAYRRLINMYGDVVMGLHHEQFEAAFDKVKKKHNVTEDTEVPAEGLRELCEAYKAVYKKGTGEDFPQDPIKQLQLAIEAVFGSWNADRAISYRRIESAKGNTEINNLIGTAVNVQAMVYGNMGDDSGTGVGFTRDPNTGQNKFYGEFLINAQGEDVVAGIRTPQPVAQMAKWDKAAHKELMEIKKKLEDHYTDMQDIEFTIERGKLFMLQTRNGKRNGIAAVKIACDMVKEGLITEKEAVLRVPASDLTHCLLPSFKPTARNAADVLCRGLNASPGAAVGKLAFTAPEARERFEAGEDVILVRRETSPEDVEGMSAAVGILTSTGGATSHAAVVARGWGKCCVAGASEVEINEKGKTITVGGRKFTAKDTISLDGTTGEVMAGEVETQEPKLSGDFAKLMEWADQYRRLSIRTNADSPADSKRARDFGAEGIGLCRTEHMFFEADRIIHMRAMILAEDEDARRAALKKLLPFQRKDFEGIFKAMKGCPVTIRLLDPPLHEFLPHEAAAQKQMAEELGVKPAEIKKRGEALHESNPMLGHRGCRLSVTYPEILEMQVQAIVEAAISCAKKKIDAQPEIMIPLVGTAAELRILREKVEETIEATKTAKKFEGELNILIGTMIEIPRACLTADEVAEYADFFSFGTNDLTQMTFGYSRDDVGGFLPDYIEAKIVPVDPFQSLDTSGVGQLVEMGVTKGRSIKKKLKVGICGEHGGDPASIEFCNSVGLDYVSCSPFRVPIARLAAAQAALKA

SEQ ID NO: 63513 - protein, 106 aa, Arabidopsis thaliana
  misc_feature (57)..(57): Xaa can be any naturally occurring amino acid
  misc_feature (67)..(67): Xaa can be any naturally occurring amino acid
MGVASLSICFSARPHLLLRNFSPRPKLVAMAAMSEDPIREWILKEGKATQITKMGSXGGGCINLASXHNQPDAGSFSVPNIRRMGPATLEGQAPGHERPVCTSPIP

SEQ ID NO: 63514 - protein, 130 aa, Zea mays
MATVSAAVVTTIVARAAIARPNALGLPALRARSERVRCSYAKDAKNAAPVSTKGAGASLLAAAGAVTASAGPALALVDERMSTEGTGLSLGLSNNLLGWILLGVFGLIWSLYTIYTSDLDEDEESGGLSL

SEQ ID NO: 63515 - protein, 391 aa, Xanthomonas campestris pv. campestris str. 8004
MTRWLFGGVFFRIGRARAAMPDSGRPTTQEPDVGEVAVSVADVLAAQARLRKYLSPTPLHYAERFGVWLKLENLQRTGSYKVRGALNALLAGLERGDERPVICASAGNHAQGVAWSAYRLGVQAITVMPHGAPQTKIAGVAHWGATVRQHGNSYDEAFAFARELADQNGYRFLSAFDDPDVIAGQGTVGIELAAHAPDVVIVPIGGGGLASGVALALKSQGVRIVGAQVEGVDSMARAVRGDLREITPVATLADGVKVKIPGFLTRRLCSSLLDDVVIVREAELRETLVRLALEEHVIAEGAGALALAAGRRVSGKRKCAVVSGGNIDATVLATLLSEVRPRPPRKPRRRNTERLRNERSTKASPPSIAIPRPSAVASTPVTAIAVEESSW

SEQ ID NO: 63516 - protein, 436 aa, Debaryomyces hansenii CBS767
MAQQQSESNNLKKIFNKLSGQPSSYSRKSLYTFGKTLGAGSFGIVRYARNNETNEEVAVKIILKKALKGKVETITDELNLLQELLHPNIVGFRDWFESKDKFYIVTQLATGGELFDRIIEKGRFTEFDASLVIVAMLEAIKYLHNKNIVHRDLKPENILYLTPADNSNVVLADFGIAKRLESPDEKLTSSAGSFGYAAPEVILGTGHGKPCDIWSLGVITYTLLCGYSPFRSENVSDFIEEVKHNNAVIFHADYWKDVSKDARRFIIKALQFDPNNRPDAETLLNDKWLVSIASEHKELDLLPNLKENFNAKQKFKQAIEMVKLNNKIKKLKELQGDDDDDPNEINLFGDEGALISSDVSSKQGAGSEGGLGSWKALSSALNSIDDRSSAASVSSTSAPKKKSDLASDAFVQLVHAATNNKERVANYKEGDNSSAN

SEQ ID NO: 63517 - protein, 469 aa, Methanosarcina barkeri str. Fusaro
MQELNGEKTVKAKKERTPMPEQPAEERRKNFNEVALGYTKEDALAEASRCLSCKEPKCVEGCPVNVDIPGFIKLVCEEDFAGAIEKIKGTNALPAICGRVCPQETQCEALCVLGKKGQPVAIGRLERFCADYERQQGVKVPEVPEPTGKKVAVVGSGPAGLTAAADLAKLGHKVTVFESLHKAGGVLSYGIPEFRLPKEIVRQEVEYIEKLGVEFKPNYIIGRIKTLDELCDEFDAVFMGTGAGLPNFMGIPGENFNGVYSANEFLTRVNLMKAYDPEYDTRVRLGRHVVVVGGGNVAMDSARSALRLGAEEVSIVYRRGEEEMPARREEIEHAKEEGITFRLLTNPVRILGDDKFNVTAVECIKMKLGEPDKSGRRSPVPVEGSEFTIPAEVVVIAIGTSPNPMIFKGSEGLDQNKKGTVVADEETGATSKCGVFAGGDVVTGAATVISAMGAGKKAAKAIDEYLKEQ

SEQ ID NO: 63518 - protein, 458 aa, Methanosarcina barkeri str. Fusaro
MTGIKSIILAGGSGTRLWPLSREMYPKQFLKFGNTSLFQETVLRCLEISDISEIFVVTNEAQKFFVIGQIEEIGYSLPTENVLIEPEGKNTLPAIFFGMKEIEKKYGRSVVGIFSSDHVLDRVAMQTIASAEDLASDYLVTFGVVPVFPHTGYGYIKPSEACVPGYRVSEFREKPDRETAEKYIKEGCLWNSGMFLFDTELFFDEVKKYAPSVFTCFENGKDINEIYACVDKISIDYGIMEKSERVAVVKLEQKWSDLGNFAAIYDEFEKDPVGNVVHECDPIMLNSDGNLVYSSCGKLVSLIDIKDMVIVDTSDALLVCPKSSSQKVKDIVSALKERNDERAYIGQTVYRPWGSYTLLEASPEHKIKNITVLPDHKLSLQLHYHRSEHWVVVKGMACVEVRGQQFFLRPGESTFISAGEKHRLSNPGKIPLEIIEVQLGELVDEADIVRFDDVYGRS

SEQ ID NO: 63519 - protein, 203 aa, Medicago truncatula
MTAQTQEELLAAHLEQQKIHHDEPVVEDDDDEDDEDDEDDDDEDDDNAEGFEGDASGRSKQTRSEKKSRKAMLKLGMKAVTGVSRVTIKKSKNILFVISKPDVFKSPTSDTYIIFGEAKIEDLSSQLQTQAAEQFKAPNLTNAGAKPESSGIAPEDEDVDETGVDPKDIELVVTQAGVPRSRAVKALKAANGDIVAAIMELTN

SEQ ID NO: 63520 - protein, 475 aa, Propionibacterium acnes KPA171202
MLPMTVKNQHSAAEEQHLRRSLSNRHIQLIAISGAIGTGLFMGSGKSISTAGPSIVVAYLVIGAMLFFVMRAMGELLLHNLQWKSFQDFAADLLGPWAGFFLGWTYWLCWVVTGMADVIAITSYWSFWTHDRAWAFILTATTLLLLLALNLLTVKLFGELEFWFALIKIVAILTLIAVAIVLIVMGFTSASGYKASVSNLWSYGGFAPRGWSGFFGGFQIAVFAYVGIELVGTTSAETANPPKTMPKAINAVPVRVLVFYVAALLAMMCVTPWNLIQTDSSPFVQMFGLIGFTAAAGIMNFVVLTSAASSANSGVYSTSRMLYGLAHKGMAPRAFGKLSRHGVPGWGLFCTIILIGSALILAAKDSVMGAFTLVTTVSAVLFVFVWSMILISHIVHVRRNPQAHAKSIYPMPGASFMPWVVLAFFVFVIVLLTGADDTLQALLAAPIWFVVLGIVWAIVRRRSHHDDLETDLPAD

SEQ ID NO: 63521 - protein, 477 aa, Propionibacterium acnes KPA171202
MSDEGVMGKSTTKRVGSHYVLDDVLGRGSMGTVWRGHDLNDGSPCAIKILNPTLTTDKGATRRFIDERDIFMSVDDDAVVRVTDMVVESSTFAIVMELVDGPDLAQVLKSLPDHRLDQGTAVSLGIEVCQALAAIHRVGIRHLDIKPANILIEDPENVSGARITDFGVSEVVAFHGPREVVGTPYYQAPEVAAGWTPTAASDLYSFGVTLYEILAGHMPFQANSAGNLLRNQPPPAIPGVDPRLWNTILTCLAPDPSQRPDSAEVLASELRSWRNGEQPVRLVSRRSQPVRPTPQPMPRPRLVRSAPSAISGATPPAPSATSVATQQRGSGWVIALLAVLVLVGAGVFFYVKGMPGSHSDAAPQPTQAPISTSTPEVRPTRTVTAHATVTTMSSPIQIQLPGGAVECGQGAWIANPRTTCPLALEVVRSVPANHPASFAIDAQDPRTGKSRHFSCNTVGQYVDCGSQDLEVYLVIPG

SEQ ID NO: 63522 - protein, 461 aa, Mycoplasma penetrans HF-2
MSNSLVKTIDVVTKFLKDKKTDISLIDIENRVLILKKIKEWVIKNTNDIVSALKSDLNKSEIESLISEVSVVLKQTNYYIKNLHKFYKNKKAKNIPFLGLKSKGFYTYKPMGTVFMINPFNYPFQLALIPLVTAIASGNFVIMKNSEKANNTSRLILKMIQEININNLVCFLDEKVSKDFIFDVIDSKPDLIFFTGSKSFGYELKKQAIANEIKIILELGSANPVIVDETADIELAARRIVWAKLMNMGQTCVAPNSIFCDEKIHDKLVEAINAELTTQYNTNKFDFVKIVDVQHLVNVANMVKSFTDIDLEKDEENLRIKPTLIQVENNNQILFQEIFAPVLFITSFKNLTDFCADYKDKITDCLALYLFSNNEYNIKNVSNSFSYGGMGVNELLLQVSNIYLPFGGIKTSGIGKYHGNFGLMEFSNLVSVLRGSKKEVNYRYFHKISKYKSLIKFLVKR

SEQ ID NO: 63523 - protein, 251 aa, Brassica napus
MSLDRRSRNPMARKIASDRFSYRDDPYRRDSHRTFSSQSNTCKNCKRPGHFARECPNVSICHNCGLPGHNLSECSAKSVCWNCREPGHMSNSCTNEGICHSCGIAGHQAKDCTARHLPPGDLRLCNNCYKQGHFSADCTNEKACNNCRKTGHLARDCRDDPVCNHCNLAGHLAIKCPKTHVLAAEERRPRGIRAQYREEEVVCRNCRQVGHMSRDCTARLMICRNCGGRGHIAYECPSGRLVNHHHYPLRY

SEQ ID NO: 63524 - protein, 339 aa, Rhodopseudomonas palustris CGA009
MRAVFMTGHGGNEVIEVGDRPMPQRRPGEVLVRMRAATVNRVDLYMRDSGAGITHSLPQTMGVDGAGVIEEADTPELIGRRVTLYPGIVCGACEFCRRGEPVLCAKMSLLGEHRDGTMAEYVCVPAANALPIPDRLDFAQAAALGVNYLTAWRMLFTKAKLQPGETVLVFGVGGGVSLAAMQIAAAAGARVLATSRSADKLARARALGADAVIDAPADKIPAAVMDLTSGRGADVVIENIGGAMWSAALKSLVRGGRVATCGATIGDQPPADLRRVFIRQLQIFGSTLGNPTEFAELIAWCDSGKLTPPIDLHYPLDDIRTAFDHLESGSQFGKIAIDI

SEQ ID NO: 63525 - protein, 232 aa, Alkalilimnicola ehrlichei MLHE-1
MKKLVLLRHGQSIWNQENRFTGWHDVDLTEKGREEAQAAGQLMKRHGLRFDYAYTSVLKRAIRTLWIGLDELDQMWIPVTKAWQLNERHYGALTGLNKAETAEEYGAEQVHIWRRSYDTPPPPLDETSPYHPRHDPRYASLKPEQLPATESLALTLERVLPYWNERIVPTLRDCDNVLIAAHGNSIRALIKHLDGLDDEAIMKVEIATGDPLVYELDDALAVVDKHYLRERD

SEQ ID NO: 63526 - protein, 559 aa, Prunus dulcis
  misc_feature (46)..(46): Xaa can be any naturally occurring amino acid
MGSLEEERSLLEDGLIQDETNGLYTGDGSVDITGKPVLKQSTGNWXACPFILGTECCERLAFYGISTNLVTYLTHKLHEGNVSAARNVTTWSGTCYLTPLIGAVLADAYWGRYWTIAIFSTIYFIGMCTLTISASVPALKPPQCVDSVCPSASPAQYGVFFFGLYLIALRTGGIKPCVSSFGADQFDDTDSRERVKKGSFFNWFYFSINIGALVSSTLIVWVQDNAGWGLGFGIPALFMGIAIVSFFSGTPLYRFQKPGGSPLTRMCQVLVASFRKWNLDVPRDSSLLYETQDKGSAIKGSRKLEHSDELNCLDKAAVISETETKTGDFSNPWRICTVTQVEELKILIRMFPIWATGIVFSAVYAQMATMFVEQGMMMDTSVGSFTIPPASLSSFDVISVIFWVPIYDRFIVPIARKFTGKERGFSELQRMGIGLFLSVLCMSAAAVVEMKRLQLATELGLVDKEVAVPLSIFWQIPQYFLLGAAEIFTFIGQLEFFYDQSSDAMRSLCSALSASDDFIGKLSELFDSDIVTYFTTQGGKAGWIPDNLNDGHLDYFSGS

SEQ ID NO: 63527 - protein, 307 aa, Nostoc sp. PCC 7120
MQETTISILGAGAWGASLANLAIANGNRVRVWSRRGSETLSAVLQGADIVLSAISMKGVREVASQIQSLTPSPETIFVTATKGLEPETIYTPSQIWQSCFPHHPVVVLSGPNLSKEIDQSLPAATVVASRVATAAATVQLAFSSSRFRVYTNPDPVGVELGGTLKNVIAIASGVCDGLHLGTNAKAALVTRGLTEMVRIGNCWGAKTETFYGLSGLGDLLATCNSPLSRNYQVGYQLAGGETLAQILAKLPGTAEGVNTCQVLVQLARQQNIVIPITEQVYRLLQGEVTPQQALDELMLRDIKPEYN

SEQ ID NO: 63528 - protein, 731 aa, Debaryomyces hansenii CBS767
MSDMEELDVKAKQYTPQLFLESEDKTDEARSTFNELQECTYSSKSTGSSGQHEHMTCDCYEDWDSDKQQNMACGEDSDCINRVTSVECSNKFCTCGNDCQNQRFQKKQYANVTVIQTELKGYGLRANEDISESSFIYEYIGEVIDEESFRKRMIDYDTKKLIHFYFMMLKKDSFIDATMKGSLARFCNHSCNPNAYVDKWVVGEKLRMGIFSKRNIQKGEEITFDYNVDRYGAQSQPCYCGEPNCIKWMGGKTQTDAALLLPDGISEALGVTHKQERQWLKENKHLRSKQQSDESIINEAFVKSIEVSALTESDVSKVMGALMRVQDLNITQKLIERIYLTSDDSINSSIIRVHGYKTLSQTIKAFKDEDKELISKILIILAKWPKVTRNKISSSQIEDVVKDINTNSNDDNLKKLSSDLLAEWGKLQMAYRIPKNIGNDKESNSPALYGRNARSRSRSRSPDRGKSAEPQHVETDEALPDGWQTAFDPNTQTNYYYHAELGISKWERPIKEVPKGPKGPKALPVSEPIQRPNLNSNGRSYNEEELTRREEERLKREKEEQFKEIQQKERLLQELILQSQKELEEKKSFEEKMKLEKLEKEKERQALKRKKLKKSKSSIPPAPPVPIDGQWTKTFAKHVPNFLKKYEAEIGRDNIKGCAKELVKTLVAKEMKKNPDTKPPKELDNAKLKKIKEYSKMFMDKFLIKYRSKHDKKRSHNEENGGTKRVKPDVE

SEQ ID NO: 63529 - protein, 450 aa, Pasteurella multocida subsp. multocida str. Pm70
MSHLSIAKFGGTSVANYAAMSASAKIVVNDPNTRVVVLSASAGVTNLLVALANGCDNEERTKLINEVRQIQENILSELKDDSLVRNKVEKLLANIESLAEAASLATSPALTDELISHGEMMSSLIFVEILREFNTPSTWIDVRNIIATDSHFGKAVPNDHKTQENSTHILKPLIDRGELIITQGFIGRDEQGKTTTLGRGGSDYSAALLAEVLNAEDVLIWTDVAGIYTTDPRIVPNAKRIDTMSFSEAAEMATFGAKVLHPATLLPAVRSNIPVYVGSSKAPEAGGTWVTRDPQHRPIFRAIALRRDQTLLTLSSLNMLHAQGFLANVFTILAKHKISVDVVTTSEVSIALTLDKTGSASSGLSLLSSALIDELSQLCSVKVDSDLALVALIGNDLHITSGIAKRIFDTLAPYNIRSISYGASTNNVCLLVTNAHADAVVSALHKNLFE

SEQ ID NO: 63530 - protein, 389 aa, Debaryomyces hansenii CBS767
MSQYRANQRLQQLSNILRPNQLSAEKSLKPETPFKVAVIGSGNWGTTIAKVLAENTAEKPDTFAKQVDMWVFQEKIDGTNLTEIINNKHENVKYLPGVKLPENLHAEPDIVKAAQGADLLVFNLPHQFLPKICKQLKGTLKPTTRAISCLKGLEVTPDGCKLLSTYITENLGIECGALSGANLAPEVARCKWSETTVAYNIPADFKGPGKDIDSAVLKEAFHRPYFHVNVIEDVAGVSVAGALKNIVAIAVGFVEGLGWGDNAKSAIMRVGLIETINFSNMFFPNSKPTTFTHESAGVADLITTCSGGRNVKVGRHMSKTGESAEEAEKKLLNGQSSQGIITAKEVHELLSNVGKTDQFPLFEATYQIIYGDESIQNLPNLLEDHSLFK

SEQ ID NO: 63531 - protein, 398 aa, Arabidopsis thaliana
MASTSLLKASPVLDKSEWVKGQSVLFRQPSSASVVLRNRATSLTVRAASSYADELVKTAKTIASPGRGILAMDESNATCGKRLDSIGLENTEANRQAFRTLLVSAPGLGQYVSGAILFEETLYQSTTEGKKMVDVLVEQNIVPGIKVDKGLVPLVGSNNESWGQGLDGLSSRTAAYYQQGARFAKWRTVVSIPNGPSALAVKEAAWGLARYAAISQDSGLVPIVEPEILLDGEHDIDRTYDVAEKVWAEVFFYLAQNNVMFEGILLKPSMVTPGAESKDRATPEQVAAYTLKLLRNRVPPAVPGIMFLSGGQSEVEATLNLNAMNQAPNPWHVSFSYARALQNTCLKTWGGRPENVNAAQTTLLARAKANSLAQLGKYTGEGESEEAKEGMFVKGYTY

SEQ ID NO: 63532 - protein, 235 aa, Parvularcula bermudensis HTCC2503
MPRICLVRHGQSRWNLENRFTGWVDVDLTEKGEAEARRAGELMKAETFKPVRAFTSVQTRAIRTLNIALHALDRLWVPVTKDYRLNERHYGGLTGLDKAETAVKHGEDQVKIWRRSYDTPPPPLDDPSPFPSLTDERYAGIEVPKTESLKLTLDRVAPYWQSTIVPAISEGDLLIAAHGNSLRALVKLLFAVGDDEITSVEIPTGNPLLVELNNQMRASSAKYLDDSRAQALPKI

SEQ ID NO: 63533 - protein, 334 aa, Arabidopsis thaliana
MSKAQKRKRLNKYDGESKTPANKSTVDGGNPYPTLLRPTAEECRDVRDALLSLHGFPPEFANYRRQRLRSFSAVDDHDTQCNLKSETLNETEEESVLDGLVKILLSQNTTESNSQRAFASLKATFPKWDDVLNAESKSIENAIRCGGLAPKKAVCIKNILNRLQNERGRLCLEYLRGLSVEEHNDFPVDTHSSRSLMRYKPRLKQVFEIAKALGWVPKTADRNKTYVHLNRKIPDELNNCKKNVAKPKAKVASPDDCPLKTDGALAQSRRGFHVELGAREKALLAEDASLRRFKSHKKGVHRLKRIGDVLTVVVVAGCCYEIYARVMRKEAQAA

SEQ ID NO: 63534 - protein, 309 aa, Glycine max
MAPGSSVFKEVLESHLMSSDYEMGKAKSEAKSNSTSTKSSIGLSGKSGISSNNGVYELLGCPVCKNLMYPPIHQCPNGHTLCSHCKVEVHNICPSCHHDLGNIRCLALEKVAESLELPCRYQSLGCHDIFPYYTKLKHEQNCGFRPYNCPYAGSECSVMGDIPTLVAHLKDDHKVDMHDGCTFNHRYVKANPHEVENATWMLTVFNSFGRHFCLHFEAFQLGSAPVYMAFLRFMGDDNEAKKFSYSLEVGANGRKLIWQGIPRSIRDSHRKVRDSQDGLIIQRNLALYFSGGERQELKLRITGRIWREE

SEQ ID NO: 63535 - protein, 462 aa, Magnetospirillum magnetotacticum MS-1
MAENSFDIIVIGGGPGGYVAAIRAAQLGMNTALVEREHLGGICLNWGCIPTKALLRSAEIYRNMQHAESYGLSAPGASFDLAKIVARSRGVSAQLQGGIKHLLKKNKVTVIEGTAKLAGGGKVAIEGKPTISAPHIILATGARARILPGFEPDGKFIWTYKEALVPDTMPKRLLVIGSGAIGIEFASFFNALGAQVTVAEAMDRVLPVEDAEISAMAQKSFEKQGMKILTSANIKGLKKNAADVTVTIEAGGKTQDITVDRIITAIGIVGNVENIGLEGTKIRVERTHVITDPYCRTDEPGIYAIGDIAGAPWLAHKASHEAMICVEKIKGLADVHPLDMRKIPGCTYCHPQVASVGLSEAKAKDKGYTVKVGRFPFMANGKAIALGETEGMIKTVFDAKTGELLGAHMIGAEVTEMIQGYVVAKTLETTEAELMHTVFAHPTLSEMMHESVLDAYGRAVHF

SEQ ID NO: 63536 - protein, 467 aa, Ganoderma lucidum
MGATSMLTLLLTHPFEFRVLIQYKLWHEPKRDITQVSEHPTSGWDRPTMRRCWEFLDQTSRSFSGVIKEVEGDLARVICLFYLVLRGLDTIEDDMTLPDEKKQPILRQFHKLAVKPGWTFDECGPKEKDRQLLVEWTVVSEELNRLDACYRDIIIDIAEKMQTGMADYAHKAATTNSIYIGTVDEYNLYCHYVAGLVGEGLTRFWAASGKEAEWLGDQLELTNAMGLMLQKTNIIRDFREDAEERRFFWPREIWGRDAYGKAVGRANGFREMHELYERGNEKQALWVQSGMVVDVLGHATDSLDYLRLLTKQSIFCFCAIPQTMAMATLSLCFMNYDMFHNHIKIRRAEAASLIMRSTNPRDVAYIFRDYARKMHARALPEDPSFLRLSVACGKIEQWCERHYPSFVRLQQVSGGGIVFDPSDARTKVVEAAQARDNELAREKRLAELRDKTGKLERKLRWSQAPSS

SEQ ID NO: 63537 - protein, 345 aa, Oligotropha carboxidovorans
MAQGQTLHQHLTGFAATDPAHGPVADVVAAFAIAATEISELISGGLLSGITGEGQTRNSDGDVQKDLDIKADQIIRAALAGTSVAALASEEAEEIEICDPAGAVSVAFDPLDGSSNINTNMSVGTIFSIVRTPSHARAAFTQPGSAQLAAGFVVYGPQTSLVLTLGDGVDVFTLDRKAKVFQKVRSRVQIPAQTPEYAINASNRRFWDPLIVAFIEDCLAGKDGVMQADFNMRWIGSMVAEAYRILVRGGIFLYPGDTREGYGEGRLRLLYEAHPIAFIMEQAGGGATTGRQRILDITANTPHQRVPLIMGSIDSVRRIERMHGSPDIKFERNPPLFATRGLFRI

SEQ ID NO: 63538 - protein, 270 aa, Oligotropha carboxidovorans
MKRTFEQIFRRENVTAAYIEGDAFHRYNRAEMRERMATEAERGNKHFSHFSAETNLFEELEQVFKTYGETGTGTTRYYVHDADEAALHGAAPGTFTDWQQLPESSDLLFYEGLHGAVVTDKVNVAQHADLKIGVVPVINLEWIQKLHRDRSARGYSTEAVTDTILRRMPDYVNYICPQFAETDINFQRIPTVDTSNPFIARWIPTPDESMVVIRLKNPRGIDFPYLLSMIPNSFMSRANSIVIHGAKLDLAMQLILTPLILQLIDRKRRA

SEQ ID NO: 63539 - protein, 335 aa, Oligotropha carboxidovorans
MSVKVAINGFGRIGRNVLRAIVESGRDDIEVVAINDLGSVQANAHLLRYDSIHGRFPHEVKISGDTIDVGRGPIRVTAEKDPAALPHAAMGVDVALECTGIFTTREKAAAHLKAGARRVIVSAPADGADMTVVYGVNHQKLNKDHVVISNASCTTNCLAPVAKVLNDAVGIERGFMTTIHSYTGDQPTLDTMHKDLYRARAASMSMIPTSTGAAKAVGLVLPELNGKLDGVAIRVPTPNVSVVDFKFIAKKNTSVEEINEAISKASGGALKGILGATHEQNVSSDFNHDPHSSIFHMDQTKVIDGNFVRILTWYDNEWGFSSRMSDTAVALGRVM

SEQ ID NO: 63540 - protein, 563 aa, Bradyrhizobium sp. BTAi1
MTLSTRNEDGQHWPLLRSLAGWRISSLPADLAAGLTLAAIAIPEQMATAKLGGFTPETGFFAFMAGSLGFALFGANRFLSCGADSTITPIFAAGLALLAATGTPEYGSLAAALALLVGVLLVLAGGFRLGGIANLLSVPVTVGFLAGIAVHIIVSQLPSVLGLPSPGGPTLARIAGLAGELGKTNIHTLIIGFGVLATVMVCERISARIPGALIALVASTLYVASAGLEAKGVHVIGEISGTIPMPSMPLIGAEQWAKLVPLAFLIAVVVMVQTSATTRSFPSAPDHPADVDRDFLGAGAGSLLAGLFGAFPVNASPPRTGIVVETGGRSQVAGLLAAIIVLLLVLFGARLLAHVPEAALGGVLLFVAQRIIRVAQIARVYRASKGEFLLIMATAAAIVVLPIEQGVALGITLSLLHGIWSTTRAHLITFERVPDTTIWWPAHPHIRGEQLSDIAVIGFQAPLSFLNAATFRADLQHLLQRRSPRLLVLEASAMVEIDYTAAQALHEVIEQCNKDGIVFAVARLESLRAQEAFERFGLYDVLPRDRVFRSVDLALRKLRGTTG

SEQ ID NO: 63541 - protein, 333 aa, Oligotropha carboxidovorans
MPDYSLAPLRPALEKSLKRSVRFVETDWRNGAPRAEVAKAIPGDILLMENTRFHPGEEENDPEFSRTLADLGDIFVNDAFSVSHRAHASTEGVARLLPSFAGRGMEAELTALDRALGKPMRSVGAVVGGAKVSTKITVLENLVTRVDELIIGGGMANTFLYAKGINVGRSLCEPDFKETVERILQRAADHHCNIVLPRDVVIAKEFAPNAPHEVVDVHAVPADSMILDVGPESVADIMEQFGDLKTLLWNGPVGAFETEPFGRGTFALARCAARLTKAGKLVTVAGGGDTVAALSAAGIQDDFSYVSTAGGAFLEWLEGRGLPGVDVLKISHA

SEQ ID NO: 63542 - protein, 242 aa, Corynebacterium efficiens YS-314
MVPRRRWPRLCDVAKASLDKDPFDVASMFDDVGDKYDLTNTVLSFGQDRVWRRRTRERLDLKPGEKVLDLAAGTAVSTVELAKSGAWCVACDFSQGMLAAGKHRNVPMVVGDGMTLPFADNSFDAVTISYGLRNIHDFRAGLREMARVTKPGGRLTVAEFSTPVIPVFGTLYKEYLMRLLPKVARVVSSNPEAYIYLAESIRAWPDQEDLAREINANGWSDCGWQNLTFGIVAMHSAIKPGN

SEQ ID NO: 63543 - protein, 152 aa, Prochlorococcus marinus str. MIT 9215
MTKERTFIAIKPDGVQRGYVAEIIGRFEKKGFKLVGLKQLIPSKDLAQNHYGVHRERPFFGDLVDFISSGPVVAMVWEGEGVILSARKLIGATKPLEAEPGTIRGDLAIDIGRNIIHGSDGEDTAKFEIDLWFNEEELCEWETSDAKWRSEN

SEQ ID NO: 63544 - protein, 486 aa, Zea mays
MQGASHMLLEEPFRLASVLSPAKPKVFPSLTKIVGTLGPNSHSVEIIQECLTAGMSVARFDFSWMDAAYHQETLDNLRKAAQNVKKLCPARVETQQKPQVKVQVMLDTLGPEIQVHNSTGEPIELKAGNHVIITPDICKALSAEILPIKFGDLAKAVKKGDTLFMGQYLFTGSETTSVWLEVVETSGENVNCLVKNAATLDGPIFTLHASQVHINLPTLSEYDKHVISTWGSCNSVDIISLSHTRSAEDVRELRAFLQAHALPDTQIYAKIENSEGLDHFDDILNAADGIIISRGDLGIDLPPENVFMFQKTAIHKCNLEGKPVIITRVVDSMIDNLRPTRAEATDVANAVLDGTDGILLGAETLRGLYPVDAVGSAIKVKAAAIVVFTFSGRAARLVAKYRPTMPILAVIFPREGSDPSKWRSYGTTQARQCFAVRGVYPLMGSTDEAETGGLTKEEYGIKLAMSYGRSVGIVKSFRQVDIFERL

SEQ ID NO: 63545 - protein, 209 aa, Zea mays
MVSKEQNKRGALHEKLKILRSVTHSHAISHAVCALLYIYVPIPFSFSDHSYAVKLYATRVRVCVSRMQGDKVSIIADASSYIKELKQKIAKLSQEMASSSPQHATSVCQQQPSSSSVSVGVLLDKKGRFLVSVFMDESCGPPPAGLLASVLEAFDEIGLTVLEARATCAGSFRLEAVGEEVVVDGGLIVDAHAVEQAVVQAIKNCPANH

SEQ ID NO: 63546 - protein, 408 aa, Gibberella zeae PH-1
MRFKLADSLSLITVQLILATSTLALSNPGSSSQKHSPNPSAPSPKGISVPFFATLERLSRLVDIAYCIGTTGVRKPFNCVSRCNDFPSLSLINAWNTGPLLSDSCGYIAVDHGVAQHGDSGDLTAGEPAIVVAFRGTYSIANTIVDLSTVPQEYVPYPSPDHGGSEPPNEPEHTCTNCTVHMGFLQSWKNTRQFVLPQLRQLRLQYPSYPIQLVGHSLGGSVACLAALELKVSLGWENVIVTTFGEPRVGNEGLARFVDEVFYLNDDNNPEGREFRRVTHKEDPVPLLPLSEWGYKSHAGEVYITKQELTPSESDIYMCIGDNDPKCIAGADDSLWMTTRRLFHARNLWTASDKLAEPNGFPSRFKLWQLLFAHRDYFWRLGLCVPGGDPADWGRGRYQGLGPDTEEL

SEQ ID NO: 63547 - protein, 232 aa, Triticum aestivum
RLGYPVPGKFPGGFCLTPRASAGCGAPGDPYPGRKGFEKTPGGPPPLPGYIPYIVPPWPPPVLAWSATSFGPFQGVKSTAGLPVSPRSNGVSLGRVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 63548 - protein, 204 aa, Glycine max
MEESKFGQTDKRKRVRDESDSVLNSPDSLKHPRAESNSFESLRVDSDEFELARLDPVLLNMLNDAENVAEREPTVLDSVIKSFEEEILSPVPNPNLASEADVFKPNLGYLLEASDDELGLPPTVAPSEDVLKPETVDSDRVGPEGMDLTGFLGFEDDIRSYEGFGFVGYDVGDNGGGYVTIDGLFDYAEPGADILWRSESLQAL

SEQ ID NO: 63549 - protein, 169 aa, Debaryomyces hansenii CBS767
MAKKDSIKKSVTHTTSNKIGHPINELISAVTTTYKDYINSLTPRLKLIDIFLTFLVLLGILQFAYVLLVGNFPFNAFLGGFISCVGQFVLTVSLRLQYNYENNSNNTRENIDQEIKEKNIEDVNETKVDIETAEASDMKPFKFVTPERAFGDFIFASLILHFVVFHFIN

SEQ ID NO: 63550 - protein, 178 aa, Arabidopsis thaliana
MSENEVKDPRIDGIKTKIRVVPDFPKKGIMFQDITTLLLDPKAFKDTIDLFVERYRDMNISVVAGIEARGFIFGSPIALAIGAKFVPLRKPKKLPGQIIFEEYELEYGSDRLEMHVEAVDSGDRALVVDDLIATGGTLCAAMNLLSKFFSFFNNISLVPKLLLSFKWLPIDSNHLPLQ

SEQ ID NO: 63551 - protein, 569 aa, Pasteurella multocida subsp. multocida str. Pm70
MFLAVKPFSALKESFRAGYTSQSLIRDIIAGLTIGVIAIPLSMALAIASGVAPQHGLYTAIVAGMIIAVTGGSRFNVSGPTAAFVVILYPITQQFGLGGLLMATLLSGLILVLMALFRLGRLIEYIPLPVTLGFTCGIGIVIATLQIKDFLGLSIVEMPAHYLEKVQTIATALPTINWADALVGIVTLLMLTQWHKLRLPIPGHLPAVIIATLLSLGLISVGQDVATIGSAFQYTLSDGTQGFGIPNALPEFILPWHIPNAQGEVITWNLETIQALLPAAFSMAVLGAIESLLCAVILDNMTDTKHHSNNELLAQGLGNIAAPFLGGITATAAIARSVANVKAGGVSPISSVVHALLVLFALLFFANALSYLPLSSMAALLLVVAWNMANVPQIIQLIRRSGRNEIAVLLTCLILTVIFDMVIAITVGVLLASLLFIRTIAEMTKSIEIAHPEDLNDVLVYRISGPLFFAAADNLFADLHDKTVNTEHEIKHIVLQCDAVTVLDTGGIHALTRFVQHMLPHQQLYMCNMQFQPLRMIVKSNTVNEIQKINFASDLSDAFNKIRVFEQQA

SEQ ID NO: 63552 - protein, 369 aa, Colwellia psychrerythraea 34H
MNLNTPQEIIADIALGKMVILMDDEDRENEGDFIMAAEKVTPAAINFMATHGRGLICMPMSREKCETLKLPLMVDKNEAQFSTNFTVSIEAATGVTTGISAADRATTVLAAANKEATHLSIVQPGHIFPLIAKDGGVLNRAGHTEASVDLARMAGFESAAVIVEILNEDGTMARRSDLEVIAQKHDIKMGTIADLIEFRNATETTIERVSQCKLPTAFGEFDLTVFKDTIDGQAHFALTKGEIKADEPTLVRVHLENTFRDLLFSQRESISTWPIANALEKIAKEGGVLVLLGKHESPNELINLVEKYAKIDAGETVKETNRHIGSRNVGVGSQILANLGVSKMRLLSSQTKYHSLSGFGLEVVEYIAD

SEQ ID NO: 63553 - protein, 216 aa, Pasteurella multocida subsp. multocida str. Pm70
MSNSSTPSCIIIAIAGASASGKSLIASTVHRELCDELGCEEIGIISEDSYYKDQSHLDMEDRIKTNYDHPNSMDRHLLIEHLKALKSGQPVDIPVYSYVEHTRTNQVQHFEPKKVIILEGILLLTDEKLRDEVSVSVFVDTPLDICFIRRLQRDMKERGRSLESVVEQYRKTVRPMFLQFIEPSKQYADIVIPRGGKNRIAINMLKAQIRQLLGKR

SEQ ID NO: 63554 - protein, 277 aa, Rhodococcus erythropolis
MARVEGQVALITGAARGQGRSHAIKLAEEGADVILVDVPNDVVDIGYPLGTADELDQTAKDVENLGRKAIVIHADVRDLESLTAEVDRAVSTLGRLDIVSANAGIASVPFLSHDIPDNTWRQMIDINLTGVWHTAKVAVPHILAGERGGSIVLTSSAAGLKGYAQISHYSAAKHGVVGLMRSLALELAPHRVRVNSLHPTQVNTPMIQNEGTYRIFSPDLENPTREDFEIASTTTNALPIPWVESVDVSNALLFLVSEDARYITGAAIPVDAGTTLK

SEQ ID NO: 63555 - protein, 338 aa, Methanosarcina barkeri str. Fusaro
MRLAVIEGDGIGREIIPAAVKVLDAFGLEFEKVPLELGYTRWERTGTAISNNDLETIKGCDAVLFGAITTVPDPNYKSVLLTIRKELDLYANVRPVKPLPGITGVTGRNDFDFIIVRENTEGLYSGIEEIGPELSWTKRVVTRKGSERIAEYACKLAKKRKNKLTIVHKSNVLKSDKLFLDVCRQTASANGVEYEDMLVDSMAYNLIMRPERYDIVVTTNLFGDILSDMCAALVGSLGLVPSANIGEKYAFFEPVHGSAPDIAGKGIANPLAAILCVKMLLEWMGEPRSQIIDEAIAYVLQKKIITPDLGGTASTMEVGNAVAEYVLSNIQDRRSPPW

SEQ ID NO: 63556 - protein, 202 aa, Oligotropha carboxidovorans
MEAIDAAGADWIHCDVMDGHFVPNISFGPDVIKAIRPRTKKVFDVHLMIAPVDPYLEAFAKAGADVITVHAEAGPHLDRSLQAIRNLGKKAGATICPATPENVLANVLDRLDLILVMSVNPGFGGQQFISSQLDKIRRIRAMIGERPIRLEVDGGVNVETAAQVAAAGADTVVAGAAVFKGGTQSAYATNIAAIRAAAGTAR

SEQ ID NO: 63557 - protein, 145 aa, Triticum aestivum
  misc_feature (58)..(58): Xaa can be any naturally occurring amino acid
  misc_feature (95)..(95): Xaa can be any naturally occurring amino acid
MSVAALRSQLNEHISYMYATGILDEYYQQLQSPQDEGFVPEVINIFLGDADRMLNDIXSLLNLPVVDFEMVCELVHQLKACNCSVGAKKVNLACXHFRQFYKGKKQKKGVSTAIESFLRKSSMNVRRANKAICNQQNCPWVLQLI

SEQ ID NO: 63558 - protein, 420 aa, Synechocystis sp. PCC 6803
MVALQIPSLAATVRQDFPILNQEINGHPLVYLDNAATSQKPRAVLEKLMHYYENDNANVHRGAHQLSVRATDAYEAVRNKVAKFINARSPREIVYTRNATEAINLVAYSWGMNNLKAGDEIITTVMEHHSNLVPWQMVAAKTGAVLKFVQLDEQESFDLEHFKTLLSEKTKLVTVVHISNTLGCVNPAEEIAQLAHQAGAKVLVDACQSAPHYPLDVQLIDCDWLVASGHKMCAPTGIGFLYGKEEILEAMPPFFGGGEMIAEVFFDHFTTGELPHKFEAGTPAIAEAIALGAAVDYLTDLGMENIHNYEVELTHYLWQGLGQIPQLRLYGPNPKHGDRAALASFNVAGLHASDVATMVDQDGIAIRSGHHCTQPLHRLFDASGSARASLYFYNTKEEIDLFLQSLQATIRFFSDDDFTV

SEQ ID NO: 63559 - protein, 194 aa, Brassica napus
MRRSSAKRDTSFLEQLILYVAGAAFTSLSLYVCARHFDPNRDAATKALKHKRELSKRLGRPLIQTNQYEDVIACDVINPQNIDVEFDSIGGLESIKQALYELVILPLKRPELFAYGKLLGPQKGVLLYGPPGTGKTMLAKAIAKESGAVFINVGVSNLMSKWFGDAQKLVAAVFSLAEKLQPAIIFIDEVDSFL

SEQ ID NO: 63560 - protein, 376 aa, Fulvimarina pelagi HTCC2506
MRAIDMPTIDHRGPTFQDLGKRVLAGIRTIFKTKNPVLIYPASGTGAWEAALVNTLSPGDLCLMYETGHFATLWKKLAERLGLRTEFIEGDWRHGADAKAIGERLQADTNHEIKAVCVVHNETSTGCVSPIKAVREAIGAAGHPALLLVDTISSLASIDYRHDEWGVDVTVGGSQKGLMLPPGLSFNAVSDKALKAQESAKLPRSYWAWDEMLAANENGFFTYTPATNLLYGLDAAIEMLHAEGLENVFARHQRHGAATRAAVEAWGLEVLCAEPTHHSGSLTAVLMPDRKGADALRKIILDRFDMSLGAGLSKVADQIFRIGHLGDFNDLTLVGTLGGVEMGLKAAGVAHKSGGVDAAMAVLGDTETASYRQAAE

SEQ ID NO: 63561 - protein, 250 aa, Arabidopsis thaliana
MNLTNLISLNLILNPPQKPRNAKMGDNGESIKWPKIKLKSNLNVSYLKNHDLFTVENCLTSDESKAFVKIAESLGFTHQGSRGPAYGEAYRDNHRISVNDPVLADTLWQSGLSNLFTDIKIRRKVAVGLNPNIRFYRYSAGQHFGRHIDESADLEDGNRTYYTLLIYLSGNSTKSKSKSSSSKTNDSSSAEPLVGGETVFYGSRNSIVAEVAPVEGMALFHIHGDKCMLHEGRNVSKGVKYVFRSDVVFA

SEQ ID NO: 63562 - protein, 320 aa, Photobacterium profundum SS9
MGKLVKGVWHDVWYDTDTSDGKFVREDAGFRHWLTANGENGPDGQQGFKAESGRYHLYVSLACPWAHRTLIFRQLKGLAPHIDVTFVSADMLEKGWVFDEPEPLYGFNFMHQVYTQAKPDYSGRVTVPVLWDKQTQTIVSNESSEIIRMFNTAFNDLTGNHDDYYPQALHPVIEQWNDYIYPAINNGVYRCGFATTQEAYEDAFSELFSALDTVDTHLATNRYLAGEQLTEADWRLFTTLIRFDAVYVGHFKCNLKRIVDYPHIQGYMKELYQFSGIAETVDFYHIKRHYYFSHTMINPTGIVPMGPALDLITLHGRDTI

SEQ ID NO: 63563 - protein, 362 aa, Oryza sativa Indica Group
MASATLLKSSFLPKKSEWGATRQAAAPKPVTVSMVVRAGAYDDELVKTAKTIASPGRGILAMDESNATCGKRLASIGLEKHRSQPPGLPDPPCHRTGLGTVHLRCYPLRGELYHSTVDGVRMVDILTEHKIVPGIKVDKGLVPSAGSNNESWCQGLDGLASREAAYYQQGARFAEWRTVVSIPNGPSELLRSFSTVSMASTGSFQVAQKVWAENFFYMAENNVMFEGILLKPSMVTPGAECKDRATPEQVSDYTLKLLHRRIPPAVPGIMFLSGGQSEVEATQNLNAMNQGPNPWHVSFSYARALQNTCLKTWGGQPENVKAAQDALLLRAKANSLAQLGKYTSDGEAAEAKEGMFVKNYVY

SEQ ID NO: 63564 - protein, 370 aa, Rhodopseudomonas palustris CGA009
MDIRAAVFREVGAALRVERIVLDPPQPTEVLVRLAAIGLCRTDYHVMRGERRVAMQPMVLGHEAAGIVEAIGDQVQGVAPGDHVVLTFIPGCGHCRWCQRGLHHLCAEGPRITHGPQLDGSFRRRDAGGRDVGAFCMIGAFAEATVVDQASVLVIDKDIPLDHASLIACGVPAGVGAARHRARVKPGDTVLVVGCGGDGMNVVQGAKLCGASMIIAADIVAQKLEWARDFGATHGTTAQGDELISTVLALTDGIGVDHAFVCINPAETLLPAFRATTKAGNVVVTAITPDTVKQIDVPPLELFATQKAIMGAVYGFASPRLQIPELLGLYRRGDLKLGELISRTYRLDEINQGYADLDAGRNLRGVVLID

SEQ ID NO: 63565 - protein, 513 aa, Chlamydomonas reinhardtii
MSLEIEATDVIKIILQFCKENGLTDSFNAIQNECQVSLNTVDSVDNLVADINNGRWDAVLPQVAQLKLPRAKLEDLYEQVVLELFELREIDTARAMLRQTQVFQRMKLDDPERYSRLEHLASRTYFDGREVYGSGSSKEKRRAAIAHALSQEVVMVPPSRMMALIGQALKWQQSQGLLPPGTAFDLFRGTVQSARDEVEAFPSVPDHEIKFTTKNHPEVARFSPDGSMLITGSVDGFIEVWDAVTGRLKKDLTYQAEEMFMMHDEAVLCLGCSRDSEMLVSGSQDGRIKVWKIRTGQCLRRFDRAHSQGVTCVSLSKDGTQVLSGSFDGTVRVHGLKSGKMLKEMRGHTSFVNDVIWGADGSQVISASSDATVRVWDAKSCECVQAFRPPQAGGGGDAAINCVALNPLNADQLLVCSRTSTVYIMTMQGQVVKSFSSGKREGGAFLAAVTSPRGEYIYCLGEDGILYCFGANSGKLEHVMNVHEKGPIGLAHHPHRNVIASYAAEGPLRTWKA

SEQ ID NO: 63566 - protein, 164 aa, Arabidopsis thaliana
MSNYAAGLGKPGSGKRRIRDLLNQPDNRVCADCGASVPKWAKYQSIHLLKSCGVHRSLGTHILKVLSVTLDEWSDEEVDSMIETGGNASANSIYEAFVPDTCSKPGPDVNHDQRMRFISLFCSFNRYLQLDGVILGADTRATEGPIVADKNCGKIHYMAPNIYC

SEQ ID NO: 63567 - protein, 354 aa, Zea mays
MCVEEPKDAERFGFGDPGVEEPAKFPLAQMERVCENTTSADFRQKLSNFVPVIRSGDWSDIGGRQYMEDTHVCIPDLAKNFGFPSLDNEVVSFYGVFDGHGGKDAAHFVCDNLPRMIVEDSDFPLQLEKVVRRSFMQIDCQFAETCSLHRASSSGTTALTAMVFGRSLLVANAGDCRAVLSRCGTAVEMSMDHRPCSLSEKLRVESLGGYVDDGYLNGLLGVTRALGDWHLEGMKGAGETGGPLSADPELKMTTLTKDDEFLIIGSDGIWDVFSNQNSVDFARKRLQEHNDVKLCCREIVEEAIRRGATDNLTAVLVSFHLEAPPRIRVDRPGRVERSISAEGLNSLRILLGRQ

SEQ ID NO: 63568 - protein, 533 aa, Physcomitrella patens subsp. patens
MTTDSEPLLRSRNLNGAGIKATGRQCHDDADRAYEKSEQINVHFGDEPDTDEEGGDIDFLPKFSWRKLWMFAGPGFLMSIAYLDPGNIESDLQSGATAGYALLWLLMWATIMGLLIQQLAARLGVATGCHLAELCREEYPVWARMVLWVMTEVAIIGADVQQVIGSAIAFRILSNGWIPLWAGVLITGIDGFLFLFLENFGVRKLELLFCVFIGIMALSFAWMFGETNPNIKAVASGLIFPSVPRKAVDKAVGIVGAVIMPHNIFLHSALVQSRDVDISKKSRVREALRYYNIESFVALFISFLINLCIMAIFAKAFFGKDEAETIGLANAGEYLQRRYGGGLFPILYIWAIGLLAAGQSSTMTGTYTGQFVMAGFLDLRVKKWIRVLVTRAVAIVPTVIVALSFDSSENELDNLSEWLNVLQSIQLPFALIPLLCLVSNKRVMGVFVITNITKVIAWTIALLVMTINMYLLFVSVFGSTVESTAASVVLGVATALYIVFVIYLVLEPAQANGNWVGIKRAFGLSRSVILLVH

SEQ ID NO: 63569 - protein, 509 aa, Zea mays
MMIARRLLRPNAPAQASSLLKHVTGTASLQGYADSLLDATVRHFGSAPSAQPEENGFKGHGMLAPFTAGWQSNDLHPLIIERSEGSYVYDINGNKYLDSLAGLWCTALGGSEPRLVKAATEQLNKLPFYHSFWNRTTKPSLDLAQEILSMFTAREMGKVFFTNSGSEANDSQVKLVWYYNNALGRPNKKKFIARSKAYHGSTLVSASLTGLPALHQKFDLPAPFVLHTDCPHYWRYHLPGETEEDFATRLATNLENLILKEGPETIAAFIAEPVMGAGGVIPPPKTYFDKVQAVVKKYDILFIADEVITAFGRLGTMFGCDYYNIKPDLVSLAKALSNAYVPIGATLVSPEISDVIHSQSNKLGSFAHGFTYSGHPVACAVAIEALKLYRERDIPGHVKQIAPKFQDGIRALADSPIIGEIRGLGMIMGTEFTNNKSPTDLFPAEWGVGAIFGEECQKRGMLVRVAGDAIMMSPTLIMTPGEVDELVRIYGEALKATEERVAALQSKKN

SEQ ID NO: 63570 - protein, 294 aa, Xylella fastidiosa Ann-1
LGESKLSLPVPMMNIINGGAHADNNVDFQEFMVLPVGFASFSEALRAGAEIFHALKSVLKGRGLSTAVGDEGGFAPDFRSNVEALDAILEAIGRAGYIAGEDVLLGLDVASSEFRDNGKYNLVGENKRLTSEQFVDFLDDLVAQYPIISIEDGLAEDDWVGWKQLTERIGHKVQLVGDDLFVTNPKVFQEGITSGIANAILIKLNQIGTLTETLESIAMAHRAQYAAIVSHRSGETEDTSIADIAVATTATQIKTGSLCRSDRVAKYNQLLRIEQALGVGVRYAGRDAFVSLKS

SEQ ID NO: 63571 - protein, 492 aa, Synechocystis sp. PCC 6803
MTNTLTSTFADLGLSEKRCQLLADIGFEAPTQIQTEAIPLLLSGRDMLAQSQTGTGKTAAFALPLMDRIDPEGDLQALILTPTRELAQQVAEAMKDFSHERRLFILNVYGGQSIERQIRSLERGVQIVVGTPGRVIDLIDRKKLKLETIQWVVLDEADEMLSMGFIDDVKTILRKTPPTRQTACFSATMPREIKELVNQFLNDPALVTVKQTQSTPTRIEQQLYHVPRGWSKAKALQPILEMEDPESAIIFVRTKQTAADLTSRLQEAGHSVDEYHGNLSQSQRERLVHRFRDGKIKLVVATDIAARGLDVNNLSHVVNFDLPDNAETYIHRIGRTGRAGKTGKAIALVEPIDRRLLRSIENRLKQQIEVCTIPNRSQVEAKRIEKLQEQLKEALTGERMASFLPLVRELSDEYDAQAIAAAALQMIYDQSCPHWMKSDWEVPEVDFNKPVLRRGRNAGGGQNKSGGGYQGKPGKPRRSSGGRRPAYSDRQQ

SEQ ID NO: 63572 - protein, 188 aa, Arabidopsis thaliana
  misc_feature (132)..(132): Xaa can be any naturally occurring amino acid
MASSMLSSAAVVTSPAQATMVAPFTGLKSSAAFPVTRKTNKDITSIASNGGRVSCMKVWPPIGKKKFETLSYLPDLSDVELAKEVDYLLRNKWIPCAEFQLQHGFVYREHGNTPGYYHGRDWDMWKLPLFGXCTHSPPVLYEAPQCQKEFPGALLKDHRDLKTPPTFQCSSFLGLQTPSFSRKPIFSF

SEQ ID NO: 63573 - protein, 329 aa, Solibacter usitatus Ellin6076
MKNLSIIGGGSWGTALAIVLASRFSKVKLWVYEEDLAVRMTAGRINDVYLPSVAIPTNVDIHHELAEVVADADIVLGVMPSHLARGMYEKMRPFIKDRMIFVSATKGLENHSLLRISEVICEVLETPRVAVISGPSFAKEVARSEPTAVVAAAADPNLAAMVQTAFSGPSFRVYTSGDPTGVEIGGSIKNVVAIGAGVLHGMGLGHNAMAALITRGLAEMTRLAVAMGGQSQTLAGLAGLGDLVLTCTGDLSRNRTLGVELAKGRKLEDIINSMKMVAEGVKTTNAAVDLAKRYSVEMPIAEQMFHMLHSGSSPQQAIRRLMERSLKGE

SEQ ID NO: 63574 - protein, 317 aa, Xylella fastidiosa Ann-1
MHSVVVVGSFSIDHVWRCDTLPTPGATIAGRYSRGPGGKGFNQAVAACRAGARTYFICALGNDTDGNMARDIATKDGFTLIGESSTEPTGTGGIYVDSHGHNTIVTGAGANAVLSTHFITEQRALITSAWIVLAQLESPIETLETALSMAREAGRLTILNAAPANATATINLLKLADVLTLNETEFVALLSRHVGERISPDNVATTDGNTLHALCNKLLSGSTVVITLGSAGVFVSHSEENLHGDTQPYYRVAAEQAHTVDTTGAGDAFNGALAASLAQQPNTAFIQHVRLANSYAARSTETEGGAVSMPILTTTSD

SEQ ID NO: 63575 - protein, 266 aa, Arabidopsis thaliana
MASVASSTTLISSPSSRVFPAKSSLSSPSVSFLRTLSSPSASASLRSGFARRSSLSSTSRRSFAVKAQADDLPLVGNKAPDFEAEAVFDQEFIKVKLSDYIGKKYVILFFYPLDFTFVCPTEITAFSDRHSEFEKLNTEVLGVSVDSVFSHLAWVQTDRKSGGLGDLNYPLISDVTKSISKSFGVLIHDQGIALRGLFIIDKEGVIQHSTINNLGIGRSVDETMRTLQALQYIQENPDEVCPAGWKPGEKSMKPDPKLSKEYFSAI

SEQ ID NO: 63576 - protein, 89 aa, Arabidopsis thaliana
WLSLFSPSTVGVTSRVKATLVGQLTAWNYSVFFRATGRANTDFLSIKGNGGRVTCLKVWPPIGKKKLETLFNLLDFRDVNWLKEVTSLF

SEQ ID NO: 63577 - protein, 1733 aa, Staphylococcus epidermidis
MKKRRQGPINKRVDFLSNKVNKYSIRKFTVGTASILVGATLMFGAADNEAKAAEDNQLESASKEEQKGSRDNENSKLNQVDLDNGSHSSEKTTNVNNATEVKKVEAPTTSDVSKPKANEAVVTNESTKPKTTEAPTVNEESIAETPKTSTTQQDSTEKNNPSLKDNLNSSSTTSKESKTDEHSTKQAQMSTNKSNLDTNDSPTQSEKTSSQANNDSTDNQSAPSKQLDSKPSEQKVYKTKFNDEPTQDVEHTTTKLKTPSVSTDSSVNDKQDYTRSAVASLGVDSNETEAITNAVRDNLDLKAASREQINEAIIAEALKKDFSNPDYGVDTPLALNRSQSKNSPHKSASPRMNLMSLAAEPNSGKNVNDKVKITNPTLSLNKSNNHANNVIWPTSNEQFNLKANYELDDSIKEGDTFTIKYGQYIRPGGLELPAIKTQLRSKDGSIVANGVYDKTTNTTTYTFTNYVDQYQNITGSFDLIATPKRETAIKDNQNYPMEVTIANEVVKKDFIVDYGNKKDNTTTAAVANVDNVNNKHNEVVYLNQNNQNPKYAKYFSTVKNGEFIPGEVKVYEVTDTNAMVDSFNPDLNSSNVKDVTSQFAPKVSADGTRVDINFARSMANGKKYIVTQAVRPTGTGNVYTEYWLTRDGTTNTNDFYRGTKSTTVTYLNGSSTAQGDNPTYSLGDYVWLDKNKNGVQDDDEKGLAGVYVTLKDSNNRELQRVTTDQSGHYQFDNLQNGTYTVEFAIPDNYTPSPANNSTNDAIDSDGERDGTRKVVVAKGTINNADNMTVDTGFYLTPKYNVGDYVWEDTNKDGIQDDNEKGISGVKVTLKNKNGDTIGTTTTDSNGKYEFTGLENGDYTIEFETPEGYTPTKQNSGSDEGKDSNGTKTTVTVKDADNKTIDSGFYKPTYNLGDYVWEDTNKDGIQDDSEKGISGVKVTLKDKNGNAIGTTTTDASGHYQFKGLENGSYTVEFETPSGYTPTKANSGQDITVDSNGITTTGIINGADNLTIDSGFYKTPKYSVGDYVWEDTNKDGIQDDNEKGISGVKVTLKDEKGNIISTTTTDENGKYQFDNLDSGNYIIHFEKPEGMTQTTANSGNDDEKDADGEDVRVTITDHDDFSIDNGYFDDDSDSDSDADSDSDSDSDSDADSDSDADSDSDADSDSDSDSDSDADSDSDSDSDSDSDSDSDADSDSDSDSDSDADSDSDSDSDSDSDSDSDSDSDSDSDSDSDSDSDSDSDSDSDSDADSDSDADSDSDSDSDSDADSDSDSDSDSDADSDSDSDSDSDSDSDSDADSDSDSDSDSDSDSDSDSDSDSDSDSDSDADSDSDSDSDSDSDSDSDSDSDSDSDSDSDADSDADSDSDADSDSDADSDSDSDSDSDADSDSDSDSDSDSDSDSDSDSDSDSDSDSDSDSDSDADSDSDSDSDSDSDSDSDADSDSDSDSDSDADSDSDSDSDSDADSDSDSDSDSDADSDSDSDSDSDSDSDSDADSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDADSDSDSDSDSDADSDSDSDSDSDSDSDSDSDSDSDSDSDSDSDSDSDSDSDSDSDSDSDSDSDSDKNAKDKLPDTGANEDHDSKGTLLGTLFAGLGALLLGRRRKKDNKEK

SEQ ID NO: 63578 - protein, 224 aa, Helianthus annuus
NDFFDYVLEELKQNDTMLTEATALDLMFALLFANFETTSQAITVAIKFLTHNPRALKELTEEHQKILRKRENPKLDLHGKNIVDEIYLQVINETLRLASIVPVLFRKAKKDIKFKGYTIPSGWAVMVCPPAVHLDPVNYKDPLDFNPWRWEDMDLKSASKTFMAFGGGQRFCVGADFAKLQIAIFLHCLVTKYQWQPIKGGDIVRTPGLQFPNGFHVRIFEKET

SEQ ID NO: 63579 - protein, 469 aa, Escherichia coli
MKRNVTAVILAGGVGSRLWPLSREKRPKQFISIDGKNSLLSNTLKRLPELNIENVIVVCNFEHRFLVAETLRKHDLLNNNIILEPCGRNTAAAIAMAALHVNKIFGSEQHLLILAADHVINNIANFSKAYFDGYDLSQLNKLVTFGVVPTYPETGYGYIRIGAEINKSSYEIECFVEKPDLALAEQFLATKNYLWNSGMFLFKANFFLEELRKYRDDILACCIESYDCSVIDEDFIKIPTAVFSKCASESIDYAIMEKSSARAVVPLDAGWSDVGSWDSIWHLASKDSLGNVLDGDILALETHGSYIRSESRLIATYGVNDLIVVDSDDALLITSKNKSQHVKYIVELLKKKNRPEIISGLKELRYWGEITTVLSQNEYKINLLTLKPGKEISYQIHSQRIECWYILKGEASIIVDDKSFKYNASDFVLIKPGCKHKVQNLTPEPILIIEIQHGNLNDECDVERLIAEG

SEQ ID NO: 63580 - protein, 409 aa, Staphylococcus epidermidis RP62A
MSLRDDALEMHRENQGKLEITPNVKVTNKQQLSLAYSPGVAEPCKEIHEDSRKVYEYTIKGNTVAVVTDGTAVLGLGNIGAEASIPVMEGKAALFKSFAGINGVPIALDTTDTQEIIKTVKLIAPNYGGINLEDISAPRCFEIEETLKKETNIPIFHDDQHGTAIVTMAGLINALKIVDKELTDIKVVLNGAGAAGIAIVKLLHAYGVNNMIMCDSKGAIYSGRNFGMNDTKTYVAKWTNKDKVEGSLEEVIKDADVFIGVSVVDILTQDMVKTMADDPIIFAMANPNPEINPNEAKQAGAKVVGTGRSDFPNQINNVLAFPGIFRGALDVEATHINEDMKKAAVEAIVHLIDENELHPDYCIPGPFDKRVAPSVAKNVAKAAMESGVARIKIDTQEIFDKTMKLTDLK

SEQ ID NO: 63581 - protein, 487 aa, Burkholderia pseudomallei K96243
MGIKHWIGGREVDSPETFTTFNPATGEPIAEVASGGAQEIDAAVRAAKDAFPKWAGTPAKERAKLMRRLGELIERNVPALADLETRDTGLPISQTRKQLIPRASENFHFFAEVCTRMNGRSYPVDDQMLNYTLYQPVGVCALVSPWNVPFMTATWKTAPCLALGNTAVLKMSELSPLTADQLGRLALEAGIPAGVLNVVQGYGATAGDALVRHPDVRAVSFTGGTVTGKRIMERAGLKKYSMELGGKSPVLIFDDADFDRALDASLFTIFSINGERCTAGSRIFVQRTIYDRFVAEFARRANNLIVGDPADESTQVGSMITRAHWEKVTGYVRLGVEEGARLVAGGPDKPANLPAHLANGNFVRPSVFADVDNRMRIAQEEIFGPVVCLIPFDGEEHGLRLANDTAYGLASYLWTRDVGRAHRLARGIEAGMVFVNSQNVRDLRQPFGGVKESGTGREGGEYSFEVFAEIKNVCLSMGSHHIPRWGV

SEQ ID NO: 63582 - protein, 336 aa, Pichia minuta
MAYNVGINGFGRIGRLVLRIALSRKDINVVAVNDPFIAAEYAAYMFKYDSTHGRYQGEVTFEGKYLVIDGQKIEVFQERDPADIPWGKEGVDFVIDSTGVFTTTAGAQKHIDAGAKKVIITAPSADAPMFVMGVNHKEYTKDLSIVSNASCTTNCLAPLAKVVNDVFGIESGLMTTVHSITATQKTVDGPSHKDWRGGRTASGNIIPSSTGAAKAVGKVLPALAGKLTGMSLRVPTTDVSVVDLTVNLKTPTTYAEISAAIKKASEGELAGILGYTEDAVVSTDFLTDNRSSIFDASAGILLTPTFVKLISWYDNEYGYSTRVVDLLEHVAKVSSA

SEQ ID NO: 63583 - protein, 679 aa, Physcomitrella patens subsp. patens
MVGVWVQTKSRIVTSAVPDQAGEYPAEKPPTPLLDTINYPIHMKNLTVRELKQLADEVRAETIHTVSKTGGHLGSSLGVVELTVALHHVFNCPEDKFLWDVGHQAYPHKILTGRRDRMHTLRQTDGLSGFVKRAESEYDAFGAGHSSTSISAGLGMAVGRDLKGKKNNVIAVIGDGAMTAGQAYEAMNNAGYLDCNMIVILNDNKQVSLPTATLDGPAPPVGALSSALSRLQSSRPLRELREVAKGVTKQLGGPAHVLASKVDEYARGMISGSGSTLFEELGLYYIGPVDGHNMDDLVTILREVKNTSTTGPVLIHLVTEKGRGYPYAERAADKYHGVVKFDPATGKQNKVKAATQAYTTYFAEALIAEAEVDKDIIGIHAAMGGGTGMNMFAKRFPERCFDVGIAEQHAVTFAAGLACEGLKPFCSIYSSFLQRGYDQVVHDVDLQKLPVRFAMDRAGLVGADGPTHCGAFDVTYMACLPNMVVMAPADEAELFHMVATAAQIDDRPSCFRYPRGNGIGAQLPENNKGIPVEIGKGRILLEGTEVALLGYGTMVQNCLAARALLADLGVAATVADARFCKPLDRDLIRQLAKNHQVIITVEEGSIGGFGSHVAQFMALDGLLDGKLKASLLPLVLPDRYIEHGAPKDQYAEAGLTAGHIAATALNVLGKTREALQVMT

SEQ ID NO: 63584 - protein, 309 aa, Streptococcus pyogenes serotype M18
MIYLAGGCFWGVEEYFSQVDGVLDAVSGYANGRGDTTNYQLIHQTGHAETVEVAYDTNRISLKELLLHFFRIIDPTSLNKQGNDRGSQYRTGIYYTDKADLAIIDEVFKEKAKDYKKKIVVEKAPLKHFIKAEDYHQDYLKKNPNGYCHIDINQATYPVIDESKYPKPSATEIKEKLSADEYRVTQKNETEKAFSNRYWDSFDAGIYVDVVTGEPLFSSKDKFESGCGWPSFSRPISPDVVRYKEDKSFNMTRTEVRSRSGNSHLGHVFTDGPKDQGGLRYCINSLSITFIPKADMEAKGYGYLLSSVE

SEQ ID NO: 63585 - protein, 324 aa, Frankia sp. EAN1pec
MRAIRLHAFGPAENLVCEDVPDLLPAEGQVRIDVQASGVHLIETRLRRGVGVGPHLPPELPTTLGGEVAGVVGAVGSGVGTGWLGRRVVAQLGAGGGYAEQAVASADSVHVLPEHLDAETAVAVVTNGATAQGVLGVANLTTDDVVLVMSAAGGLGSLFVQAAHHAGVTVVGVAGGDARAARARELGADVAVDYQDADWPALVREALDGRAVSVVLDGVGGVLGRQALELLGPGGRFLMYGWAAGEPTAITTRDLVERELTATWAIGPNATPSGGWRELAARALEEAAAGRLVPLMTRFLLERAADAHSALEAREAEGKVVLTI

SEQ ID NO: 63586 - protein, 456 aa, Synechocystis sp. PCC 6803
MNTAKTVVAEQRDFFRQGKTKSVQDRLTALAKLKTQIQAQEEEIIKALKQDFGKPTFESYVNEILGVIREINYYQKHLQQWSKPQRVGTNLMVFPASAQLRPEPLGVVLIISPWNYPFYLCLMPLIGAIAAGNCVVVKPSEYTPAISGVITRLIQNVFSPAWATVVEGDETISQQLLQEKFDHIFFTGSPRVGRLIMAAAAEQLTPVTLELGGKSPCVVDREINLQETAKRIMWGKLVNAGQTCVAPDYLLVEQSCLEQLLPALQQAIQMLFGENPAHSPDYTRIVNQQQWSRLVSLLSHGKVITRGDHNEGDRYIAPTLIIDPDLNSPLMQEEIFGPILPILTYQSLSEAIDFINIKPKPLALYFFSNNRQKQEEILQSTSSGSVCLNDILLHLTVTDLPFGGVGESGMGRYHGKATFDTLSNYKSILRRPFWGETNLRYSPYGKKMNLIKKLFS

SEQ ID NO: 63587 - protein, 324 aa, Lactobacillus sakei subsp. sakei 23K
MQTRKIIIDCDPGIDDTLALNLAIQSPEVEVVALTIVCGNVPVEIGVDNAFKCLERLGRLDIPVYAGAAQPLKKTFVSAQDTHGMDGLGDSHIPRQTTTKAAEQSAADFLATTFKAPCDISIIALGPLTNIATALTLNPQLGANCARFVSMGGTYKSHGNCSPVAEFNYWSDPEAALAVYEHLNQKIEMIGLDITREIVFTPTLLAYCQRINPEVGDYLAAITQFYFDFHWQYEHIIGCVINDPLAVAYFIDPTLCQGFESYTTVETTGISIGQTLVDRFDFWHRPINSLILTEVDTNRFFEQFLTVVLNAQASIIKTDLKKLR

SEQ ID NO: 63588 - protein, 473 aa, Pichia pastoris
MSALTALRVTRPLLRFPAARVSLNLFARGYASKSWPEHTVIDMPALSPTMTQGNIVKWHKAVGDQLEPGESIAEVETDKASMDFEFQEDGYLAKILLGDGTQEIPVGKPIAVYVEDKADVEAFESFTIEDAGAPAAAAALAKEEPKEEPKEAATPAPSSEESKSEAKPSSSKQPRPAGSRIIASPLAKTIALEKGISLKEITGTGPNGRIVAKDVESYKPKSTAAPAAPVSSPAPSTATAAYQDIPLTNMRKVISKRLTESKQSAPNYIISSSISVSKLLKLRASLNASSNDRYKISVNDLLIKAIAVACKRVPEANAYYLEQEGVIRQFENVDVSVAVATPTGLITPIVFNADSKGLETISKTVKDLGKRAKENKLKPEEFQGGTITISNLGMNPSVSFFTSILNPPQSAIIAIGTTEKKAVPDKGSPHGFVFDDVIQITGTFDHRTVDGAKGGEWVRALKQIVENPLELLL

SEQ ID NO: 63589 - protein, 284 aa, Zea mays
MAACSHLAAAGGSSPAAAAVVRSPAHSSAAAAFARLRSTLRFSSAGLSVKGSRATFPWVAAAGPAAAAPVADLDGRPATEKQPIIVIDNYDSFTYNLCQYMGELGLNFEVYRNDELTIEDVKRKNPRGILISPGPGEPQDSGISLQTVLELGPTIPIFGVCMGLQCIGEAFGGKIIRAPSGVMHGKSSPVYYDEELGKALFNGLPNPFTAARYHSLVIEKETFPHDALEATAWTEDGLIMAARHKKYKHIQGVQFHPESIITPEGKKIILNFIRFIEELEKQRS

SEQ ID NO: 63590 - protein, 228 aa, Zea mays
QIGWTAVAVGCRELEYIAAYVSDITNGALESIGTFCKNLYDFRLVLLDKQKKITDQPLDNGVRALLRNCVKLRRFAFYLRPGGLSDVGLGYIGLYSGNIQYMLLGNVGESDNGLIQFATGCTNLRKLELRGCCFSERALAVAVLQMPSLRYIWVQGYRASRTGQDLMLMARPYWNIEFAPPIPESAYRVMADGQPCVDTHAQVLAYYSLAGRRPDCPQWLGTLPPASL

SEQ ID NO: 63591 - protein, 358 aa, Propionibacterium acnes KPA171202
MQHILILAGGSGTRLWPLSHQGEPKQLLELIDGVSLLRMAYERVAGLVPDANILVCTGSSYADTVAKLLPEVPAENILGEPVGRDSLSAVAWPAGIIADRDPDGVMAVVTADHIIRPVDDFRAALQHGFDLANTDPTALVTFGVVPTEPNTGFGYLHRGGRLRPGSRAHQVLEFVEKPSAEVARQYLDSGEYWWNSGMFVWRAATLLDCLSQLKPQTRHHVDELVADPSRLAEVYPCMEKVSVDIAVMEPASHGGCGVHVAAIPLEIQWYDVGSYEALAPHLPSDGMGNNVSGLTVSVDSAGNLLINDRPDAVLAVAGLHDMAVVSTDRATLVVPMSQSQQVKAVVAEVAARVGARYA

SEQ ID NO: 63592 - protein, 393 aa, Staphylococcus epidermidis RP62A
MQFDTIELAIEALRNGESIIVVDDEDRENEGDLVAVTEWMDDNTINFMAREGRGLICAPIDKSIAERLKLQSMEQNNTDIYGTHFTVSIDHYKTTTGISAHERTQTARALIDENTNPEDFHRPGHLFPLIAKENGVLTRNGHTEAAVDLARLTGAQPAGVICEIMNDDGTMAKGEDLQSFKERHHLKMITIKSLVAFRKAVELNVNLKAKVKMPTDFGHFDMYGFTTNYSDEEIVAIVKGDLKSNPNVRMHSACLTGDIFHSQRCDCGAQLEASMKYIDEHGGMIIYLPQEGRGIGLINKLRAYELIEKGYDTVTANLALGFDEDLRDYHVAAEILKYFDISEINLLSNNPKKFEGLEDYGIEIVDRIELIVPETQYNHSYMETKKNKMGHLI

SEQ ID NO: 63593 - protein, 365 aa, Bradyrhizobium japonicum USDA 110
MIAPALQFWGNVMQLIVLPGDGIGPEITTATSGVLRAASERFQLNLRLEEHAVGHASLKQFGTTVRPELLDIVRGADGLILGPTATFDFKDEAHGEINPSRHFRKNLDLYANVRPARTYAGRPGRLGDFDLVVVRENTEGFYADRNMEQGNGEMLVTPDVAISLRRITRACCERIAHAACRLAMKRRRHLTIVHKANVLKIGDGMFLDICRAAAKGYAGLEVDDILVDAMMAHVVRNPDRFDVIVATNMFGDILSDLTAELSGSLGLGGSLNVGDRYAMAQAAHGSAPDIAGQDVANPVSLILSTALLLAWHGERSGAVRYEEAARAIEAAVAKAIGEGRATRDVGGRLGTIAAGAAIAEILQGA

SEQ ID NO: 63594 - protein, 502 aa, Medicago sativa
MGSCFSTESRSPHPNSPSSSSSSFRKNRKNSKKKLGSRASSFEYWRNEPLHKIHDRIFLNGSSEFASLFTQQGKKGTNQDAMVVWENFCSREDTIFCGVFDGHGPYGHMVAKRVRDSLPLKLNTQWELNVSGDDVLKEISINAAGSMILEDATFASADEESRVSIDAEEMEKLPEIFHTLKESFLKAFKVMDRELKMHQTIDCFCSGTTAVTLVKQGRDLIIGNVGDSRAVLGTREKDDSLVAVQLTVDLKPNLPAEAERIRKCKGRVFALHDEPEVCRVWLPNSDSPGLAMARAFGDFCLKDFGLISVPEVSYRRLTEKDEFVVMATDGIWDVLSNKEVVDIIAAAPRRATAARSLVETAVRAWRYKYPTSKVDDCAVVCLFLDKGMQKISTASHANKSKEHRPSSGIQVSYNGDNEEDVSGPNALERSGTCRKGNDNNNISHEDKEEEEFKEEEEIDPELEKEWSALEGVSRVNTLLNLPRFVPDKEDKAAAAARSKKLK

SEQ ID NO: 63595 - protein, 445 aa, Bradyrhizobium japonicum USDA 110
MRRGDIGSCDRVDPSGKTLAGCDAGGDRGLGHGAFSSRAMWASDRTAARLLRPTLRQINTRLAGPPDPSISASMERAADMQTLLREIRNTPLLWMLVFVPIVLLAEAAAPHSHTLLFVLAVLAIVPLAALLSHATEAVAAKTGDAVGGLLNATLGNLTELIIAITALRAGQYMLVKASIAGAIVTNAVFMLGACLLLGGLRYHVQEYNRAGARLSSGLLLMATVALLAPSAVADLEHLPQGGGILNKLSVGISVLLIIAYALGLLFSLGTHKELFASADHGDDKEAHWPIGIAVGTLLVVTVLVALVSEIFVESVQKAAETFGMSPAFVGFIIVSLVGAAAEFAVAFGAARKDRLDMVVSIALGSASQIALFVAPALVLLSYVVGPTPMNLQFWPGAVTMVMIATVTSAFITASGRSAWFVGALMIFIYAVFALTLYVVPPAGEG

SEQ ID NO: 63596 - protein, 556 aa, Synechocystis sp. PCC 6803
MATTLLSPTRFVHGLRFDNLRGDIFGGITAAIVALPLALAFGVASGAGPIAGLYGAICTGFFAALFGGTPAQISGPTGPMTVVMASTFANLTASNPENGWAMALTVVMFGGIFQVVLGLLGLGKYITFMPYTVISGFMSGIGVIIVILQIAPLLGHQTAPGVVPSLQAIPTYLNDVNFAALGLGLIALAIVFFSPPRLNRILPAPLIALVLGTIISMIFFGNVSLPRIGEIPSGLPSLHLPYLSWGSLQQMLLYSIMLAVLGSLDSLLTSLVADNISRSHHDSDRELVGQGIGNLVSGLCGGLPGAGATMRTVININSGGKTPIAGMIHALILLMIVLKAGQLTEPIPHAVLAGILIKVGIDIVDWSFLKRAHQLSTKGAGLMYLVLGLTVFVDLITAVAVGVFVANLFTVKNLTDLQLESIKSVTRADGEDWLLEEEQQILRAANGRIFMFHLSGPMSFGAAKSIARRLAIVENYDVLILDLATVPRLGVTALLAIETMLKDALAKQREVFLVGAKGQVQARLQRLPVLAQLSPHHRLESRLLALQMAAVCINVD

SEQ ID NO: 63597 - protein, 540 aa, Aspergillus oryzae
MGQTHSSNSHEGAGSDVNQPEEKKVDYYELLQVERNASGEERALELHPDRNYGNVEAATRLFAEIQTAYEVLSDAQERAWYDSHRDVFLGNDGKPEGADYSYDTRMTTSDEILKLFSKFSPRMEFTDAPTGFYGALRETFAQLALEETMACRWENVACVKYPTFGNCNADPEEVVRPFYAAWGSFATKKSFAWKNVYRYSEAPDRRVRRLMEKENKRLREDAIREFNEAVRSLVAFVKKRDPRYKSNTQSESQRQEFLRQSAAAQATRSRAANQAKLRDHVMQDWAKAETLGDESSDTSEDEVEYFECVVCHKTFKSHNQFEVHERSKKHIKAVKQLRWEMRAQNEELGLKGNVSDPEEPHWENSAYSIPQDGPVHNMESSVQQPRDGETRNGIGTDKYTSSDTRVDTKPDEGSLPHTDCHRDSIPDLSEADYVPRECVERRLGSQPTLIQRTGEMESPDNLSQRFSATEIEDSQTSPPKVGKAKQKRAKKAQRAMNQLQHIKCATCYAIFPSRSQLFIHIHEFDHAQPSNMGDVQRRGQ

SEQ ID NO: 63598 - protein, 271 aa, Amycolatopsis orientalis
MQRNFKEFKITVDPVRDDFLRAKGPGQRNLLLGRAVFEFASDLEHLDTIQQEFVDGSHRPLIRRNWQDSTADYSDPTQLLIQGQQVMQNWERPLMKVLAENAAANGGDLLEVGFGMGISATYVQDAGVRSHTLIEINSEVKAEFEKWRAQWPDRDIRLELGAWQDVLGGLGQYDAILYDTYPTDEREFARTLGPKAIVLAAEFFEHAAAHLRPGGVFSYYTNEIDSLSRAHQRALLEHFSSFRVEVVRDLKPPADCTYWWAGTMAAVTAVK

SEQ ID NO: 63599 - protein, 644 aa, Mycobacterium smegmatis str. MC2 155
MNESNDRIDTTLVGRLARQLRADAIRASTAAGSGHPTSSMSAADLTAVLLARHLSYDWERPDHPDNDHFILSKGHASPLLYAAFKAVGVITDTELMTGYRRFGSRLQGHPTPVLPWVDVASGSLGQGIAIGVGVALAGKFLDRSGFHVWTLCGDSEMAEGSVWEALDKAGYYGLSNFTVIVDVNRLGQRGPTEFGWDLETYAKRVEAFGARAISVDGHRLEAIDQALTAARNTTQPTVILARTVKGRGFSEVEDREGWHGKAFPPEMARRALAELGEVEGLTVAGPKPASRSGQSSAPGAGNPDGFSDRPRYAPGEKVATRAAYGAAVAALGAVNRRVVALDGEVSNSTGAAEFTEHHPERYFEMFIAEQQLVASSVGLHVRHYIPFASTFAAFLTRAHDFIRMAAVSQANICLIGSHAGVEIGADGPSQMALEDLAMMRSVHGATVLYPSDATSTVALVDLMADADGVRYLRTTRGAYPVLYEPATVFTIGGSHTLRSSSADDVTLIGAGVTVHQCLAAAESLHRDGIAARVIDVYSVKPIDRDTLLEAVRDTGARLVIAEDHHPEGGLGSAVLEAISGAETPRLKLMHLAVRAMPGSGTPAELLADAAIDAASIDKAARHLLQADDGRSDDGRSDDDETLTA

SEQ ID NO: 63600 - protein, 762 aa, Oryza sativa Japonica Group
MNHKHSFSALCAAMILNVIILFVDSYVAVASDTLFPGQSLSGSETLVSENGIFELGLFPSAPAGTKHYLGIRYKNMSSNNPITFWLGNRIPITYFINATLYIDAGKLYIEELGSILWTSNSTRNESNTAVAVILNTGNFVIRDQLNSSVVTWQSFDHPADKLLPGAYLGLDMVMGTNILLTLFKPPYNCTLMIDQSRKRGFIMFIDGHDKYLGTFPEWMVTYEENGSLVRLNDPGIPNDTEYMKLQLGQLSLLRWLDNATISGWQSVWSHPSSCKVSAFHCGAFGICTSTGTCKCIDGFRPTEPNEWELGHFGSGCSRITPSNCLGVVSTDLFVLLDNLQGLPYNPQDVMAATSEECRAICLSECYCAAYSYHSACKIWYSMLFNLTSADNPPYTEIYMRIGSPSKRRMHILVFVLIFGSIGVILFLLMLLLMYKRSSCVARQTKMEGFLAVYSYAQVKKATRNFSDKLGEGSFGSVFKGTIAGSTIVAVKKLKGLGHTEKQFRTEVQTVGMIQHNNLVRLLGFCTRGTRRLLVYEYMPNGSLDSHPFSETSRVLGWNLRHQIVVGIARGLAYLHEECRDSIIHCDIKPENILLDAEFCPKIADFGMAKLLGREFSAALTTIRGTIGYLAPEWISGQAITHKADVYSFGVVLFEIISGRRSTEKIRHGNHWYFPLYAAAKVNEGDVLCLLDDRIEGNASLKELDVACRVACWCIQDDEIHRPSMRKVIHMLEGVVDVELPPIPASFQNLMDDYDSDIYSVEV

SEQ ID NO: 63601 - protein, 257 aa, marine gamma proteobacterium HTCC2143
MTAKGKPEIGLGLWKVPKSQCADVVYNAIKLGYRHLDSACDYGNEIEVGQGITRAIADGLCQREDLYVVSKLWNTYHSKEHVQPALEKTLADLGLDYLDSYLIHFPIAQPFVPFETRYPPEWIEDPLASEPAMKTAPVPLFETWQAMENLVEQGLVKTIGVCNYSSGLLNDLMAYATIKPSDLQIESHPYLTQERLIRLANDYGIAVTAFSPLGALSYFELEMADELESVLIQPVVLAAAKRLEKTPAQVVLRWGLQ

SEQ ID NO: 63602 - protein, 204 aa, Oryza sativa
  misc_feature (168)..(168): Xaa can be any naturally occurring amino acid
  misc_feature (186)..(186): Xaa can be any naturally occurring amino acid
MSGVTKIAIGGIALASALGTYVGMTYMLTAHGYRFDIGWYLTSITPFMWACTGIALAIALSVVGAAAGIYSTGASIIGGGVKAPRIRTKNLVSIIFCEAVAIYGIIMAIVLSNNIESSASDIMSTKNYNSGYKLFGAGLTVGFSNLFCGISIGVVGSGAALADAQNSXLFVKILIVEIFRLAIGLXFGLIVSILQSSGAFMGDQ

SEQ ID NO: 63603 - protein, 181 aa, Mycoplasma penetrans HF-2
MKLNVTIEIPKKSNVKYEYDRKTNQISVDRILFGTEVYPHNYGFIKEALDWDGDELDALVIADQSFLPGIIVPAKIIGAMEMIDDGETDTKLISVIDCDPRYKHINNLSDLGEHTLKEIQNFFETYKLLQNKKVVIKGFKDSAWATKEYNECVELMKKYGKMDKDEFVNKMKKEHPEKYKA

SEQ ID NO: 63604 - protein, 371 aa, Alkaliphilus metalliredigens QYMF
MKDVMGIVNDIKIKRDLRDLVSHRSTAAVPFGGRYRVVDFVLSNMANGGIKNVGIFTQSNNRSLLDHVDSGKAWDLFNKRGGLFILPPTFSYERFGNRLGDIDHFYNHMDYLERSTQQYVLISNSNSIYNMDYSKIKEAYEKSGADIVILYQRKKEWDSSIKYVSMIMDEKSKIVDMSVNKLIGNNSFKDMGVAFMKKELFMEIIRECHSKGLNDFVKDGLIKNTKKYNMYGMPYDGYVANIDSINNYYKHNMNLLKPEIWKQLFFKEGLINTKVKDEAPSKYNKTAKVSNSLVANGCIIEGEVINSILFRGVKVGKNVTVKNSILMQKNVIHEGCQLEHVILDKDVVVTEGKVLKGDEGYPFVVSKKTVL

SEQ ID NO: 63605 - protein, 139 aa, Gibberella zeae PH-1
MRSIDPVGNVAGVVHRTALPRISIAISDIAIGLLRLLIFHQSLNMSYKVTIKTPNEDYTFNCGSDEYILDVAESNGIKLPYSCRAGVYSSCAGKLVSGTIQQDDQDFLDSDQVEAGYVLLCIAYPTSDCIIKANAEDEL

SEQ ID NO: 63606 - protein, 371 aa, Alkaliphilus metalliredigens QYMF
MKKECIAMILAGGQGTRLGMLTKNIAKPALPFGGKYRIIDFTLSNCSNSGIDTVGVLTQYEPLVLNSYIGIGSHWDLDKKSGGVMVLPPYVKENGGNWYRGTADAVYQNLDFVEHYEPEYLLVLSGDHIYKMDYSAMLKHHKEKQADATIAVIRVPSEETYRFGIMNTDEEERIIEFQEKPENAKSDLASMGVYIFNWKKLKKHLIEEDQNPDSSLDFGKNIIPKMLNEGEKLFAYGFQGYWKDVGTVESYWEANMDLIEDDASLDLHERNWIIYSVNPSQPPQYIGPSAKVTESLLNEGCQIFGEVSHSVIFPGVYIGKGAVVKDSVIMANAIIGDHAKIEKSIIAEKAIIQKKEIIGDNKKNDITVVAT

SEQ ID NO: 63607 - protein, 281 aa, Pisum sativum
MASATSSLCSSTLQSQINGLSLRKTSLLHSPSLTFSRRKFSTVVKASSRVDKFSKSDIIVSPSILSANFAKLGEQVKAVELAGCDWIHIDVMDGRFVPNITIGPLVVDALRPVTDLPLDVHLMIVEPDQRVPDFIKAGADIISVHCEQSSTIHLHRAVNQVKSLGAKAGVVLNPGTPLSAIEYVLDVVDLVLIMSVNPGFGGQSFIESHVKKIAELRRLCVEKGVNPWIEVDGGVTPANAYKVIEAGANALVAGSAVFGAKDYAEAIKGIKASKRPEPVAV

SEQ ID NO: 63608 - protein, 524 aa, Propionibacterium acnes KPA171202
MEIDIHTTAGKIADLGRRIDEAVNAASPSAIEKQHATGKMTARERILRLLDEDSFTELDEFARHRSTNFGMDRKRPYTDGVITGVGAIHGRPVCVFSQDVTIFGGSLGEVYGEKICKIIDFAVKTGCPLIGINEGGGARIQEGVASLARFGDIFRRNTRASGVIPQISIIMGAAAGGHVYSPALTDFIVMVDQTSQMFITGPAVVKQVTGEDVSLEELGGARTHSVKSGNSHYLANDEDDALEFVRDLISYLPQNNLEDPPFYDDGEADLTITDHDRKLDVLIPDSSHQPYDMHEVITTVLDEDTFLEIHELFAPNVICGFGRIEGRAIGIVANQPMINAGTLDIDASEKAARFVRTCDSFNIPVLTFVDTPGFLPGVEQEHDGIIRRGAKLIYAYAEATVPLLTVVTRKAYGGAYIVMGSKTLGADVNLAWPTAQIAVMGAEGAVSILHRRTLAMDPDPQAKRKELIDEYETTLSNPYQAAERGWIDQVIHPHETRASVIRTLRLLRTKRETLPPKKHGNIPL

SEQ ID NO: 63609 - protein, 261 aa, Pisum sativum
MAGLFVNQGKEYAIARPSYPPQLFQFIASKLLLTTLFGMSPPEGQAAKSLANLYKNVIATDVSEKQLEFATKLPNVQYQHTPSTMSIPEVEQIVAQQGTIDLVTIAQGLHWFNLPNFYEQVKFVLKKPHGVIAAWCYFLPRISDEVDIVLDQFYYSDANPYWDSARKLVEDNIRSIDFPFEAVDGVDHTGPFEFVTETLMSFDGLLTYIRSWSAYQTAKEKGVELLREDVVEKFKVAWGEDHAPKTAKFPIYLRIGKVRNV

SEQ ID NO: 63610 - protein, 234 aa, Geobacillus stearothermophilus
MRQSKEERVHRVFENISAHYDRMNSVISFRRHLKWRKDVMRRMNVQKGKKALDVCCGTADWTIALAEAVGPEGKVYGLDFSENMLKVGEQKVKARGLHNVKLIHGNAMQLPFPDNSFDYVTIGFGLRNVPDYMTVLKEMHRVTKPGGITVCLETSQPTLFGFRQLYYFYFRFIMPLFGKLLAKSYEEYSWLQESAREFPGRDELAEMFRAAGFVDVEVKPYTFGVAAMHLGYKR

SEQ ID NO: 63611 - protein, 497 aa, Escherichia coli
LEPRHAMLLRCRLPGGVITTKQWQAIDKFAGENTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGVETFKAEVERRAGIKFEPIRPYEFTGRGDRIGWVKGIDDNWHLTLFIENGRILDYPARPLKTGLLEIAKIHKGDFRITANQNLIIAGVPESEKAKIEKIAKESGLMNAVTPQRENSMACVSFPTCPLAMAEAERFLPSFIDNIDNLMAKHGVSDEHIVMRVTGCPNGCGRAMLAEVGLVGKAPGRYNLHLGGNRIGTRIPRMYKENITEPEILASLDELIGRWAKEREAGEGFGDFTVRAGIIRPVLDPARDLWD

SEQ ID NO: 63612 - protein, 452 aa, Vibrio vulnificus YJ016
MNRVGDVMSSNTKKIGLIACTGVVAGNMMGSGIALLPSTLASVGSISIFSWAICIVGALSLAFVFARLATKNPQEGGPIAYAGEVSPVFGFQTGVLYYHANWIGNLAIAITGVSYLSVFFPVLNDPIPAGLATIASVWVFTLVNLLGGSWVSRLCTVGLVLILVPVLGTALFGWTHFDSAIYSQNWNVSAGSDGHAIITAVLICLWSFVGVESAAVSSGMVENPKRTVPLATMLGTAIAGVIYVLSTQMISGMFPASEVAASGAPFALATTELFGSWTAPFVSAFTALACFTSLGSWMMLVSEAGKRAANDGNFPKVFGETDKNGVPKKGLVIASSMMTMLMLVLMFFSSETAHASDMFNQLTTDAVLLTMLPYFYSSINLIRFEGMTTRNTFVMLFSGIASLFCMVALAGAEGSTLTATFIMSLIILMFYSKKTGLAQYMAAHPEEASAQH

SEQ ID NO: 63613 - protein, 463 aa, Aspergillus oryzae
MAFRLPFHRLPEQNLRVIPRYAQSPRNISLGTRRNLTSAALRSCVRNTKRPASCIPQVLGANVFRSSFAPLGGYQVRTYADTIVKVPQMAESITEGTLKQFSKQVGDYVERDEEIATIETDKIDVSVNAPEAGTIKELLVNEEDTVTVGQELAKLELGGAPETKTEEATEKPKEPASTEEPKAPEPEQPKSAKDSEKPAASEPGSSKQPQPAASKPDIPDDAKPSPGNREERRVKMNRMRLRIAERLKQSQNTAASLTTFNEVDMSSLMEFRKLYKDDVLKKTGVKLGFMSAFSRACVLAMKDIPAVNASIEGPNGGDTIVYRDYVDISVAVATEKGLVTPVVRNAETMDLVGIEKAIADLGKKARDNKLTIEDMAGGSFTISNGGVFGSLMGTPIINLPQTAVLGLHAIKEKPVAVNGKIEIRPMMYLALTYDHRLLDGREAVTFLVKVKEYIEDPRRMLLG

SEQ ID NO: 63614 - protein, 288 aa, Methanosarcina acetivorans C2A
MVETTSFLNFLETVGVLGTLIFVLTSMLGMGFSLTVQQILAPLSNRKLVILSLAANFILVPLLALGVLLIFPLSEGLSIGLFLLGTSAGAPFLPKLAQVAKGDTAFAVGLMVLLMVVTIFYVPIVLPLFLSGVTISPWDIAKSLILLMLLPLVLALFIRARHEEIASGLLPLMTQATNLSLLVLFVAFFVVYLSDLISVIGSTAVLAAAVFLLISFIIGYFLGGSAGPVKRVLALGTAQRNLSAALAISALNFTDPDVMVMIMVVALAGLILLMFIGGELGKRAEKLA

SEQ ID NO: 63615 - protein, 313 aa, Methanosarcina acetivorans C2A
MLRQREGLQNCLLLIGLPLTIGAGAATAAFLFPDLILAEAALLGAILAPTDAGLGQLIVNNPKVPVRIRQGLNIESGLNDGGAIPFFIFFLVLANGEELNKPIGTIFSLAIEHIGFGALVGIFLGLLGEWLSRRAVKASWTSGLYHRIGFLTLAVISWLVADTVGGSGFVAAFLAGMVSEAMGRKVEKEEIIFTEAEGNILSLAVFFIFGVAAATRLPDIGFPEVVYAVLSLTVILIVPVAIYLIGTKLHRETVLFLGWFGPRGLASVVLLLIAMEEAKGIPGLETINLAVRVFLIFSGFSSISRQPQNFIPI

SEQ ID NO: 63616 - protein, 322 aa, Synechocystis sp. PCC 6803
MEQPMKPTVIITGASSGVGLYGAKALIDKGWHVIMACRNLDKTQKVADELGFPKDSYTIIKLDLGYLDSVRRFVAQFRELGRPLKALVCNAAVYFPLLDEPLWSADDYELSVATNHLGHFLLCNLLLEDLKACPDADKRLIILGTVTANSKELGGKIPIPAPPDLGNFEGFEAGFKKPIAMINNKKFKSGKAYKDSKLCNMLTTRELHRRFHQETGIVFNSLYPGCVADTPLFRNHYSLFRTIFPWFQKNVTKGYVSQELAGERVAMVVADDKFKDSGVHWSWGNRQQAGREAFVQELSEQGSDAQKAQRMWDLSEKLVGLV

SEQ ID NO: 63617 - protein, 407 aa, Synechocystis sp. PCC 6803
MPMALWGIVSINQSSPTRRASTMGIFNRRRLLLGGVALGGAFTIGREERHRQEIRELQALAKAQAANTDRTSMLNAAFEADAEKIYRGEEIINSVRLTPPILPYDRQISQLLIRCSKIATQQYLTGKTIPSYDGNIRQLPAYSSDLDEYKQIASFRGREAHISESVAVQIPLDNTGDPLDKTWDQAEDSLGETIRQVVKVTQEIPVYLGFILSSPRRNLIVFRGTQTTMEWVNNLRAQQIPFTERRSGQYFGKIHQGFIENYLRIVSPIPREIAQQLDPAVPCYVTGHSLGASLAVLAALDLAVNLPNLRSQIQLYSYACPRVGDVTFAQLHSRQVPNSYRIVNLADVIPLLPPTTGLGTYVHVGQSWSFLSQGGDILPNHVVDTYQGAVDREVETDQSRDYPIAAV

SEQ ID NO: 63618 - protein, 188 aa, Physcomitrella patens subsp. patens
MATERVTQETTSQTPEGPVMCKNVCGFFGSQATMGLCSKCYRETVMQAKMTAVAEQATQAAQVLPSAASSAQPPVLMEEDKSSFEADSMLIQPPQSSSHHPVEVAPVTVAPQVVVAPVATPSRPAPNRCGSCRKRVGLTGFQCRCGHLFCALHRYSDKHSCTYDYKAAGQEAIAKANPLVVAEKVVKF

SEQ ID NO: 63619 - protein, 474 aa, Prochlorococcus marinus str. AS9601
MLKKKVKNICCIGAGYVGGPTMAVIADNCNYLNITVVDINEERISKWNSSDFDNLPVYEPGLKEIIKRVRNRNLFFTIDLKNSIKNADMIFISVNTPTKTSGFGAGYASDLKWVEASARQVAQNAVGHTIVIEKSTLPVRTAKVIKQILISSFDEEFENKTEKSFSILSNPEFLAEGTAIEDLNNPDRVLIGGDEEDSINALKNIYEKWVPEDKIITTNLWSSELSKLAANAFLAQRISSINSISAICEATGAEVNEVSNAIGFDSRIGFKFLSAGPGFGGSCFKKDILNLVYLCRYFGLNEVAEYWEQVVKFNEWHTKRISKLIVEKLFDTVALKKILILGFSYKANTNDTRESPAIKIVKDLLENGAEIIISDPQVDPDIIALDLGIEENVFKNGSGQGKWRYHKDIYEAAMGVDAVVIITEWKVYKSLSWHKLVKVMRKPAWLFDTRSITNYEELKDLDINYWSIGNSNYC

SEQ ID NO: 63620 - protein, 243 aa, Desulfococcus oleovorans Hxd3
MKKTGPVQNEAQHASAIQTMFDAIAPRYDFLNRFLSLRRDVYWRKRMISAVMRPGAWVRTLLDVACGTGDVAIEAVRQGSGELSVWGADFSCAMLAAGKNKVAPFKDQIHLVAADAFFLPFRDDSFDAITIAFGIRNIADKPAALKGFYRHLRKGGVLAVLELTTPQKGFLKSLYLFYFKRILPLIGWVVSKNMGAYQYLPASVMGFPPSPEFATMMEQAGFADIAWHPLTFGIATLYVGYKK

SEQ ID NO: 63621 - protein, 365 aa, Desulfococcus oleovorans Hxd3
MAVKRDYYEILGVARDVSATELKKQYRKIALKCHPDKNPGNKEAEDQFKEASEAYAVLCDPEKRQIYDQYGHAGLEGLGNGRGAGFDDIFSSFGDIFEDFFGFGSGRRSRRGPRKGEDLRYDLTIDFLEAAFGKQTEIELEKLEPCSACEGTGCAEGTQPETCRHCGGTGQATRSQGFFVVKTTCPACRGTGRMIASPCARCRGNGREMVRKTVSLKIPAGVDTGSRLRLSGEGEAGDPGGRPGDLYVFINVRPHEFFQRNNNDVVCIMEISFVQASLGATISVPTLTGERELEIPKGTQYGDIFRFKGEGIASLRSGNRGDQIIQVEIKTPTRLNKKQEELLTEFSRLESDKIGNKLKNLFKRR

SEQ ID NO: 63622 - protein, 428 aa, Pfiesteria piscicida
MKWGDVGGSGSKDVPIAKDAARGAEIGGRGAAVAPSIGQSESSGSFQKLCGEVLLDLPKHLVAVKQVGKGAYGEVFLCKDERTQGQVAVKVIRDFTKDLLFGKRIFREVKILMALQHENLMRLIDLPAVPSPDFNVVYMVMPYMLADLHRMIYSSLKLVESHCQAFTCQILRGLKYLHSAGIVHRDLKPANIMVNKNCTLRITDFGLARGRCDDEEVLTDYVVTRWYRAPELMLVPSSYFEAIDLWSVGCIHFECVARTVLFPGEHHFDMLKKIADTLGMFTPEGVAWCPQDQKGEVDTMLNKLEDLRSKELNSLASRLPEASEVCLDLLLKLLDKVPSTRISAAEALEHPYLQHLRDPAGETVAKRPFAWDFDVFEPSERALKDRIYAECARIHPEIITRDAKYLMDRGFKVPAQRPSPADEKPDGS

SEQ ID NO: 63623 - protein, 449 aa, Solibacter usitatus Ellin6076
MNIDLAPYISHLDRVNPLRWTGQVTQVVGLLIESRGPSVAIGDFCEVKTASGRRIHTQVIGFRDGRVLSMPLEEIDGLQLGDPLAARSEDARVEVGPGLLGRVIDGFGKPMDTGPAINARESYSLHGTPTNPLDRQHITQPLVTGIRAIDALLPCGKGQRIGIFGGSGVGKSTLLGSMSRNNSADVTVIAMIGERNREVRGFLENELGPEGRKRSVVVCATSERPAPLRVRACFVSLAIAEYFRDQGANVLLVMDSVTRLAMAQREIGLAAGEPPSQKGYTPSVFNLLPKVLERAGNFGRGSITGFFTVLVEGDDFNEPICDAVRGILDGHFILSRDLGAQGHYPAIDILHSVSRLTSAIATPAQKEAARKIRAALAAYRDAEDLIQLGAYVSGSNPDLDASIHLRPELLDFLRQDHLVVSTLEETLRRLEALATQLQHLPATQAGNKR

SEQ ID NO: 63624 - protein, 542 aa, Mycobacterium smegmatis str. MC2 155
MTSVTEPSAEHQVDIHTTAGKLADLKRRTEETLHPVGEAAVDKVHAKGKLTARERILALLDEGSFVELDALAKHRSTNFGLEKNRPLGDGVITGYGTIDGRDVCIFSQDATVFGGSLGEVYGEKIVKVQELAIKTGRPLIGINDGAGARIQEGVVSLGLYSRIFHNNIKASGVIPQISLIMGAAAGGHVYSPALTDFVVMVDQTSQMFITGPDVIKTVTGEDVTMEELGGAHTHMAKSGTAHYVASGEQDAFDYVRDLLSYLPPNNYADPPLYPVAIPEGSIEETLTDEDLELDTLIPDSPNQPYDMHEVITRILDDDEFLEVQAGYAGNIVVGFGRVEGRPVGIVANQPTQFAGCLDINASEKAARFIRTCDCFNIPIVLLVDVPGFLPGTDQEYNGIIRRGAKLLYAYGEATVAKVTVITRKSYGGAYCVMGSKDMGADVVVAWPTAQIAVMGASGAVGFVYRQQLKEAAKNGEDVDALRLELQQTYEDTLVNPYIAAERGYVDAVIPPSHTRGYVANALRLLERKIVQMPPKKHGNIPL

SEQ ID NO: 63625 - protein, 146 aa, Arabidopsis thaliana
MHSSLETTAPATLERRESNLGDKLILKGLKFYGFHGAIAEERTLGQMFLVDIDAWVSLKKAGESDNLEDTISYVDIFSLAKEIVEGSPRNLLETVAELIASKTLEKFHQINAVRVKLSKPNVALIKSTIDYLGVDIFRQRNTSSKN

SEQ ID NO: 63626 - protein, 367 aa, Vibrio vulnificus YJ016
MTLNKLSPIITCRCLLDSVILLPVIFNQKLSCGATIMTIKVGINGFGRIGRFVFRAAQERADIEVVGINDLIDVDYMAYMLKYDSTHGRFNGTVEVEGGNLIVNGKTVRVTAERNPEDLKWDAIGVDVVAEATGLFLDDATARKHITAGAKKVVLTGPSKDATPMFVMGVNHTSYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKNGASYEAICAAMKEASEGELKGVLGYTEDAVVSQDFIGEVQTSVFDAKAGIALTDNFVKVVSWYDNEIGYSNKVLDLIAHISK

SEQ ID NO: 63627 - protein, 287 aa, Zea mays
  misc_feature (12)..(12): Xaa can be any naturally occurring amino acid
TFRLMHVQGLPXWTNTSSVTIQDVIQGEVLLAVLSNYMVDIDWLLTACPSLRKVPHVLVLHGQDGASLELMKKLKPANWILHRPPLPISFGTHHSKAMLLVYPQGIRIVVHTANLIHVDWNSKSQGLWMQDFPWKDTVDMNKKTAFENDLVDYLSALKWPEFRVNLPGVGDVNINAAFFRKFDYSNSMVRLIGSVPGYHVGSNIRKWGHMKLRNVLDEIMFNKQFCKSPLIYQFSSLGSLDEKWMSEFACSLSAGKSDDGSQLGIGKPLIVWPTVEDVRCSIEVEEA

SEQ ID NO: 63628 - protein, 384 aa, Thermoanaerobacter tengcongensis MB4
MPKKDLYEILGVDRNASQEEIKKAYRRLAKKYHPDLNPGDKEAEQKFKEINEAYEILSDPQKRAQYDQFGHAAFEQGGSQQGGFGDFGEGGFDFDFGGFGDIFGDIFSDFFGTGRRKAEKGPKKGADIRYDLTLTFEEAAFGTEKEIEVERFEVCDVCHGTGVKPGSRPETCPVCHGTGEIRQTQNTPFGRIVNIRTCPRCHGEGKIITDPCQKCGGTGKIRKRRKIKVTIPAGIDEGQMLTLRGEGEPGLRGGPNGDLYIVIHVKPHEIFKREGYDVYVKIPISFADAALGGEIKIPTLDGMVSFTIPEGTQTGTKFKLRGKGIPHIGGRGRGDQIVEVYVEVPKRLSEKQKELLREFKRLEGENTAEHKSFFQRMRDAFGGS

SEQ ID NO: 63629 - protein, 469 aa, Oceanobacter sp. RED65
MIQMGNPMSKLKTLKWIAERHQFKSQPVVSGRLTRMVGLTLEAVGCNVKVGDRCHVEQGSEFIEAQVVGFDEDKFFLMPVEPANSLSPGAKVTPILDSAEIPVGDMLLGRVINGAGKPLDGKGDLVSQNTLNLDGSIINPMQRAPIRQTMDVGIRAINGLLTVGRGQRMGLFAGSGVGKSVLLGMMTRFSTADIIVVGLVGERGREVQEFIQDILGEEGMKRAVVVASPADDSPVMRMRAADLSTAIAEYFRDEGKDVLLLMDSLTRYGQAQREIALAVGEPPATKGYPPSVFAKIPKLVERAGNGPEGGGSITAFYTVLTEGDDLQDPIADSARAILDGHVVLARRLAEEGQYPAIDIEASISRAMPQIVSKASLQNAQKFKHLYSLYRQNMDLISVGAYSPGNNPELDHAVRLHPIMRTFIMQELDESMSLADSQEGLDLILQHGHAYQQGGQQGNQQEQHQLQPGQ

SEQ ID NO: 63630 - protein, 385 aa, Oryza sativa Japonica Group
MARPAARGIVAGAAASTVPLPRAGVASPCPTARSLGFAARGTDPRLAIHVSSRRRAASASAGSRLARAVATMAKKSVGDLAAADLEGKRVLLRADLNVPLDASQNITDDTRVIAAIPTIKHLIGNGAKVILCSHLGRPKGITPKFSLAPLVPRLSELLGIQVQKADDVIGPEVEKSVSVLPNGSVLLLENVRFYKEEEKNDPEFAKKLASLADLYELDYLVGAVSNPKRPFAAIVGGSKVSSKIGVIESLLEKCDILLLGGGMIFTFYKAQGFPVGASLVEDDKLELATSLLAKAKEKGVSLMLPTDVIVADKFAPEANCQAIAKKLAELSGKGVTTIIGGKDSVAAVEKVGVANVMSHISTGGGASLELLEGKELPGVVALDEA

SEQ ID NO: 63631 - protein, 393 aa, Brassica napus
MATTVFSKLSKIFFLFAIYCALDPFKHSSISKYPVFQTYKIDMPPLSSLPKERDHENLLQNSEIKFLNEVQGPESIAFDPLGRGPYTGVADGRILFWDGTRWTDFAYTSNNRSELCDTKSSLLAYLKNEHICGRPLGLRFHKRTGDLYVADAYFGIMKVGPEGGLATSLTTEADGVPLRFTNDLDVDEEGNVYFTDSSSVFQRRNFMHLIVSGEDTGRVLKYNPETKETTTLLRNLQFPNGLSLGRDGSFFIFCEGSIGRLRKYWLKGEKAGTSEVVALLHGFPDNIRTNKDGDFWVAVHCHRNIFTHVMAHHPNVRKFFLKLPITVKFQYLLQVGGWPHAVAVKYSEDGKVLKVLEDKQGKVVKAVSEIEEKDGKLWMGSVLMSFMAVYDLP

SEQ ID NO: 63632 - protein, 369 aa, Aspergillus oryzae
MTLRVKRRRLSRQPTMVNQLDNSANDPCRPATAQEKEKWNGFCELESEPVIVFIGNQFPFPIQTTSNACASVALLNIVNNIEGLELGDNLQHFKDFTMPFTPALRGDAISNFDFVKRIHNSFARKMDMLNSDLQLKNEATSRRSRSSKGNHDETEMDAGFHFIAFVPALGKVWKFDGLERQPQALGPCTPNEDWLGLVKPHLITRMTEYEEDQIEFSILSLVRDPLVDLIGKLAVNIKCLELLNQRLTTQAPAVAHSELPFASRILENTILGPDKSFDMTRESIDQAIVPVVLERYNLFSAQEIVDFQQKLCNEQQALRAAIRDEQQTQRADDDYAAGRRYDYGPAIRTWVRFLARKGVIESLIPMGEV

SEQ ID NO: 63633 - protein, 159 aa, Magnetococcus sp. MC-1
MNIRVGQGFDVHRWIEGRPLMLGGIEVPHNQGLLGHSDADVLLHAICDALLGAMGRGDIGRHFPDNDPHYAGIASIKLVKHVYGYMQEQGWQLINLDATVICQQPKLAPHIPRMETVIAAALGCDVEQVNVKATTTEKLGFTGRNEGVAAQCVVLLQRP

SEQ ID NO: 63634 - protein, 342 aa, Prochlorococcus marinus str. AS9601
MNNNRILITGAAGFIGSALILRLLENEKTIIGVDNLNNYYDVRLKKSRLKLITEKSKKLKANWIFHEFHIEDKKSLDFITEKYSPSIVIHLAAQAGVRYSLDNPKSYADSNLIGFFNILEFCKENKVKNFVFASSSSVYGLNKKIPFVEDDNVDHPISFYAATKKSNELMAHSYSHLYDIPTTGLRFFTVYGPFGRPDMAPMIFANAILNSKPINIFNYGNLHRDFTYIDDIVNGLFGCCYKPAIKSENFSSNYQNKSYSNAPFQIFNIGNSNPIKIDYFISMLELNFNKKAIINLMPLQPGDVKFTYADISKIQKWIGYKPKVSFEKGIREFSKWYLDFYE

SEQ ID NO: 63635 - protein, 480 aa, Prochlorococcus marinus str. AS9601
MNSKVIIPVILCGGSGSRLWPLSRKSLPKQFLSLNPENKKSLLQQTYQRVKNIKNCSGPIIICNEEHRFIVAEQMREIKIKPTAIILEPFGRNTCPAITLACLEAIKYSKDPFLLILSSDHIVQSEKKFQEVISKGTNYAEQGRIVTFGIIPKSPQTGFGYIESEYPFKENSLDGHNIIRFIEKPDLKTAKKFIKDRKFVWNSGIFLFQPSVILKEIQKFNPEIIKCCKKSLSNKEIDLDFTRINQEEFSKCPNLSIDFSIMEKTDLGTVLPLDAGWDDIGSWESLWQISKKDSKGNVFQGNVIGEKTENCYLRSENRLIVGLGIKDLITIETRDAILVADKQKSQDVKDIVSLLKKSNIPEGLTHKKVYRPWGNYLSLVEDSKWQVKLISVNPGEKLSLQRHKFRAEHWVVVEGVAKVEIDKKVLILEDNQSTFIPVGAKHRLSNCGKEILNIIEVQSGTYLGEDDIERFEDNYGRLNS

SEQ ID NO: 63636 - protein, 424 aa, Pasteurella multocida subsp. multocida str. Pm70
MNIEKLKIGIIGLGYVGLPIAVEFGKKVPTVGFDINEKRVKSLASGKDYTLEVSEEELQHASKLRYTNQTKGLEECNFFIVTVPTPIDHYKQPDLNPLIKASETIAEVLKKGDVVVYESTVYPGATEEICVPVLEKMSGLKFNHDFFVGYSPERINPGDKEHRVTNILKITSGSTPLVANYIDFVYKLIIKAGTHQAPSIKVAEAAKVIENTQRDVNIALINELALIFNKMGIDTEDVLNAAGTKWNFLPFKPGLVGGHCIGVDPYYLTHKAQSLGLHPEIILAARRLNDRMGEYVATQLIKEMVKKDIPVVNSKILVMGLSFKENCPDIRNTKIIDLVNSLKEYDIDIDIYDPWVDKYEAEAEYGLTPITEIHSHNYDAIIIAVAHQQFKCMTEKDFKALGKENFVLYDLKYVLDQSQANIRL

SEQ ID NO: 63637 - protein, 195 aa, Polaromonas sp. JS666
MKLKTCLILSALIVGASVQAAQDPAAKPAEPAKVSVLQKAEEGAKKAAAEAREATHKAAEAAQRAAEKAEQAVSDTSQKAADAARQAAQEADEAAKKAVRKTAEATKKATVATKEAAQKAEEAAKKAAAATKEAAQKAGEAAKKAAKSGKEAAQKAAEATRDAAQNAWEATREAADKALETTKETARDIKDAVTK

SEQ ID NO: 63638 - protein, 414 aa, Arabidopsis thaliana
MLTAGNGIESETRPDTVANGQDLLKDEIVSEHLTRNIQFFGLESQHKVTGSYVVVIGLGGVGSHAASMLLRSGVGKLLLVDFDQVSLSSLNRHAVATRADVGIPKAMCLKKHFSSIFPECHIEAKVMLYDSSSEEEILSGKPDFVLDCIDNIDTKVGLLAACVKRGLKVLSATGAGARADPTRIRVADIRESTIDPLSRSVRHRLRRKHGIEGGIPVVFSLEKPKAKLLPFEGTNGEDENPLDYQVVPGFRVRIIPVLGTIPAIFGQIMASYVITQLAGVQVQMEPIVNLDLDHYRLLHQRLIEHEETVYGTSAEVEVDVEEVMYIVKELWHGRSARDETAKDVGRGMWRAMNELMLVRWDAKKPATVSNLVLLKFKEADEHETKTLEEVKESETEFFERVSCVLKKAELDFYG

SEQ ID NO: 63639 - protein, 450 aa, Mycobacterium smegmatis str. MC2 155
MTATLTGGPDLQQARRILTEIPGPRSRDLAERRNAALPAGLASGAGVYIAAAGGGVVVDVDGNSFIDLGSGIAVTTVGNAAPAVVSRAGSQLAQYTHTCFLNVPYEPYIEVAERLNALTPGDHQKRTALFSTGAEAVENAVKYARAYTGRDAVVVFDHAFHGRSLLTMTMTAKNQPYKHGFGPFAPEVYRAPMAYPYRWPSGPENCAAEAFDLFTTLIDAQIGADQVACVVVEPIQGEGGFIVPAEGFLQKVADFCRERGILVVADEVQTGIARTGAWFACEHEDLVPDLITTAKGLGGGLPLAAVTGRAEIMDAAHAGGIGGTYAGNPVACAAALGVFDEIEQNGLIERARAIGEVIVAELRSIAATTGLIGEIRGRGAMIAVELIKPGTREPNKEAVAALAKHCHDNGVLTLTAGTFGNVLRFLPPLTITDELLVDAFGVIRDGFAAL

SEQ ID NO: 63640 - protein, 583 aa, Oryza sativa
MSSKSPLQSMPGQAAKPKGTGEQGGDAEVVSEERTPSDQQQGSPVSTLDKELSGLSSESGILDDSLVAEEEDSGELKEIQNLDCNGNQEKKTSQKSSTSDSFASAKVSDGTNSLRKTSGSAKTSDRANFTESGKSSMCRASTSSDISDESSRSSMSSATTKPHKGNDSRWEAIQTVKTKDGILGLNHFRLLKKLGSGDIGSVYLSELSGTRSYFAMKVMDKASLASRKKLLRSQTELEILQSLDHPFLPTLYTHFETDKFSCLVMEFCPGGDLHTLRQRQPGKHFSEQAAKFYVAEVLLALEYLHMLGIIYRDLKPENVLVREDGHIMLSDFDLSLRCSVSPTVIKSANPGLDALQRNNAAYCVQPACIEPSCIQPSCVAPTTCFGPRFFKSKSKSKSKKEKSKPEAANQASLFPELIAEPTDARSMSFVGTHEYLAPEIIKGEGHGSAVDWWTFGIFLYELLFGKTPFKGSGNRATLFNVVGQPLRFPESPIVSFSARDMIRGLLVKDPQHRLGYKRGATEIKQHPFFEGVNWALIRCASPPDIPKPVELDCRPKQVPSTNGKVAPASNQKGSDNYLEFEFF

SEQ ID NO: 63641 - protein, 143 aa, Lactobacillus sakei subsp. sakei 23K
MSDDLRQQLTPEQYVVTQENATEMPFSGEYDEFDQPGIYVDVVSHEPLFSSLDKYDAGCGWPSFTRPIVKLNEKRDRTHGMERVEVRSQNADSHLGHVFTDGPQEQGGLRYCINSAALKFIPKDDLKAAGYGEYLALFEKEGQ

SEQ ID NO: 63642 - protein, 670 aa, Arabidopsis thaliana
MSDLPLDLVEEILSRVSATSLKRLRSTCKQWNTLFKKRSFSQKHFHIAPKESMVLMLKEYRVCSMNINLNVSPPSVEFQGTLGIKDDSHSNLGQVEIVEVYHCDGLLLCATRDNRLVVWNPCLGETRWIQLKDECRRYSTFALGYENNKFCRRNYKILRYWGWFHDHIPDDGGRFRFEIYDFRSDSWKVLDDVPDDRFPPVSVVSLKGNTYWFGSNKKDFLRSFDFTTERFNHIGLPPSRDHGFMALSVVGEEQLSVLQEIETSKMEIFVTNKVGTEEAALLWSKSFIVDLPIGGHCSEVFASLLINEEKKVALCCNLDFETDGNLIFTIGEDNKYYSEIPYATNKPWCRRYGAKLMETAVTHSHLLNPRVPLVTENIRVPAMGVVRVFSKMTFEKKKTTEEKGSSGGKADQGNKGEQLIVSYWGVKPMKITKEDGTEWKWSCFRPWETYKSDLTIDLKKHHVPSTLPDKLAYWTVKSLRWPTDLFFQRRYGCRAMMLETVAAVPGMVGGMLVHCKSLRRFEQSGGWIKALLEEAENERMHLMTFMEVAKPNWYERALVIAVQGIFFNAYFLGYLISPKFAHRMVGYLEEEAIHSYTEFLKELDNGNIENVPAPAIAIDYWRLEADATLRDVVMVVRADEAHHRDVNHYASDIHYQGRELKEAPAPIGYH

SEQ ID NO: 63643 - protein, 417 aa, Alkaliphilus metalliredigens QYMF
MFIFLPFPCILITNTKDSKYKDKDDVYMNLQEESLKLHEEKVGKIEVTSKVSVKNRHDLSVAYTPGVAEPCKRINEHKDNVYKYTSKGNLVAVVTDGTAVLGLGDIGPEAAMPVMEGKAILFKEFANVDAFPICLDTKDVEEIVRTVKLMAPTFGGINLEDIAAPRCFEIEKRLKEELDIPVFHDDQHGTAIVVVAGLINALKVANKKMEDATIVVNGAGSAGVAITNMLLNMNPKDILLCDRAGILYPGAPENNSSKEEMAKITNKSVRKGDLKTAMTNADVFIGVSAGNVVTEEMVKSMNKDAIIFAMANPIPEIMPDVATKAGAKVVGSGRSDFPNQVNNVLAFPGIFRGALDVRATDINEEMKLAAAYGIASIIEEKDLTAEYVIPDAFDQRVVEKVAAAVAKAAIESGVAKK

SEQ ID NO: 63644 - protein, 157 aa, Nostoc punctiforme PCC 73102
MTKKLHEPLLVVEDSNEDFRMLQRLMRLMSVQNPIHRCTNGDEVLEFLYQQGSDAHSKGENLPNSKVALRPSVILLDLNLPGIDGRDILDRLKQDKSFKEIPIVVFTTSSNPKDIELCYQKGANGYLVKPMDAQELKKTIQAFVDYWLDANMPPVLD

SEQ ID NO: 63645 - protein, 441 aa, Chlamydophila pneumoniae CWL029
MIENDFPEASNFESSHFYRDKVGVIILCGGEGKRLSPLTNCRCKPTVSFGGRYKLIDIPISHAISAGFSKIFVIGQYLTYTLQQHLFKTYFYHGVLQDQIHLLAPEARQGDQIWYQGTADAIRKNLLYFEDTEIEYFLILSGDQLYNMDFRSIVDTAIRTHVDMVLVAQPIPEKDAYRMGVLDIDSEGKLIDFYEKPQEKEVLKRFQLSSEDRRIHKLTEDSGDFLGSMGIYLFRRDSLFSLLREEEGNDFGKHLIQAQMKRGQVQTLLYNGYWADIGTIESYYEANIALTQKPHAEKRGLNCYDDNGMIYSKNHHLPGAIITDSMISSSLLCEGCVINTSHVSRSVLGIRSKIGENSVVDQSIIMGNARYGSPSMPSLGIGKDCEIRKAIIDENCCIGNGVKLQNLKGYIKYDSPDKKLFVRDNIIIVPQGTHIPDNYIF

SEQ ID NO: 63646 - protein, 459 aa, Propionibacterium acnes KPA171202
MTSMVIIGAGPGGYEAASVAAAGGVDVTVVEETGIGGAAVLTDCVPSKTLIATAEVTSTLRRAAELGLRHTETFEVDLDAVNSRVRQLAQAQSDDISRGLERKGVRLISGRARLATGAPGHLHRVVINDDETIDADIVLLATGTTPRELPAARCDGERILTWKQVYSMREVPEHLIVVGSGVTGAEFASAYDSLGCPVTLVSSRDQVLPGEDPDAAQVLQQVFESRGMEILSRSRAVSAIRDGDGVVVGLEDGRTVRGSHVFMAVGSTPNSADLGLEEVGVAVGPRGHITVDKVSRTNVPGIYAAGDCTGVFALASVAAMQGRIAVWHALGQALQPLDLSLVCSNVFTSPEIATVGVTQTDVDSGKVQARSTRLDLSTNPRAKMQGLHDGFVKLFCRPATGNIIGGVVVSPRASELIHPISVAVAERIPVDAFQHDFTVYPSLSGSVSEAARRLQTFVA

SEQ ID NO: 63647 - protein, 158 aa, Glycine max
TLNGGANFVALGYTKGDGLGAEIVGTFVLVYTVFSATDAKRNARDSHVPILAPLPIGFAVFLVHLATIPITGTGINPARSLGAAIIFNKDLGWDDHWIFWVGPFIGAALAALYHQVVIREVIQSNQVGNTKKNQNNVSGFRFHFIKMICLSFFFLILI

SEQ ID NO: 63648 - protein, 177 aa, Magnetospirillum magnetotacticum MS-1
FCASGSSSSPAPLEDQGASLIVAQLLFLEAENPKKEISFYINSPGGVVTSGLSIYDTMQFIRCPVTTLCVGQAASMGSLLLAAGEAGHRFALPNARIMVHQPSGGFQGQATDILIHAREIEALKKRLNEIYVKHTGRDYETIHQALERDNFMTADAAKEFGLIDDILHKRPETAATA

SEQ ID NO: 63649 - protein, 249 aa, Brassica napus
  misc_feature (128)..(128): Xaa can be any naturally occurring amino acid
  misc_feature (191)..(191): Xaa can be any naturally occurring amino acid
  misc_feature (198)..(198): Xaa can be any naturally occurring amino acid
  misc_feature (204)..(204): Xaa can be any naturally occurring amino acid
  misc_feature (215)..(215): Xaa can be any naturally occurring amino acid
  misc_feature (218)..(218): Xaa can be any naturally occurring amino acid
  misc_feature (220)..(225): Xaa can be any naturally occurring amino acid
  misc_feature (229)..(229): Xaa can be any naturally occurring amino acid
  misc_feature (236)..(236): Xaa can be any naturally occurring amino acid
  misc_feature (241)..(242): Xaa can be any naturally occurring amino acid
  misc_feature (245)..(245): Xaa can be any naturally occurring amino acid
MATITAVKARQIFDSRGNPTVEVDVHTSSGVKVTAAVPSGASTGIYEALELRDGGSDYLGKGVSKAVGNVNSIIGPALIGKDPTQQTAIDNFMVHELDGTQNEWGWCKQKLGANAILAVSLAVCRAGXAVGSGIPLYKHIANLAGNPKIVLPVPGLQRNSNGGSHAGNKLAYARKFMISPLVGASSFKTLXKKGGGVXVTPNLXKSGIKKKKKLXQDXQXXXXXXKKGXFCPQTSXKKKGXXPLXIGLN

SEQ ID NO: 63650 - protein, 467 aa, Vitis vinifera
MSCMHVFPNSSVSQANTVHRVFKLEGGRTLVQVNGQRAVSACLNVEVKAPKSANLGKLGFGESKDVMEMEGRVIVGTYARTPIVLVSGKGCKLYDAEGREYLDMSSGIAVNSLGHGDPTWLKAVIEQANTLTHVSNIYYSIPQVELAKRLVACSFSDRVFFSNSGTEANEAAIKFARKFQRHSHPDAKEPPTDFIAFTNSFHGRTMGALALTSKEHYRSPFEPVMPGVTFVEYGNIEATKELIQKGKTAAVFVEPIQGEGGIYSATKEFLQFLRSACDDAGVLLVFDEVQCGLGRTGHLWAHESYGVFPDIMTLAKPLAGGLPIGAVLVTERVASAINFGDHGSTFAGSPLVCNAALAVLEKISEPSFLASVAKKGQYLKQILTQKLGHNPHVKEVRGFGLIVGIELDVQASPLVVACQEAGLLVLTSGKGNVVRLVPPLIITEEELELAAEVLSGSLPALDGSNSK

SEQ ID NO: 63651 - protein, 295 aa, Nostoc punctiforme PCC 73102
MQKNQVRKAVIPVAGFGTRLFPATKVVKKELFPIIDRDGRAKPVILAIIEEAISAGIAEVGIVVQPDDREIFEDLLKNPPKKELFKKLSPQNQEYSRYLEDLGSKITFLLQEEQLGYGHAVFCAKDWVQDEPFLLMLGDHVYASDIQKSCASQLLDVYEQVNQSVVSLTTTPAEILHTAGCVTGVWQELNSILEVTQLYEKPTIEYAQQHLHVEGMAENEFLCIFGLYLLSPKIFDFLAEHINQNLRERGEFQLTSSLDRLRQEEGITGYVVKGKCFDTGLPDTYRQTMIDFRNF

SEQ ID NO: 63652 - protein, 325 aa, Thermoanaerobacter tengcongensis MB4
MGKVAVIFTGGTIAMKQDPNLKGAVPSLTGKDLLEIIPHRENVLEIETIEFGNYPSPHLTVELLEELREVVEKTLKRDEIKGVVITHGTDTLEETAYFLELTTNFDKPIVLTGAMKNSSEAGYDGPSNLIDSLTTASSEKSKKRGVLVVLNGEIHSAKDVTKTHTSSLDTFKSPETGPLGYVDSGNVYFYRNVEKRQYIPTKKLERRVSLLKVVFGMDDKLIRFLVENGERGIVIEGTGRGNVPPKVAEGIKYAISKGTVVVLVSRCPMGRVHPSYAYEGGGKHLESLGVIFGGNLSGQKARVKLMAALAYTSDYRKIREIFEEE

SEQ ID NO: 63653 - protein, 513 aa, Arabidopsis thaliana
MTTTEFQSCFIFLLLCLFSLVCYSLFFRKPSSRRDAHGCDLPPSPPSLPVIGHLHLILSSLVHKSFQKISSNYGPLLHLRIFNVPIVLVSSASVAYDIFRVHDLNVSSRGSPPFEESLLFGSTGFISAPYGDYFKFMKKHLVTKLLGPQALERSRLIRTNELERFYINLLDKATKKESVEIGKEAMKLSNNSICKMIMGRSCLEEKGEAERVRGLIIESFYLTKKFFLAFTLRGLLEKLGISLFKKEIMGVSRRFDDLLERYLREHEEKPDNEHQDTDMIDALLAAYRDEKAEYKITRNQIKAFLVDIFIAGTDISALTTQGTMAEIINNPNIFVRIREEIDSVVGKSRLIQETDLPKLPYLQAVVKEGLRLHPPTPLMVREFQEGCKVKGFYIPASTTLVVNGYAVMRDPNVWEDPEEFKPERFLASSRLMQEDEIREQALKYIAFGSGRRGCPGANVAYIFVGTAIGMMVQCFDWRINGEKVDMKEAIGGLNLTLAHPLKCTPVARFPKPF

SEQ ID NO: 63654 - protein, 231 aa, Vibrio vulnificus YJ016
MNKYLAELFGTFWLVLGGCGSAVLAAAFPDVGIGLLGVSLAFGLTVLTMAFAIGHISGCHLNPAVTIGLWAGGRFEAKEIVPYILAQVIGGVIAGGVLYTIASGQMGFDATSSGFASNGYGEHSPGGYSLTSALVTEIVMAMMFLLVILGATDQRAPQGFAPIAIGLCLTLIHLISIPVTNTSVNPARSTGVALYVGDWATAQLWLFWVAPILGALLGAVAYKLISGSNKD

SEQ ID NO: 63655 - protein, 451 aa, Burkholderia pseudomallei K96243
MNAPTEPTAPDTTVRTDAEWLDAHWMPFTANRQFKRDPRIIVEGKGAYYTAADGRQIFDGLSGLWCCGLGHGRAEISDAVARQVARLDYSPAFQFGHPQSFELANRIKAMTPAGLDYVFFTGSGSEAADTSLKLARAYWRAKGKGTKTRLIGREKGYHGVNFGGISVGGIGPNRKLFGQGIDADFLPHTQLPENRFSRGLPERGAELAERLLDLIALHDASNIAAVIVEPFSGSAGVVVPPKGYLQRLREICTAHDILLIFDEVITGFGRTGAMTGAEAFGVVPDIMNVAKQVTNGAQPLGAVIASKDVYDAFMAAGGPDYMLEFPHGYTYSAHPVACAAGVAALDLLVKEDALGRVRELAPYFEAAVHGLKGVRHVADIRNCGLAAGLTIEHAPGEPARRPYEIAMHCWKNGFYVRYGGDTIQLAPPFIAEKREIDSLIGALNDALLATD

SEQ ID NO: 63656 - protein, 894 aa, Arabidopsis thaliana
MAFSSCFLLVLLQIFSALLLCLAQDQSGFISLDCGSPRETSFREKTTNITYISDANFINTGVGGSIKQGYRTQFQQQTWNLRNFPQGIRNCYTLNLTIGDEYLIRANFLHGGYDDKPSTQFELYLGPNLWSTVTTTNETEASIFEMIHILTTDRLQICLVKTGNATPFISALELRKLMNTTYLTRQGSLQTFIRADVGATVNQGYRYGIDVFDRVWTPYNFGNWSQISTNQSVNINNDYQPPEIAMVTASVPTDPDAAMNISLVGVERTVQFYVFMHFAEIQELKSNDTREFNIMYNNKHIYGPFRPLNFTTSSVFTPTEVVADANGQYIFSLQRTGNSTLPPLLNAMEIYSVNLLPQQETDRKEVDAMMNIKSAYGVNKIDWEGDPCVPLDYKWSGVNCTYVDNETPKIISLDLSTSGLTGEILEFISDLTSLEVLDLSNNSLTGSVPEFLANMETLKLINLSGNELNGSIPATLLDKERRGSITLSIEGNTGLCSSTSCATTKKKKKNTVIAPVAASLVSVFLIGAGIVTFLILKRKKRTKLGLNPNSGTGTTPLHSRSHHGFEPPVIAKNRKLTYIDVVKITNNFERVLGRGGFGVVYYGVLNNEPVAVKMLTESTALGYKQFKAEVELLLRVHHKDLTCLVGYCEEGDKMSLIYEFMANGDLKEHLSGKRGPSILTWEGRLRIAAESAQGLEYLHNGCKPQIVHRDIKTTNILLNEKFQAKLADFGLSRSFPLGTETHVSTIVAGTPGYLDPEYYRTNWLTEKSDVFSFGVVLLELVTNQPVIDMKREKSHIAEWVGLMLSRGDINSIVDPKLQGDFDPNTIWKVVETAMTCLNPSSSRRPTMTQVVMDLKECLNMEMARNMGSRMTDSTNDSSIELSMNFTTELNPGAR

SEQ ID NO: 63657 - protein, 442 aa, Pseudomonas syringae pv. syringae B728a
MTFASLGLIEPLLRALEALGYQTPTPVQTQAIPPVLAGRDLMAAAQTGTGKTAGFALPLLQRLTMEGPKVAPNSIRALVLAPTRELADQVHESIRQYAEHLPLTTYAAYGGVSINPQMMKLRRGVDVLVATPGRLLDLHRQNAVKFSQLQTLILDEADRMLDLGFAEELRGIYAVLPKQRQTLLFSATFSDEIRLLAAQMLNDPLTIEVSPRNVAASSVKQWVVTVDKKRKADLFIHLMKKHRWGQVLVFAKTRVGVDQLVDRLQALGMNADGIHGDKPQATRQRALDRFKSNEVKILVATDVAARGLDIDDLPTVVNLDLPIVAEDYIHRIGRTGRAGLTGEAISLVCADEVELLSAIEVLTRQTLERKEEQDFEPEHRVPSTDASGQILKKPKKPKKSKVSGSKRNLGKWVDSGDSEPAPVVKPVRKVPVFNTGPRKKKP

SEQ ID NO: 63658 - protein, 379 aa, Yersinia pestis biovar Microtus str. 91001
MEMIKTRAAVAWGPNQPLSVEEVDLMPPQKGEVLVRIVASGVCHTDAYTLSGADPEGVFPTILGHEGGGIVEAIGEGVTSVAVGDHVIPLYTPECGECKYCRSGKTNLCQAIRSTQGKGLMPDGTTRFSKNGQPIFHYMGTSTFSELTVVPEISLAKINKEAPLEEVCLLGCGVTTGMGAVMNTAKVKPGDTVAIFGLGGIGLSAVIGAQMAGASRIIGIDLNTSKFELARKLGATDLINPKDYDKPIQEVIVELTDGGVDFSFECIGNVNVMRSALECCHKGWGESVIIGVAGAGEEISTRPFQLVTGRVWRGSAFGGVKGRSELPGIVQQYLDGKFALNDFITHTMALDQINEAFDLMHEGKSIRSVIHFNHSSESK

SEQ ID NO: 63659 - protein, 441 aa, Amycolatopsis orientalis
MAVVGAGYVGLTTAACLASLGHRVRCTDSDRGKLARLKRGEVDILEKGLPGLVAEGIAAGRLGFVESAAEAVETAEAVFLCVPTPMGEGGMADLSAVIDVATKVRDVLSPGCVLVNKSTVPVGTAARVAALLGRDDVAVVSNPEFLREGTAVHDFLNPDRIVVGSDTRGPAERVAALYARLGAPTVLTDAASAEMVKYAANCFLATKLSYVNAIAELCERLGADIGDVTEGMGYDRRIGPTFLSPGPGWGGSCLPKDTMALKQVAEVAGFEFGLLDEVISGNAKQASRVVERIAVACGLDADADLTGLRIGLLGLTFKAGTNDLRDSPALSVARLLAERGAELTGYDPGLTGAEPPIPGVRVVDDPYYIAKDAHALVLLTDWPQFRALDWPRIAGLLEGPVVIDTRNHLDPDALSRAGIAWRGFGRPPVDPVRTPSLDPVP

SEQ ID NO: 63660 - protein, 398 aa, Pseudomonas putida KT2440
MNHALTQLQPYPFEKLRALLGSVKPAADKRAIALSIGEPKHESPAFVAQAMADNLDKLAVYPSTLGLPALRQAIGQWCERRFGVPAGWLDADRHILPVNGTREALFAFTQAVVNRADDGLVISPNPFYQIYEGAALLAGATPHYLPCLENNGFNPDFDAVPAEVWKRCQILFLCSPGNPTGALVPMNTLKKLIALADEHDFVIAADECYSELYFDEDAPPPGLLSACAELGRSDFARCVVFHSLSKRSNLPGLRSGFVAGDAQIIKPFLLYRTYHGCAMPVQTQLASIAAWQDEAHVRENRDQYRAKYDAVLDILQPVLDVQRPDGSFYLWAKVPGDDAEFTRDLFEAQHVTVVPGSYLSREVDGVNPGAGRVRMALVAPLAECIEAAERIRAFLQNR

SEQ ID NO: 63661 - protein, 260 aa, Pseudomonas putida KT2440
MTVTIKTAEDIEKMRIAGRLAAEVLEMIEEHVKPGVTTEELDRLCHDYIVNVQQAIPAPLNYKGYPKSICTSINHVVCHGIPNDKPLKDGDTLNIDVTVIKDGYHGDTSRMFHVGNVPVWAERLSKVTQECMYKAIELVKPGCRLGDIGEVIQKHAEKNGFSVVREFCGHGIGKVFHEEPQILHYGRAGTGMELKEGMTFTIEPMINQGKADTKVLGDGWTAITKDRKLSAQWEHTLVVTATGYEIFTLRKDDTIPRTSA

SEQ ID NO: 63662 - protein, 442 aa, Gibberella zeae PH-1
MASLLRMKAVTGLSGLSRVAASRVALSHSATLCQRGAIDPQRRLFSNSGFLNGSYIVSVPPMAESITEGTLSSLSKKVGEAVEQDEEIASIETDKIDVLVNASEPGAIAEYFAEEGDTVVVGQDLARIVTGEDAGSAKKSEGGEQKPAKEEPKKEESKPSEQPAKTEEKKSSPAQDAPKPSKPAESKPASKESKSAAPAQSSGAPNRGERVNLQEKMSRMRRTIAGRLKQSQNTCASLTTIQEVDMSNLIAWRAKYKEEVAEEHGVRLGYMGAFTKATTIAAQKVPQINAQIDTEKEIITYHDYVDVSIAVSAPKGLVTPVLRNTESLSIVELERAVAAAAKKARDGKLTMEDMEGGSFSISNPGIFGSMFGTPVINYPQAAVFNMNGIRQEVVAINGEAVIRPMMYISLTYDHRLIDGREASMFLNTVKKYIEDPSRMLLA

SEQ ID NO: 63663 - protein, 540 aa, Chlamydophila pneumoniae CWL029
MQSSEVKPFSRLRAYLCPIYKSEFSKFVPLFLLAFFVGFNYCLLKNMKDTLVIVGSDAGAEVIPFLKVWGIVPGAVIVTMVYGWLGSRYPRDTVFYCFMAAFLGFFFLFAVIIYPVGDSLHLNSLADKLQELLPQGLRGFIVMVRYWSYSIYYVMSELWSSVVLSMLFWGLANQITTITEAGRFYALINTGLNLSSICAGEISYWMGKQTFVAYSFACDSWHSVMLNLTMLITCSGLIMIWLYRRIHHLTIDTSIPPSRRVLAEEGAATANLKEKKKPKAKARNLFLHLIQSRYLLGLAIIVLSYNLVIHLFEVVWKDQVSQIYSSHVEFNGYMSRITTLIGVVSVLAAVLLTGQCIRKWGWTVGALVTPLVMLVSGLLFFGTIFAAKRDISIFGGVLGMTPLALAAWTGGMQNVLSRGTKFTFFDQTKEMAFIPLSPEDKNHGKAAIDGVVSRIGKSGGSLIYQGLLVIFSSVAASLNVIALVLLIIMVVWIAVVAYIGKEYYSRAADAVATLKQPKEPSSSIVREAQESVEQEEMAVL

SEQ ID NO: 63664 - protein, 538 aa, Zea mays
MRNSWPFSLGPPGGARAHRPSPPASAPLPPPQDLVSPETMYRAAGSHLRSLKHHGASRLASTSVAKQSSGGLFSWLLGGKSSELPPLDVPLPGISIPSPLPDFVEPSKTKVTTLPNGVKIASETSSSPAASVGLYIDCGSIYETPASSGVSHLLERMAFKSTVNRTHLRLVREVEAIGGNVSASASREQMSYTYDALKSYTPEMVEVLIDSVRNPAFLDWEVKEQLQNIKSEIADASANPQGLLLEALHSVGYSGALAKPLMASESAVNRLDVSSLEEFVAEHYTAPRMVLAASGVDHDALISVVEPLLSDLPCVKRPEEPKSVYVGGDYRCQADSPNTHIALAFEVPGGWNQEKTAMVVTVLQMLMGGGGSFSAGGPGKGMHSRLYLRVLTNFQQIESFSAFNSVYNNSGLFGIYAVTSPDFSSKAVDLAAGELLEIATPGKVTQEQLDRAKEATKSAVLMNLESRSIASEDIGRQVLTYGERKPIEYFLKTVEEITLNDILSTAKEMMSTPLTMASWGDVIHVPSYESVSRKFHSK

SEQ ID NO: 63665 - protein, 461 aa, Crocosphaera watsonii WH 8501
MKTIPTPKTPTLVQQLQWVLNPTGYLQTNHHRYPDLFKAKIIGLGNDIILISNPEIMQYILTHDRQEFTAPSSLNTLLKPLLGDYSVVMLDGDGHRQRRQLVMPSFHGERLKVYGDLTCRITREAMEKLPENQPFLAREVMQDISLKVIMEAVFGVTEGERYEELQYRLKELLDLFDSPITSGFLFFPSLQKDLGNWSPWGYFLRQRQALDKLIYAEISDRRANPDPERTDILSLLMFAKDEQGESMKDQELRDELITLLMAGHETTASAMAWALYWLHHIPEIKDKLIEELNTLSPDAEGMDIFRLPYLTAVCNETLRLSPSAMLTFTRLAQQTVEVGGYTFKPGDIVAGCLYLTHLREDIYANPKQFNPQRFLDHKYSAYEFIPFGGGSRRCMGEALAKFEMKLVIAIIISEYCLKLADTQPEKQQRRGLTLSPKRGVKMILEGKRQPQKARELELSTR

SEQ ID NO: 63666 - protein, 232 aa, Vibrio rumoiensis
AHLFQYDSTHGRFQHKVTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCT

SEQ ID NO: 63667 - protein, 85 aa, Arabidopsis thaliana
  misc_feature (12)..(12): Xaa can be any naturally occurring amino acid
  misc_feature (27)..(27): Xaa can be any naturally occurring amino acid
WLPPPLSYAAEXTWAGYDTMVAPFTGXKSYAEFPVTPKTNKDITSIASNGGRVSCLKAWPPIGKKKTETPIYLPDLSDPKTAKEA

SEQ ID NO: 63668 - protein, 157 aa, Triticum aestivum
  misc_feature (78)..(78): Xaa can be any naturally occurring amino acid
  misc_feature (108)..(108): Xaa can be any naturally occurring amino acid
  misc_feature (116)..(116): Xaa can be any naturally occurring amino acid
  misc_feature (128)..(128): Xaa can be any naturally occurring amino acid
MAPTVMASSATSVAPFQGLKSTAGLPVSRRSNGASLGSVSNGGRIRCMQVWPIEGIKKFETLSYLPPLSTEALLKQVXDYLIRSKWVPCLRFNKVGSSPVEHNASPGXYYDGRYWXMWKLPISGCTDXQVINEVEEVKKDTLPYFRSGTNASRHQTL

SEQ ID NO: 63669 - protein, 220 aa, Vibrio fischeri
GALISYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTNLHKGIERIFPKFSNKFEAISVRVPTVNVTAMDLSVTINTNVKVND

SEQ ID NO: 63670 - protein, 144 aa, Chlamydophila pneumoniae CWL029
MEQTLSIIKPDSVSKAHIGEILSIFEQSGLRIAAMKMMHLSQTEAEGFYFVHRERPFFQELVDFMVSGPVVVLVLEGANAVSRNRELMGATNPAEAASGTIRAKFGESIGVNAVHGSDTLENAAVEIAYFFSKIEVVNASKPLV

SEQ ID NO: 63671 - protein, 541 aa, Aspergillus nidulans FGSC A4
MAAPVLPLTQVKLPELPASQLSPEQLHWKTFKNPLLIPSPANGPVNFITQPSAPSSASAFPSLTQPPDVFTVTTGARVQIYSIRTRKLLRTITRFDDTARGTDVRPDGRILVAGDDTGTLQVFDVGSRAILKTWKDHKQPVWVAKFSPSDPTCVLSASDDRTVRLWDLPSENSIKSFVGHSDYVRTAAFMPGSLASSGSLVSGSYDRTVRLWDPRMEGRSAMTFKMGAPLETVLPMPTGTTVLAAADNKIAVLDIVAGKPLHMIQSHQKTVTSLSLASDGTRLLSGALDGHLKIHETTGWNVVAGFKYQSPILSLCAITSGAAREDKHIAVGMQSGLLSIKTRLSGQQKARERERKKEMEALLEGKIEEYDKKKNKNKRRQGSAWERRWRGLDFVGEGVDIIIDGNEAKKRKKEKGWELDLRKGRYATALDQVLGSADRIAQLTLFSELRHRSALRAALRGRDEVTLQPVLQWVYKNITEPRLVGLSVEVAMNVLDIYSANLGQSEQIDKMVERLHWRVRDEVDFAHQAFETKGMLDMLRA

SEQ ID NO: 63672 - protein, 239 aa, Vibrio rumoiensis
MAHLFQYDSTHGRFRHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVD

SEQ ID NO: 63673 - protein, 220 aa, Vibrio rumoiensis
NELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVT

SEQ ID NO: 63674 - protein, 160 aa, Pseudotsuga menziesii
MSSTSTPNRGLTKIATNRLQKELVEWQVNPPAGFKHKVTDNLQRWIIEVTGAPGTLYANETYQLQVDFPEHYPMEAPQVIFLQPSPLHAHIYSNGHICLDILYDSWSPAMTVSSVCMSILSMLSSSTVKERPPDNDRYVKNCRNGRSPKETRWWFHDDKV

SEQ ID NO: 63675 - protein, 415 aa, Zea mays
MGAVTSTVAARFAFFPPSPPSYGFEQPAPLPAPATPEPPAPATSKPPPPAPATPKPPPAGEEKGGGAVVELTGVPRRVNVEARRLRTKRGTEVVAMHVRQAGAKLTLLYSHGNAADLGQMYELFVELSAHLNVNLMGYDYSGYGQSTGKPSEQNTYSDIEAVYRCLIETYGASEDNIILYGQSVGSGPTLDLASRLTRLRAVVLHSPILSGLRVMYPVKHTYWFDIYKNIDKIPLVRCPVLVIHGTADEVVDCSHGRSLWELAEVKYEPLWIKGGNHCNLELYPEYIKHLKKFVGAIEKSPPPPPIDECMESSGPSDCTPAEPECTADSRKSTDCRDKARPSIDQRQSTDRRDKPRGSTDRRDKTRKSVDHPEKPRASVDQPDRPRKSIDRFGGMMKSVRLCNIDCFKVTATSGS

SEQ ID NO: 63676 - protein, 217 aa, Vibrio sp.
IQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVND

SEQ ID NO: 63677 - protein, 364 aa, Xylella fastidiosa Ann-1
MSKRDYYQVLGVPRTASEDDLKKAYRRCAMKYHPDRNPGDAAAEAAFKECKEAYEVLADTKKRKLYDTHGHAAFEHGVGSGNAPDMNDIFGNIFGGARASRRGADVGYMVELDLEEAVAGVERQIQIPTLVECTHCHGSGSEDGHVETCGTCRGSGQVRIQRGIFAMQQTCPHCGGRGVIIRNPCKVCNGAGRVEDHKTLSVKIPAGVDNGDRIRLSGEGEQGPDGVPPGDLYVEVRVREHPIFQRDGDDLHCEVPVRISQAALGDIVRVATLDGEAEIRIPAETQSGKLFRLRGKGVRSVRSRTEGDLYCRIVVETPVNLTAEQRNLLEQFEMTFAGEDARKHSPKSATFLDGVKSFWDRMTS

SEQ ID NO: 63678 - protein, 505 aa, Burkholderia pseudomallei K96243
MKHDSNVTSPLGHLIDGKRVDGGERVQPVFDPATGASTKRVRMADRPSVEAAIAAAQAAYPAWRNTPPLKRARVMSRFKTLLEEHANELCALITAEHGKVLADAMGELQRGIENVEYASYAPELLKGEHSKNVGPAIDSWSEFQALGVVAGITPFNFPIMVPLWMWPMAVACGNTFVLKPSERTPSSTLRMAELALEAGLPPGVLNVVNGDKEAVDTILTDSRVKAVSFVGSTPIAESIYTTGCAHGKRVQALGGAKNFAIVMPDADIGNAVNALMGAAYGSCGERCMAIPLVVAIGDDTAEQVVDGLKAEIAKMKVGPGTGEQVDMGPLVTRQHFEKVTGFVEAGIAAGATLVVDGRGVKVDGHEGGYYLGPCLFDHVKPGMPIYQHEIFGPVLGVVRVASLAEAMALVDAHEYGNGTCLFTRDGEAARFFSDNIQVGMVGINVPLPVPVAYHSFGGWKRSLFGDLHAYGPDAVRFYTKRKTITQRWPSAGVREGTVFSFPSSR

SEQ ID NO: 63679 - protein, 553 aa, Oryza sativa
  misc_feature (93)..(93): Xaa can be any naturally occurring amino acid
MATPEDTGSWLLYLSLAAKCSGDGDGQPHRLLGFVVVCAVAGLVTCLLHWSFPGGPAWGRWWWTRRRRRGSPCGVAAVPGLRGLPVIGSMWLXTGLAHRKLAAAAEAAGAARLMALSLGETRVVVAAHPDVAREILHGAAFADRPVKESAYGLLFHRAIGFAPHGAYWRALRRVASTHLFSPWQVAASAPQRAVIARQMVRAIKLQQRSRSGDSAAGAAVEVRRVLRRASLHNVMWSVFGRRYELQLDPGKESDEVRELRALVDEGYDLLGQLNWSDHLPWLARFDLQSTRARCSRLVPRVNRFVTRIIDEHRSSAPVAAAIDFTDVLLSLQGSDKLADSDMVAVLWEMVFRGTDTVAVLIEWVLARLVLQQDVQARVHDELGRVVGLDRDVTESDTASLVYLHAVIKETLRLHPPGPLLSWARLATSDVHVDGYLIPAGTTAMVNMWAIAHDPDVWAEPMEFRPERFIGKAAEFSVMGSDLRLAPFGSGRRSCPGKSLAMATVAFWLATLLHEFALLPSPDPAHGVDLSEVLRLSCEMATPLAVTAWPRRVV

SEQ ID NO: 63680 - protein, 262 aa, Yarrowia lipolytica CLIB122
MTVPKLPLSFPLDQAVDTIRLSDKGSYYILELNAPPDNRLTPSFITAFIEALDTLKFYYDPKPLVTTSTSPKFYSNGLDYELAQKTPNFMSLYFYPLLKAFVDFPWPTIANINGHCFAGAFCLAAFHDYRVMNPAKGWLCMNELEFDAPLMGPLMSIYVTKFGAAIAQRISLNAERFTAKTALEAGLIHAHGSWPEVEEIVKRIGEYSNRTFYSQMRAGILRNVLTTMDYDNETRILHERRDRLWKYEDENKPRIGALLSKL

SEQ ID NO: 63681 - protein, 730 aa, Vibrio vulnificus YJ016
MSYLALARKWRPRQFKEVVGQGHVLTALENALEHNRLHHAYLFSGTRGVGKTSIGRLFAKALNCEKGITSAPCGQCDTCREIEEGRFVDLLEIDAASRTKVEDTRELLDNVQYKPARGRFKVYLIDEVHMLSRHSFNALLKTLEEPPEYVKFLLATTDPQKLPVTILSRCLQFHLKPITVDAIHQQLDFILAKEGVTAQARALGMIAHAADGSMRDALSLTDQAIALGNGQIETDLVSHMLGTIDTDQAIHLLEAISSKQPQVAMDKIQQLAQNGAEWDGLLQQLATQLHRIAMYQLLPSSLDKAQPDAEKIELLSRALSPQDVQLFYQIALKGRDDLSLAPNGRIGMEMIVLRMMAFRPADVSQANIISAQGANLASAPAAQSAAPQVSTSPAQTAPAMSAKPSSERVAPAERPQAVSHAPSRLASSMNAPSSVAPQPVQTEMPPQYDAPPMDYADYPPMDDMPPMGYGYEDAAALQPEPQPAPQQAPERASPAPGGLTGLRHQLRSQRQGLAQNGGSKKSKAASAEKESVLDRVAQKQATAAQVSPRQSLAPSEPEVKEDEPYQWRPSQPVVQSKSKELTPTEIKRALEHEKTPEMAEKLVAESLEQSEWAKLITQLETAKLVEQLALNSAFNKEGSTIALTLRSHQQHLNTDKAQKELLSALNETLGETCHLSVEVGGQGETPLELRERLYQQKLQQAFTSLENDTHVQFILRRFSAELDRDSVRPV

SEQ ID NO: 63682 - protein, 368 aa, Bradyrhizobium japonicum USDA 110
MTPENAGTPMSANNAFHIAVLAGDGIGPEVMAPAIEVLRKIEQKSDLRFRFTEAPAGANNYLATGKSMPERTIKLCEEADAILLGACGLPSVRYPDNTEIAPQIELRFIFDLYAGVRPARLIPGVPSPIVGADTRGIDLVVIRESTEGLFASMGKGVVTHEDARETMVITRRTSERLFEFSFRLAARRKARGKPGMLTCVDKANVFKAFAFFRGIFDEIAKKHPEVRTDRLYVDACSAMLVKRPWDFDVMVMENMFGDIVSDITASLIGGLGMAPSADIGDKYAVFQPCHGTAPDIMGQGKANPTGMILSAAMMLDWIADKHGVESAAEAGETIERAVDQVYAGGIKPMEFGGSNGTADITKAVLGAL

SEQ ID NO: 63683 - protein, 469 aa, Burkholderia pseudomallei K96243
MAIISESSSAAAAAAPGGARAPDTLARSLNVRDVVMITVSGVTPASSIFVIAPFAIQQAGSGAVMSFVLGGLLAFAFALCYAELSAAHRSAGGEYVMVKRVFGALPGYLTFVAVLAVNVFIPAVLASGAAPYLNAALGTQLGNQSVALAIVLASYALGILNIRTNAWITGAFLVIEILVLALIAYLGFSEPHRSPLALVHPVVANGAALVPATLAAIMPAVGTAIFCYNGFGAAVFLAEDLEGGNRDIAKAVICSLAVILVVELVPLTAIVLGAPSFVELAKSADPIGYVVRALSNPGVSRVVSGGIFLSVFNAIIAIVIMVGRFLYSSGRHALWSHACNGAFTRIHPRLESPWIATLTLAVPSTLLVFVSSLDALTAFTVDLLLLVYLAVGVAALASRVMRRDVDHHYRMPWWPLPPIVAIAGAGYTLYTTIAAATKPTDLYIIAGLAAVSLAAYARWARRSAAFREL

SEQ ID NO: 63684 - protein, 806 aa, Arabidopsis thaliana
MTRGAGGETVAWSYFCRDVVPFTAMVAVECVTVGSNTLFKAATLRGLSFYVFVFYTYVVATLVLLPLSLIFGRSKRLPSAKTPVFFNIFLLALVGFMSLIVGCKGIEYSSPTLASAISNLTPAFTFTLAVIFRMEQIVLRSSATQAKIIGTIVSISGALVVILYKGPKVLTDASLTPPSPTISLYQHLTSFDSSWIIGGLLLATQYLLVSVWYILQTRVMELYPEEITVVFLYNLCATLISAPVCLFAEKDLNSFILKPGVSLASVMYSGGLVSSFGSVIHTWGLHLKGPVYISLFKPLSIVIAVAMGVMFLGDALYLGSVIGSLILSLGFYTVIWGKAREDSIKTVAESLSSKSTIMTMRSSLPSSSSAYSLASTSLSNRLETIFKKASELCTLCDIEACVIYYGPDGELKTWPPEREKVRDIALRYSQLNEALRRKKSVNLHGFLNKKKKNKGLKNTDKKRKTSLKKVNVLKYPLADHYPPDQVSPLIQSLELHVSKFHERLEFLESRKQNETQPDHHSLASSSLNHQTQSLNPSQFSLFMYNHGDNTLSQIPVSASNFNQDYFSALLEQSELKNQLMKQEICGNDQNQNMWMGNITNNNFQLPCVSVQESVNNFGLMHKEFYGCDHNMSVGNINSNSCEHPCVSSTQHYSAVEESVNNPWLNQLMQNELYGYGRKVLDAASFTSFESSWIIGGLLITSQYLLVSVWYILQSQVMEIYPEEITVVFFYNLCGMLISPPVCRKRLDLLGVFDSSLCSVIHTWGLHLNGPVYVSLFKPLFIAVAVVMGAIFLGDALHLWMCHIFQL

SEQ ID NO: 63685 - protein, 291 aa, Desulfitobacterium hafniense DCB-2
MSDKLGRNEECWCGSGQKYKKCHASIEEKIKSYAAKGYAIPDRSLLKNQKQIEGIRGSSKINIALLDYIGDFVVEGVTTEELDRLIYNKTKELGGIPATLNYKGYQKSSCISVNDIVCHGVPSRGVRLRNGDIVNIDVSTLYKGFYSDSSRMFCIGEVSVEKRKLVTVAKECTELGVQEVKPWGFLGDVGQAVNDHAKKNGYTVVKEIGGHGIGEKFHEDPWVGYVSKRGTGMLLVPGLIFTVEPMINMGKAGIVLDQNDGWTVYTADGKPSAQWEKTVLVTDTGCEILTY

SEQ ID NO: 63686 - protein, 435 aa, Yarrowia lipolytica CLIB122
MKTSHITVALLAAVATAATIRVDSGNAVTLDIVKRHGDHSVPHSHGDDEDEHDHDHDHDHEGHDHGEELTAEEKAAAKAAKLAERCKTPDRDLNIKYRIGALFAMMGMSALGVLPPVLMNSFFKVSIKSLPLTFLKQFGTGVVISTAIIHLMFGAVLQFMDNPCLGELSYEPTGPAFVLAGLFLAFVIEYTFTKLLEKRSDHLTAPHAHGHSHSDSNSDLEKTGPDVTENTLHISPSAAAAAPGTTHAHGDGNTHGHNHSGEISGGHGGHCLIDPTDKVSVMIMESGIIFHSILIGVTLVLAPNSNFTTLFIAILFHQMFEGVGLGSRIAGLVNTKLLLKLLMCLFFILITPIGMAIGLGVIDVYNGSGSKTTIWVLGVLNGLSAGVLLWAGVVEMLAFDWLFGDLVHTTKRRTIVAFAGLVAGLILMSLIGKWA

SEQ ID NO: 63687 - protein, 370 aa, Triticum aestivum
  misc_feature (181)..(181): Xaa can be any naturally occurring amino acid
MPATASPPPLLLAAALLLSAALLCSACPVPLPKQTADNSPRLQRAYVALQALKRAITDDPKNLTGNWCGPDVCAYFGVFCAPSLDDPCARAVAGVDLNHGDLAGTLPFELGHLTDLAVLHLNSNRFAGGLPDSLPKLSLLHELDVSNNLLSGGFPQHILCLPNVKYVDIRFNNLCGPVPPXAIFDKKIDALFINDNNFDFELPENFGNSPASVIVLANLRLRGCIPASVGRMGGTLNELVMLNSGIRSCIPPEIGWLRELTVLDVSFNQLQGTLPESMAGMHALEQLDVAHNELAGHIPEGICALPRLANFTYSYNYFCGEPERCMALRRNDDRQNCIAGRPDQRPADQCLAFLHRPPVHCDGHGCLAQH

SEQ ID NO: 63688 - protein, 5723 aa, Amycolatopsis orientalis
MKHPGAAMSTSENKVVEALRAALKEADRLRGENRRLTGEPIAIIGMACRYPGGVRSPEELWDLVAGERTGLTGFPVDRGWDLDGLYDPEQGKPGKSYVREGGFLHDAARFDPAFFGISPREALAMDPQQRLLLEISWEAIERAGIAPDSLRGSRTGVFAGVIHNEYSAIAGTPPADLEPYLGNGSFASIASGRVSYTFGLEGPAVTVDTACSSSLVALHLAAQALRQGECSLALAGGVTVMANPAAFVDFSRQRGLAADGRIKAFAEAADGTAWGEGAGMLLVERLSDARRNGHRVLAVVRGSAVNQDGASNGLTAPNGLSQQRVIRQALANARLAPSDVDAMEAHGTGTRLGDPIEAQALLATYGQDRTTPLWLGSVKSNIGHSQAAAGVASIIKLVEAMRHGVLPKTLHVDAPTSHVDWSEGAVSLLTEAEPWPKTDRPRRAAVSSFGISGTNAHVVLEQPTAEEEPPSTFAGPVPFVLSGKTEAALHEQVARVRELARDSDVTAADLAFSLATTRTALDHRAALVGTLDDLLTATLVEGRATDGGTAFLFTGQGSQRLGMGRELAERFPVFAQAFDDVSSRFERPIAELSAEELNQTANTQCALFAFEVALFRLVENWGLRPDFLAGHSVGEIAAAHVADVLSLDDAVTLVSARGRLMQALPTGGAMVALQATEAEVAPLLTDRVSLAAINGPESVVVSGDEEAVAAVVSHFEGRKSKRLTVSHAFHSPLMEPMLDDFRAVVEGLTFAEPRIPIVSGGLAEVSTSDYWVRHVRDAVRFHDSVEFLKAEGVTRFLEIGPDAVLTAMAKESAEDAVVLPASRRDRPEVTTLLTAVAGLHVHGAEVDWAPLFDGARRVDLPTYPFQYEHFWLESGAAHRDVSAAGLDASPHALLAAAVRPAGEDEILLTGRISLSTLPWLADHVVGGNVLLPGTAFAELALAAADEAGCEAVEELNLEAPLVLPEKGGVQLQVAVGAADDQGRRSVTVHARPEDDGFWVRHASGVLGTAVSTQDEMIEWPPSGAEPVDLEGFYPNLAAEGLGYGPAFQGVRAVWTRDGDVFAEVQVDDTPGTFGIHPALFDSALHAIGVGESRGLEIPFAWSDLRLHADGATVLRVRLSPAGDGAVSVFATDPAGAPVLSVGSLSLRAPVAATASLPRDSLFRVTWTPVTVPAGAGEPTVESFVDFDDVRQATAHARQIAVEPGEAPVVFLTSGAFTDPAQASVWGLMRSAREEYPGRFVLVDADDPATLTAGLLAGIVASGETEAIVREGEVRVPRLTPVRGGETGPGWDPEGTVLITGGTGALATELARHLVTRRGVRNLILAGRRGPAAEGASELAAELADLGAQARIVACDVADRDQLTALLDGVPLTAVVHAAGVLDDGLLADLTRDRFETVLRSKVDGAILLDELAGDAHLVFFSSAAGVLGSAGQANYAAANAALDAVAARRRERGLPATSLAWGLWETGDGMAGALAGTDRARMAGSGLLPLPVGDALTLFDFAVGAEEVLFVPMRLDVPALRASATDVPLLRAFAGKSRRTASAAPAARELRDRLASLPTEERGRELLALVRGQVAEVLGHRDAGAVEPARPFRELGFDSLTAVELRNGLNAASGLRLPATAVFDHPTPKALADLLAAELFGAAPEAPVQGPAMAADEPIAIIGMACRYPGGVASPEDLWRLVAEGRDGISLFPADRGWDVDGLYDPDPGKAGKSYVREGGFLHEAGDFDAGFFGISPREALGMDPQQRLLLEVSWEAFERAGIDPGTLRGSDTGVFAGQMYHDYLTGATVVPDDVEGYLGTGNSGSVLSGRVSYTFGLEGPAVTVDTACSSSLVALHLAAQALRRGECSLALAGGVTVMATPETFVDFSRQRGLAPDGRSKSFSDGADGTSWSEGVGMLLVERLSDAERNGHRILAVVRGSAVNQDGASNGLTAPNGPSQQRVIRRALADARLEPSEVDAVEAHGTGTTLGDPIEAQALLATYGQGREDAALWLGSIKSNIGHSQAAAGVAGVIKMVEAMRRGVLPKTLHVTEPSSHVDWTAGAVSLLTEARLWPDAGRPRRAAVSSFGISGTNAHVVLEQGPAPVEAIESGEGPAAFVLSAGSEAALHDQASRLRDFLAETPAALADVAFSLATTRAALEHRAAVVAADRETLLAALENLTVTGRATEGRTAFLFTGQGSQRLGMGLQLAERFPVFAAAYDEVCSRFEQPLRDLTAEELNQTANTQCALFALEVALFRLVESWGVRPDFLAGHSVGEIAAAHVAGVLSLDDAVTLVSARGRLMQALPTGGAMVALQATEAEVTPLLTERVSLAAINGPESVVVSGEEDAVAAVVSQFEGRKSKRLTVSHAFHSPLMEPMLDEFRVVADSLSYAAPRIPIVSGGLAEVSTSDYWVRHVRDAVRFHDSVKFLEAEGVTRFLEIGPDGVLTAMAKETAEDAVVVPALRRDRPEVETLLTAVAGLHVHGVGVDLTALLGGGSPVDLPTYAFQHRRFWLSSAGGAAGDVTAAGLGTTDHPLLGAAAALPGDGGFLLTGRLSGHAQPWLAEHRVGGVVLLPGTAFVEIALRAGDEAGCGHLEDLTLEAPLVLPERGATQLSVLVGAADDTGRRTIEIHSREEGEDGWQRHATGLLSAAGAVEPAGLTTWPPQNAEAVPVGDVYERLAATGLEYGPAFRGLRAAWRAGEDLFAEVELPEDQHSDAARFGVHPALLDAALHTLGLAGGGDGTRLPFAWSGVRLHAAGATRLRVRLRPSGPDGFEVLVADGTGRPVVSAEELTLREISGDALARKGHDSLYRVAWRPVPLPETGETLPAESVFSVPRGGDSAERVHETTAAVLEVVQRRLEDEPGGPLVVHTRGGVAAGDGEAVTDLAHAAVWGLVRAAQSENPGRFLLVDAETLPDGRILAIDEPQIALRDGRALAPRLATTASSTELTPPEGAWRLDTTGRGTLENLTLVPSPEAVAPLAEGEVRIAVRAAGLNFRDVLIALGMYPGAATLGSEGAGVVTEIGPGVTGLDVGDRVFGLMSNGFGPQVVTDHRTLAKMPEDWSFATAASVPIVFLTAYYGLFDLARLEAGESILVHAAAGGVGMAATQLARHAGAEVFGTAGPGKWDTLRANGFDDTHLSSSRDLGFEEKFRDATGGRGVDVVLNSLAGDYVDASLRLLAPGGRFAEMGKTDIREPGETGVEYHPFDVIDAGPERIHEMLAALLELFAAGALTPLPVTGWDVRRGPDAFRFLSQAKHVGKNVLTMPAALDPDGTVLVTGGTGALGALFARHLVRERGVRRLLLASRRGHDAPGVPELVAELTEAGASVTVEACDAADRGALAAVLAGIPAAHPLTGVVHTAGVLDDGLVGSLTPERLAKVLRPKVDAALNLHELTSGADLAEFVVFSSAAGVFGNAGQANYAAANGFLDALSVRRAAHGLPARSLAWGLWAETGGMGGTLGEAELARMAQSGTAALSTQDGLELFDAAGALAEPVLVPMRLDVTAMGGDGLPPLLRGLARGPVRRAASAGAAGDADSLRDRLLAVPVADRETLLVDLVRTHSATVLGHTAADAVEATRSFQEIGFDSLTAVELRNRLTAATGLRLPATLIFDYPTPEALAAHIGEGVLGAQGGPETGQAAVTADEPIAIVAMSCRFPGHADTPERLWALLAEGRDALGEFPADRGWDLERLFDTDPDRRGTSYTRQGAFLETAGDFDAGFFGISPREALAMDPQQRLLLETSWEAFERAGIDPATLRGSRTGVFAGVMDNEYVSGSAEVPDGVEGYLATGTSASVASGRVSYTFGLEGPAVTVDTACSSSLVALHLAAQALRQGECSLALAGGVTVMATPGTFVEFSRQRGLAADGRCKAFADGADGTGWGEGAGMLLVERLSDARRNGHPVLAVLRGSAVNQDGASNGLTAPNGPSQQRVIRQALANARLEPSEVDAVEAHGTGTTLGDPIEAQALLATYGQDRERPLLLGSVKSNIGHTQAAAGVAGVIKMVLAMRHGTLPRTLHVDTPTSRVDWAAGRIELATEPTQWPETGGPRRAAVSSFGMSGTNAHVVLEQAEAVETRDETSPGLLGDVVAWPLSAKEPEAVAAQAARLKSFLTGERPADVAYSLATARTTLEHRAVVVGEDPIAGLAALAAGEPSGSVVTGTATSGKAVFVFPGQGSQWAGMAVELLASAPVFAESMAECEAALLSYVDWKLTEVLSDATALERVDVVQPALFAVMVSLARLWRASGIEPAAVVGHSQGEIAAACVAGALSLDDAARVVCLRSKAITALSGRGGMVSVAAPEAQVREILPEGVSLAAVNGPASVVVSGDVAGLDALMTACEASGLRAKRIPVDYASHSAHVDAIEQDVLAALDGIEPRAPEIPFYSTVAGEPLDPVVDAAYWFRNLRGTVHFGQAVRRLLDDGFRFFVEASPHPVLVTGIADTAEDAGERAVAVGSLRRDEGGPLRFLTSLAEAHVHGLSPDWAALAPGTRVDLPTYAFQHEHYWLRTRSSADPGQAGLDDGGHPLLGAVVPLAGSDGLVATGRISARNQTWLPDHAVGGALLLPGAALVDLALTVGERTGCGRIAELTIEAPLVLGESGSARLQVTVGASADDGTREVAVYSRDETAGTDWIRHATGLLAADGETPVADLTQWPPAGAEPISLEGHYEGLAELGYGYGPAFRGLRAVWRRGDDVFAEVALPEDRIAEAAAFGLHPALLDAALHALGFGMLPDDGRLRLPFAWNEVSLSAVGAPSLRVRLSPAGEDAVAVDLADTAGAPVASIGSVVFRPVAEAQLAGARRDPADSLFQIQWTDLSAKDVVAPAVVVLGEDCADLAELAADLDAGRPAPDVVLTTCAPVTGDIAEGAHAAARDALTLVQNWLADERFSGARLVFRTSGAVSVAADEPVSDPANATVWGLVRTAQEENPGRFGLLDTDGSEAVLGAALALDEPQLALRAGTVLGARLVKASADTALVPPPGSRAWTVDTLGGGTLENLVLRDRPDLLAPLADGQVRIAVRSAGLNFRDVVVALGLVPGQEGIGGEGAGVVTETGPGVTDLAPGDRVLGMFDASFGPIAVADRKLIAPVPDDWSFTEAASAPVAFLTAYVGLADLGELRPGQTVLIHAAAGGVGMAAVQLARHFGAEIYVTASPAKWDTLRAMGFDDDHIASSRTLDFEDKIREATGGRGVDLVLDSLAREFVDASLRLVREGGRFVEMGKTDIRDADEVAAAHPGVTYRAFDLIDSGHDRIQEILGELLALADKDVVRPLPTTAWDVRRAPEAFRFLSQAKHTGKIVLEPPAVLDPEGTVLITGGTGVLGGLFARHLVTAHGVRRLLLTSRRGLDAEGARELVADLTGLGATVTVVACDVADRAAVAGLLGSVPPEHPLTAVVHTAGVLDDGLIPALTPDRLGTVFRPKVDAAVHLHELTRDLGLAAFVLFSSSAATFGAAGQGNYAAANAFLDALAQHRRAEGLAGQALAWGFWAERSAMTGHLDEADVARMKRSGVSPLSSVDGLALFDAAAERDVAALVPVHLDTAALRGQTEVPALLRVLAGAPAKRVAGAAATSGPSLAQRLAALPAADREPFLLDLVRSHAAAALGHASVAKVGPELAFRDLGFDSLTAVELRNRLGAATGLRLPSTLVFDQPSPAALARHLLAELGEPAGAEPEVAVLADLDRLETALAAAVTDDETADRITDRLRAVLARWTEARGPAEDEGDGDLADASADELFDILHKEFGRS

SEQ ID NO: 63689 - protein, 280 aa, Triticum aestivum
  misc_feature (54)..(54): Xaa can be any naturally occurring amino acid
  misc_feature (66)..(66): Xaa can be any naturally occurring amino acid
  misc_feature (221)..(221): Xaa can be any naturally occurring amino acid
AYLGDTTEQVCTKKQVATGPEFPGYRRPTRPRPLLLSRLRLPPTRPKNPSPQPXARTERGGGGGNXSTGGEMVFFALLVGAELDGLTNLQPRGGCDDPSYPYYFKLRCESCGETSAKTTCVSLEEVVQLPTGKGTANLLQKCKLCSREGSVVMIPGQGTPLTAEQSQKGEMTCLMVFECRGYEPIEFAFGNGWKAESVHGTPFDIDLSEREFDEYEEKGKXPVPLSKLESTFQSGEKTRVFLGKTQYCQNTNFPLGAFPPHPAWAQKPPKEFLEYEPKSP

SEQ ID NO: 63690 - protein, 600 aa, Desulfitobacterium hafniense DCB-2
MIDVVSANGGHLAPNLGVVELTLALHRVFDSPKDKIIWDVGHQSYVHKLVTGRQKEFKSLRLYKGLSGFPKRCESPHDCFETGHSSTSISAAVGFAKARDLRKEKNQVVAVIGDGAMTGGMAFEALNHAGHTKTNMIVVLNDNEMAIAQNVGAMSSYLNRLRTDPRYDRSKDEIENLLKRIPGIGSKMAKAAEKAKDSLKYLLVPGLLFEEMGFTYLGPVNGHDQIALEQVFEQAKMVKEPVLVHVLTQKGRGYEPSEKNPALFHGVGPFNKVTGEVIKKPAPPTYTQVFGEALCELAEKDPRITAITAAMPSGTGLNLFAQKFPDRFFDVGIAEQHAVTFSAALAFGGMKPVVSIYSTFYQRAYDQVLHDVCLPHANVVMAIDRAGVVGDDGPTHHGVFDISFLRVIPNLVFMAPKDENELRHMLYTSLQLDGPVALRYPRSVGQGVELTEELRELPVGKAEILQEGKDITLIGVGPMVYTCLAAAVELRHRGVEATVINLRYINPLDRESILRYARMTKRIITVEDHMLAGGMGSAVMEVLGDEGLTDVVVERLGYDEYVDQGAISLLHQGYGLSVVGILKAAERLKVLQRIEGRSSV

SEQ ID NO: 63691 - protein, 468 aa, Dasypyrum villosum
GGVRASRFATTLYGARAAICEMPFSTISADDLGGLGGTCVLRGCVPKKLLVYASKFSHEFEESHGFGWTYDTDPKHDWSTLIANKNTELQRLVGIYKNILKNANVDLIEGRGKVVDPHTVSVDGKLYTAKNILIAVGGRPSMPDIPGIEHVIDSDAALDLPSKPEKIAIVGGGYIALEFAGIFNGLKSDVHVFIRQPKVLRGFDEEVRDFVAEQMSLRGITFHTEHSPQAITKSKDGLLSLKTNKETIGGFSHVMFATGRKPNTKNLGLEEVGVKMDKKGAIVVDEYSQTSVDSIWAVGDVTDRINLTPVALMEGGAFAKTLFGGEPTKPEYRAVPAAVFSQPPIGQVGLTEEQAIEEYGDVDVYLSNFRPLRATLSGLPDRVLMKLIVCATTNKVVGVHMCGDDAPEIIQGIAIGVKAGLTKQDFDVTVGVHPTSAEEFVTMRSPTRKVRRKTAAEAESKDEVVTQK

SEQ ID NO: 63692 - protein, 569 aa, Mycobacterium smegmatis str. MC2 155
MTSSEAPAKTAEKPAPKTRPAKRPRGEGQWALGYREPLNANEQAKKDDNPLNVRARIENIYAKNGFESIDKGDLRGRFRWWGLYTQRKPGYDGTWTGDENTDMLEDEYFMLRVRCDGGALTTAALRTLGGISTEFARDTADISDRENVQYHWIQVENMPEIWKRLDAVGLQTTEACGDCPRVVLGSPLAGESLDEVIDGTPAIDEIVRRYIGKPEYSNLPRKFKTAISGLQDVVHEVNDVAFIGVNHPEHGPGFDLWVGGGLSTNPMLAQRVGVWVPLDEVPDVWEGVVSIFRDYGYRRLRSKARLKFLIKDWGVEKFREVLETEYLKRPLIDGPAPEPVTRPIDHVGVQKLKNGLNAVGVAPIAGRVSGTILTKVADLAEAAGSDRIRFTPYQKLIILDVPDDKIDELRAGLDALGLPSTPSHWRRNLMACTGIEFCKLSFAETRKRAQVLVPELEKRLDDINAQLDVPITVNINGCPNSCARIQVADIGFKGQMVDDGNGPEEGFQVHLGGSLGLDSGFGRKLRQHKVLSSELGDYIERVVRNFVKQREDGERFAQWAVRADEADLR

SEQ ID NO: 63693 - protein, 335 aa, Chlamydophila pneumoniae CWL029
MKVVINGFGRIGRLVLRQILKRNSSVEVLAINDLVPGDALTYLFKFDSTHGRFPEDVRCEADHLIVGKRKIQFLSERNVQNLPWKDLGVDLVIECTGLFTKKEDAEKHIQAGAKRVLISAPGKGDIPTFVMGVNHKTFNPEKDFVISNASCTTNCLAPIAKVLLDNFGITEGLMTTVHAATATQLVVDGPSKKDWRGGRGCLQNIIPASTGAAKAVTLCLPELKGKLTGMAFRVPIEDVSVVDLTVRLDKSTTYDDICKAMKQASETDLKGILDYTDEQVVSSDFIGSEYSSIFDALAGIALNDRFFKLVAWYDNETGYATRIVDLLEYVEKNSK

SEQ ID NO: 63694 - protein, 486 aa, Pseudomonas aeruginosa PAO1
MIKHWINGREVESKDVFENYNPATGELIGEVASGGAAEIDAAVAAAREAFPKWANTPAKERARLMRRLGELIDRNVPHLAELETLDTGLPIHQTKNVLIPRASHNFEFFAEVCTRMNGHSYPVDDQMLNYTLYQPVGVCGLVSPWNVPFMTATWKTAPCLALGNTAVLKMSELSPLTANELGRLVHEAGIPPGVFNVVQGYGASAGDALVRHRDVRAVSFTGGTATGRRIMEAAGIKKYSMELGGKSPVLVFEDADLERALDAALFTIFSLNGERCTAGSRIFVQESVYPQFVAEFAARARRLIVGDPQDPKTQVGSMITQAHYDKVTGYIRIGLEEGATLVAGGLERPAGLPAHLSKGQFIQPTVFADVDNRMRIAQEEIFGPVVCLIPFKDEAEALRLANDVEYGLASYIWTQDIGKAHRLARGIEAGMVFINSQNVRDLRQPFGGVKASGTGREGGEYSFEVFAEIKNVCISMGSHHIPRWGV

SEQ ID NO: 63695 - protein, 321 aa, Oryza barthii
YVISVGLGTPSKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPGFSFGCNMDSFGANEFGNVDGLLGMGAGAMSVLKQSSPTFDCFSYCLPLQKSERGFFSKTTGYFSLGKVATRTDVRYTKMVARKKNTELFFVDLTAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 63696 - protein, 399 aa, Coccidioides immitis RS
MVVTDPEVDIMREKQRQVEAQAGGTSNTNLDGGAESGDTGRPPKSRHDYSQTAHKETTFGDYILGQTLGEGEFGKVRLGWKRDGSVQVAIKLIRRETLGSNPGRLPKIHREIAILRELSHPNIVRLHEMVETDRHIGIILEYASGGELFDYILNQRYLKDHAARRLFAQLVSGVGYLHKKGIVHRDLKLENLLLDRNRNIIITDFGFANTFNPADELSEEIEYNLTNREFVKRMRLDRPDAKGIRRGDLMQTSCGSPCYAAPELVVSDSLYTGRKVDVWSCGVILVCLLLGHQYAMLAGYLPFDDDPANPDGDNINLLYKYIVTTPLTFPEYVTPHARDLLRRILVPDPRKRADLFEVARHSWLAEYASVVSHITSNTTNVADIANTTVTSGLLCPFHI

SEQ ID NO: 63697 - protein, 258 aa, Vibrio rumoiensis
ELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFN

SEQ ID NO: 63698 - protein, 271 aa, Methanothermobacter thermautotrophicus str. Delta H
MVNKMDIIPEITRKSITDLINNKERIDGRSLHEFRDISIETGVISKAEGSSRVKLGNTQIIVGVKPQIGEPFPDTPEMGVILTNSELLPMASPTFEPGPPDERSVELSRVVDRCIRESRMIDLEKLCIIEGSKVWMLFLDLHIIDYDGNLFDAAVLATVAALLDTRIPAAEVEDGEVVINREKMQPLPVNRKALMCTFAKIGNEIVLDPSLEEEDILTARISIGVTEEGSICAMQKGGEGPLTRDDVLKAVSIAVEKVPQLIEYLDKSMTP

SEQ ID NO: 63699 - protein, 321 aa, Oryza barthii
YVISVGLGTPSKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPGFSFGCNMDSFGANEFGNVDGLLGMGAGAMSVLKQSSPTFDCFSYCLPLQKSERGFFSKTTGYFSLGKVATRTDVRYTKMVARKKNTELFFVDLTAISVDGERLGLSPSIFSRKGVVFDSGSELSYIPDRALSVLSQRIRELLLRRGAAEEESERNCYDMRSVDEGDMPAISLHFDDGARFDLGRGGVFVERSVQEQDVWCLAFAPTESVSIIG

SEQ ID NO: 63700 - protein, 241 aa, Vibrio fischeri
ELSQPEAMAHLFQYDSTHGRFQHKVTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTL

SEQ ID NO: 63701 - protein, 711 aa, Cryptococcus neoformans var. neoformans B-3501A
MPPIAASPPNHDENAPLLASPSLEAGTTGPPTPSPPWQFWNRPPFRRVHFADHDQFVSPASAHSESELSADGNGGYGTNPKYPRQPLQQEEKMGQWMMYCLLVLVGMVFGALFSRNWSIKGDAGDMPMVPPVWTLPPPTGLPRNDAYLINATTAAVASEDVTCSNLGLSIMQDKNGSAVDAAITTTLCIGLLNAFSSGIGGGGFMVVRVPETHEVKDQALRDIGYDGELEESRVVALDFRETCPSNCEKDTYGTHKAGRMAAQVGGLAIGVPGELRGLEAAHKLYGTLPWKDVVMPVAELAKGWRVSRELARRLRLFGDFMLSSPTWSAVYAPRGPLLVEGDFIQRLNYGKTLKKIAEEGASAFYQGEIAESSVKTIAKAGGVMTLDDLQSFKALSYPAIHSTFMSKEIYTTSAPSSGGIMLGLLNILEPLNITSNNGLKNPLNLHRFIEALKFAFGARSWVTDPAFAEDRKRLEEVYTKEWANEIREKITDNETHSADYYGLQYDTPIDHGTTHLSVVDKWGGAASVTSTINLIWGSHVMDPKTGIIFNDEQDDFAVPGAPDAFGLWPSPWNYPAPGKKPLSSTSASIILNPATGSSPSPSLYAVVGGSGGSRIFPSVAQVLLNLFSGLGISQSIEAYRVHNQIVPDLTTMEVGPEGVDEEVVKGLKERGHKIGEFDVNIGISEVQAIVLEDGHIFASSDSRKNGIAAGY

SEQ ID NO: 63702 - protein, 263 aa, Escherichia coli
AISIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 63703 - protein, 321 aa, Oryza meridionalis
YVISVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPGFTFGCNLDSFGANEFGNVDGLLGMGAGPMSVLKQSSPTFDGFSYCLPLQMSERGFFSKTTGYFSLGKVATRTDVRYTKMVARKKNTELFFVDLTAISVDGERLGLSPSVFSRKGVVFDSGSELSYIPDRALSVLRQRIRELLLKRGAAEEESERNCYDMRSVDEGDMPAISLHFDDGARFDLGSHGVFVERSVQEQDVWCLAFAPTKSVSIIG

SEQ ID NO: 63704 - protein, 258 aa, Vibrio harveyi
AVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTETPLVSI

SEQ ID NO: 63705 - protein, 346 aa, Synechococcus sp. RS9917
MAAFDLALRDWLDLQLALQRSTHAEIGLRNAEPLSSSSARKGIILAGGSGSRLHPITQAVSKQLLPVYDKPMIYYPLSTLMLAGIREVLIITTPHDQAAFQRLLGDGSRWGMAIDYAIQPSPDGLAQAFLIGADFLAGRPAALVLGDNLFHGHDLVPQLRSSNAQAQGATVFAYPVSDPERYGVAEFDHQGRVLSIEEKPKQPKSRYAVTGLYFYDASVVERAQQVQPSARGELEITDLNQLYLNDGLLQVELMGRGMAWLDTGTCDSLNDASGYIRTLEHRQGLKVGCPEEVAWRQGWINAEQLTALAQPLKKSGYGTYLLQLLDDSLSDNAALQSSLRRPTHAG

SEQ ID NO: 63706 - protein, 875 aa, Thermoanaerobacter tengcongensis MB4
MTKKYVYFFNEGDASMRDLLGGKGANLAEMTRLGLPVPPGFTVTTEACTRYYEDGETIAPEIVEQIHEYMKKLEEVTGKKFGDPNNPLLVSVRSGARVSMPGMMDTILNLGLNDETVEGLARATNNERFAYDSYRRFIQMFSDVVMGIDKNKFEAILDEIKEKRGAKFDTDLTAEDLKEVVKRFKELYKQEKGVDFPQDPQEQLLEAVKAVFRSWNNPRAIVYRRLNDIPSDWGTAVNVQSMVFGNMGNDSGTGVAFTRNPATGEKALFGEFLMNAQGEDVVAGIRTPQPISTLKETMPEVYNQFVEIAEKLEKHYKDMQDIEFTIERGKLYMLQTRNGKRTAQAAIKIAVDLVREGLIDEKTAVLRVDPKQLDQLLHPTFEPEALKAAKPVAKGLPASPGAASGKVYFTADEAVAAAKSGEKVILVRTETSPDDIEGMASAEGILTTRGGMTSHAAVVARGMGTPCVVGCGDARIDEQAKVMRIGDIVVREGDYISIDGSTGNVYIGEIKTVTPEISGDFAILMGWADKYRRLRVKANADTPRDAKIALEFGAEGIGLARTEHMFFDEERIPAMREMIIAKTEEQRRKALEKILPMQRSDFEQLFEIMGEYPVTIRLLDPPLHEFLPHLDEEIRELAEDMGVPFEELKATVESLKEFNPMLGHRGCRLAVTYPEIAEMQTRAIIEAAINVKKRTGKDVKPQIMIPLVGELKEFKYLKDIIVKVADEIIKQSGIELKYLVGTMVEVPRAALTADKIAKEAEFFSFGTNDLTQMTFGFSRDDAGKFLETYYEKKIYEFDPFEKLDQEGVGKLVEMGTKLGKQTRPDLEVGICGEHGGDPSSIEFCHRVGLDYVSASPYRVPIARLAAAQAAIKYGN

SEQ ID NO: 63707 - protein, 241 aa, Vibrio sp.
MLKYDSTHGRFNGTVEVEGGNLIVNGKTVRVTAERNPEDLKWDAIDVDVVAEATGLFLTDETARKHITAGAKKVVLTGPSKDATPMFVMGVNHATYAGQDIVSNASCTTNCLAPIAKVLNDKFGIESGLMTTVHATTATQKTVDGPSAKDWRGGRGASQNIIPSSTGAAKAVGVVLPELNGKLTGMAFRVPTANVSVVDLTVNLKEGASYEAICAAMKEASEGELKGVLGYTEDQVVSQDF

SEQ ID NO: 63708 - protein, 278 aa, Staphylococcus epidermidis RP62A
METVQFYNGRTMPKIGLGTYRVKDGDECRESVKYAIEQGYRSIDTAMIYGNEETVGQGIKEGLESTGLSREDLFITSKLWLTDFGRQNVEDAYRQSVAKLGLDYLDLYLMHWPGTNEAVMIDTWRGMEDLYKQNQVKNIGVSNFTPEHFEALLAQVSIKPVINQVEFHPYLTQNELRKYLEAQNIIMESWSPLMNSQILHDEVINEVANEVGKTPAQVVIRWNIQHDVVVIPKSVTPHRIEENLDVWNFELSDNQMERIDQLNQDKRIGPNPLEFNGK

SEQ ID NO: 63709 - protein, 235 aa, Vibrio rumoiensis
AHLFQYDSTHGRFQHKVTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHI

SEQ ID NO: 63710 - protein, 497 aa, Gibberella zeae PH-1
MELKQNTTIVVLGASGDLAKKKTYPALFGLYRNQFLPKDVKIVGYARTKMDHDEYIRRIKSYIKTPTKEIEQQLEDFAALCTYVSGQYDKDESFQGLEQHLQEVEASRPENHRLFYMALPPSVFTIVSQHLKKICYPKNGIARVIVEKPFGKDLASSRELQKSLEPDWNEQELFRIDHYLGKEMVKNILILRFGNSFLGATWNRHHIDNVQITFKEPFGTEGRGGYFDEFGIVRDVMQNHLLQVLTLLAMERPISFNAEDIRDEKVRVLRAIPAIEPKNVIIGQYGKSLDGSKPAYREDDTVPQDSRCPTFCALVAYIKNERWDGVPFIMKAGKALNEQKTEIRIQFKDVTSGIFKDIPRNELVMRIQPNESVYIKMNSKLPGLSMQTVVTELDLTYRRRFSDLKIPEAYESLVLDCLKGDQSNFVRDDELDASWRIFTPLLHYLDDNKEIIPMEYPYGSRGPAVLDDFTSSYGYKFSDAAGYQWPTTNAAAAPNKL

SEQ ID NO: 63711 - protein, 360 aa, Fusobacterium nucleatum subsp. vincentii ATCC 49256
MDKKMINFTVGPVQMSKKIRDIGQREIPYFRTEEFSKIMKENEKMICCLAEADDKSKALFLTGSGTSGMEATILNCFSKEDKILIINGGSFGQRFVDICRILDIPFYEIKLNYGEILTEQELEKYSDKGISGLLVNAHETSTGILYDMKMISKFCKKNKIFFVVDSISSFIADELSFSDLGIDVMIIGSQKALALPPGLAILILSEKAITRIKNNKVNSLYFDLKIALKDNQNGQTPFTPAVSILLQLHERLKDILEEGIKGERAKIKELKLDFMNRIKNLPLKIFSKNASNAMTAIETKNISAYSIFLILKDEYNIWVCPNGGELKEKIFRVGHIGHLSISDNDKLIEALNDINKRGLL

SEQ ID NO: 63712 - protein, 804 aa, Methanosarcina acetivorans C2A
MSENKSKYTRWFEETKIEDVPLVGGKNASLGEMYRELTSKGVKIPNGFSVTAEAYWYVLKAGGILEKLKQTMEGLDTSDVSELAKRGKAARDLILGAGIPDDLWEEIKTGYDGLCKQYGENTDVAVRSSATAEDLPTASFAGQQETYLNIRGYPALRDACSRCLASLFTDRAISYRVTNNFDHFKVALSIGIMKMVRSDMASSGVMFTLDTETGFRDVVFITGSYGLGENIVQGQVNPDEFYVFKPTFREGYKPIIQKNLGDKQIKMIYGRGDSKVLTRNVEVPEVDRVRFCINDEEVLKLAEYAITIEDHYSNKYKEPRPMDIEWAKDGVTGELFIVQARPETVQSQRKRDILETYVLEKKSNALARGKSVGEKIASGKAHVIPDISDLPSFKPGEILIADTTTPDWEPVMKTAAAIVTNKGGRTCHAAIVSRELGIPAVVGAGNATEVLETGREITVSCAEGEDGLVYEGILPFHKDAQDLKDLKRPKTEIMMNLGNPEEAFGFSMIPNDGIGLARLEFIISSYIKIHPMALVHPEKVKDPEVLQEIEKLTGNSDREEYFVDKLSQGVGTIAAAFYPKPVVVRMSDFKTNEYASLLGGSYFEVTENNPMLGFRGASRYFNERYREGFALECRAMKKVRDEMGLTNLILMIPFCRTVEEAKKVIAEMEKNGLKRGENDLQVYVMCEIPNNVLQIDEFSEYFDGFSIGSNDLTQLTLGVDRDSELLAAEFDERDPGVMEIMAMAVQGAKRNGRHSGICGQAPSDFPEIAEFLVKEKIDSISLNPDSVMKITLKVSDTEKELGRQ

SEQ ID NO: 63713 - protein, 498 aa, Morus indica
MRINPTTSSPGVPALEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPIDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGVINEQNIAESKVALVYGQMNEPPGARMRVGLTALTMAEYFRDVNEQDVLLFIDNIFRFVQAGSEVSALLGRMPSAVGYQPTLSTEMGSLQERITSTKEGSITSIQAVYVPADDLTDPAPATTFAHLDATTVLSRGLAAKGIYPAVDPLDSTSTMLQPRIVGEEHYETAQRVRQTLQRYKELQDIIAILGLDELSEEDRLTVARARKIERFLSQPFFVAEVFTGSPGKYVGLAETIRGFKLILSGELDGLPEQAFYLVGNIDEATAKAMNLEMENKLKK

SEQ ID NO: 63714 - protein, 412 aa, Methanosarcina acetivorans C2A
MSQKTAGKDYLTMDDVELDNKRILLRVDFNSPMDANGNILDDRKIKSHLYTLRSLENSRVVMMSHQGRPGDKDYTTLEAHAKLATELLGRKVTYEDDIFSACARNAIKSLEKGDILLLENTRFYAEENMNRAPEEQARTQMVRKLYPLFDVFINDAFSVSHRSQCSVVGFTEVLPSVAGILMDREITGLDKGLKCHEHPAVFALGGTKAKDIVKVISDILKRGGADRILTTGVVATVFMMAIGIEVGEVNRKFIEDHKYLDQVSIASRLLKEYSGKIIVPKDIALNNDGKREEVKVDKIKGDLPIADIGPETISDYSKFLKEAKLSVFHGPAGIFELESFRLGTEELLKAAAQSNYSIAGGGHTLAAIDQLGLESKYSHLSMGGGASITYLSGEHMPGIEALKNYASRCCKD

SEQ ID NO: 63715 - protein, 497 aa, Pseudomonas syringae pv. phaseolicola 1448A
MTTLTRADWEQRAQHLKIEGRAFIQGEYTAASSGETFDCISPVDGRMLAKVASCDTADAQRAVDSARSAFNSGAWSRLAPAKRKETMIRFAGLLKQNAEELALLETLDMGKPIGDSFGVDIPGAARALSWSGEAIDKLYDEVAATPHDQLGLVTREPVGVVAAIVPWNFPLMMACWKLGPALSTGNSVILKPSEKSPLTAIRIAQLAIEAGIPAGVLNVLPGYGHTVGKALALHMDVDTVVFTGSSKIAKQLMIYAGESNMKRVWLEAGGKSPNIVFADAPDLQAAAEAAASAIAFNQGEVCTAGSRLLVERSIKERFLPMVLEALATWKPGNPLDPATNVGALVDTQQMNTVLSYIEAGHAEGARLVAGGKRILQETGGTYVEPTIFDGVNNAMKIAQEEIFGPVLSVLTFDSDEEAIQIANDTPYGLAAAVWTANISRAHLTAKALRAGSVWVNQYDGGDMTAPFGGFKQSGNGRDKSLHAFDKYTELKSTWIKL

SEQ ID NO: 63716 - protein, 454 aa, Bacillus pumilus SAFR-032
MKNRNGWLYFFGALGGALYGYDTGVISGAILFMKEDLGLNAFTEGLVVSSILIGAMLGSSLSGKLTDQFGRKKAIIAAAILFIIGGFGTALAPNTEVMVLFRIVLGLAVGCSTTIVPLYLSELAPKESRGALSSLNQLMITFGILLAYIVNYALADAEAWRLMLGIAVVPSVLLLCGIMFMPESPRWLFVHGQADCAKEILAKLRKSKQEVEEEISDIQQAESEEKGGFKELFEPWVRPALIAGVGLAFLQQFIGTNTIIYYAPKTFTSVGFGNSAAILGTVGIGAVNVVMTFVAIKIIDRVGRKALLLFGNAGMVLSLIVLSVVNRFFEGSTAAGWTTIICLGLFIVIFAVSWGPVVWVMLPELFPVHVRGIGTGVSTFLLHTGNLIISLTFPTLLSAMGISNLFLIYAVIGVGAFLFVKYMVTETKGKSLEEIEDDLKKRNRAVTGDEGKTV

SEQ ID NO: 63717 - protein, 515 aa, Methanosarcina acetivorans C2A
MAQARRPLMLIILDGWGYREVEEGNAVLSAGTPNLDRLVKDYPWCLLEASGGAVGLPEGMMGNSEDGHLNIGAGRIVYQNLTRINISIRNGDFFKNPVFLNAISKVKANDSSLHLIGLVSCGGVHSYTPHLHALIKLAKEKGLKKVYIHAFLDGRDVPPKTALGDIKKLNEFCKEHGGAKIATVSGRYYAMDRDKRWDRTKLAYDVLTLGASQYKAPNAETAVSEAYGRGETDEFVKPTVITDHEEKPVATIRDKDSVIFFNFRADRARQLTWAFVKDDFDGFVREKRPKIYFVCMARYDEDLDLPVAFPHEELKNVLGEVLSKQGLTQLRIAETEKYAHVTFFLNGGEEKRYEGEDRCLIPSPKIATYDLKPEMSAYKITDEVVRRIQSGKYDVIVLNFANMDMVGHTGIFEAAVKAVEAVDKCIGRIVEALKEIGGVALITADHGNAEQMIDSKTGEPHTAHTSNPVRCIYFGNGEVKALKKGKLCDLAPTLLELIGIPKPQEMTGKSLLVKE

SEQ ID NO: 63718 - protein, 139 aa, Pasteurella multocida subsp. multocida str. Pm70
MAVERTLSLIKPDAVKRHLIGAILSRFEQAGFRVVAAKMLHLTQAQAEGFYAEHQDKAFFPELVAYMISAPVLALVLEKENAVKDYRTLIGATNPAVAAEGTIRRDFAIDGRHNSVHGSDSLDSAKREIAYFFVESEIF

SEQ ID NO: 63719 - protein, 289 aa, Desulfitobacterium hafniense DCB-2
MFQKELEDYARLVDSYLAQFPWPTGTLAESMNYSLSAGGKRIRPVLALAAAHAVGGDCEDILPAVCALELIHTYSLIHDDLPAMDNDDYRRGRLANHKVFGEGQAILAGDALLTYAFELLAQPMSGVDSQRQLRAVREVAQAAGPEGMVGGQMLDLEAEEKQLNLAELEQVHRLKTGAILVVAARLGAILAGGTEEKIEALTSYAQAIGLAFQIKDDILDLESDSETLGKPVHSDLRQHKSTYPSLMGLAGAKLELKIKTDEAHAALAVLGERAGFLHELADYIAQRKY

SEQ ID NO: 63720 - protein, 446 aa, Bordetella parapertussis 12822
MSTTHVLHRSLRHTPPVAVRGEGVWLYDQAGRAYLDGSGGAAVSCLGHNHPDVRAAMHAQIDALAYAHTGFFSTEIAERLADRLVADAPAGTSHAYFVSGGSEAIEAALKMARQYFVEIGQPQRRHLVARRQSYHGNTLGALAVGGNEWRRAQFAPLLIDVAHVAPCYAYRDQREDESAEQYGERLARELEDTFQRLGPDTVIAFVAEPVVGATAGALTAVPGYFRRIREICDRYGILMIADEVMCGMGRTGTLYAVEQEEIVPDLITIAKGLGGGYQPIGAVMAQGRIVDAMSKGSGFFQHGHTYLGHATACAASLAVQEVIRRDGLLARVRQQGDGLRQRLMQALGAHPHVGDIRGRGLFLGVELVRDRAAKATFDPELALHARIKREAMARGLMVYPMGGTIDGRHGDHVLVAPPFIIADDELDQLVERLAGAIDAAIAQTRA

SEQ ID NO: 63721 - protein, 523 aa, Aspergillus oryzae
MADQFKARTLKRKNVKGLALNAAPKPLSNPSDGDAQVPGAIGNTDSNRTDTLEIGLEFRLDLRSEDLITLKELGAGNGGTVSKVMHASTKVVMARKIIRVDAKENVRKQILRELQVGHDCNSPNIVTFYGAFQNEARDIVLCMEYMDCGSLDRISKDFGPVRVDVLGKITESVLAGLVYLYEAHRIMHRDIKPSNILVNSRGNIKLCDFGVATETVNSIADTFVGTSTYMAPERIQGGAYTVRSDVWSVGLTVMELAVGRFPFDASDSSAGDRASAGPMGILDLLQQIVHEPAPKLPKSDAFPPILHEFVAKCLLKKSEERPTPRELYDKDAFLQAAKRTPVDLQEWAISMMERHNRKSYLAPPPPKSLKDEKEESPRRSPAPKPALSKSSRTPHYTPTSGEIPVNMVNEMSSHSRHYHVPPNPSPRPSRSTRSPPTISLEHLSLETKDDDYRSGRRPSRAHLGDPVSALEPPSRQHIASRSASSHNMKSRMPLQTSAMPVRAAPPPSGPLPPASVPGTPWQR

SEQ ID NO: 63722 - protein, 121 aa, Kluyveromyces lactis NRRL Y-1140
MFRSVFRAAPSLTRVSGLRSGFVKPTFSSASRFYASSSLSKEEITTRIADVIKSFDKTASATSITANTQFSKDLGLDSLDTVELLVSIEEEFDIEFPDKVADELKSVGETVEYIASSPEAN

SEQ ID NO: 63723 - protein, 355 aa, Prochlorococcus marinus str. AS9601
MKTVLTTGGLGYIGSHTVIALINRGFNVLIIDSLINSKSETFNNIEKILFNEMGEIKEKLFFRKGDLRNKLWLENIFQEFNDKKQPIEAVIHFAGLKSIGESILNPLNYYDVNLNTTLCLLSVMSKFKCFKLIFSSSATVYKIDKNEKISENGILSPLNPYGNTKLSNEKIIEDVFKSDDKRWKIANLRYFNPCGAHDSGIIGENPLINHSNIFPTILRVINREIEKLPIYGSDWPTKDGTCIRDYIHVMDLAEAHLAALIYLYENEPTYLNLNIGTGTGISVLELIKTFSNVNNCQIPYYFTEKRKGDAAFVVANNSLVIQTLKWEPKRNLKDICKDSWRWFIKSKEGSNFKNN

SEQ ID NO: 63724 - protein, 240 aa, Methanothermobacter thermautotrophicus str. Delta H
MITIITQDQLKTSPSVREDGRAFDELRPLKIEAGILERADGSSYLEFGGNKILVAVYGPREAQIRKLQRPDRAVIRCRYNMAPFSVEERKRPGPDRRSVEISKITAEALRPALILEKFPRSVIDVFIEVLEAEGGTRCAGITAASVALADAGIPMRDMVVACAAGKVGDQVVLDLSEEEDKEGQADVPVAILPRTREITLLQSDGNLTPEEFERALDLAVEGCLRIHEVQKEALRKRYGE

SEQ ID NO: 63725 - protein, 142 aa, Brassica napus
  misc_feature (114)..(114): Xaa can be any naturally occurring amino acid
  misc_feature (122)..(123): Xaa can be any naturally occurring amino acid
  misc_feature (125)..(125): Xaa can be any naturally occurring amino acid
  misc_feature (127)..(127): Xaa can be any naturally occurring amino acid
MDDWEAEDFQPLPAKVVLKSNWDDEDVDENDIKDSWEVDDEPVPHAPVVKPATEKAPKKAAAAAKGVEKKAKTVEASKEEPLDPFAEKLRIQRLVEEADYQATAELFGAKTQEXNIDIFIPXXEXDXLEYAESYFLEYGEEI

SEQ ID NO: 63726 - protein, 165 aa, Chlamydophila pneumoniae CWL029
MSLSKNSHKEDQLEEKVLVVNRCSKVVKGGRKFSFSALILVGDGKGRLGYGFAKANELTDAIRKGGEAAKKNLMKIEALEDGSIPHEVLVHHDGAQLLLKPAKPGTGIVAGSRIRLILEMAGIKDIVAKSFGSNNPMNQVKAAFKALTGLSPRKDLLRRGAAIND

SEQ ID NO: 63727 - protein, 557 aa, Pseudomonas aeruginosa PAO1
MYQYDEYDQALVSERVAQFRDQIARRLDGELSEEEFLPLRLQNGLYLQKHAYMLRVAIPYGTLSAPQLRALAHVARHYDRGYGHFTTRQNIQFNWIELEQVGDILEHLAGAQMHAIQTSGNCVRNITTEAFAGVAADEWTDPRPLAEILRQWSTVNPEFLFLPRKFKIALSSAVEDRAAVQMHDIGLYLYRHPDAGELRLRVLVGGGLGRTPMLGQVIRDDLPWQHLLSYVEAILRVYNRYGRRDNKYKARIKILVKALGIEAFAREVEEEWQHLRDGPAQLTAEECQRVAERFVLPRYLPPADGELAYGSARAADPAFARWASRNVQAHKVPGYASVVLSTKPGASAPPGDVTAEQMERVADWAERYGFGEIRVAHEQNLVLPDVRLENLHALWREACAAGLGTPNQGLLSDIIACPGGDYCALANAKSIPIAQGIQQRFEDLDHLHDIGELSLNISGCMNACGHHHIGNIGILGVDKSGSEWYQVTLGGAQGKDSALGKVIGPSFSAAEVPAVIERIVETFTDLRVGPERFIDTFNRVGLEPFKARVYARMEEPA

SEQ ID NO: 63728 - protein, 321 aa, Oryza longistaminata
YVISVGLGTPSKTQILEIDTGSSTSWVFCECDGCHTNPRTFLQSRSTTCAKVSCGTSMCLLGGSDPHCQDSENYPDCPFRVSYQDGSASYGILYQDTLTFSDVQKIPSFSFGCNMDSFGANEFGNVDGLLGMGAGPMSVLKQSSPTFDGFSYCLPLQMSERGFFSKTTGYFSLGKVATRTDVRYTKMVARKKNTELFFVDLTAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 63729 - protein, 429 aa, Pseudomonas putida KT2440
MAKIVDIKGREVLDSRGNPTVEADVLLDNGIIGSACAPSGASTGSREALELRDGDKSRYLGKGVLKAVANINGPIRDLLLGKDPSDQKALDRAMIELDGTENKAKLGANAILAVSLAAAKAAAQDQDLPLYAHIANLNGTPGQYSMPVPMMNIINGGEHADNNVDIQEFMVQPVGAKTFSDGLRMGTEIFHHLKAVLKARGLNTAVGDEGGFAPNLASNEDALGAIAEAVEKAGYKLGTDVTLALDCAASEFYEDGKYNLSGEGKSFDAEGFADYLKGLTERFPIISIEDGLDESDWAGWKILTDKIGEKVQLVGDDLFVTNTKILKEGIEKGIGNSILIKFNQIGSLTETLEAIQMAKAAGYTAVISHRSGETEDSTIADLAVGTAAGQIKTGSLCRSDRVSKYNQLLRIEEQLGAKAVYRGRAEFRG

SEQ ID NO: 63730 - protein, 314 aa, Moorella thermoacetica ATCC 39073
MNRRENKNEVISLTRIQKAIIPAAGWGTRFLPATKAQPKEMLPIVDKPAIQFIVEEAVNAGAEDILIITGKNKRAIEDHFDRSLELENLLREKGKDELLALVEGIAELADIHYIRQKEQLGLGHAVYCARKFIGQEPFAVLLGDDIIVNSPSCLEQMLAVYEEVGATIVAVQEVPREEVNRYGVIDPLEVDGSLIRVRDLVEKPRPEEAPSNLAVIGRYILVPAIFPLLEKVKPGAGGEIQLTDALRLLARQDRVYAYRFQGKRYDIGDKLGFLQATVEFALARPDLAGPFSEYLAGIITSTADKLQVAATREG

SEQ ID NO: 63731 - protein, 173 aa, Aspergillus nidulans FGSC A4
MSSPLPWSGPTMRKIRSSPNLGYGLKANLLKLIDHYSNPRNVGSLNRKSLDVGTGLVGAPACGDVIRLDIQVDEATGKITETRFKTFGCGSAIASSSYLTTLLKGKTLEEASKISNTQIASELCLPPVKLHCSLLAEDAVTAAIKNYRSKRAAPATDLSGTAKEIPKEAAATA

SEQ ID NO: 63732 - protein, 323 aa, Oryza longistaminata
YVISVGLGTPSKTQILEIDTGSSTSWVFCECDGCHTNPRTFLQSRSTTCAKVSCGTSMCLLGGSDPHCQDSENYPDCPFRVSYQDGSASYGILYQDTLTFSDVQKIPGFSFGCNMDSFGANEFGNVDGLLGMGAGPMSVLKQSSPTFDGFSYCLPLQMSERGFFSKTTGYFSLGGKIAATRTDVRYTKMVARRKNTELFFVDLTAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 63733 - protein, 371 aa, Pseudomonas putida KT2440
MMIKSRAAVAFEAKKPLEIVEVDVAMPKAGEVLLRVVASGVCHTDAYTLSGADPEGIFPSILGHEGGAIVEAVGEGVTSLAVGDHVIPLYTPECGKCKFCLSGKTNLCQAIRATQGKGLMPDGTTRFSYKGQQLFHYMGTSTFSEYTVLPEISVAKIQKEAPLEKVCLLGCGVTTGIGAVLNTAKVKPGDTVAIFGLGGIGLSAVIGAVKAKASRIIAIDINPAKFEIARQLGATDCVNPKDYDRPIQEVIVDLTDGGVDFSFECIGNVQLMRAALECCHKGWGESVIIGVAGAGQEISTRPFQLVTGRVWRGSAFGGVRGRSELPSYVEMSEKGEIPLDTFITHTMGLEDINKAFDLMHEGKSIRSVIHF

SEQ ID NO: 63734 - protein, 323 aa, Oryza glumipatula
YVISVGLGTPSKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPGFTFGCNMDSFGANEFGNVDGLLGMGAGQMSVLKQSSPTFDGFSYCLPLQMSERGFFSKTTGYFSLGGKIAATRTDVRYTKMVARRKNTELFFVDLTAISVDGERLGLSPSIFSRKGVVFDSGSELSYIPDRALSVLSQRIRELLLRRGAAEEESERNCYDMRSVDEGDMPAISLHFDDGARFDLGRHGVFVERSVQEQDVWCLAFAPTESVSIIG

SEQ ID NO: 63735 - protein, 246 aa, Vibrio sp.
AVNELSQPDAMAHLFQYDSTHGRFQHKVTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHN

SEQ ID NO: 63736 - protein, 323 aa, Oryza glumipatula
YVISVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPGFTFGCNMDSFGANEFGNVDGLLGMGAGQMSVLKQSSPTFDGFSYCLPLQMSERGFFSKTTGYFSLGGKIAATRTDVRYTKMVARRKNTELFFVDLTAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 63737 - protein, 249 aa, Photobacterium damselae subsp. damselae
AVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVD

SEQ ID NO: 63738 - protein, 421 aa, Mycobacterium smegmatis str. MC2 155
MAASPHSLCEFIDASPSPFHVCATAAARLRDAGYTELAETDAWPAAGRFFTVRAGSLVAWRTVEDASAPFRIVGGHTDSPNLRVKQRPDRMVAGWQVVALQPYGGAWLNSWLDRDLGISGRLTLRDESADDGIAHHLVRIDDPILRVPQLAIHLSDDRKGVSPDPQRHLNGVWGLGERPGVFIEFVADRAGVDAADVLGFDLMTHDLAPSAVTGAAGEFVSAPRLDNQATCYAGLEAFLAAEESGYLPVLALFDHEEVGSQSDHGAQSELLPTVLERIALAAGQSREDFLRRVAGSMVASGDMAHATHPNYPERHEPGHLIEVNAGPVLKVQPNLRYATDGRTAAAFALACDQAGVPLQRYEHRADLPCGSTIGPMTAARTGIPTVDVGAAQLAMHSAREFMGAHDVAAYSAALQAFLSPA

SEQ ID NO: 63739 - protein, 989 aa, Oryza sativa
DMLLCFVEIFSILCCCIIYYYHLQTKKASASEPTEWPVLGHLFGMFANIHRFHDWATDILAGGWHNFEARAGLTGIRFFITCDPSNVRHIFTSNFANYPKGDEYAEIFDVLGNGIFNADGESWRSQRAKAQMLMAGARFRAFAARSSRDKAEKSLLPLLAHAADTGARCDLHDLFLRLTFDVTCTLVFGVDTGCLSAGLPVIPFARAMDDVLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRAIVANMHRLLDGVTFLLATSQLNFQCRFWLAGFRFFVTCDPDNVRHIFTSNFDNYPKGDVFADMFDVLGGGIFNTDGERWRRQRNKAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPV

SEQ ID NO: 63740 - protein, 321 aa, Oryza nivara
YVISVGLGTPAKTQIVEIDTGSSTTWVFCECDGCHTNPRTFLQSRSTTCAKVSCGTSMCLLGGSDPHCQDSENYPDCPFRVSYQDGSASYGILYQDTLTFSDVQKIPSFTFGCNLDSFGANEFGNVDGLLGMGAGPMSVLKQSSPTFDGFSYCLPLQKSERGFFSKTTGYFSLGKVATRTDVRYTKMVARRKNTELFFVDLAAISVDGERLGLSPSIFSRKGVVFDSGSELSYIPDRALSVLSQRIRELLLRRGAAEEESERNCYDMRSVDEGDMPAISLHFDDGARFDLGSRGVFVERSVQEQDVWCLAFAPTESVSIIG

SEQ ID NO: 63741 - protein, 249 aa, Vibrio harveyi
AVNELSQPEALAHLFQYDSTHGRFQHKVTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVD

SEQ ID NO: 63742 - protein, 1021 aa, Oryza sativa Japonica Group
MSLVYRLPLIHECGLVMFCRTLKIDVLGQVRIGVLQMTRVIHDSGEGMQKEALAMVSSDVNFPKGHFPDYKIGPNNQIIDPEEIHEAVPLKEIVAKETAQLLEQRRRLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVGVSAMLIACKYEEIWAPEVNDFILISDSAYTREQILAMEKGILNKLQWNLTVPTAYVFIMRYLKAGASADNKSDKEMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 63743 - protein, 266 aa, Vibrio fischeri
AVNELSQPEAMAHLFQYDSTHGRFQHKVTHDQEYLYIDLPDGSQDKVRILHQADLSLLPWQSLEVDLVLDCTGVYGSKSDGEKHITAGAKKVLFSHPGGSDLDNTIIYGVNHDTLLPEHRIVSNGSCTTNCIIPVIKAIDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHNIVDYTEAPLVSIDFNHDPHS

SEQ ID NO: 63744 - protein, 235 aa, Vibrio harveyi
AHLFQYDSTHGRFQHKLTHDQEYLYIDLPDGSQDKVRILHQADLSLLPWQSLEVDLVLDCTGVYGSKSDGEKHITAGAQKVLFSHPGGSDLDNTIIYGVNHDTLLPEHRIVSNGSCTTNCIIPVIKAVDDAFGIDSGTITTIHSSMNDQQVIDAYHSDLRRTRAASQSIIPVDTKLHKGIERIFPKFSNKFEAISVRVPTVNVTAMDLSVTINTNVKVNDINQTIVNASRCTLHN

SEQ ID NO: 63745 - protein, 513 aa, Bacillus cereus ATCC 10987
MLDQKQQSNTFEERVETIKQGGAPKYHEQNKAKGKLFVRDRLALLFDNGEYVEDALFANCEQTGLPADGVITATGKIHGRTACVMANDSTVKAGSWGARTVEKILRIQETAEKLRVPLFYLVDSAGARITDQVEMFPGRRGAGRIFYNQVKLSGKVPQVCLLFGPSAAGGAYIPAFCDVVMMVEGNASMYLGSPRMAEMVIGEKVTLEEMGGARMHCSVSGCGDVLCKTEEDAITQARQYISYFPNNYLEKTPLVTPQEPKQFDKTLEEIIPENQNAPFNMKDLINRVIDEGSFYEVKKLFAQELITGLARIDGKPVGIIANQPRMKGGVLFHDSADKAAKFINLCDAYHIPLLFLADVPGFMIGTKVERAGIIRHGAKMISAMSEATVPKISIVVRKAYGAGLYAMAGPAFEPDCCLALPTASIAVMGPEAAVNAVYANKIAALPEEERDSFIAEKREEYKKDIDIYHLASEMVIDGIVHPNNLREELKGRFEMYMSKYQVFTDRKHPVYPV

SEQ ID NO: 63746 - protein, 758 aa, Oryza sativa
MDPCTGSMNPARARGTGQPLRVYGPGPCTESDRILFVSSRLPRESFPPLKPIAAAAGASLSFWSKIIAQNPRLELLLGRLILESEEGMSGPLDRFARPCLVPCKALLFVILPKRLSHLSVAGFEGFTHNDEKKEIRSDADNSEGEKKTKIGSFKKKAINAGNKFRHSLRRRSKKKNEPRGSIEDIRDVQDLQAVDAFRQCLVDEDLLPQQHDDYHTMLRFLKARKFDVEKAKSMWSDMLKWRKEFGADNIEEFDYTEADEVMKYYPQFYHGVDKEGRPIYIELIGKVDANKLMQVTTIERYVKYHVKEFERCFQMRFPACSIAAKRPIDSSTTILDVQGVGLKNFSKAARDLITRLQKIDNDNYPETLRRMYIINAGQGFKMLWSTVKSFLDPKTASKIHVLGSKYQNKLLEIIDENELPEFFGGKCKCEAFGGCKKSDKGPWKDPNIIKRVLNGEANYGRQIVTISSTDGKIIRYAGPQYPTRKGSDGSAESGSEVEDGASPMASRNLITNPLLTPVHEEASCHASKLAAHGFTSASPSIIEESIPVVDKVVDDGWGSPRASSSPSRSLPITFDGLWTQVITWLTVLIVSLFAMVRSVPSRMAKRFSSQSTDHDHSYVEYPQEAEYKEEFRPPSPAPSYTEKDVLSSMVRRLGELEEKVQALETKPSEMPFEKEELLNAAVRRVDALEAELISTKKVYVKILLPYKKKVMKYFNFHEQALYEALMRQDELLAYIDKQDMIKFRVRYSFLTLFFLLLR

SEQ ID NO: 63747 - protein, 579 aa, Arabidopsis thaliana
MAQVVATRSIQGSMLSPNGGSVSTRSEKLLKPASFAVKVLGNEAKRSGRVSVRSRRVVDTTVRSARVETEVIPVSPEDVPNREEQLERLLEMQQFGDTSVGMWSKPTVRRKTKIVCTVGPSTNTREMIWKLAEAGMNVARMNMSHGDHASHKKVIDLVKEYNAQTKDNTIAIMLDTKGPEVRSGDLPQPIMLDPGQEFTFTIERGVSTPSCVSVNYDDFVNDVEAGDMLLVDGGMMSFMVKSKTKDSVKCEVVDGGELKSRRHLNVRGKSATLPSITEKDWEDIKFGVENKVDFYAVSFVKDAQVVHELKKYLQNSGADIHVIVKIESADSIPNLHSIITASDGAMVARGDLGAELPIEEVPILQEEIINLCRSMGKAVIVAANMLESMIVHPTPTRAEVSDIAIAVREGADAVMLSGETAHGKFPLKAAGVMHTVALRTEATITSGEMPPNLGQAFKNHMSEMFAYHATMMSNTLGTSTVVFTRTGFMAILLSHYRPSGTIYAFTNEKKIQQRLALYQGVCPIYMEFTDDAEETFANALATLLKQGMVKKGEEIAIVQSGTQPIWRSQSTHNIQVRKV

SEQ ID NO: 63748 - protein, 295 aa, Arabidopsis thaliana
MEGKEEDVRVGANKFPERQPIGTSAQSTDKDYKEPPPAPLFEPGELSSWSFYRAGIAEFIATFLFLYITVLTVMGVKRAPNMCASVGIQGIAWAFGGMIFALVYCTAGISGGHINPAVTFGLFLARKLSLTRAVFYMIMQCLGAICGAGVVKGFQPTPYQTLGGGANTVAHGYTKGSGLGAEIIGTFVLVYTVFSATDAKRSARDSHVPVWTPLLVPILAPLPIGFAVFLVHLATIPITGTGINPARSLGAAIIYNKDHSWDDHWIFWVGPFIGAALAALYHQIVIRAIPFKSKS

SEQ ID NO: 63749 - protein, 159 aa, Salmonella typhimurium LT2
MRIGHGFDVHAFGGEGPIIIGGVRIPYEKGLLAHSDGDVALHALTDALLGAAALGDIGKLFPDTDPAFKGADSRELLREAWRRIQAKGYTLGNVDVTIIAQAPKMLPHIPQMRVFIAEDLGCHMDEVNVKATTTEKLGFTGRGEGIACEAVALLMKAAK

SEQ ID NO: 63750 - protein, 234 aa, Pseudomonas syringae pv. syringae B728a
MDIRSVPSSRLAVAGGQESFQLVKNLVIAALLECCSVEEFNELKETLLIEYVTEQSHEDLLMFARKDPASCGDPLVIARTYTSFAAVMHYRLAHCVYQNAKRSCNSHEQSLAAIISRRGKMLSGAEIHFRCSIGARLIIDHGFGTVIGETAIIGDDCYILGGVTLGARGISSNPSIPRHPKVGSRVQIGAFSSVLGPVNIGDDAFSGPRCIITQDVPSGARVQVKTSLQVVIEQ

SEQ ID NO: 63751 - protein, 566 aa, Triticum aestivum
  misc_feature (152)..(152): Xaa can be any naturally occurring amino acid
MHSVSISASASASAIASGGARSKAAAGRRPGEIRFCGLRGDALACGSLRASHAAAATRRAVLRAAASANGAAGSGDGFDYDLVIIGAGVGGHGAALHAVEEGLKTAIIEGDVVGGTCVNRGCVPSKALLAVSGRMRELHDEHHMKSLGLQVXSTGYDRQAVADHANNLASKIRSNLTNSMKAMGVDILTGFGKIVGKQKVRYGKVGFPEKEITAKNIIIATGSVPFVPKGIEIDGKTVFTSDHALKLESVPDWIAIVGSGYIGLEFSDVYTALGSEVTFVEALDQLMPGFDPAIAKLAQRVLINPRKIDYHTGVFASKITPAKDGKPVLIELIDAKTKEHKETLEVDAALIATGRAPFTNGLGLENINVVTQRGFIPVDERMQVTDADGNVVPNLFCIGDANGKLMLAHAASAQGISVVEQISGRDHILNHLSIPAACFTHPEISMVGLTEPQAREKADNEGFEVSVVKTSFKANTKALAENEGDGIAKMIYRPDTGEILGVHILGLHAADLIHEASNAIALGTRLQELKLAVHAHPTLSEVLDELFKAAKVNSGVSHSVNEPVAA

SEQ ID NO: 63752 - protein, 664 aa, Aspergillus oryzae
MAAPTQLAFRTVKGIGILDAAPVYEPLSGFERPEGNLRCSAYSPCGRYFAWASPEKVTVIDPSVGHIITNIPAENVFELGFSPLGTYLITWQRPSKDANGDAVKNLKVWKIVETAPDSNGDEHTIVGSYVQKSQTGWNLQYTSDERYCARVVTNEVQFYQSDNLSKVWNKLRVEGVIDFAVSPGKSQSVAVFVPERKGQPAAVKVFMVPQFGAPVSQKTFFKGDKVQLKWNASGTTLLVLAQTDVDRSGKSYYGETTLYLLGATGGFDSRVDLDKEGPIHDVTWSPNSREFGVVYGYMPAKTTIFNFRGVPQHSFALAPRNTISFSPHGRFVLVAGFGNLAGQMDIYDLEKNYFKIATVEASNASVCEWSPDGKYILTATTSPRLRVDNGVRLWHVSGALVYNEEMHELYDVFWRPQSTTQHPLGDPFHPLPTPHPSAVAYLSTRKAPVKPAGAYRPPGARGQLTPLAFKREDQGGATFIRDGANGGALNGLGKPRRREIPGADPVEEYLPPGAAPGGGVVLPPGADQPEKLSKSAARNKKKREAKKLKDGEDGQPARSPESHGDKGHHERSRSKANNSERKNANQANGASPASTKPNNNAAVEAAGTPTAQEKKIRGLLKKIRAIDELKMRLAGGEKLEDTQLKKIQTEESVRKELESLGFNG

SEQ ID NO: 63753 - protein, 336 aa, Pseudomonas syringae pv. syringae B728a
MINLTNLASSLARVALSDSTKPTIDRAMNVVSHIAGKVALQVNSSLLEQKGRLNERQQKGLEVILDALLGKEPVTHVETHEGGGRFNLARAAFDVASVVWERDQSMRNVMSFLGINDSKGNLLFSLGKTLADAMARPEPENGKHNSEANYAFFSSNLKLNKLMNDIADQVINEIRQQNTDRVRRPTPGPSWRPESTQQQARPQTPPSARPQANSAPPPPKAQPDAGAQRPSTERPPKTTPTGASAKVDDSAPAKPPVKQLYEHLGLSDMTADLSAVKKAYKKAALKYHPDKNAGNVAEANERFKKISNAFRILSDPELRTKYDNGVIDENGNEFKT

SEQ ID NO: 63754 - protein, 463 aa, Desulfitobacterium hafniense DCB-2
MALKVPRHEMPCQDPKERAHNFNEVALGYASETAIEEAQRCLQCKKPKCVEGCPVNISIPEFIQKITEEDFEGAAAVIKQSSSLPAVCGRVCPQESQCEAKCILGIKGESVAIGRLERFVADYEISKGCKIPEVAPPSGKKVAIIGAGPAGLACAGDLAKAGHKVTIFEALHVAGGVLMYGIPEFRLPKDIVQNEICNLEPMGVEILVNQVVGKVTSVHELMQNGYDAVFIGTGAGLPNFLGIPGENLNGVYSANEFLTRTNLMKGYRFPEYKTPVKIGKKVAVFGAGNVAMDAARTALRLGAEEVSIVYRRSRAEMPARHEELEHAEEEGVNFQLLTNPVAIQGDEKGAVKSLTCLRYELGEPDASGRRKPVPIPGSEFEIEVDTVVVAIGQGPNPLVTQSTEGLELNKWGNIVVNEETLETSIPGVFAGGDIVTGAATVILAMGAGKKAAAGINAYLKNKG

SEQ ID NO: 63755 - protein, 331 aa, Vitis vinifera
  misc_feature (61)..(61): Xaa can be any naturally occurring amino acid
  misc_feature (133)..(133): Xaa can be any naturally occurring amino acid
MVKAIRVHELGGPEVLKWEDVEIGEPNEGEICVKNQAIGVNFIDVYFRKGVYKATTMPFTXGMEAVGVVTAVGPGITGRKVGDVVAYAGTPMGSYSEEQILPANRVVPVPPSIDPTVGASIMLKGMTVHYLVXRCFKVEPGHIVLVHAAAGGVGSLLCQWANALGATVIGTVSTNEKAVQAKEDGCHHVIFYKEEDFVARVNEITSGNGVHVVYDSVGKDTFEGSLACLRARGFMVNFGQSSGIPDPVPLPSLGAKSLFLTRPSLMQYTATRDELLEAAGEVFANVASGVLRVRVNHTYPLSQAAQAHADLESRKTSGCVVLIPDCIGTTS

SEQ ID NO: 63756 - protein, 292 aa, Bacillus pumilus SAFR-032
MSHIVVVGSCSMDLVVTSNKRPNAGETVLGESFKTVPGGKGANQAVASARLGADVYMIGRVGDDTYGQDILSNLQDQGVRTSYMKPVTEMESGTAHIILAEGDNSIVVVKGANNEVTPDYVREALSTIDDIGMVLIQQEIPEETVEAVCAICSKKEIPVILNPAPARKVSQQVLDQATYITPNEHEAVLMFNGRSIEDALRQYPNKLLITEGKNGVRYFDGLKEVLVPGFPVEAVDTTGAGDTFNGALAVALTEGKSLYDALAFANLAASMSVTKFGAQGGMPTREELERKK

SEQ ID NO: 63757 - protein, 112 aa, Glycine max
  misc_feature (37)..(37): Xaa can be any naturally occurring amino acid
MASSMISSPAVTTVNRAGAGMVAPFTGLKSMAGFPTXKTNNDITSIASNGGRVQCMQVWPPVGKKKFETLSYLPDLDDAQLAKEVEYLLMKGWIPCLEIQLEQRFVFREPHQ

SEQ ID NO: 63758 - protein, 365 aa, Bordetella parapertussis 12822
MRARPARAPRSLPIRIAMSFQVTIEPSKHQFQAEAGQTVLDAALAAGIVLPYSCRTGACSTCKGKVVAGEVDAGPYPAQILSPEDLAQGYTLFCQAKPQSDLVVESTEVRLASDIQIRKLPSRVQTIERVAPDVAVLKLQLPASEQFRYYAGQYIEVILKDGKRRSYSMAGAPHTGSPLELHIRHMPGGLFTDHVFGAGDTQMKEREILRLEGPFGSFFLREDSDKPIVLLASGTGFAPVKAIVEHMIHNQIQRPAVLYWGGRRPRDLYHDALAQSWAGSLPGFRYVPVVSDALDEDGWSGRTGYVHEAVMQDLSDLSGYEVYACGTPLMVDAARREFSAQCGLPAEAFYADAFTSEADLAKATP

SEQ ID NO: 63759 - protein, 175 aa, Azoarcus sp. BH72
MGFDLVKAGKDVPNDINVIIEISAQGDPIKFEVDKDSGAVFVDRFMGTSMRYPLNYGYVPHTIAGDGDPVDVLVVTPFPLQPGVVIRCRPVGVLKMEDDGGVDAKVVAVPVSKLTPLYDKVQTTEDLPELLMKQTVHFFEHYKDLEPGKWVKVLGWGTVDEAKQEILDGLAKAAK

SEQ ID NO: 63760 - protein, 157 aa, Pseudomonas putida KT2440
MRIGHGYDVHRFCDGDFITLGGVRIPHKYGLLAHSDGDVLLHALSDALLGAAALGDIGKHFPDTDPQFKGADSRALLRHVVGIVKAKGWKVGNVDATIVAQAPKMAPHIETMRQLIAEDLQVELDQVNVKATTTEKLGFTGREEGIAVHSVALLLPA

SEQ ID NO: 63761 - protein, 175 aa, Kluyveromyces lactis NRRL Y-1140
MGAAPSRIVDNLLDDTNFDRAEIERLKKRFMKLDKDSSGSIDKTEFMSIPGVSANPLAKRIIEVFDEDNSGDVDFQEFITSLSIFSGRGETDAKLRFAFRIYDIDKDGYISNGELFIVLKIMVGTNLEDEQLQQIVDRTIMENDVDGDGKLSFEEFKKAAETTEVIQSLTLQHNI

SEQ ID NO: 63762 - protein, 353 aa, Desulfococcus oleovorans Hxd3
MAIMMSMAGAFSQADGGPADGSEKVKTATFAGGCFWCMEPPFEKLEGVKNVVSGYTGGQTANPTYKEVTSGKTGHLEAIQVIYDPEKISYQELLDVFWRQIDPTDTGGSFVDRGSQYRSAIFYHDEAQQAVALASKEALAASGRFAAPIATGVLPFTAFYPAEEYHQDFYRTNPSHYKRYRAGSGRDRYIQTIWEIPPLEASRQWSPGTYTRPSDAELKQRLTGLQYDVTRKDRTEPPFKNEYWDNKRAGLYVDVVSGEPLFLSADKFDSGTGWPSFTRPVAEDAVVYKRDRSLLMTRTEVRSRHADSHLGHVFDDGPPPSGKRYCINSAALRFIPVDELAAQGYGEYVKRLE

SEQ ID NO: 63763 - protein, 193 aa, Triticum aestivum
KIARVPPPSKLYTYIVQPWPPTVMASSATSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 63764 - protein, 321 aa, Oryza nivara
YVISVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPSFTFGCNLDSFGANEFGNVDGLLGMGAGPMSVLKQSSPRFDGFSYCLPLQKSERGFFSKTTGYFSLGKVATRTDVRYTKMVARRKNTELFFVDLAAISVDGERLGLSPSIFSRKGVVFDSGSELSYIPDRALSVLSQRIRELLLRRGAAEEESERNCYDMRSVDEGDMPAISLHFDDGARFDLGSKGVFVERSVQEQDVWCLAFAPTESVSIIG

SEQ ID NO: 63765 - protein, 695 aa, Ustilago maydis 521
MVTRTSQPHTSREKTASQSSSKSLASVEDGSQRSNLRAVHVPPTRRRSIAVIAAILALVCVTALALGLGLGLGLKHKHKSQSNVDSSTSNLVPGATASDLPFISREHLADPSQLTLDPTWNRFAPPQDRVYNWTLTQVLSNPAGVTKQMRLVNNLYPGPKIEANIGDRIIVHVENKMPVPTSIHWHGQYQRGSNEMDGSAGITECGIAPGTSFTYNWTVQQSGTYWWHSHYAPTYADGIFGPLILHGEDEKFRIINPDNATTTIPSNGTTVRANYDQDLIFVVNDAYQADSFSVAAFARSKSGPPGGDQGDEPVPDYGLINGLGFSNCALAPNGTSCISDDLTRKTAYNFTVPARKRVRMRFINAGSLASFRISIDGHSMTLIEADSTEVEPIVVQCFNIMVAQRYSVIVETDQPVGAYAVRAEVLDDMFAYDNPFLVMDQYAIMRYEGVSASTPPTSNAGNSTLVNVTESLSTSQLVPITRIDAPASNMTTKLVVNFGLDAFSQWHAFFNQTTFTSEMAPQASLMKAYTFEATRHALNTNSSVGAYYNDPDEMIVTNSEVVVMDVIVNNLDEGEHPFHLHGFTPFLIGAGAGNFQGPSNFSDTRINPMRRDVFSVPPFSWIAFRFVADNPGIWPFHCHLMPHMAIGLLMQFQILPDQIPLLAITDPFYSQCSAVNNWVQQNQKLLTSTGDPNDM

SEQ ID NO: 63766 - protein, 817 aa, Oryza sativa Japonica Group
MLSVHVFIGLLLLSLHAPPYSAAVDDTLAAGQVLAVGEKLVSRNGKFALGFFQPSAIAISKSSNYTNALGWYLAIWFNKIPVFTTVWVANRERPITVPRLNSTWLKMSGDGNLYILDHATNSIIWSTDHVVNTTTETGMNTSATLLNSGNLVIRNPSGVVSWQSFDNPTDVVLPGAKFGWNKATGLNRLGISKKSLIDPGLGSYSVELDTTGARGLILKHRNPSMEYWSSDRALIIPVLKSLFEMDPRTRGLITPAYVDNSEEEYYIYTMSDESSSVFVSLDVNGQIKMYVWSRANQSWQSIYAQPVDPCTPSATCGPFTICNGNSTQTCDCMESFSVKSLWDWELDDRTGGCIRDTPLHCVSDKNMTSSTDMFQPIGLVTLPYDPQIMQDATTQGECAQACLSDCSCTAYSYQNSRCSVWHGKLLNVNKNDGIYINADNVLHLRLAATDFQDLSKNKRKTNVELVVGASIVSFVLALIMILLMIRGNKFKCCGAPFHDNEGRGGIIAFRYTDLAHATKNFSEKLGAGGFGSVFKGVLTNMATIAVKKLDGAHQGEKQFRAEVSSIGIIQHINLVKLIGYCCEGDKRLLVYEHMLNGSLDVHLFQSHAAVLNWITMHQIAIGVARGLSYLHESCRECIIHCDIKPENILLDISYFPKLADFGMATFVGRDFSRVLTTFRGTVGYLAPEWISGVAITPKVDVYSFGMVLFEIISGRRNSPEVHTSGNYDATYFPVRAINKLHEGDMSSLVDPRLHGDYNLDEVVRVCKVACWCIQDDEFDRPTMREVVRVLEGLQELDMPPMPRLLATLTNFSAVASM

SEQ ID NO: 63767 - protein, 291 aa, Oryza sativa
MEGKEEDVRLGANKFSERQPIGTAAQGSDDKDYKEPPPAPLFEPGELKSWSFYRAGIAEFMATFLFLYITVLTVMGVNNSTSKCATVGIQGIAWSFGGMIFALVYCTAGISGGHINPAVTFGLFLARNLSLTRALFYMVMQCLGAICGAGVVKGFQKGLYETTGGGANVVAPGYTKGDRLGAEIVGTFILVYTVFSATDAKKNARDSHVPILAPLPIGFAVFLVHLATIPITGTGINPRRTWGCHHLQQGHAWGHAGEDHWIFWVGPLMGGALVAIYHQGVIRAIPFKSRW

SEQ ID NO: 63768 - protein, 136 aa, Glycine max
MNQNPQSSDGRNDDDSALSDFLASLMDYTPTIPDELVEHYLAKSGFQCPDVRLTRLVAVATQKFVAEVAGDALQHCKARQATIPKDKRDKQQKDKRLVLTMEDLSKALREYGVNLRHQEYFADSPSTGMDPATREE

SEQ ID NO: 63769 - protein, 484 aa, Crocosphaera watsonii WH 8501
MSATFSALRQIKKTFTKTVLFGNKPSAELFAILSVYFVQGILGLARLAVSFFLKDDLGLTPAQMGALTGIAAIPWVIKPLFGFISDGLPIFSYRRRPYLVISGLLGSLSWILLATVVSNVWLATVTLLLTSLSVAISDVIVDSLVVERARKESLSQAGSLQSLTWGVSAFGGLITAYLSGLLLERFSNQIVFEITAIFPFIVCLAAWLIAEEPVSKNELLSQQDQSLVKQQIKQVWKAIKQKSIFLPTAFVFLWQATPNGDSAFFYFATNELGFEPEFLGRVRLVTSVAALLGVLIYQKFLKNVSFRNILGWSVVISSAFGMTTLLLVTHTNRLLGIDDHWFSLGDSLILTVAGQIAFLPILVLSARLCPKGIEATLFALLMSIVNLANLLSHELGSLLTHWLGVTETNFNNLWLLITITNLSTLLPLPLVKWLPNNDPQAEELEEQENISYVGEVYEGKALGTVTDDALIPDVIPEFITNKKK

SEQ ID NO: 63770 - protein, 878 aa, Alkaliphilus metalliredigens QYMF
MMKYVYSFNEGDQSMKGLLGGKGANLAEMTRIGLPVPPGFTVTTETCNEYYTKGEKLWPELETEIFQQLAYIEEVTGKKFGDHHRPLLVSVRSGAVVSMPGMMDTILNLGLNDASVIGMAAATKNERFAYDSYRRFIQMFGDVVLGIEKYKFDTLLEKRKLDKGIEQDTDLTTEDLQYLVEAFQKIVLRESKMSFPQDVRVQLLMSVEAVFKSWNNPRANVYRKLNDIPKSLGTAVNIQSMVFGNMGETSGTGVAFTRNPSTGEKLLYGEFLMNAQGEDVVAGIRTPRVIQELGDKMPEVYQEFVDVADLLEAHYKDMQDIEFTIENSKLYLLQTRNGKRTAAAAINIAVEMVGEGVLTKKEAIMRVKPSQLDQLLHPTFDEKALNVATLITKGLPASSGAATGQVYFNGEDVVRINSAGGKAILVRQETSPEDIEGMVASQGILTARGGMTSHAAVVARGMGKCCIAGAGEVRIDEGQKYFKVGNQRYEEGQWISLDGNIGNVYEGKVPTKEPKLIGNFGVLMEWADQFRQLKIRANADTPRDTRQAIKFGAEGIGLCRTEHMFFEGTRINTVRKMIVANNIKDRQRALDQLLPMQKADFIEIFKEMGDRPVTVRLLDPPLHEFLPHGDEDIKELAQALEMTYQSLKEVVSDLKEFNPMLGHRGCRLAVTYPEIYEMQVKAIIEAAIEVKEQHGYNIVPEIMIPLIGEIKELQYIKNVIIKVIDGVIEEKNADLKYLIGTMIEVPRAAITADEIAEEAEFFSFGTNDLTQMTYGFSRDDAGRFISEYREKNILDHDPFQRIDRRGVGRLMEIAVELGRKVKPELKIGICGEHGGDPDSIDLCQELGLDYVSCSPYRVPIARLAAAQSVIKNKDQSKE

SEQ ID NO: 63771 - protein, 167 aa, Neisseria meningitidis
MFEPLWNNKYIESVQLTIAEQLGVEERGEFYDITGALRDMVQNHLMQMLCMTAMEAPASLDADAVRDEKVKVIKSLKPLTVESVNENVVRGQYTAARGMNGYLEEINVRKTALPKPTSAIKAEIENERWKGVPFYLRTGKRMAGKVAEIVLNFKDLNSHIFEGSRTA

SEQ ID NO: 63772 - protein, 485 aa, Thermoanaerobacter tengcongensis MB4
MKDKDLSNVMVIFGGTGDLTHKKLMPALYNLRYQNILPENFAVVAIGRRDKTEEEYRNEMLESVKTYSRFDIDEKIWQDLSSRIFYKRFDFNYDNGYMELSYFLDELDRKYNTQGNRVYYLAVAPEYFGIIVEKLYRHGMVSNETSWQRVVIEKPFGENLESARKLNKMITDVFTERNTYRIDHYLGKEMLQNIMVIRFANVFFEPVWNRRYIDNVQISSNETVGIENRGGYYEKAGALRDMVQNHMMQLLTLTAMEPPVNLDTESIRDEKVKVLKSLEIMTPELVEKNVVRGQYVGYRQEEKVSPTSNTETFVALKVHIENFRWAGVPFYIRTGKRMPEKSTQIVIQFKPLPGILYFKEYKNLLPNLLVIKIQPEEGVKLQFNAKVPGAGDITIEPVNMDFCQNCQISNNSPEAYERLLFDVMRGDSTLFTRWDEVEYSWRFVDAIAKAWAEKTPDFPNYYPGTWGPSEAEELLRRDGRMWWNV

SEQ ID NO: 63773 - protein, 205 aa, Thermoanaerobacter tengcongensis MB4
MKIYDISMEIHENMTVYKNKEEKRPQHTITVQKGDVTESRICMDMHTGAHIDAPLHMINGGDTIENLDLSKVITRCKVFDFTHISDKITREDLKDKNIEKGDFVIFKTRNSFREDFDFQFVYLEKSGAEFLKEKGVVGVGIDALGIERDQPEHETHKILLGAGVVILEGLRLKEVEEGEYFLFAAPLKIKGAEAAPTRAVLIKEE

SEQ ID NO: 63774 - protein, 155 aa, Fusobacterium nucleatum subsp. vincentii ATCC 49256
MNINIICVGKIKDKYINDGIAEFSKRMTSFVTLNIIELKEYNKEDSINISIEKESLEILKQISKSNSYNILLDLDGKEINSENMSKYIDNLKNKGISSINFIIGGSNGVNKELKNLVDMKLKFSHFTFPHQLMRLILLEQVYRWFAISNNIKYHK

SEQ ID NO: 63775 - protein, 104 aa, Glycine max
MAALGSKLAQLQAKACEATRFVTRNGCAYHKTLIEKNKQFVVQPPTVEKCQELSKQLFYTRIASLPVRYEAFWKEADQVKQLWRNRKDLNVEHAGIIALFGLEL

SEQ ID NO: 63776 - protein, 303 aa, Oryza sativa Japonica Group
MIDDNVQREIINHRSLKHPNIIRFKEVILTPTHLAIVMEYASGGELFERICKNVRFSEDEARYFFQQLISGVSYCHSMQVCHRDLKLENTLLDGSPAPRLKICDFGYSKSSVLHSQPKSTVGTPAYIAPEVLLKKEYDGKTADVWSCGVTLYVMVVGAYPFEDPEEPKNFRKTIQRILNVQYSIPENVDISPECRHLISRIFVGDPSLRITIPEIRSHGWFLKNLPADLMDDDSMSSQYEEPDQPMQTMDQIMQILTEATIPPACSRINHILTDGLDLDDDMDDLDSDSDIDVDSSGEIVYAM

SEQ ID NO: 63777 - protein, 486 aa, Yersinia pestis biovar Microtus str. 91001
MALRLVTGVILQTGVFLMSKQQIGVVGMAVMGRNLALDIESRGYSVSIFNRSSDKTDEVVAENPGKNLVPSYTVEEFVDSLEKPRRILLMVKAGEATDKTIASLTPHLDKGDILIDGGNTYYKDTIRRNRELSAQGFNFIGTGVSGGEEGALKGPSIMPGGQKEAYELVAPILEKIAARADDGDACVAYIGADGAGHYVKMVHNGIEYGDMQLIAEAYSLLKQSLGLSNEELASTFAEWNKGELNSYLIDITKDIFTKKDEDGNYLVDVILDEAANKGTGKWTSQSSLDLGEPLTLITESVFARYLSSLKDQRVAASKVLTGPKVQPFTGDKAEFIEKIRRALYLGKIVSYAQGFSQLKAASNENNWDLNYGEIAKIFRAGCIIRAQFLQKITDAYAENADIANLLLAPYFKQIADEYQQALRDVVSYAVQNGIPTPTFSAAINYYDSYRSAVLPANLIQAQRDYFGAHTYKRTDKEGVFHTEWMA

SEQ ID NO: 63778 - protein, 439 aa, Bacillus pumilus SAFR-032
MNIAIAGCGYVGLVTGVCLAEAGHNVACIDIDRRKIMQLKQGRPPMYEPGLKELLKRNLAQGRIQFHINGEVAYPQADVLMIAVGTPQQADGQADLQYVLQAAKEIGTKAKSGAVLVVKSTVPVGTGDQIEQMIHQELGRKEPLSIASNPEFLREGSAISDTLRADRLVIGAETKAVLDRLEEMYADFHLPVVKTDRKSAEMIKYASNAFLATKISFMNEIASICEKTGADVEWVAQGMGLDQRIGSSFLKAGIGYGGSCFPKDTNALVQIAGHVSHDFELLKAVIKVNNEQRAGFIRSIQERLGANLEGKRIALLGLAFKPNTDDMREAPSVPIAHELHQLGAELVAYDPVASRHAARELPDQVVFAHTIEEAIKDVHAVCILTEWTEIQTFPLKSYKEWMRQPLIFDGRNCHTLEAAEQAGVEYHSIGRRPVSPIYM

SEQ ID NO: 63779 - protein, 505 aa, Kluyveromyces lactis NRRL Y-1140
MDLRVGRKFRIGRKIGSGSFGDIYHGTNLISGEEVAIKLEPIRTKHPQLDYESRVYKYLSGGIGIPFIRWFGKEGEYNAMVIDLLGPSLEDLFNYCHRKFSFKTVIMLALQMICRIQYIHGRSFIHRDIKPDNFLMGVGRRGSTVHVIDFGLSKKYRDFRSHNHIPYRENKNLTGTARYASVNTHLGIEQSRRDDLESLGYVLIYFCKGSLPWQGLRATTKRQKYDRIMEKKLCITVEQLCQGLPMEFVEYMRYCRNLRFDERPDYMYLARLFKDLFIKLEYHNDHLFDWTMLRYTKAMIDKQGGAQALEQKDENGNKQDSFDKVKQLAMKKFSTHFHYWKPDDTSHPTAEDIKQQTILNTQVISTIPDEVMNAIDRNMEQLKHEVNQQVASQPQQGQPQGQTQGQGQTQGQGQPQSGQQLDTQLPQPTTLLQQQRAQVQGQQEQMLQQQQQQQQQQQQQQQQQQLLQQQLQTQQQTHPNAMAITNPLPNPNNTTKTTTTNNIWL

SEQ ID NO: 63780 - protein, 355 aa, Prochlorococcus marinus str. AS9601
MTFLDIKNAKAAILVKQNSPLIVDDIQFPKQLDYGQVLVKVLVSGICGSQLGEISGAKGEDKYIPHLLGHEGCGIVKAIGPGVKTVKVNDKVVMHWRPGSGIQSDPPKYKFQGRDLNAGWVTTFNEYGIISENRCTSINKDLDPEIGSLLGCAVTTGFGVVENNAKLKIGESIVIYGAGGIGLSVIEAAKAVSAWPIIAVDIFDNRLNLAREIGATHIINGKSGDVENKINSILKNKPLNVFIDNTGIPSIIELGYSLVDKFGIIVLVGVPKIGNNINIFSLPLHFGKTIVGSHGGESNPDSDIPRYINHFIKNKVDPKKIITQRFDLENINKAIDSIKSGDTAGRIIIELSHKK

SEQ ID NO: 63781 - protein, 304 aa, Prochlorococcus marinus str. AS9601
MRTAFAKEITNIAEMRKDVVLLSGDIGNRMFDDFKLIANSRFFNCGIAESNMMSVASGMALCGLRPIIYTITPFTTIRCLEQIKIGAAYHKVPVIIIGTGSGLSYAELGATHHSLDDVSVIRSIPDIRVLAPCDSSELKAFLHQSLQSEFPTYMRIGKKGEPILTKESSKIEIGKANILKDGNDIIILGIGPILNEALEAANNKNIDREKVSVVSMGSVKPLDTNFLNQINKRKFKKWIILEEHSIIGGLGSSIIEWKIDNKIKTPEIKRMAAPDKFIHNLGNQKYIRKEIGLDSNSILQEIIF

SEQ ID NO: 63782 - protein, 186 aa, Methanothermobacter thermautotrophicus str. Delta H
MFMILIINNHGQYNHRIHRTLRYLQIPSELVPNTTPLDEIISRDPEGLILGGGPSLERSGNCVEYIQKLEIPILGICLGHQLIAKAYGGEVATAEAESYAQIELEILDEDDIFRGLGPRMSVWASHKDEVKKLPDEFDVLATSSICEVEAMKHHDKPVYGIQFHPEVHHTREGHRVFENFYDVCRS

SEQ ID NO: 63783 - protein, 311 aa, Methanothermobacter thermautotrophicus str. Delta H
MMLMLNPSDFIEEAVEEIRSTVGNEKAIIALSGGVDSSVASVLAGRAIGDNLTAVFVDHGLLREGEAEYVRKTFSERLNFRYIDASEEFLKELEGVTDPEEKRKIIGRVFIEVFERVAEEIGARYLVQGTIAPDWIESEGQIKSHHNVALPHGLVLEIVEPIRELYKDEVREIGLELGLPREMIQRQPFPGPGLAVRIVGEITREKIEICRRANAIVEEEVVESGLHESLWQYFAVLTDTMVTGVKGDVRDFGYLVVIRMVESLDAMTASVPELPWDLIKRISKRITAEIPEVTHVALSVSDKPPSTIEFA

SEQ ID NO: 63784 - protein, 175 aa, Secale cereale
  misc_feature (168)..(168): Xaa can be any naturally occurring amino acid
MAPAVMASSATTVAPFQGLKSTAGLPVGRRSGSAGLSSVSNGGRIRCMQVWPIEGIKKFETLSYLPPLSTEALLKQVDYLIRSKWVPCLEFSKVGFVFREHNNSPGYYDGRYWTMWKLPMFGCTDATQVLNEVEEVKKEYPDAYVRVIGFDNMRQVQCVSFIAFRPPXCEESGKA

SEQ ID NO: 63785 - protein, 638 aa, Oryza sativa
MLSARAAATAAAAAASPLWKRGEGGSSGSGSGCTSCREVRRRAAVRVRTPVPRRVEAVAMESAAETEKKEEVAAAGGGVEDMATEEVPVTPWAFSVASGYTLLRDPHHNKGLAFSEKERDAHYLRGLLPPAVVSQDLQVKKIMHNLRQYSVPLQRYMAMMDLQERNERLFYKLLIDNVEELLPVVYTPTVGEACQKYGSIFRQPQGLYVSLKDKGKVLDVLRNWPERNIQVIVVTDGERILGLGDLGCQGMGIPVGKLSLYTALGGVRPSACLPITIDVGTNNEQLLNDEFYIGLRQRRATGKEYHELMEEFMSAVKQIYGEKVLIQFEDFANHNAFDLLAKYSKSHLVFNDDIQGTASVVLAGLLSSLKVVGGTLAEHTYLFLGAGEAGTGIAELIALEISKQTKAPIEECRKKVWLLDSKGLIVNSRKESLQAFKKPWAHEHEPVTTLLDAVQSIKPTVLIGTSGVGKTFTKEVIEAMASFNERPVIFSLANPTSHSECTAEEAYNWSQGRAVFASGSPFDPVEYNGKIHVPGQSNNAYIFPGFGLGVVISGAVRVHEDMLLAASETLADQATQENFEKGSIFPPFTNIRKISARIAATVAAKAYELGLATRLPQPRDLEKYAESCMYTPVYRSYR

SEQ ID NO: 63786 - protein, 175 aa, Secale cereale
MAPTVMASSATSVAPFQGLKSTAGLPVSRRSNGASLGSVSNGGRIRCMQVWPIEGIKKFETLSYLPPLTTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 63787 - protein, 507 aa, Saccharomyces cerevisiae
MTKSEQQADSRHNVIDLVGNTPLIALKKLPKALGIKPQIYAKLELYNPGGSIKDRIAKSMVEEAEASGRIHPSRSTLIEPTSGNTGIGLALIGAIKGYRTIITLPEKMSNEKVSVLKALGAEIIRTPTAAAWDSPESHIGVAKKLEKEIPGAVILDQYNNMMNPEAHYFGTGREIQRQLEDLNLFDNLRAVVAGAGTGGTISGISKYLKEQNDKIQIVGAEGFGSILAQPENLNKTDITDYKVEGIGYDFVPQVLDRKLIDVWYKTDDKPSFKYARQLISNEGVLVGGSSGSTFTAVVKYCEDHPELTEDDVIVAIFPDSIRSYLTKFVDDEWLKKNNLWDDDVLARFDSSKLEASTTKYADVFGNATVKDLHLKPVVSVKETAKVTDVIKILKDNGFDQLPVLTEDGKLSGLVTLSELLRKLSINNSNNDNTIKGKYLDFKKLNNFNDVSSYNENKSGKKKFIKFDENSKLSDLNRFFEKNSSAVITDGLKPIHIVTKMDLLSYLA

SEQ ID NO: 63788 - protein, 102 aa, Chlamydophila pneumoniae CWL029
MVKIISSENFDSFIASGLVLVDFFAEWCGPCRMLTPILENLAAELPHVTIGKINIDENSKPAETYEVSSIPTLILFKDGNEVARVVGLKDKEFLTNLINKHA

SEQ ID NO: 63789 - protein, 347 aa, Aspergillus nidulans FGSC A4
MAEFIRSDILGTTFETTSRYANLQPVGLGTAGVVCSAYDLISEQVVAIKKMMKPFHSTSVAKRTYREVKLLRHLRHDNLINMSDIFISPLEDVYLVTELLGTDLHRLLNGKPLESKFAQYFTYQILRGLKYIHSAGVIHRDLKPGNLLINENCDLKICDFGLARVQEPQMTGYVSTRYYRAPEIMLTWQRYGSKVDLWSVGCILAEMLLGRPLFPGTDHINQFWLITDLLGNPPDEVIDRITTNNVRNPAPDLQPSNHLEPANGNRRIDSSGALNLLDNLLVFDPDRRISAEQGLMHPWMAPYHDPTDEPVATEQFDWSFNDADLPLDTWKIMMYVHHCSDVVSFTL

SEQ ID NO: 63790 - protein, 321 aa, Oryza rufipogon
YVISVGLGTPAKTQIVEIDTGSSASWVFCECDGCHTNPRTFLQSRSTTCAKVSCGTSMCLLGGSDPHCQDSENYPDCPFRVSYQDGSASYGILYQDTLTFSDVQKIPSFTFGCNLDSFGANEFGNVDGLLGMGAGPMSVLKQSSPTFDGFSYCLPLQKSERGFFSKTTGYFSLGKVATRTDVRYTKMVARRKNTELFFVDLAAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 63791 - protein, 283 aa, Thermoanaerobacter tengcongensis MB4
MIRGCRMKVGYLGPKGTFSEEAVFKYIEGMKECEAIEFATIQDVVKSVAEGTCDEGILPVENSIEGSVNVSLDLLINDAEGILVRGEVIISISQCLICDDFIDFKDVHCILSHPQALAQCREYILNNFPTAEVKTTESTVKALLGVNAKKGIVAIGPERAAWLYNLKILEKDVQDIKENYTRFLVIAKRDSDYTGEDKTSIVFSVPNVPGSLYRALGVFAEKNINMTKIESRPSRKKFGEYVFWVDIEGHRKEERIKEALEDLKIKADFLKVIGSYPKFKMGK

SEQ ID NO: 63792 - protein, 884 aa, Oryza sativa Japonica Group
MAVGLPIVFGCHDYSGFTNIDCGFVDGESYTDSTTNLTYVPDHEFVEGGTHHEVVPKLISGSTDEQEKTLRSFPDGQRNCYTIPSTSGKKYLIRTTFTYGNYDGLRSSENGSLFLFGLHIGVNFWTTVNLTKQDSSDTIWKEVLTVAPDEFIYVCLVNFGSGTPFISALELRQLDDPMYPFLNLFVSVSYFTRMRFGAVDDFITRYPTDLFDRFWEAAQCYSYPWLNLTTNQTVNKLPGNDNFQVPTLIVQKASTINSGFSWLNISITAGDNLNGQSLELLPIFHFAEIEKNRPNRTFQIYSDGNELHQAFSPSYLQVDSVYLRDRYLHESGTTFTLCKTNSSELPPLINAFEAYSLVRMENLTTDTIDVSSMKQVKTQYNVQRRSWNGDPCSPKEYTWEGVKCNYYDGKQNPRIILVNLSASRLSGWINPSFRNMSLEILDLSHNNLSGTIPYNQVNSLKSLNLSYNQLIGSVPDYLFKRYKAGLLELRLEGNPMCSNISESYCAMQADKAKKNTATLLIAVIVPVVAITLMLFLWMLCCKGKPKEHDDYDMYEEENPLHSDTRRFTYTELRTITNNFQSIIGNGGFGTVYHGILGNGEEVAVKVLRETSRALSKDFLPEVQTLSKVHHKNLVTFLGYCLNKKCLALVYDFMSRGNLQEVLRGGLEYLHESCTPAIVHRDVKTANILLDENLVAMISDFGLSRSYTPAHTHISTIAAGTVGYLDPEYHATFQLTVKADVYSFGIVLLEIITGQPSVLVDPEPVHLPNWVRQKIARGSIHDAVDSRLMHQYDATSVQSVIDLAMNCVGNVSIDRPSMTEIVIKLKECLLAGTGKKQLVSGSYKQKDAMDAGIARQFQLLISGVPIVSNECISGGITELSYYSGR

SEQ ID NO: 63793 - protein, 319 aa, Rhizobium leguminosarum bv. viciae 3841
MPARQASNGSGEIMGVWIDTDMGFDDIAAILMVGQSEFEIDGISLVFGNTPLPQVRINAAGAASAFGWTFPIHTGRAMPVLGKLETAQAILGETGIPTSGRSLPPAADLAESDAFTALCRWLERKGQHRILALGPLTNIAAVALARPDLAARITELVWMGGGVTSGNHTASAEFNALADPEALSIVIAHGLPLRMVDLDLCRKVLARPEDAEPVRNAGGANAELIADMFSGYIRIGTSRGRPAMAIYDPSAAVAFVAPDIVSFRPARIDVELQGALTRGRTVVETRATHATFNAQFAADIDADMARVIILAALVNEARK

SEQ ID NO: 63794 - protein, 503 aa, Ralstonia eutropha JMP134
MEQSKAGTLIGAFAEFFPGATEIGSYVGGRLVAGTGQEIQLFDPATGEKSLSYRDAGPEIAQQACIAARDAQKTWWGLTHAARGRILYAVAAKVREHNEPLAVLESMSQGKPIRDSRREVEMVAEMFEFYAGWADKFYGHVIPVPTTHLNYTRREPYGTILHIAPWNIPILSFGWQVAPTVAVGNAVLLKPSELTPFTSLAVASLAEQAGVPVGLINVLAGYGHTTAQAAIADDVVKKVVFVGSPATGIRIAEAAAKRVIPCILELGGKSANIVFDDANLDLAAIGAQAAVFSGAGQSCTAGSRLLIQRKVYEQVVDKVAEGARKLRLGHPLEASTEIGPINNRNQYEHIKRMIARGVEEGAQLAAGTTSFGDGGYFVPPTLFAGVSNQMDIARMEVFGPVISAIPFETEEEAIAIANDNEFGLAGAVWTNDVARAHRVAAQVDAGTFWINGYRAIHVGSPFGGYKNSGYGRTSGIEALYEYTQTKSVWVQTASASVTAIGRA

SEQ ID NO: 63795 - protein, 570 aa, Salmonella typhimurium LT2
MSEKHPGPLVVEGKLSDAERMKLESNYLRGTIAEDLNDGLTGGFKGDNFLLIRFHGMYQQDDRDIRAERAAQKLEPRHAMLLRCRLPGGVITTTQWQAIDKFAADNTIYGSIRLTNRQTFQFHGILKKNVKPVHQMLHSVGLDALATANDMNRNVLCTSNPYESQLHAEAYEWAKKISEHLLPRTRAYAEIWLDQEKVATTDEEPILGQTYLPRKFKTTVVIPPQNDIDLHANDMNFVAIAENGKLVGFNLLVGGGLSIEHGNKKTYARTASEFGYLPLEHTLAVAEAVVTTQRDWGNRTDRKNAKTKYTLERVGLETFKAEVERRAGIKFEPIRPYEFTGRGDRIGWVKGIDDKWHLTLFIENGRILDYPGRPLKTGLLEIAKIHQGEFRITANQNLIIASVPESQKAKIETLARDHGLMNAVKPQRENSMACVSFPTCPLAMAEAERFLPSFTDKVEAILEKHGIPDEHIVMRVTGCPNGCGRAMLAEIGLVGKAPGRYNLHLGGNRIGSRIPRMYKENIAEPDILASLDELIGRWAKEREAGEGFGDFTVRAGIIRPVLDPARDFWE

SEQ ID NO: 63796 - protein, 416 aa, Musa acuminata
MFLLLFLVILNLAQSQILFQGFNWESWRQQGGWYNFLKDKVSDIANAGVTHVWLPPPSHSVGVQGYMPGRLYDLGASKYGNQDELKALIGAFHDKGVKCVADIVINHRCADKQDGRGIWCIFEGGTDDARLDWGPHMICRDDTQYSDGTGNLDTGEGFAAAPDIDHLNTQVQHELTDWLNWLKTDIGFDGWRLDFAKGYSSSIAKIYVEQTQPNFVVAEIWSSLAYRNDGKPTYDQNGNRQGLVNWVQQVGGPVTAFDFTTKGILQAAVEGELWRMRDPQGKAPGMMGWWPEKAVTFVDNHDTGSTQKLWPFPSDKVMQGYAYILTHPGVPSIFYDHMFDWGLKEKITRLAKTRTRNRIHSGSSLNILASDADLYMAMIDGKILTKLGSRYDVGNLVPSNFHVVASGNDYCVWEKR

SEQ ID NO: 63797 - protein, 606 aa, Azoarcus sp. BH72
MSLVEVKVPDIGDFDSVPVIELFVKVGDTIKVDDAICTLESDKATMDVPSSAAGVVKEVLVKVGDKVGEGAVLLKVEAAGAAASPLQGEGRGGDGVKPASDVPHPPPSLPLEGGGAKAAPAAASHTGGADAEYDMVVLGAGPGGYSAAFRAADLGLKTAIIERYATLGGVCLNVGCIPSKALLHVAAVIEEAEHVETAGIKFAKPSVDVDALRKHKDGVIGKLTGGLAGMAKARKVDVIRGYGSFLDPHHLEVEETTGNGQDKTGAKKVVKFKNCIIAAGSAAVHLPFIPKDPRIVDSTGALELRQVPGKMLVIGGGIIGLEMATVYSTLGARIDVVEMLDGLMQGPDRDAVKVWEKQNAARFDKVMLKTKTVAVEAKDDGLWVKFEGEGAPAEPVRYDMILQSAGRSPNGKKIGADKAGVIVGERGFIPVDVQMRTNVPHIFAIGDIVGQPMLAHKAVHEAHVAAEVAAGHKAAFDATVIPGVAYTHPEVAWVGYTEAQAKSEGKKVEVAKFPWAASGRAIANGADYGFTKLIFDAETHRVIGGTIVGPSAGDMIGEVCLAIEMGADAVDIGKTIHPHPTLGETVGMAAEVAHGSCTDLPPMRKK

SEQ ID NO: 63798 - protein, 337 aa, Bordetella parapertussis 12822
MSSPDWRLCVAPMIDVTDRHCRYFHRLLAPRARLYTEMITTGALLHGDVARHLDFDAAEHPVALQLGGSEPDALAQAARLGRQWGYDEINLNCGCPSERVQRGAFGACLMAEPGLVADCMKAMQDAVDIPVTVKHRLGLDYDESYGFVRDFVGQIYDTGCRVFVVHARNAVLKGLSPKDNREIPPLRYDVARQLKRDFPDCVIVLNGGLADAQAARAVAGEFDGVMLGRAAWHTPRVLSEVSLQWWPAIRLPSDAQVVDAMMQYAATQIARGVPLRVMTRPLLGLVNGQAGARRWRRLLSDPVRLAANDPSLLYEAWRSLQGAPRERDACADPLPAV

SEQ ID NO: 63799 - protein, 562 aa, Azoarcus sp. BH72
MSQLIEVKVPDIGDFDSVPVIELFVKVGDTIAVDDAIATLESDKATMDVPSSAAGVVKEVLVKVGDKVSEGALLIKVEAAGAAAAAPAAAAAAPAPAPAPAAPAPAPAPAGAAPAAAGGVVDVVVPDIGDFSDVPVIELFVKVGDTIKVDDAIATLESDKATMDVPSSAAGVVKEVLVKVGDKVSQGSLLLKLESGAAAAAPASPPPLQGEGRGGDGVKPASNVPHPPPSLPLEGGGAKTAAAPAAPSAVTLGGKVHASPSVRAFARELGVDLAQVKATGPKNRVLKEDVAAFIKGAMSTGVVPGKTPAAAAGASLGGGLDLLPWPKVDFAKFGEVEVKPLSRIKKISGQNLARNWVMIPAVTYHEDADITDLEAFRVQMNKEYEKSGKKLTMLAFIIKASVRALQEFPEFNTSLDGDNLVYKKYFNIAFAADTPNGLVVPVVKDADKKSVFQIAEETGALAKKARDGKLGPADMSGACFTISSLGGIGGTYFAPIVNAPEVAILGVNKSVMKPVWDGKQFVPRLTLPMSLTADHRVIDGALATRFNVYLAQLLADFRRVML

SEQ ID NO: 63800 - protein, 157 aa, Bordetella parapertussis 12822
MLKVSEILRVKGDTLYTASPDTHVSMAVQTMSEQDIGSLVIMESGMLAGMLTFREIIRHIDQHGGNVGDTTIRAIMDDAPVSVSPNTSADEVQRLMLEKHARYIPVMDGPTLLGVISFYDMAQAIVAAQQFENNMLKAYIRDWPMGVGAVQALIRQR

SEQ ID NO: 63801 - protein, 495 aa, Bordetella parapertussis 12822
MKWLRLQDLPTDNSFAALPAEFYTRLQPRPPAAPRLLHANAEAAALIGLDPAEFSTQAFLDVFSGHAPLPGGDTLAAVYSGHQFGVWAGQLGDGRAHLLGEVRGPAGGWELQLKGAGMTPYSRMGDGRAVLRSSVREYLASEAMHGLGIPTTRSLALVVSDDPVMRETVETAAVVTRMAPSFVRFGSFEHWSARRQPEQLRVLADYVIDRFYPECRVAGAGRLDGEHGEILGLLAAVTRRTALLMADWQAVGFCHGVMNTDNMSILGLTLDYGPYGFMDTFQLGHICNHSDSEGRYAWNRQPSVGLWNLYRLASSLHTLAPDPEALRAVLDGYEAVFTQAFHGRMAGKLGLPQFLPEDETLLDDLLQLMHQQGADFTLAFRRLGEAVRGQRQPFEDLFIDRAAAGAWYDRLAARHASDGRAAQARAAAMDEVNPLYVLRNHLAEQAIRAAARGDAGEIDILLKLLRNPYKQQPGYDAYAGLAPDWAAGLEVSCSS

SEQ ID NO: 63802 - protein, 170 aa, Kluyveromyces lactis NRRL Y-1140
MLRQVVRSSGVFARNSCRLGLVRYQSTAGTSTPAAAVDPKISQIVQDISKLTLLETSALIQELKTQLNIPDISFPAAGAGSAAPAAPAEEAKEEEVVEEKTIFSIKLESFDAKSKPKIIKEVKNLLGLSLVEAKKFVESAPKVLKENVAKEDADKVKAALEGLGAKIVLE

SEQ ID NO: 63803 - protein, 493 aa, Candida glabrata CBS 138
MFRAVSRRGFSSSSYLAAIKKQHDLVIIGGGPGGYVAAIKAAQLGLDTACIEKRGSLGGTCLNVGCIPSKALLNNSHLYHQIKSDTKNRGIDVKGDVEINVEQFQKAKDTVVKQLTGGVEMLFKKYKVNYYKGVGSFESENSVKVTPVEGIKGTVEDETIIEAKNIIIATGSEVTPFPGIKIDEERIVSSTGALSLKEVPKRLAVIGGGIIGLEMGSVYSRLGSKVTVLEFQPKIGASMDGEVAATSQKFLKKQGFNFKLSTKVVSAERNGDVVDIVVEDTKSGKTENIQADVLLVAVGRRPYIEGLGAEKLGLEVDKRGRLVIDEQFSTKHPHIKVIGDVTFGPMLAHKAEEEGIAAVEYIKKGHGHVNYGNIPSVMYTHPEVAWVGKTEEQLTEEGIKYKVGKFPFIANSRAKTNMETEGFVKILIDAETERMLGAHIIGPNAGEMIAEAGLALEYGASAEDVARVCHAHPTLSEAFKEANLAAFDKPINF

SEQ ID NO: 63804 - protein, 408 aa, Triticum aestivum
  misc_feature (404)..(404): Xaa can be any naturally occurring amino acid
MATRTTAHGATGDDEVAEAAGTALRHRHGHAGKGAGEAANGGASPEDASVEQVFADKAVPSWREQLTVRALVVSALLAVMFSVIVMKLNLTTGIIPSLNVSAGLLGFFFVRLWTNAFERMGLVGHPFTRQENTVIQTCVVSAYGIAFSGGFGSYLFGMSDTIAKQATEANDPWNIKEPHLGWMIGFLFLVSFIGIFALVPMRKIMIVDYKLTYPSGTATAYLINGFHTPEGAKLAKKQVKILGRYFMVSFFWGFFQWFFSGGDDCGFKNFPTLGLEAYKNRFYFDFSPTYIGVGMICPHIVNVSVMLGGIISWGIMWPLMGKKKGSWYPASLPESSLHGLQAYRVFISIALILGDGLYNFVKVLIRTIAGFISMVHKNSKAMLPVSDNGSPTAEAMSFDDERRXELFL

SEQ ID NO: 63805 - protein, 308 aa, Prochlorococcus marinus str. AS9601
MLNPIKLASKNFLSSLDTSLEEFLHILELAKNFKNKDLSIKLQEKVLGLIFDKSSTRTRVSFQVAMSRLGGTTVDLNPTTSQIGRGEPIRDTARVLSRYCDVLAIRTFKQTDLEEYAKWSSKPIINALTDLEHPCQALADFMTIKEEFLDFNDVVLTFIGDGNNVANSLILCGALLGVEVRIACPKGYEPNSLLIDKAYEIYENKNLLKITNEPNTAVLGANVLYTDVWSSMGEENQKDEKEKVFNGFTIDRDLVSKADKDAIILHCLPAYRSKEITDEIFESHKSRIFDQAENRLHAQQALLSCILQ

SEQ ID NO: 63806 - protein, 321 aa, Oryza rufipogon
YVTSVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPSFTFGCNLDSFGANEFGNVDGLLGMGAGPMSVLKQSSPTFDGFSYCLPLQKSERGFFSKTTGYFSLGKVATRTDVRYTKMVARRKNTELFFVDLAAISVDGERLGLSPSIFSRKGVVFDSGSELSYIPDRALSVLSQRIRELLLRRGAAEEESERNCYDMRSVDEGDMPAISLHFDDGARFDLGIHGVFVERSVQEQDVWCLAFAPTESVSIIG

SEQ ID NO: 63807 - protein, 414 aa, Mycobacterium smegmatis str. MC2 155
MTAAKTLDVTAIRADFPILSRVMRGGNQLAYLDSGATSQKPLQVLDAEREFLLTSNGAVHRGAHQLMEESTDAYEQGRADIAAFVGADPDELVFTKNATEAINLVAYVLGDKRFERAVGPGDVIVTTEVEHHANLVPWQELAERTGATLKWYGVTDSGRIDLDSLELDERVKVVAFSHHSNVTGAVAPVAELVSRAKAVGALTVLDACQSAPHQPVDLHALDVDYAAFSGHKMLGPTGIGVLYGRRGLLDAMPPFITGGSMIETVTMEKTTFAPAPQRFEAGTPMTSQVVGLAAAARYLTALGMPAVEAHEAELVAAALEGLAGVPGVRIIGPTAMENRGSPVSFVVDGVHAHDVGQVLDDDGVAVRVGHHCAWPLHRRFGIAATARASFAVYNTLDEVDRLVAGVKRAVEFFA

SEQ ID NO: 63808 - protein, 172 aa, Glycine max
MLRIAASAKTIVRTGSLEAPPLGIRVLPRLYHERVVDHYDNPRNVGSFDKNDPTVGTGLVGAPACGDVMKLQIKVDDKTGKIVDARFKTFGCGSAIASSSVATEWVKEKQIEEVLTIKNTEIAKHLSLPPVKLHCSMLAEDAIKAAVKDYEAKRASASAGGQTTTGEKAATA

SEQ ID NO: 63809 - protein, 321 aa, Oryza rufipogon
YVISVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPGFSFGCNMDSFGANEFGNVDGLLGMGAGPMSVLKQSSPTFDCFSYCLPLQKSERGFFSKTTGYFSLGKVATRTDVRYTKMVARKKNTELFFVDLIAISVDGERLGLSPSVFSRKGVVFDSGSELSYIPDRALSVLSQRIRELLLKRGAAEEESERNCYDMRSVDEGDMPAISLHFDDAARFDLGSHGVFVERSVQEQDVWCLAFAPTESVSIIG

SEQ ID NO: 63810 - protein, 341 aa, Mycobacterium smegmatis str. MC2 155
MAASLRVPKVVVLGGGSWGTTVASICARRGPTLQWVRSEETAKDINENHRNSRYLGDDVVLPDSLTATNDFSEAAACADVIVMGVPSHGFRGVLQELARELRPWVPVVSLVKGLEQGTNLRMSQIVDEVLPGHPAGILAGPNIAREVAEGYAAAAVLAMPDQHLAAKLAELFRTKRFRTYTTDDVTGVEMAGALKNVYAIAVGMGYSLGIGENTRAMVMARAVREMAKLGEAAGGHRDTFAGLAGMGDLIVTCTSQRSRNRHVGEQLGAGKKIDEIIASMNQVAEGVKAASVIMEFADQYGLNMPIAREVDAVINHGSSVEQAYRGLMAEKTGHEVHSSGF

SEQ ID NO: 63811 - protein, 424 aa, Xylella fastidiosa Ann-1
MSNSPQTPLVTRQRLSEVRYEIRGELARRARELEAEGRKLIKLNIGNPGAFGFRAPEHLQRAIADDMGRTDPYTHQQGLPIAREAIAAAYARRHYPDVDADRVFVGNGVSELIDLSLRALLNPGDEVLVPSPDYPLWSAATILNDGRPVYYRCAPENGFQPDAVEIETLVSSRTRAIVLINPNNPSGANYSQELLERIVAIAVKHHLLLLVDEIYDQILYDGAVFVPVAPLAGTHPCITFSGLSKVHRACGWRVGWALLSGSSIQVDNLRNAMDLLGALRLCANVPGQYAIDAAVNGPDTITPLCSPGGPLYETRRAVIDACAASEHLSLVVPAGALYAFPSVVGPAARHFDDYAFALELMNEEGVLVVPGSSFNVPYRDHFRVTLLPDAGLIREVFSRIDRALSRRAEVADKVVPLKSRSAAA

SEQ ID NO: 63812 - protein, 321 aa, Oryza rufipogon
YVISVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPSFTFGCNLDSFGANEFGNVDGLLGMGAGPMSVLKQSSPTFDGFSYCLPLQKSERGFFSKTTGYFSLGKVATRTDVRYTKMVARRKNTELFFVDLAAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 63813 - protein, 560 aa, Coxiella burnetii RSA 493
MNNVHAYKRRIGPIGLMMSAVSAMIGSGWLFSSLYVGRLAGPASILAWIFGGILVMIVALTYAEIVTMLPITGGSTRFPQLTHGTFVSLFFGWITWFTLMTAPAIEVQAMIQYAANYWPTLIRHHGAGMHGLSPLGYLIATLMMIGFSLINIYSIRLITRLNNIFSFWKLIIPVLTAIVLMVVAFHPNNFNNPHYGGFMPNGWKGVFAALATGGILFAFNGFKQAVELAGEAENPNRTVIIGILGSLIIVLIIYLLLEIGFIGALSPESLSKGWFFVHFIGDAGPLAGLLMTFGVTWMAILLYIDAMIATSAAGLVYSTSSSRTLYGLSANRQLPKFLQEVNERGIPAKAVFVNFIVGMTFFLPFHGWYAMAEFMSSIIALSYITGPICCLSLRYQLPEHKRVFRLPLITVWSFFGFYICTLIVYWAGWSVVSKLGLSLFISFMLFVVYRLFSKRPRGIHMNWRAATWMWPYLVGLNVISYLGSYGGGINKIHFGWDFLYLAILCFCCLYLAVTFRASDKHVAETLVRFEEEVKTGIPSTVPDEEFENPSLVRKEVSYID

SEQ ID NO: 63814 - protein, 376 aa, Arabidopsis thaliana
MSDETTSSPSPAPAKKKQNLGWMEWMRGWSSVFGEILFQRITASHLENPLPLPSVNDLTCVVTGSTSGIGRETARQLAEAGAHVVMAVRNTKAAQELILQWQNEWSGKGLPLNIEAMEIDLLSLDSVARFAEAFNARLGPLHVLINNAGMFAMGEAQKFSEEGYEQHMQVNHLAPALLSVLLLPSLIRGSPSRIINVNSVMHSVGFVDPDDMNVVSGRRKYSSLIGYSSSKLAQIMFSSILFKKLPLETGVSVVCLSPGVVLTNVARDLSRILQALYAVIPYFIFSPQEGCRSSLFSATDPQIPEYWETLKNDDWPVCPFISQDCRPANPSEEAHNTETAQRVWEKTLELVGLPLDAVEKLIEGENIQCRYGAQHE

SEQ ID NO: 63815 - protein, 351 aa, Synechococcus sp. RS9917
MARLLITGGAGFIGSHTCLVLLEAGHDLVVLDDFSNSSPIALERVQELAGVPLVTDRLELVRGDLRDAALLERMFSGAAAAGSPIEAVIHFAGLKAVGESVAQPLRYWDVNVGGSRALLSAMDAHGCRVLVFSSTSTVYGEPEVFPLTETTPTNPIHPYAQTKLAVEQMLHALSVSGPWRVAALRYFNPVGAHPSGRIGEDPLGIPNNLFPFITQIAAGRLKQLKVFGNDYPTPDGTGIRDYLHVMDLAEAHSAAVEHLLQANAPTSLTLNLGTGQGLSVLDVVHGFETATGITIPYEVVGRRPGDVPKLEACPKQAEAVLGWKAQRSLADMCRDGWAWQSANPQGYRGAT

SEQ ID NO: 63816 - protein, 462 aa, Fusobacterium nucleatum subsp. vincentii ATCC 49256
MNKGTITQIISAVVDVAFKDELPAIYNALKVKLEDKELVLEVEQHLGNNVVRTVAMDSTDGLKRGMEVIDTGKPITIPVGKAVLGRILNVLGEPVDNQGPINAETFLPIHREAPEFDDLETETEIFETGIKVIDLLAPYIKGGKIGLFGGAGVGKTVLIMELINNIAKGHGGISVFAGVGERTREGRDLYGEMTESGVITKTALVYGQMNEPPGARLRVALTGLTVAENFRDKDGQDVLLFIDNIFRFTQAGSEVSALLGRIPSAVGYQPNLATEMGALQERITSTKSGSITSVQAVYVPADDLTDPAPATTFSHLDATTVLSRNIASLGIYPAVDPLDSTSKALSEDVVGKEHYEVARKVQEVLQRYKELQDIIAILGMDELSDEDKLTVSRARKIERFFSQPFSVAEQFTGMEGKYVPVKETIRGFREILEGKHDDIPEQAFLYVGTIEEAVAKSKDLVK

SEQ ID NO: 63817 - protein, 126 aa, Oryza sativa Japonica Group
MAEVNPKAYPLADSQLAQAIQELVSQAANYKQLKKGANEATKTLNRGIAEFVVMAADAEPLEILLHLPLLAEDKNVPYVFVPSKQALGRACGVTRPVIACSVTSNEASNLRDPINNLKVAIEKLLI

SEQ ID NO: 63818 - protein, 380 aa, Populus trichocarpa
MSSTAGQVICCKAAVAWEAGKPLVIEEVEVAPPQAMEVRLKILFTSLCHTDVYFWEAKGQTPLFPRIFGHEAGGIVESVGEGVTDLKPGDHVLPVFTGECKECRHCKSEESNMCDLLRINTDRGVMLNDGKSRFSIRGQPIYHFVGTSTFSEYTVVHVGCVAKINPAAPLDKVCVLSCGISTGLGATLNVAKPKKGSSVAIFGLGAVGLAAAEGARIAGASRIIGVDLNSNRFDEAKKFGVTEFVNPKDHNKPVQEVIAEMTNGGVDRSVECTGSVNAMISAFECVHDGWGVAVLVGVPNKDDSFKTHPMNVLNERTLKGTFFGNYKPRSDLPSVVEKYMNKELELEKFITHEVPFSEINKAFEYMLSGAGLRCIIRMGA

SEQ ID NO: 63819 - protein, 116 aa, Zea mays
MDFFNQAKAVRMRNVHDKYLTADEDEETVTQDRNGSDKRARWIVEPVRGSFEVIRLRSCYGNYLTASNERFLLGATGRKVVLSKPARLDSSVEWEPVREGSKMKLKTRYGNLLRAN

SEQ ID NO: 63820 - protein, 237 aa, Oryza sativa Japonica Group
MPKDKVFRVPPPENARLFQHYNRRARRRARCSCARVCSWLLLALVLLAAALAASAAVVYLVFKPRQPDYTLLSLAVSGLGGILGNASSTAAPAPVSFSPEFDATVRADNPNGKIGVHYEGGGSHVAVSYGGVRLADGAWPAFYQGPRNVTVLVATAKGLGIRFSERLLGDIAAAGRLRSVPFDVDVKVPVRLQVGGVRTWAVPVRVRCAVVVDRLAADAKVVSKSCRVKARFLFWKD

SEQ ID NO: 63821 - protein, 167 aa, Neisseria meningitidis
MFEPLWNNKYIESVQLTIAEQLGVEERGEFYDITGALRDMVQNHLMQMLCMTAMEAPASWMPTRCAMKKVKVIKSLKPLTVESVNENVVRGQYTAARGMNGYLEEINVPQDSFTETYVAIKAEIENERWKGVPFYLRTGKRMAGKVAEIVLNFKDLNSHIFEGSRTA

SEQ ID NO: 63822 - protein, 471 aa, Mesorhizobium loti MAFF303099
MKVVPVIISGGAGSRLWPASRQSHPKPFLKVADGLSLIQHTVLRAASMQHVVELVTVTSTGHLFLTKDVFDELDSVVLPRTFLLEPEGRDTAAAVAAATVHAKATQGPDAVLCVFPADHMIGDLPAFQTAMNRAIEQALQGRIATLGITPDRPDTAFGYIEADGEKVVRFVEKPNAETAKSYVASKRFFWNAGIFCFKAQVMLDEMAAHCPQVIDAVLDSYDNARVSHGEHVASVELSSEHFAMAPRISLDHAVMEKTHNLAVVPCEMGWNDIGSWNAMAELVAADGSGNRIRGDVHVVDTVGSYISSDKRVIGTVGISDLVIVDSPDALLVASRDRVQDVKKLFEGLKAAGHEAHLLHSTVHRPWGTYTVLEESERFKIKRIEVKPGGRLSLQMHHHRSEHWVVVSGTAKIVNGDQELLLTTNQSTYIPCGHKHRLENPGNIGLVMIEVQSGEYLGEDDIVRLEDVYGRT

SEQ ID NO: 63823 - protein, 560 aa, Pseudomonas sp.
MTKLQIVGMTCASCVEHVKEALEKIPGVHRADVSYASGKAELKVDEGVSREQMQAAVEALGYRAAFEDATAPTRSGLLDKARGWLSGSIGAGKDGDRLHVAVIGSGGAAMAAALKAVEGGARVTLIERGIIGGTCVNVGCVPSKIMIRAAHVAHLRRESPFDAGLSTTSLTVLRERLLAQQQGRVDELRHAKIEGILESTPAITLVRGTARFQDGRTLSVELAEGGERIVAFDRCLIATGASPAVLPIPGLKDTPYWTSDEALASDTIPKRLAVIGSSVVAVELAQAFARLGSKVTVLARSTLFFREDPAIGEALTAAFRMEGIEVLEHTQASQVSHVDGEFILSTNHGELHADRLLVATGRTPNTQGMNLQGAGVKLDERGAIQIDSGMRTSAPDIYAAGDCTDQPQFVYVAAAAGTRAALNMTGGEAKLNLDAMPAVVFTDPQVATVGYSEAEAHHAGIETDSRTLTLDNVPRALANFDTRVSSSWSSEEGSGRLIGVQAVAPEAGELIQTAAIAIRARMTVQELADQLFPYLTMVEGLKLAAQTFAKDVKQLSCCAG

SEQ ID NO: 63824 - protein, 259 aa, Oryza sativa Japonica Group
MAVVASRCTGLLLPDLGASLAGFRRRRSTPASSLSFRPRRARRRLGSLSCIAPPDSAEPQTDEPAAKDDSTEDKAEASSASQDAGNPTFPNKDLSRRIALASTIGAVGLFAYQRLDFGGVSLKDLAANATPYEEALSNGKPTVVEFYADWCEVCRELAPDVYKVEQQYKDRVNFVMLNVDNTKWEQELDEFGVEGIPHFAFLDKEGNEEGNVVGRLPKQYFLDNVVALASVVMLRPIDKSATRLLYSLKSLGDRNFEPL

SEQ ID NO: 63825 - protein, 380 aa, Azoarcus sp. BH72
MTAFPPALLALADGTVFYGKGIGAVGSTVGEVVFNTSMSGYQEILTDPSYCRQIVTLTYPHIGNTGVNREDVEADRVHAAGLVIRDLPILPSNFRMDQRLDAYLKAENVVAIAGLDTRKLTRILREKGAQAGCIVTAADGAQLNAEAAVAEARAFPGLAGMDLAKVVSAKEAYPWQEGEWVLGEGYVAQTEPRFHVVAYDFGVKRNILRMLAQRGCRLTVVPAQTPATVVLGLKPDGVFLSNGPGDPEPCDYAIEAIREILAARVPTFGICLGHQLLALASGGRTVKMKAGHHGANHPVKDVDSGQVLITSQNHGFAVDVANLPSSLRVTHVSLFDGSNQGIARTDVPAFSFQGHPEASPGPHDVAYLFDRFIGLMEAAK

SEQ ID NO: 63826 - protein, 401 aa, Vitis vinifera
MATKRSVGDLKEADLKGKRVFVRVDLNVPLDESLKITDDTRVRAAVPTIKYLMGHGAKVILASHLGRPKGVTPKYSLKPLVPRLSELLGVEVKMANDCIGEEVKILVAKIPEGGVLLLENVRFYKEEEKNDPEFAKKLASLADLYVNDAFGTAHRAHASTEGVAKYLKPSVAGFLMQKELDYLVGAVSNPKRPFAAIVGGSKVSSKIGVIESLLGKVDVLLLGGGMIFTFYKAQGYGVGSSLVEEDKLDLATSLLEKAKSKGVSLLLPADVVIADKFAADANSKVVPASCIPDGWMGLDIGPDSIKTFGESLDTTKTIIWNGPMGVFEFDKFALGTEAIAKKLADLSEKGVTTIIGGGDSVAAVEKVGLAEKMSHISTGGGASLELLEGKTLPGVLALDDA

SEQ ID NO: 63827 - protein, 497 aa, Mesorhizobium loti MAFF303099
MKGDDGLTVTQSLTRRLKNPELFDDLAGVPGRKAEQSTRRFSVFNPSTGELLAELPDMDVRDVSKAIDKAEAAQEHWAALTARERSDILWEWHQLILDHSEDLAAILTAEMGKPLAEAKSEIAHAAAYLQWYAEEANRIYGETISPPSNDRRMLVIKQPIGVVGAITPWNFPASMVARKISPALAAGCAIVLKPAEQTPLVAGAMFTLARMAGFPDGVLNLIYASEGDAVGRELCSNPKVRKISFTGSTEVGRLLMRECSDQIKRTSFELGGNAPFIVFDDADVDAAVDGALQAKFRNAGQTCVSANRLYVQSSVYNEFCDKFTKRVSALRVGDGFEPEVAIGPLIDKCALAKIEDHIRDAVRQGGKIRCGGNRIGESGTFFEPTVITDVERTMRVAQEETFGPLAPIIRFNDPDQVVREANDTIYGLAAYFYASNLKRVWRVAEALEYGMVGINTGRMSSEAAPFGGMKQSGIGREGSRHGLEDYLEMKYLCMGGL

SEQ ID NO: 63828 - protein, 478 aa, Vitis vinifera
MASAAASPSSLSLLHSTSAARSSPRLPSASLRLPTLPLRRLGFAGAAADSLLTLHVASRTRSFRGKASRGVVSMAKKSVGDLTGADLKGKKVFVRVDLNVPLDDNQKITDDTRVRAAIPTIKYLIDNGAKVILSSHLGRPKGVTPKFSLAPLVPRLSELLGIQIVKADDCIGPEVEKLVTALPDGGVLLLENVRFYKEEEKNEPEFAKKLASIADLYVNDAFGTAHRAHASTEGVTKFLKPSVAGFLLQKELDYLVGAVSSPKRPFAAIVGGSKVSSKIGVIESLLEKCDILLLGGGMIFTFYKAQGLSVGSSLVEEDKLSLATSLLEKAKAKGVSLLLPTDVVIADKFAPDANSKIVPASAIPDGWMGLDIGPDSIKIFNEALETTKTVIWNGPMGVFEFDKFAEGTVAVAKKLAELSGKDVTTIIGGGDSVAAVEKVGVADVMSHISTGGGASLELLEGKELPGVVALDEATPVPV

SEQ ID NO: 63829 - protein, 383 aa, Moorella thermoacetica ATCC 39073
MIYLNNAATSWPKPETVYQAHDAYLRHLSGSVNRGAGGASLDAGRAVLETRELLADFFNIREPEQVIFTANATEALNLALQGLLEPGDHVVISSLEHNAVARPLHTLQDKGVEYTIVNCDARGRLNPLDVERAIGPRTRLICLTHASNVTGTILPVNEVGEIARRHHLQYLVDTAQTAGEIPVDVEAAGITLLAFTGHKGLLGPPGTGGLYIRYPDTVRPLIYGGTGSRSELLTQPEVLPDKYESGTVNAPAIAALGAGVRFIRETGLDNIRRHTRELTARLLEGLRRLPGVTLYGPTDSGERVPVVSLNIRGLSPGEASAWLADHYDIVSRPGLHCAPLAHQTIGTLKTGTLRLSPGFFNTAAEIDAALAAIKELMEVMQGE

SEQ ID NO: 63830 - protein, 152 aa, Zea mays
  misc_feature (32)..(32): Xaa can be any naturally occurring amino acid
  misc_feature (70)..(70): Xaa can be any naturally occurring amino acid
  misc_feature (104)..(104): Xaa can be any naturally occurring amino acid
  misc_feature (114)..(114): Xaa can be any naturally occurring amino acid
HSYGITNYLKPAVTRFLLHYELDFLVSAVANXPNNPFAGIDGGSKVSSKIGVIENLLAQVLILILSGRLXTTFYNAQGYSVGKYLVQEDKPDLITNVIEKAEAXKGFLFILPHXIVVADNSADNTDSNIVPPTDIPDDCMGLDASPDATKTF

SEQ ID NO: 63831 - protein, 272 aa, Pseudomonas aeruginosa PAO1
MSSTIHPLPSFGLGTFRLTGQVVVDSVRSALELGYRAIDTAQIYGNEADIGRAIAESGVPRSELFLTTKVWVDNYAREKLLASLRESLEKLRTDRLDLVLIHWPAPGNGVELGEYMAALAEAKSLGLTRRIGVSNFNIELTRQAIAAVGAGEISTNQIELSPYLQNRALTAYLEEQGIAVTSYMTLAYGKVLKDPTLAGIAARHRATVAQVALAWAMQLGYAVIPSSTRRENLASNLLARDLRLDAEDMARIAGLERNGREVSPQGLAPAWD

SEQ ID NO: 63832 - protein, 218 aa, Triticum turgidum subsp. durum
MPGLTIGDTVPNLELDSTHGKIRIHDYVGNGYVILFSHPGDFTPVCTTELAAMANYAKEFEKRGVKLLGISCDDVQSHKEWTKDIEAYKPGSKVTYPIMADPDRSAIKQLNMVDPDEKDAEGQLPSRTLHIVGPDKKVKLSFLYPSCTGRNMDEVVRAVDSLLTAAKHKVATPANWNPGECVVIAPGVSDDGAKKMFPQGFETADLPSKKGYLRFTKV

SEQ ID NO: 63833 - protein, 340 aa, Coccidioides immitis RS
MAAMIAGLYRLLKGRISTPVDPNTSLEGKTVLITGGNRGLGLEAAIKYVNLGATTVIIGCRSTERGNQAKATIETLTRRRGVVQIWPLDMSRYDSVIAFAGRVNEEIPRLDIALLNAGVLHRNYTLSSEGWEDTLQINTLSTILLALLLLQKLRASRTDGGGPANLTFTSSGTHKFVKGEQLVGSEDQSILQHVNAESNFSSIVQYKVSKILIEFAVKCIAKIARQENGTVDVIVNSACPGFCSTNLEREFDSFVHRLLGPIFYFIFGRSAEQGSRTLVSATLLGEESHGKFWTHDSFPDLSQFLISTEEGKRLQERAWTEIVEELKTRSPLIKELLNPS

SEQ ID NO: 63834 - protein, 256 aa, Zea mays
MPRGPAAALRASLPAGGRRRSCMVVRCDAGVEAQAQAVAKAASIAALEQFKISADRYMKERSSVAVIGLSVHTAPVEMREKLAVAEELWPRAIQELTSLNHIEEAAVLSTCNRMEIYVVALSWNRGIREVVDWMSKKSGIPASELKEHLFMLRDSDATRHLFEVSAGLDSLVLGEGQILAQVKQVVRSGQNSGGLGKNIDRMFKDAITAGKRVRSETNISSGAVSVSSAAVELALMKLPKSEALSARMLLIGAGKM

SEQ ID NO: 63835 - protein, 299 aa, Pseudomonas putida KT2440
MTLQYPTIADCVGNTPLVRLQRIAGETSNTLLLKLEGNNPAGSVKDRPALSMIARAELRGQIKPGDTLIEATSGNTGIALAMAAAIKGYKMILIMPDNSTAERKAAMTAYGAELILVTKEEGMEGARDLAEKLQAEGRGLVLDQFANGDNPIAHYNSTGPEIWQQTQGTITHFVSSMGTTGTIMGCSQYLKEQNPAVQIIGLQPMEGSAIPGIRRWPEEYLPKIFDATRVDRVVDMSQQEAEDTTRRLAREEGIFCGVSSGGAVAAMLRLSREVENAVMVAIICDRGDRYLSTGLFDPR

SEQ ID NO: 63836 - protein, 183 aa, Glycine max
FFLDKCLGECFLLLPELLKKVGRLYSLCLQFAAATPWLFSSSVGFPNPVDPFDDSKGLNKARWKSGPVLLSTPRNVAVPGFVLNFGKGFFSGLQSLGSLLSSNSPAEPYLFFFGQWVFGVLIVKDGFFWVFTWVLAFLPKGGGFSSFGVFGLFPRLGGVLCLGIENNFFCFPVFFDTFLLKFD

SEQ ID NO: 63837 - protein, 642 aa, Coxiella burnetii RSA 493
MNREVFTEFNKVLDEIAAQNPIAVILQSGKKKGFIAGADIKQFTDLKNKNEAFDLIRQAQLVLDKLEALPMPTVAMISGFCLGGGLEVALACRYRVAEDNESTLIGLPEVKLGIHPGWGGTVRLSKLIGAPKAMEIMLPGAAVPARKSAKLGMVDAAVPLRNLENAARYFALQKPPVHKPKGWEKYTNVSYIRPWLGRLFYKKLSAKVEKTHYLAPYAIVHNWIKEGVGKEAYFTEAQSIAQLMMTESSRNMVRLFFLRERLKSLAKKTRYLPQQIHVIGAGVMGGDIAAWCALRGIRVTLHDKSAEKIAPAIKRAHALYEKKLKIPRLIQAAMDRLEPDVEGTGVKKADLIIEAVFEDIKVKQEVLSAIEPQLKPEAILATNTSSLSLDELSSVLKNPERLVAIHFFNPVAKLPLVEVASSQQTSADIAEKALAFVGAIDKLPLAVSSSPGFLVNRALMAYLLEANRCLDEGFSMEQIDKAATDFGMPIGPIELADRIGLDICLSVAQHLKNFYKHAEVSERLKTLVKEGHLGAKTGQGFYHYQNGRRVESKSTAESTNPDLTDRLILQLVNEVKKCLDEKVIDKEDLADAGIVFGTGFAPFRGGPMQYAKSRGEADVVKTLKRLAKQYGERFLPSEGWSA

SEQ ID NO: 63838 - protein, 378 aa, Alkaliphilus metalliredigens QYMF
MSKRDYYEILGVSKDVDEQELKRAYRKQAMKYHPDRNPDDPEAESKFKEANEAYEILSSPEKKARYDQYGHAGVNGNGGGPQGFGGGGGFEDIFGDIFDMFGGGGGFSSGRRRSGPQRGSDIQYEMSITFEEAAFGAEKTVEFYKQDNCGTCHGSGAKPGTDAKSCSHCNGTGEVRYAQRTPLGQIVNVRPCEHCHGEGKIVEEPCTACSGKGKVKKHKKIKVKVPAGVDTGSAIPLRGEGEPGTKGGPYGDLYVVLRVLPHRLFVRDGYDVICEMPITFVQATLGDELEVPTLEGKVKYKIAEGTQSGTVFRLKNKGIVHPKGYGKGDQYVKVIIEVPKKLSDKQKEMLKQFAAASGEDIHEQRRSFFEKVKDAFSS

SEQ ID NO: 63839 - protein, 496 aa, Burkholderia sp. 383
MTPFDTSLVPDGNILIGGEWRRGRGTPFASIYPADQSVNMEVSTANAEDAAEAVVAADAAWRRADWAGLKPHQRAQVLYRIADLIMQRHEALANLQRRDNGKPIGETRVLVASAANTFRYFAACLETLDEELTPSRGDYLTMSVYEPIGVIAAITPWNSPIASDAQKLAPALAGGNAVVLKPAEVTPLVSLALARICEEAGVPKGVLSVLPGKGSVIGDVLVRHPLVKKVSFTGGTEVGRGIARIAAEKLMPVSLELGGKSPTIVCDDADLDHAVNGVLYGIFSSSGEACIAGSRLFVQRAVYDEFMTRLVAGARKLRVGDPTRPDTQMGPLITAKHRESVERYVALGLEEGGRLLCGGERPSGDGRENGFFYQPTILEGLPNSARICQEEIFGPVLVAMPFDDEASLIAQANDSVFGLAAGIWTRDYKRAWRIARALETGTVWINTYKLFSISTPFSGWKESGMGREKGRLGIREYMQQKSLYWGLNDAPLPWAN

SEQ ID NO: 63840 - protein, 402 aa, Chlamydophila pneumoniae CWL029
MDKLTVQDLSPEEKKVLVRVDFNVPMQDGKILDDIRIRSAMPTINYLLKKHAAVILMSHLGRPKGQGFQEEYSLQPVVDVLEGYLGHHVPLAPDCVGEVARQAVAQLSPGRVLLLENLRFHIGEEHPEKDPTFAAELSSYGDFYVNDAFGTSHRKHASVYVVPQAFPGRAAAGLLMEKELEFLGRHLLTSPKRPFTAILGGAKISSKIGVIEALLNQVDYLLLAGGMGFTFLQALGKSLGNSLVEKSALDLARNVLKIAKSRNVTIVLPSDVKAAENLQSKEYSVISIDQGIPPHLQGFDIGPRTTEEFIRIINQSATVFWNGPVGVYEVPPFDSGSIAIANALGNHPSAVTVVGGGDAAAVVALAGCSTKVSHVSTGGGASLEFLEQGFLPGTEVLSPSKS

SEQ ID NO: 63841 - protein, 338 aa, Photobacterium profundum SS9
MRVLVTGGMGYIGSHTCVQMIEAGMTPVIVDNLYNSKETVLARIEALTGVMPAFFQGDIRDRAFLEKVLSENDIDAVIHFAGLKAVGESVVKPLEYYDNNVHGTLVLVEAMRTAGVNSLIFSSSATVYGDPASVPITENFPTSATNPYGRSKLMVEECLTDIQLAYPEMSITLLRYFNPVGSHKSGTMGEDPQGIPNNLMPFISQVAVGRREFLSVFGDDYPTVDGTGVRDYIHVVDLADGHLAALNYKGSEAGLHIYNLGTGNGSSVIQMVDAFSKASGVEVAYKVAPRRPGDIAECWADPAKAKAELHWEAKLSIEDMTTDTWRWQSNNPNGYPDA

SEQ ID NO: 63842 - protein, 504 aa, Aspergillus oryzae
MADLYPSLAQCAIVATAFKILLFPAYKSTDFEVHRNWLAITHSLPVKEWYYEKTSEWTLDYPPFFAAFEWLLSQVAQYADPAMLTVKNLNYDSWQTIYFQRATVIISELVLVFALNRFIKSAPQSNKHLAHISSLSILLSPGLLIIDHIHFQYNGFMYGVLILSIVLARKQSTLLYSGITFAILLCMKHIHLYLSLAYFVYLLRTYCLDPKSVFRPRFGNIFKLGLGVISVFAVAFGPFIYWNQLLQLKDRLFPFSRGLCHAYWAPNIWAMYSFVDRALILLAPRLGLSINEEALTSVTRGLVGDTSFAVLPEVTKEHTFALTFLFQLLPLIKLWRSPGDWDVFVGAITLCGYASFLFGWHVHEKAVLLIIIPFSLIALRDRRYFSAFRSLAIAGHVSLFPLLFTAAEFPIKTVYTVFWLVLFLFVFEQVAPVPERPRIFPIVDRFSLLYLAVAIPLIIYCSLLHQLIFGLERYEFLPLMFMSSYSALGVVGSWIGFMVVYFTA

SEQ ID NO: 63843 - protein, 131 aa, Populus trichocarpa
MGGVTSTIAAKFAFFPPNPASYTVVTDDSSSAVSGGSTTRLYIPEVPRKDDVDVLKLRTRRGNEIVAVHIKHPRASATLLYSHGNAADLGQMFELFVELSNRLRINLMGYDYSGYGQSSGKVYTSFPIPGC

SEQ ID NO: 63844 - protein, 199 aa, Ehrlichia chaffeensis str. Arkansas
MTLVPMVVEQTSRGERAYDIYSRLLKERIIFITGPIEDQMASLIVAQLIFLESENPEKEICMYINSPGGVVTAGLSIYDTMQYIKPKVSTLCLGQAASMGSLLLAAGEPGMRYALPNSRIMIHQPSGGFQGQATDIEIHAKEILDIKGRLNDIYVKHTGRDLSEVVANMERDNFMRAEKAKDFGIIDKVIEKRLDIGVE

SEQ ID NO: 63845 - protein, 375 aa, Oryza barthii
WSKMCMQPDVKPNKRKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIIRNNMSITLVDISDPTMSIETDSARMWETVARKGQHRSFVANLWSTIA

SEQ ID NO: 63846 - protein, 257 aa, Oryza sativa
  misc_feature (23)..(23): Xaa can be any naturally occurring amino acid
MAAATVSVRFHPAASAARCGGGXLTQDDLKRLAAVRAVEQVESGMVLGLGTGSTAAFAVAEIGALLASGKLSGIVGVPTSKRTFEQAQSLGIPLSTLDDHPRIDLAIDGADEVDPDLNLVKGRGGALLREKMVEAASDKFIVVVDETKLVTGLGGSGLAMPVEVVQFCWKYNQVRLQDLFNDEGCEAKLRLDEGGKPYVTDNSNYIVDLYFKTPIKDALAAGKEISALEGVVEHGLFLDMATSVIIAGTDGVSVKTK

SEQ ID NO: 63847 - protein, 375 aa, Oryza barthii
WSKMCMQPDVKPNKRKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIIRNNMSITLVDISDPKMSIETDSARMWETIARKGQHRSFVANLWSTIA

SEQ ID NO: 63848 - protein, 159 aa, Brassica napus
MMMIRQAAKKALELTSRQSIPCSVGIFRSYHENVIDHYDNPRNVGSFDKNDPTVGTGLVGAPACGDVMKLQIKVDEKTGQIVDARFKTFGCGSAIASSSVATEWVKGKAMEEVLTIKNTEIAKHLSLPPVKLHCSMLAEDAIKAAVKDYKEKRVKTGGV

SEQ ID NO: 63849 - protein, 319 aa, Arabidopsis thaliana
  misc_feature (154)..(154): Xaa can be any naturally occurring amino acid
  misc_feature (211)..(211): Xaa can be any naturally occurring amino acid
  misc_feature (290)..(290): Xaa can be any naturally occurring amino acid
MAIEDVLALIVLLSVVRVSVAITQLRELDGDRSEFPEAEGVVRGVTVRGVSRQGALAAGLLRLRFRDCFVRRCDGSVLLGCAGGDAGGDAVPDLTLGGYGVVDAAETALKKEYPGVISCADVLALVARGAVAVVGGPWWPVPLGRRAGRVSGLXDALRGVPSPFADMGTLKGGFADEGLDAGDLVVLSGGHTIGISSCALVGSRLSGFTGXGDSAPSLRPRDVRELKRKCPPTDFRTSLNMDPGSALTFDTHYFKVVAQKKGLFTSDSTLLDDIETKNYVQTQAILPPVXFPSFNKGFSDSNGQTLVSSQICLPGKKIG

SEQ ID NO: 63850 - protein, 242 aa, Azoarcus sp. BH72
MTTKLIAGNWKLNGSLAKNAALIDELRRAEMHCVVCVPYPYLAQAQALVAGSLIELGAQDVSEYEQGAYTGEVSAAMLVEFGCRYVIVGHSERRALFGDSDQVVGRKAASALAAGLTPIVCVGETLAERELGEVEAVIRRQLQAVADCVGGEALPTLVVAYEPVWAIGTGRSATPEQVAQTHGFIRAWFSARCDASAVRILYGGSVKPENAAVLFSTDDVDGGLIGGASLVGSDFVAICRAA

SEQ ID NO: 63851 - protein, 1483 aa, Kluyveromyces lactis NRRL Y-1140
MEGSNNGLSSRPEKLDGDPRSTSDTSSSGSCTSLKEFSGNNHELHQDTDQQVVKDAAEDPAFLKKVETLSRSLSRRTTTLSEWDEVDENFDMYREIQGILKASNDGGIHLRKAGITARNVAVKGVDAQFLEGATYGDMLMLPATIFKGIKKARQTTLRDIISNVNLLVRPGEMLLVLGRPGSGCSTFLKTMAGELSHFKGVSGDISYDGVSQKDMLKYFKSDVIYNGEMDVHFPHLTVQQTLDFAVACKTPSKRINDFTRQQYIEFIRDLYATIFGLKHTYNTKVGDDFVRGVSGGERKRVSIAEALAARGSIYCWDNATRGLDASTALEYTEAIRCMTNLLKSTALITVYQASENIYETFDKVTILYEGKQIYFGRIEEAKKYFENLGFICPARQATAEFLTSLTDSKGLRRVRPGFENKVPRTRDDFVRVWEESKEYHDLIQSIEHYETKEVDGAKTIQFFKESMVEEKDKASRKKSKFTISYWAQIRLCTRRGFQRIYGDKSFTITNTVAAIIQALVTGSLFYNTPSSTQGAFSRGGVLYFAILYFSLMGLANISLANRPILQKHIAYSLYHPSAEALASTISNAFFRMISLTAFLIILYFLSGLTRNAGRFFMVYLFVALASESINALFEFITAACDSISQANAIAGLVMMALSLYSTYMIQTPSMHPWFEWISYILPLRYAFENMLNAEFHARRMDCGGTLVPTGPVYENVSSEYKVCAFIGSQPGESYVLGDNYLKLQYDYSYSHQWRNFGILIAFLVGFLVFKSVITEFKTPIKSSGDALLFKKGTSLNTIPKDEESNVNSTDSITKTTDSSSRSDDPALFADMRSEGIFLWKDICYTIPYKGGERLLLDNVSGYVKPGTLTALMGESGAGKTTLLNTLAQRTDIGVVTGDMLVNGKPIDASFERRTGYVQQQDVHIKEMTVRESLQFSARMRRPLTVPDEEKLDYVEKVIEILDMSAYGEALVGNIGYGLNVEQRKKLSIAVELVAKPNLLLFLDEPTSGLDSQSAWAIVQLLKKLAGAGQSILCTIHQPSATLFEEFDRLLLLRKGGQTVYFGDIGEHSSTLLSYFERNGARRCEEKENPAEYILEAIGAGATASVKEDWHEKWIKSSEFVSVNQEINDLIEKLAHQPNDDSSTELITKYATPYWYQFVYVLRRTMVMFWRDVDYLMAKTMLYISSGLFIGFTFYNVGTSFVGLQNAMFAAFMACIVSAPAMNQIQARALQSRELYEVRESRSNMFHWSCMLFSQYITELPYQLWCSTLFFVSFYFPLKAEYTSLKAGLFYLNYCVIFQLYCVGLGLAVLYMSPDLPSSNVIMGLLLSFMITFCGVVQPVNLMPGFWTFMWKVSPYTYLIQNFVSLMLHDKTVICTDKELSYFNPPPGSTCGSYMTDYFTEGFGYIKNPEATSNCAYCRYKIGDQYLSYISAKYADLWRNFGFLWVYICFNLIAMVSLYYIFHVKRFSPKSLVMGVVGKFKKEK

SEQ ID NO: 63852 - protein, 1560 aa, Kluyveromyces lactis NRRL Y-1140
MSDDSGSSIDDRDGRNSTSPAAELNQYTGLNAAGAHRPYLGFENDPQEQQRIQTLARTLTNSSIASKQNSSVGAQGINNGNHGQDTADADSSTNESLQRTLTRASLHINPDDVKIPFDEDARSADPRLDPYSANFDSKFWVQTMHQMFNSDPDYYKPVSLGVCLKGLRVSGVSVDADYQATVANAPLKVLNAARHFVSKRDESRYFDILRPMDALFEPGRLCTVLGRPGAGCSTLLKTVSARTYGFTVRPESVISYDGISQHDIEKHYRGDVIYSAEMDYHFANLNVGYTLEFAARCRCPSARPQGVSREEYYKHYAAVVMATYGLSHTYSTKVGDDYVRGVSGGERKRVSIAEVTLAGAKVQCWDNATRGLDSATALEFVRALKTNATISRTTPLLAIYQCSQDAYDLFDDVLVLYEGRQIYFGPADSAKQYFLDMGWECPDRQTTADFLTSVTAANERKCRPGYEKKVPKTPDEFYEHWKSSSEYAQLMNRIDAYLNKHNNEDSAKEFFDHHTARQSKHSKSSSPFLLSFMMQVKAVMDRNVQRLKGDPSVYAFNIFGNCSMAFIISSMFYNQKDNTGSFYYRTAALFTALLFNSFGSLLEILSLFEARKIVEKHKTYAFYRPSADALASIITELPSKFIIAICFNLIYYFLVNFRRSPGHFFFYFLIAITSTFTMSHLFRSIGAACTTLEQAMLPASILLLILSIYAGFVIPKGNILGWSKWLYYLNPIARSMEAMVANEFAGRTFECSQFIPAGGEYDELPLALKICSVVGSEPGSAYVSGTAYMEESFSYKDSYRWRNWGIVLCYAVFFLAVYLLLIEYNKGEMQKGEMTVFPRSVLMKLKKKNQNLKNDIESNDSLLKDMTNGNDSQDEKSDSSNEKMAEKIGSDQVVFWKNICYDVQIKTETRRILDNVDGWVKPGTLTALMGSSGAGKTTLLDALADRISTGVITGDVLVNGRPTDASFQRSTGYCQQQDLHGRTQTVREALTFSAYLRQPYNVSKKEKDEYVETIIRLLEMETYADALVGVTGEGLNVEQRKRLTIGVELVAKPKLLLFLDEPTSGLDSQTAWSVCQLMRKLANHGQAILCTIHQPSAILMQEFDRLLLLQKGGQTVYFGELGHGCCKMIEYFESKGSQKFPADCNPAEFMLHVIGAAPGSHVTTDYHKVWLESQEYQAVQKEIDRMSREMVNIPQEDSEDLKKEFATPLWYQFLIMTRRVLEQHWRSPIYIYAKIFTTSFSALFIGFSFFNANNSMQGLQNQMFSLFMLLVMFSPLVHQMLPQYTDQRDLYEVRERPSKTCSWITFVLSQIAAELPWSFLIGTITYFCFYYPVGLYRNAPNTEQVHERGALFWLICIAFINFTMTFGQACIAGVERRENAALLANNCFMICLAFCGVLVTRDKLPGFWKFMYYLSPFTYLISTMLATAVGNSDVRCSAKEYLHFSPAPNMTCQQYMSPYMSVAGGYLLDGNATDSCGFCVMAETNVYLATVNIKYSQIWRNWGIFLCYIGANVFLFVLLYWAFRVPRDHYLLIKIHAIKSKITNSLKSRKLIRSSKNNEA

SEQ ID NO: 63853 - protein, 139 aa, Moorella thermoacetica ATCC 39073
MYGDLVIDHFLNPRNVGRIEDADGIGAIGDPGCGDYLCIYIKVRDNRLVDVKFQVHGCPAAIATSSILTEMARGKTLEEGLRITDADVAAAIGGLPEVKLHCSNLGASALHDAIRNYQAKMQAGGQQNGRRGSPGSGKV

SEQ ID NO: 63854 - protein, 547 aa, Pseudomonas aeruginosa PAO1
MAKAADVVVQCLENEGVQYVFGIPGEENLDLLESLRKSQIRLVLTRHEQSAGFMAATYGRLTGKTGVSLSTLGPGATNLVTAGAYAYLGGMPMLMITGQKPIKKSKQGRFQILDVVGMMQPLTKYTHQLASADNIPSRVREAFRLAEEEKPGAVHLELPEDIAAEQTDSLPIPPSLSRRPLAEYKAICAAVEKLRAARSPILVIGAGANRKMTAKVLKQLIDKTGIPFVTTQMGKGVVDERHPRFLGNAALSAGDFVHRAVEAADLIVNVGHDVIEKPPFFMVRGGTEVIHVNFRSAEVDPVYFPQIEVVGDIANAIWQIGEALDDTAHWDFTRLLAIREANEAQVAEGADDPRFPLYPQRLVADVRRALPSQGIVALDNGMYKIWFARNYKAHMPNTVLLDNALATMGAGLPSAMAAHLVYPDRPIVAVCGDGGFMMNSQELETAVRLKMNLTVIILRDNGYGMIRWKQSNMGFADFGLDYGNPDFVHYAEAYGAHGHRVDSAEGFLPLLERCLGTPGVHVIDCPVDYSENDRILNVELRERALAV

SEQ ID NO: 63855 - protein, 363 aa, Triticum aestivum
  misc_feature (116)..(116): Xaa can be any naturally occurring amino acid
MNHHLESSDYQKLFCRKMDSAELQTPLLHGLPDEIALLCLARVPRQYHNALRCVSRGWKALLSSEEWHSYRKRNNLAESWIYVICRGTGFKCYVLVPDPTTRSLKVIQVMEPPCSXREGVSIETLDRRLFLMGGCSWLKDANDEVYCYDAASNHWSKAPPMPTARCFFVSAALNDKIYVTGGLGLTDKSPNSWDIYDKATDSWFSHKNPMLTPDIVKFVALDDELVTIHKASWNRMYFAGIYDPVDQSWRGKENEIALCWSGPTVVVDGMLYMLDQSLGTKLMVWLNETKQWVMVGRLSDKLTRPPCELVAIGRKIYVIGKGLSTVTIDMDMAARVDGFLVSSSTGPLMEHDFSPEKCSVITI

SEQ ID NO: 63856 - protein, 379 aa, Desulfococcus oleovorans Hxd3
MISKRARQITPFLVMDVLEKADEMERQGIDVVHLEVGEPDFDIPLCVKTAVEKALADGRTYYTHSLGDIRLRQAICDHYKNRYGVTVTPSRVIVTSGTSPAMMMAFAALLDPGDEVIISDPHYACYPNFITFAGGQPVTVPVYEADGFQYSPEAIAAAMTERTKAIFINSPSNPTGTLLSRERMAAIARFEPYIISDEVYHGLVYEGREHSILEFTDNAFVLNGFSKLYAMTGLRLGYLIVPEPFVRTVQILHQNFMISANSVVQFAGIAALEQAGDDVARMKAIYNERRLYMIRRLRELGFTIPVEPTGAFYLFVNAGHLSSDSYSLAFDILEKARVGVAPGIDFGKNGEGFLRFSYANSLENIAEGLNRLEPYLERR

SEQ ID NO: 63857 - protein, 548 aa, Bacillus sp. SG-1
MQRGQIKEKLKQDQYDLIVIGGGITGAGIALDAASRGMKVALAEMQDFAAGTSSRSTKLVHGGLRYLKQFEVKMVAEVGKEREVVYENGPHVTTPEWMLLPIHKGGTFGKFSTSVGLRVYDYLAGVKKVERRNMLSASNTLGKEPLIKRKGLKGGGYYVEYRTDDARLTIEVMKKAVEHGTVALNYLKADRFIYESEKVKGIQARDVLTGEIFNIRSEKVVNASGPWVDEVRRKDYSINNKKLRHTKGVHIVVDQKKFPLKQAVYFDTRDGRMVFAIPREGKAYVGTTDTFFEGDTSNPKMTEEDRAYLIDCIHYMFPEVKVTENDVESSWAGIRPLIFEDGKDPSEISRKDEVWEGESGLVTIAGGKLTGYRKMAEHVVDLIAKRFKQEMKESFPASKTRHMPIAGGEVGGSAGFLSYVAEKSLEAEQFGLSVETGRELLQRYGSNAEELFKIAHSYKKTNSSSLEMPAEIFAMLLYSINEEMTVTPLDFFMRRTGKLFFDIQWVKRWKKSVVEMMAALLDWKPELKRQYQTELDNAIKDAQVPVGK

SEQ ID NO: 63858 - protein, 406 aa, Chlamydophila pneumoniae CWL029
MKNLKEDFPIFAAKAKENEPFIYLDSAATTQKPQQVIDAVANFYTSSYATVNRAIYSSSRNVTEAYAAVREKVRKWVSAASDSEIVFTRGTTAGLNLLAISVNDLWIPKGGVVLVSEAEHHANVLSWEIACRRRGSLVKKIRVHDSGLIDLDDLEKLLNEGAQFVSIPHVSNVTGCVQPLQQVAELVHRYDAYLAVDGAQGAPHLPIDVQLWDVDFYVFSSHKIYGPTGIGVLYGKKDLLDQLPPVEGGGDMVAIYDHQNPEYLPAPMKFEAGTPNIAGVLGLGAALDYLDGLSAKFIYDKEIALTTYLHKELLEIPGVEILGPSIEEPRGALIGMTIDGAHPLDLGFLLDLRGIAVRTGHQCAQPAMERWNVGHVLRVSLGIYNDEDDIDQFILVLQDSLDKIRR

SEQ ID NO: 63859 - protein, 375 aa, Oryza meridionalis
WSKMCMQPDVKPNKRKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMSIETDSARMWETVARKGQHRSFVANLWSTIA

SEQ ID NO: 63860 - protein, 375 aa, Oryza meridionalis
WSKMCMQPDVKPNKCKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMSIETDSARMWETVARKGQHRSFVANLWSTIA

SEQ ID NO: 63861 - protein, 234 aa, Fusobacterium nucleatum subsp. vincentii ATCC 49256
MFLQRTELLIGSDNIEKLKNSNVIVFGLGGVGGATVEALVRAGIGNLSIVDFDTVDKTNLNRQIITTQSVIDKPKVEVAKERILSINPDINLTVYNKKFLKENTDLFFKDKKYDYIVDAIDLITAKLDLIEFATNSKIPIISCMGTGNKLNPAKFKVANIEKTSVCPLAKIIRKELKKRRINKLKVVYSDETPRKPFNLDGGREKFKNVGSISFVPPVAGMLLASEVIKDICEL

SEQ ID NO: 63862 - protein, 128 aa, Sulfolobus acidocaldarius
MGFAPDYVKSLNVPKLGICLGHQLIAKVLGGEVRKANKPEYGLTTVNIVDEDTILRGLKPSIKAWESHNDEVVRPPSGFRILASSENAKVQAMVNNDNSIFGVQFHPEVKHTEKGIEVFKNFIKICRK

SEQ ID NO: 63863 - protein, 395 aa, Gracilaria tenuistipitata var. liui
MTYNLHPAILVLKDGKFYRGWTLINSIISFGEVVFNTGMTGYQEIMTDPSYAEQIITFTYPEIGNTGINHEDNESNKIHVKGIITKNICFSPNNWRQQESFINYIFNNQIPHIFGIDTRALTKHLRKTGSMNGCISSQYLNPYLLSTKFKDRLSIESSDLVKQVTTSKNYEFQGYSHKHFSYLQYKTDKMYGYGLKIILIDFGVKYNILSRLDNYGCSIQILPATSSYETINAYNPDGIILSNGPGDPSIITYAIKTVKKIIKYTNIPIFGICMGHQIISLALEGTTFKLKFGHRGLNHPAGMKQKAEVTSQNHGFAVNQESLYKDTINITHFNLNDTTVAGILHNKKPIFSVQYHPEASPGPHDSDYLFKYFINLIKHFKQYKNYKNSSLAQAR

SEQ ID NO: 63864 - protein, 261 aa, Zea mays
MAATVLFTPAQCHRATATTSGRGAPSHCALAPGHRRPGRGSVRAVPPEQSSLPQAAAAVYGTAGDVKAALYRALDGANRGIFGMTSAKRSEIHGLVELLESRNPTPEPTAKLQDKWGRMHVDGCWKLIYSTISILGKKRTKLGLRDFISLGDFLQIIDVKQEKAVNVVEFSARALKILTGKLTIEASYRVTSQTRVDIKLESSTITPEQLMNIFQKNYDMLLDIFNPEGWLEITYVDESLRIGRDDKENIFVLERADLPDV

SEQ ID NO: 63865 - protein, 228 aa, Fusobacterium nucleatum subsp. vincentii ATCC 49256
MKLVLIRHGESAWNLENRFTGWKDVDLSPKGVEEAKAAGKSLKEMGLVFDVAYTSYLKRAIKTLNIVLEEMDELYIPVYKSWRLNERHYGALQGLNKAETAKKYGDEQVHIWRRSFDVAPPSIDKNSEYYPKSDRRYANLADSDIPLGESLKDTIARVLPYWHSDISKSLQEGKNVIVAAHGNSLRALIKYLLNISNEDILNLNLTTGKPLIFEMDKDLKVLKAPESF

SEQ ID NO: 63866 - protein, 551 aa, Oryza sativa
MATRRALSSLVRAASRLRGASPAPRPRGPLHRPSPSGYLFNRAAAYATAAAAKERPPAPATGKATGGGKITDEFTGAGAIGQVCQVIGAVVDVRFDEGLPPILTALEVLDHNIRLVLEVAQHLGENMVRTIAMDGTEGLVRGQRVLNTGSPITVPVGRATLGRIMNVIGEPIDEKGDITTNHFLPIHREAPAFVEQATEQQILVTGIKVVDLVAPYQRGGKIGLFGGAGVGKTVLIMELINNVAKAHGGFSVFAGVGERTREGNDLYREMIESGVIKLGDKQSESKCALVYGQMNEPPGARARVGLTGLTVAEHFRDAEGQDVLLFIDNIFRFTQANSEVSALLGRIPSAVGYQPTLATDLGGLQERITTTKKGSITSVQAIYVPADDLTDPAPATTFAHLDATTVLSRQISELGIYPAVDPLDSTSRMLSPHVLGEDHYNTARGVQKVLQNYKNLQDIIAILGMDELSEDDKLTVARARKIQRFLSQPFHVAEVFTGAPGKYVELKESVNSFQGVLDGKYDDLPEQSFYMVGGIEEVIAKAEKIAKESAS

SEQ ID NO: 63867 - protein, 367 aa, Bordetella parapertussis 12822
MFSRLQEFFMTHQIAVLPGDGIGPEIVEQAERVLKALDLPLELRQAPVGGAAFDQFEHPLPPATLELAQGSHAVLFGAVGDWKYDTLPREFRPEQAILGLRKALGLFANLRPAILYPELASASSLKPEIVSGLDILIIRELTGDIYFGTPRGVRTAADGAFAGEREGYDTMRYAESEVRRIARIGFESARKRNKKLCSVDKANVLETSQFWRDLVIEVSRDYPDVELSHMYVDNAAMQLVRNPRQFDVIVTGNLFGDILSDEAAMLTGSIGMLPSASLNAAGQGLYEPSHGSAPDIAGQGIANPLATILSAAMLLRYSLNLAPQADRVEAAVRKVLADGLRTADIHEAGTTKVSTSQMGDAVLKALG

SEQ ID NO: 63868 - protein, 365 aa, Malus x domestica
MGSTPETQMTPTQVSDEEANLFAMQLASASVLPMVLKAAIELDLLEIMAKAGPGAFVSPADLSSQLPTKNPDAPVMLDRMLRVLASYSILTYSLRTLPDGKVERLYGLGPVCKFLTKSVDGASIGSLCLMNQDKVLMESWYNLKDAVLEGGIPFNKAYGMTAFEYHGTDPRFNRVFNKGMADHSTITMKKLLENYNGFEGLTSIVDVGGGTGAVLNMIVSKYPSIKGINFDLPHVIEDAPQYPGVEHVGGDMFVSVPKGDAIFMKWICHDWSDEHCLKFLKNCYAALPDNGKVIVAECILPVAPDSSLATKGVVHIDAIMLAHNPGGKERTEKEFEALAKGSGFQGFRVVCSAFNTYAIEFLKKN

SEQ ID NO: 63869 - protein, 422 aa, Mesorhizobium loti MAFF303099
MMPQSRVWHPFTQHALEPAIPEIARTEGAYLYKADGTRILDAISSWWVVTHGHRHPRIIKAIETTASSLVQIIFAGFTHEPAERLAKALVGLAPAGLDWVFYSDSGSTSVEVALKMALGYFRNIDAPRSRIVVMEHSYHGDTIGTMSVGARGAFNAAYEPLLFEVDTIPFPAAGREQETLDRFEAVARDRRTAALIVEPLVLGAGGMLMYPAWVLAELKKIAETSGTLLIADEVMTGWGRTGTMFACEQASISPDILCTSKGLTGGAIPLAATLATDAIFQAHYSEDRKKTFFHSSSYTANPIACAAALANVEIWRDEPVAERVAALSAKQAAGLQRFRDNPYFTDCRATGTIAALDLRTGSAGYLAEIGPKLRAFFLERGLLVRPLGNVLYLLPPYCITGGELDALYDAIEEAAERFGSRP

SEQ ID NO: 63870 - protein, 170 aa, Zea mays
MRATSSPVAGAVLAAPSSAAAVVVKPLPRGAANGGSTGRREVLAGTGLGAALLLALGPVCGAARAADEEYVSETKEVIGKVRSTINLDKSDPSVADAVAELRELSNSWVAKYRREKSLLGRPSFREMYSALNAVSGHYISFGPTAPIPAKRRARILEEMDTAEKALLRGR

SEQ ID NO: 63871 - protein, 365 aa, Malus x domestica
MGLTPEIQMTPTQVSDEEANLFAMQLATGSILHMVLKAAIELDLLEIMAKAGPGAFVSPADLSSQLPTKNPDSPVMLDRMLRLLASYSILTYSLRTLPDGKVERLYGLGPVCKFLTKNEDGASIGSLCLLIQDKVLMESWYHLKDAVLEGGIPFNKAYGMTAFEYHGTEPRFNKVFNKGMADNSTITMKKLLENYNGFEGLTSIVDVGGGTGAVLNMIVSKYPSIKGINFDLPHVIEDAPQYPGVEHVGGDMFVSVPKGDAIFMKWICHDWTDEHCLKFLKNCYAALPDNGKVIVAEYILPVAPDGSLATKEVVHSDAIMLAHNPGGKERTEKEFEALAKGSGFQGFRVVCSAFNTYAIEFLKKN

SEQ ID NO: 63872 - protein, 419 aa, Oryza sativa Japonica Group
MGAGRSSGGGGVVRCSLQGAVVGGRAEWQSSCAVLSSKVAALGAASPHAAAPSFVNGHVAPLVPEQQAAAEDGGAVLDLVPVSSVNGGGVAKNLPQPLRISDLSPAPMHGSQLRVAYQGVPGAYSEKAAGKAYPGCDAIPCDQFEVAFSAVELWIADRAVLPVENSLGGSIHRNYDLLLRHRLHIVGEVQLPVHHCLMALPGVRKECLTRVMSHPQALAQCEHTLTAMGLNVVREAFDDTAGAAEYVAANGLRDTAAIASSRAAELYGMEVLADGIQDDCGNVTRFVMLAREPIVPRTDRPFKTSIVFAHDKEGTSVLFKVLSAFAFRDITLTKIESRPHRHRPIRLVDDANVGTAKHFEYMFYVDFQASLAEPRAQNALAEVQEYTSFLRVLGSYPMDMTPMTAGSSSTVTSDDSSST

SEQ ID NO: 63873 - protein, 380 aa, Glycine max
  misc_feature (185)..(185): Xaa can be any naturally occurring amino acid
MATAGKVIKCKAAVAWEAGKPLSIEEVEVAPPQAMEVRVKILYTALCHTDVYFWEAKGQTPVFPRILGHEAGGIVESVGEGVTELVPGDHVLPVFTGECKDCAHCKSEESNLCDLLRINVDRGVMIGDGQSRFTINGKPIFHFVGTSTFSEYTVIHVGCLAKINPEAPLDKVCVLSCGISTGLGXPTLNVAKPKKGSTVAIFGLGAVGLAAMEGARMAGASRIIGVDLNPAKYEQAKKFGCTDFVNPKDHSKPVQEVLVEMTNGGVDRAVECTGHIDAMIAAFECVHDGWGVAVLVGVPHKEAVFKTYPMNFLNERTLKGTFFGNYKPRTDLPEVVEMYMRKELELEKFITHSVPFSQINTAFDLMLKGEGLRCIMRMDQ

SEQ ID NO: 63874 - protein, 401 aa, Salmonella typhimurium LT2
MNAFNPTQFRAQFPALADAGVYLDSAATALKPQAVIDATHQFYCLSAGNVHRSQFAQAQRLTAQYEAARAKAARLLNAPDEKSIVWTRGTTEAINMVAQCYARPRLRPGDEIIVSVAEHHANLVPWLMVAQQTGAQVIKLPLNDRRLPDVERLPELITSRSRILALGQMSNVTGGCPDLASAISAAHAAGMVVMVDGAQGAVHFPADVQQLDIDFYAFSAHKLYGPTGIGVLYGKPELLEAMSPWLGGGKMIRDVSFEGFTTQSAPWKLEAGTPNVAGVIGLSAALEWLSDIDIEQAENWSRGLATLAEDALAKRPGFRSFRCQDSSLLAFDFVGVHHGDMVTLLAEYGIALRAGQHCAQPLLAELGVTGTLRASFAPYNTQHDVDALVNAVDRALELLVD

SEQ ID NO: 63875 - protein, 327 aa, Zea mays
  misc_feature (20)..(20): Xaa can be any naturally occurring amino acid
MASTLLHAATASGAEPLPAXARGGAATAFHPLASTPSIRLARSSFSSNRRLEGSLRAGSAGHRFAGRGAPRGRRVVAALAGEQTEGSEVGDDKDNSNGEIKPEEAQEAWKGMLEQFKGEALRMQALSVQAYDVYSMRAREVLLEASEKLKIQADKAQKDLSVIATEVSQEGQEYLVMAARNSPDSIKDITTTFRALGRLNWPSEYEDYHVGIPFGTFLTVGGFLNFMLTGSTSALRFGIVLGLALLTLGISSLRSHREGDRRPRLLVKGQAAIALVIFFREFSVLLQNGWFPKIFIVLLSGVVAAFYFYRIATGTPKDLTSKNDSAN

SEQ ID NO: 63876 - protein, 365 aa, Malus x domestica
MGSTPETQMTPTQVSDEEANLFAMQLASASVLPMVLKAAIELDLLEIMAKAGPGAFVSPADLSSQLPTKNPDAPVMLDRMLRVLASYSILTYSLRTLPDGKVERLYGLGPVCKFLTKSEDGASIGSLCLMNQDKVLMESWYNLKDAVLEGGIPFNKAYGMTAFEYHGTDPRFNKVFNKGMADHSTITMKKLLENYNGFEGLTSIVDVGGGTGAVLNMIVSKYPSIKGINFDLPHVIEDAPQYPGVEHVGGDMFVSVPKGDAIFMKWICHDWSDEHCLKFLKNCHAALPDNGKVIVAECILPVAPDTSLATKGVVHIDAIMLAHNPGGKERTEKEFEALAKGSGFQGFRVVCSAFNTYAIEFLKKN

SEQ ID NO: 63877 - protein, 273 aa, Bacillus sp. SG-1
LEGGAKAAPAEKQETAQAAETAKEEAAPKAAAAQKVPEGEFPETREPMSGIRKAIAKAMVNSKQTAPHVTLMDEVDVTKLWAHRKKFKEVAAEKGVKLTFLPYVVKALTSALREYPALNTSLDDKTSEIVHKHYYNIGIAADTDKGLLVPVVKNADRKSMFSISNEINELAGKARDGKLSGDEMKGASCTITNIGSAGGQWFTPVINHPEVAILGVGRIAEKPVVKNGEIVAAPVLALSLSFDHRMIDGATAQHALNHIKRLLNDPELLLMEA

SEQ ID NO: 63878 - protein, 416 aa, Ustilago maydis 521
MPPNERTPLVSANDNGLPSHNNEHSGAHSQQPNIVSSLYWILTCSWINAFLVFVPLGIVAEHLHWPAIWIFSLNFLAIIPLAKILGDATEQVSLRLGQTLGGLLNATFGNAVELIVGIVALIQGQLRIVQTSLIGSILSNILLVLGMSFVAGGLFRSENTFQQTAAQASGSIMTLGCITLAIPAAYHMSVKSSAALAGNFEKLALLNAPVVGEEDRTGLLFISRGTSLILVGIYVLYLYFQLKSHAFLYEADEQDDEQEEANMSPIAAMIALGGVTVLTAFNADYLVGAIDEVANDYKIPKAFIGTILLPIVGNMAEHLTAVWMASKGKMEISLGIAIGSSIQISVGMIPILVLVGWAIKQPLTLYFETFETVILVAAVFLVNTLVQDGKSNYMEGAMLCSLYAVAALSFWVSPEV

SEQ ID NO: 63879 - protein, 496 aa, Pseudomonas aeruginosa PAO1
MTELLSREEYAAIAATLDLPQRAFIDGGFRDACGGRTFASTNPATGELLAQVAACDAEDVGHAVASARRAFEDGRWRSRTPAERKAALLRLAELLEEHLLELAVMESLDSGKPIRECQHTDLPETINTLRWHAELIDKIYDSTAPVGSAALAMVVREPIGVVGLVLPWNFPLLMLAWKIGPALAAGCSVVVKPAPETSLTALRVAELASQAGIPAGVFNVVPGGGREAGEPLGRHPDVAMVSFTGSTATGRLFLKYAAESNLKRVVLECGGKNPAVVMNDVEDLDLVAQHVVNGAFWNMGENCSASSRLIVHAEVREALLERIGAQLREWRMGDPLDPRNRLGALVSPAHFEKVRAYLDQARTERLAVRFGGATEAGIFVEPTVVDGVSPHSRLFREEIFGPLLSVTSFDDIDEAIALANDTVYGLAASAYTGSLRHALRLSREIRAGIVTVNCFGEGDASTPFGGYKESGFGGRDKSVWAHDQYTELKTIWIDAS

SEQ ID NO: 63880 - protein, 469 aa, Bacillus sp. SG-1
MVVGDFPIETDTIVVGSGPGGYVAAIRAAQLGQKVTIIEKENLGGVCLNVGCIPSKALITAGHRFHQAQHSDDMGIVAENVKVNFDKVQEWKGGVVKKLTGGVEGLLKGNKAEIVRGEAYLVDANTLRVMDESSAQTYKFKNLILATGSRPIEIPSFKFSKRVLDSTGALNLTEIPESMVVIGGGYIGTELGTAYANLGTKVTILEGADDILSGFEKQMTQIVKKGLKQKGVDIVTKAMAKGVDETDSGVTVKYEVNGEEKTVDAEYVLVTVGRRPNTDEIGLEEAGIDMTDRGLIKIDKQCRTNVSNIFAIGDIVDGPPLAHKASYEGKIAAEVISGEPAEIDYMGIPAVCFTDPELATVGYTEAQAKEEGLEITASKFPFAANGRALALNATDGFMKLITRKADGLIIGAQIVGSGASDMIAELGLAIESGMTAEDVAMTIHAHPTLGEISMEAAEVAMGSPIHIIK

SEQ ID NO: 63881 - protein, 282 aa, Triticum aestivum
MSGGPAAVSFLTNIAKAAAGLGAAASLLSASLYTVDGGERAVVFDRFRGVLPDTVGEGTHFIVPWLQKPYIFDIRTRPHNFSSNSGTKDLQMVNLTLRLLSRPDVVNLPTIFTSLGLEYDDKVLPSIGNEVLKAVVAQFNADQLLTDRPHVSALVRDSLIKRAREFNIILDDVAITHLSYGADFSQAVEKKQQVAQQEAERSRFLVARAEQERRAAIVRAEGESESARLISDATALVGNGLIELRRIEAAKEIAGVIARSPNVSYIPSGNNGQMLLGLSTAR

SEQ ID NO: 63882 - protein, 331 aa, Nostoc punctiforme PCC 73102
MTSEQIIRRSDILNTQVITRDNGKRLGIISQVWVDIDQREVVALGLRDSLISISGIPRYMYLNNISQIGDVILVDNEDVIEDIEVESLSNLINWEVITETGEVLGKVRGFKFNGETGKLNSIVIASLGLPQIPDQFLSTYEFSVDEIVSTGPNRLIVFEGAEERVNQLTTGLLERLGIGKAPWERDAEEEYGYTPPRQVAPGNQLPSGVPLQPPRQKVRAPEPVAREEEWNEDYVEEERPQRQVMKARQYESIQYEEDEEEDNWSEATGNDRYQQPQPLKYEAKPYSKPYVDEYDDYDDVEGDAWEDEPKPVNIPKKVKERQPEYEEEGGY

SEQ ID NO: 63883 - protein, 285 aa, Populus trichocarpa
MAKDTEVAEAGSFSAKDYQDPPPAPLIDAEELTKWSFYRALIAEFIATMLFLYITVLTVIGYKSQIDGNADPCGGVGILGIAWAFGGMIFVLVYCTAGISGGHINPAVTFGLFLARKVSLIRAVMYMVAQCAGAICGVGLVKAFQKSYYTKYNGGANVLADGYSTGTGLGAEIIGTFVLVYTVFSATDPKRSARDSHVPVLAPLPIGFAVFMVHLATIPITGTGINPARSFGAAVIYNNKKAWHDQWIFWAGPFIGAAIAAFYHQFILRAGAIKALGSFRSNPNV

SEQ ID NO: 63884 - protein, 427 aa, Photobacterium profundum SS9
MSVYDTICIIAAVAVFISLFNHRVGKFQTTIAITGWSVIISLALLFLSNMNYIPLNKEHELINIIQNIQFDDFLLKGVLGFLLFGGALNIKLPHLKDQKFEITILALASTLFSTFFIGTVLWLLFSLVGINMAFIHCCLFGALISPTDPIAVLAIVKKMNAPQRVSTQIEGESLFNDGIGLVIFVTLFEVAFGETAPTVSSTIALFTHEALGGIAFGLVLGLVFHYLIKHSHDSMMRLILTMLIPTSGYVLGQHLGVSAPLAMVVSGIMIGNWTRNSIAEDESNQLNHLWELADEILNAILFLLIGLIMLTFSFHYIDIVAVAIAIPLVLCSRYLSVKIAYLGFNRYRTYNPESIKILTWGGLRGGLALAMAMAIPSGIATGFSPEIDVKEIIVLMTYAVVVFSIIIQGSTITPMIHKAKELEKTGY

SEQ ID NO: 63885 - protein, 431 aa, Photobacterium profundum SS9
MSFASQNFSPEIVRALTECGYEKLTPIQAQAIPHARRGSDILANAQTGTGKTAAFSLPIIQQILEKPKSRGRFNVRALILAPTRELAAQIAQNIAEYTKYTDLKTAAIYGGTKMSSQERTLEKGVDILVATPGRLIEHVDLKNVSLANIEFLVFDEADRMLDMGFITDMRKVMGEVNTNPQIMMFSATSSKQMNALASDILRKPKRIMVDRENTTADTVSHVVYPVDQERKRELLSELIGKKNWKQVLVFVNYKETANELVKELKKDGIKAVLCHGDKAQSARRRALDEFKEGKARVMVATEVAARGLDIQALPHVVNFDMPFLAEDYVHRIGRTGRAGLKGHAISFVSKEEELTLVQVEQLIGQRIHRVQLLGYEPANRDAFVQKMNTKAAFKDRKGRTNNPTEQQSSSERRVRLRQAIKGKAKITTLKK

SEQ ID NO: 63886 - protein, 446 aa, Clostridium difficile 630
MALGGITMEKGIKLGFWSIVLLGINAIIGSGIFGLPGDAYTDIGPASILVLVFCMLLAVSIALCFAEAGSWFDTDGGPYLYAKEAFGDFVGFEVGFMKWIVSMIAWATMANFFAVTLSSVWPQAAEPLIKNIIIGILVVGLGIINFMGMKQSKHLNNIMTIGKLLPIVLFIAVGLFFIKGSNFTPFVIIQKGQSASSAFVAVSITLFYAFTGFESLAVAAKDMENPKKNVPKALVMVMFVVSVIYMLILGISIGVLGNGLAGSATPVADAAIKMLGPIGGYIITIGTIVSVGGINIASSIFTPRSAAALVEQGLMPKSIRKTNKNGAPYIAIIVSVIGTLLIAWSGSFTTLSQISVVSRFIQYIPTCLAVLILRKKYAGKDVNFRIPGGAIIPIFAVIISILLLIKAGIDEPMKIVWGLGGMIIVVPVYFYMTKVYSKKYNDVEVK

SEQ ID NO: 63887 - protein, 147 aa, Populus trichocarpa
MATTAALSSAMVSTSFTRRVPVTSLRALPNVGESLLGLKASRGGRVKAMAAYTVKLITPDGEKEFACPDDIYILDHAEEAEEIDLPYSCRAGSCSSCLGKIVKGTVDQSDASFLDDDQIEEGWVLTCVAYPTSDVVIETHKEEEFSG

SEQ ID NO: 63888 - protein, 466 aa, Helicobacter hepaticus ATCC 51449
MQGKITQVMGPVVDVEFSSYLPMINEAIDVNFDIEGRKNNLVLEVAAHLGDNRVRTIAMDMTEGLIRGQEVKARGKPIEVPVGEAVLGRIFNVTGDVIDGGKPLESDLKWPIHREAPSFENQSTRTEMFETGIKVVDLIAPYSKGGKVGLFGGAGVGKTVVIMELIHNVAYKHSGYSVFAGVGERTREGNDLYHEMKEGGVLDKVALCYGQMNEPPGARNRIAFTGLTMAEYFRDEKGLDVLMFIDNIFRYAQSGSEMSALLGRIPSAVGYQPTLAGEMGKLQERITSTKKGSITSVQAVYVPADDLTDPAPASVFAHLDATTVLDRKISEKGIYPAVDPLGSTSRILDPQIVGEEHHKVATGVQQVLQKYKDLQDIIAILGMDELSEEDKQVVARARKIERFLSQPFFVAEIFTGSPGKYVTLEETLEGFKGILEGKYDDIPENAFYLVGNIQEALEKAQKLKNA

SEQ ID NO: 63889 - protein, 268 aa, Salmonella typhimurium LT2
MSVVISDAWRQRFGGTARLYGEKALQRFAEAHICVVGIGGVGSWAAEALARTGIGAITLIDMDDVCVTNTNRQIHALRDNVGLAKAEVMAERIRQINPECRVTVIDDFITPDNVAGYMNAGFTYVIDAIDSVRPKAALIAYCRRYKVPLVTTGGAGGQIDPTQIQVADLAKTIQDPLAAKLRERLKHNFGVVKNSKGKLGVDCVFSTEALVYPQADGSVCAMKATAEGPKRMDCASGFGAATMVTATFGFVAVSHALKKIMAKAARQE

SEQ ID NO: 63890 - protein, 365 aa, Malus x domestica
MGSTPETQMTPTQVSDEEANLFAMQLATGSILHMVLKAAIELDLLEIMAKAGPGAFVSPADLSSQLPTKNPDSPVMLDRMLRLLASYSILTYSHRTLPDGKVERLYGLGPVCKFLTKNEDGASIGSLCLLIQDKVLMESWYHLKDAVLEGGIPFNKAYGITAFEYHGTDPRFNKVFNKGMADNSTITMKKLLENYNGFEGLTSIVDVGGGTGAVLNMIVSKYPSIKGINFDLPHVIEDAPQYPGVEHVGGDMFVSVSKGDAIFMKWICHDWSDEHCLKFLKNCYAALPDNGKVIVAEYILPVAPDGSLATKEVVHSDAIMLAHNPGGKERTEKEFEALAKGSGFQGFRVVCSAFNTYAIEFLKKS

SEQ ID NO: 63891 - protein, 520 aa, Oryza sativa Japonica Group
MPAASSLVVGVAFTAAVAVAVAAAVARRAWRHRGLRLPPGPPGWPVVGNLLQVVFAGKPFIHYIRDLRREYGPIVKLQMGVRTLVVISSAELVHEALVEKGREFATRPAESPIRSIFSSGKFTVNSAVYGPEWRSLRRNMVSGMLSAARLREFRPARLRAMERFVARVRAEAAASRDGASVWVLRNVRFAMFCVLLDMTFGLLDLDEELVVRVDAVMKRVVLAVAARIDDYLPFLRPFLWRQHRQAVALRREQIDTVLPLINRRRAIVRGMRAGSPPDPAVAAPYSYLDSLLDLRVEGRDAVPTDEELVTLCAEMINGGTDTTATAIEWAMARVMDNPSIQARLHGEIMQRVGDARPVDDRDTEGMPYLKAFVKELLRKHPPTYFALSHAAVEPGSKLAGYDVPVDANLDIFLPTISEDPKLWERPTEFDPDRFLAGGETADITGSAGVRMIPFSAGRRICPGVGMGTAHIALMVARMVQAFEWRAHPSQPPLDFEDKVEFTVVMKRPLLAMVTPRKLSF

SEQ ID NO: 63892 - protein, 261 aa, Bacillus subtilis
MHTLLIEKTAVVTGAAGGIGLEIAKEFAREGAAVIISDINEQAGKEAAARLKDEGCEAVSITCDVTNEKQVADMLQTVEKQFGRLDILVNNAGIQHVAPIEEFPTEQFERLIRLMLTAPFIAMKHAFPIMKKQQFGRIINMASVNGLIGFHGKAAYNSAKHGVIGLTKVGALEGAADGITVNALCPGYVDTQLVRNQLKDISATRNVPYERVLEDVIFPLVPQKRLLSVKEIADYAVFLASDKAKGVTGQAVVMDGGYTAQ

SEQ ID NO: 63893 - protein, 215 aa, Malus x domestica
YNLKDAVLEGGIPFNKAYGMTAFEYHGTDPRFNKGMANHSTITMKKLVENYNGFEGLTSIVDVGSGTGVVLNMIVSKYPSIKGINFDLPHVIEDALQYPGVEHVGGDMFVSVPKGDAIFMKWICHDWSDEHCLKFLKNCYSALPDNGKVIVAECILPVAPDSSLATKGVVHIDAIMLAHNPGGKERTEKEFEALAKGFGFPRLSSRVLCFQHLCH

SEQ ID NO: 63894 - protein, 364 aa, Pseudomonas syringae pv. phaseolicola 1448A
MSEQELKALRVRIDSLDEKVLELISERARCAQEVARVKMSSLAEGEVPVFYRPEREAAVLRRVMDRNRGPLSNEEMARLFREIMSSCLALEQPLKVAYLGPEGTFTQAAAMKHFGHAVISLPMAAIDEVFRKVVAGAVNFGVVPVENSTEGAVNHTLDSFLEHDMVICGEVELLIHHHLLVGESTKTQSISRIYSHAQSLAQCRKWLDAHYPNVERVAVASNAEAAKRVKGEWNSAAIAGDMAAGLYGLTRLAEKIEDRPDNSTRFLIIGNQEVPPTGDDKTSIIVSMSNKPGALHELLVPFHESGLDLTRIETRPSRSGKWTYVFFIDFVGHHQDPLVKAVLEKISSEAVALKVLGSYPKAVL

SEQ ID NO: 63895 - protein, 319 aa, Archaeoglobus fulgidus DSM 4304
MENFEIWVEKYRPRTLDEVVGQDEVIQRLKGYVERKNIPHLLFSGPPGTGKTATAIALARDLFGENWRDNFIEMNASDERGIDVVRHKIKEFARTAPIGGAPFKIIFLDEADALTADAQAALRRTMEMYSKSCRFILSCNYVSRIIEPIQSRCAVFRFKPVPKEAMKKRLLEICEKEGVKITEDGLEALIYISGGDFRKAINALQGAAAIGEVVDADTIYQITATARPEEMTELIQTALKGNFMEARELLDRLMVEYGMSGEDIVAQLFREIISMPIKDSLKVQLIDKLGEVDFRLTEGANERIQLDAYLAYLSTLAKK

SEQ ID NO: 63896 - protein, 531 aa, Arabidopsis thaliana
  misc_feature (203)..(203): Xaa can be any naturally occurring amino acid
  misc_feature (295)..(295): Xaa can be any naturally occurring amino acid
MAAMITVDFQNSFAFILFCLFSLLCYSLFFRKAKGSRAGRDLPPSPPSFPVIGHLHLLLSVLVHKSFQKISSKYGPLLLLRIFHVPIVLTSSASVAYEIFRAQDVNVSSRGHPPVEESLWFGFSSFFFAPYGDYFKFMRKLIATKLLGPQALDRSRKIRADELDRFYRNLLDKAMKKESVEIGEEAAKLNNNIICKMIMGRSXMIMGRSCSEKNGEAERVRGLVIESLALSPKIFLGMIFHKPLKKLGISLFQKDIKSVSPKFDELLEKFLVEHEEKMEEDHYKANDMMDLLLEXYGDENAEYKITRNHIKSLFVELLVAGTDTSALATQWTMAELINNPTILERLREEIESVVGNTRLIQETDLSNLPYLQSVVKEGLRLHPPASISVRMSQERCELGGFYIPEKTLLVVNTYAIMRDPNFWEDPEEFKPERFITSSRSEQEDEMREEVLKYIPFSAGRRGCPGSNLAYVSLGIAIGVMVQCFDWRIKGEKVNMSETAGTIMLAMAQPLKCTPVPRTLNLLPSSLHIPSS

SEQ ID NO: 63897 - protein, 540 aa, Zea mays
MGLGVVAELVRLGVLSSTSDHASVVSINLFVALLCACIVLGHLLEENRWVNESTALIVGLGTGTVILMISRGVVIHVLVFSEDLFFFYLLPPIIFNAGFQVKKKQFFRNFITITLFGAVGTLISFTVISLGALGLISRLNIGALELGDYLALGAIFSATDSVCTLQVLSQDETPFLYSLVFGEGVVNDATSVVVFNALQNFDITHIDAEVVFHLLGNFFYLFLLSTVLGVATGLISALVIKKLYFGRHSTDREVALMMLMAYLSYMLAELFALSGILTVFFGCIVMSHYTWHNVTESSRITTKHAFATLSFLAETFLFLYVGMDALDIDKWRSVSDTPGKSLAISSILMGLVMVGRAAFVFPLSFLSNLAKKTEHEKISWKQQVVIWWAGLMRGAVSMALAYKKFTRAGHTQVRGNAIMITSTIIVVLFSTMVFGLLTKPLINLLIPHRNATSMLSDDSSPKSLHSPLLTSQLGSDLEEPTNIPRPSSIRGEFLTMTRTVHRYWRKFDDAFMRPMFGGRGFVPFVPGSPTERNPPDLSKA

SEQ ID NO: 63898 - protein, 375 aa, Bacillus cereus E33L
MLFYFELVVILLCTKLAGDISVRLGQPSVLGKLIIGIIIGPAVLGIINSSELIDELSEIGVLLLMFMAGLETDLEELNRNLKSSFAVAAGGIIFPFIGGYVTGLLFGLIQSHAIFLGLLLCATSVSITVQTLRDLGKMNTRESTTILGAAVFDDVIVVILLAFVMSFLGTQDVNITLVIVKKIIFFVSIVFIAWKVVPWIMKMLVPLRVTEALISAALIICFSFSYYSEMMGIAGIIGAFAAGIAISQTEYKHEVEHKIEPIAYAIFVPVFFVSIGMEITFQGIGSQLWFIIIMTLIAIFTKLIGSGLGARLTGFNLQSSISIGAGMVSRGEVALIIAANGLAANLLAKENFTAIVIVVILTTIITPPLLKKYFV

SEQ ID NO: 63899 - protein, 384 aa, Staphylococcus aureus subsp. aureus MRSA252
MKLSLNSNSKFLRAPSIRQFSNRMNNLDDCVNLTIGQPDFPMPDVVKKAYIDAINNDKTSYSHNKGLLETREAISQYFKNRYHFSYDPEEIIVTNGASEAIDTTLRSIIEPGDEIIIPGPIYAGYIPLIEVLGGKPIYIDTTATQFKITPDALESHISPKTKAVLLNYPTNPTGVVLKRNEVLNIVNVLKKYPIFIISDEIYAENTFSGKHVSFAEFEDIRDQLILIGGLSKSHSATGIRIGFLLGPQYLIDKLTFMHAYNCICANVPAQIACITALNEGLEAPKYMNEAYVERRNYLVSELTKLGFEITAQPEGAFYIFPNIKHITDDDFEFCVDLLESTHLAIVPGSSFTEFGKGFVRISYAYEMDVLKEGMKRLAKYLNTK

SEQ ID NO: 63900 - protein, 458 aa, Xanthomonas campestris pv. vesicatoria str. 85-10
MSALFGATPADWLDARNLRLATRLGTLGLEPTAGRTLIREGILRRAVGLTLEATGCEAPMGATCKVEVDGGWVDAEVVGFAGERTYLMPSAELHGLLPNARVVPSRRRGGVEVGEGLLGRVIDSDGTPLDGKGPIRAEGSIGMAGVSINPLAREPITTSLDVGVRAINAMLPIGRGQRVGLFAGSGVGKSTLLGMMTRFTSADVIVVGLIGERGREVRDFVETTLGEEGLRRAVVVAAPADRPPLARLHGAYRATAIAEWFRDQGLNVLLLMDSLTRFAQAQREIGLSVGEPPTTRGYPPSVFAKLPALVERAGNGAKGRGSITAFYTVLTEGDDPQDPIADAARAILDGHILLSRRVADSGLYPAIDLESSVSRVVQDIADDTWRLRIRKLKRLLSAYTANRDLIAIGAYQRGSDPATDEALARWPEIVEFLGQDVHKASLLSDSLSALQQLVEPEN

SEQ ID NO: 63901 - protein, 565 aa, Lactobacillus plantarum WCFS1
MYRALYRVWRPQRFDEIVGQQMITQTLKNAIMTHQTSHAYLFTGPRGTGKTSAAKIFAKAINCHHLVDGEPCNECETCTAITKGQLNDVIEIDAASNNGVEEIRDIRDKAKYAPTQADYKVYIIDEVHMLSTGAFNALLKTLEEPPANVIFILATTEPHKIPLTIISRTQRFDFRRITAKDSYDRMVYILNEKDVTYDEKALRVIAAAAEGGMRDALSILDQVISFGDNTVTLDDALMVTGSVTKQLLANYVSEVTDHDTKPALETMRQILQEGKDANRFIEDLISYTRDVLLYQQAPEMVDSVAMGEDDQQFEAFAKQIDAEVLYQMVKTLNDIQQQMRFTTHPDVYLEVLTVKLAQLDGQAAVQPVAAATVNPEDPTVHKLAQQVEQLQSEVKTLRSQGGSITKPAPAKPRSSNGPVVKKVNVSQIYPILGAATKNDLIKVRDVWTDLMNILSVTQRALMHVAQPVAASSEGVVVAFDYAFVYQKAIDDQTLIDALGNGLDRLMGEAPKIVCVPKEQWPQIRKDYLATHQPGGATSEQQAPAKEPVVEEAKNMFGDLVEVQPD

SEQ ID NO: 63902 - protein, 386 aa, Bacillus sp. SG-1
MNIHEYQGKEILRNNGVAVPNGKVAFTADEAVEAAKTLDSSVYVVKAQIHAGGRGKAGGVKIAKSVDEVRTYAEELLGKTLVTHQTGPEGKEVKRLLIEEGCDIKKEYYVGLVLDRATSQVVLMASEEGGTEIEEVAAETPEKIFKEYIDPVVGLTGFQARRIAFNINIPKELVNKAAKFMLGLYNVYIQKDASIVEINPLVVTGGGDVMALDAKFNFDSNALYRQKNVLELRDLEEEDAKEIEASKYDLSYISLDGNIGCMVNGAGLAMATMDIVKHYGGDPANFLDVGGGATAEKVTEAFKIILSDENVKGIFVNIFGGIMKCDIIAEGVVEAAKQVELTVPLVVRLEGTNVDLGKKILNESGLNIIAAQSMADGAQKIVEQVG

SEQ ID NO: 63903 - protein, 399 aa, Methanothermobacter thermautotrophicus str. Delta H
MEYVAFSVAVIILLGLLFNRVFTRARLPGILGMLILGILIGPHGLNLISKSIMDISPDLRVIALIIILLRAGFGINLESLRKVGMTAVKMSFIPDVFEGLAVMVASHYILGLPIIEAGILGFVIAAVSPAVIVPQMLSFIERRMGTAKGIPTIILTGASVDDVVSITLFSVFLGIYQGQQVNLLVEAIGVPLSILTGITGGLALGLALVYLFRRFEIRNTEKTLIILGAAILLKNMGDLISTYLPIAALVGVMVVGLVILERMPETGLKLSEKFNKVWIFAEILLFVLVGAQVDVRLIFHVGLLGLAVITAGLMVRSIGVLLSLKGTDLNLKEKVFCISAYIPKATVQAAIGAIPLAAGVAAGETILAMAVLAILFTAPLGSLAVKWTGERFLEVERGN

SEQ ID NO: 63904 - protein, 165 aa, Streptococcus pyogenes
MIKKENIPNLLTLVRIAMIPFFLFITSSSNKVGWHIFAAVIFAIASFTDYLDGYLARKWHVVSNFGKFADPLADKMLVMSAFIMLVGLGLVPAWVSAVIICRELAVTGLRLLLVETGGKVLAAAMLGKIKTATQMLSIILLLWPLDIPRKRLTLYCSFFHYLFWI

SEQ ID NO: 63905 - protein, 503 aa, Coxiella burnetii RSA 493
MRKQIFHQLLSQRSKSPQSSGHAFAPSNIALCKYWGKRNLELNLPVTSSLSISLGDKGATAAISPSSTNQHELIINNQPIAIYSTHAKQLLAFLEAFNFLGVKYHLELNFNIPLAAGLASSACAYAAIVKALDNFFEWQLDRKSLSILARLGSGSACRSVFNGFVEWYCGKDPDGMDSYAEPLVENWPGLCIGLCILNQKPKTVSSREGMRRTVTTSPLYSAWPEKANRDLTQLKKAIAKKDFNLLGRTAESNALAMHATMLAAWPPLLYSSPETITVMQKIWSLREAGTEIYFTQDAGPNIKLLFLESNKEKIKQSFPEIEIISPFKTSREQRVVLVDENDRRLGIEEKIKAHREGKLHRAFSVFIFSRKNNEWQLLLQQRHPEKYHSGGLWTNTCCSHPRPDEDIVTAGERRLFEETGLKIPLKRVGEFHYTATVGNQLIENEYDHVLIGFTDADAIDFNKKEISAVRWIRVSELKNELKENPSHFTPWFMQALEIAIKPL

SEQ ID NO: 63906 - protein, 381 aa, Oryza sativa Japonica Group
MSETDSSAAAAEGRKPRRLRGHKKGAVTCCVASSSRPGVVASSGEDGCLCWFDLRTKDVLFTMEATNQPISSVCFKAGNEDLVYASAGNEILSFDVRMGPQAKPLDTYNYNRDEINQIAVSSKGFLAAADDSGDVKIINTIQKSLYKRLREAHTSICSSVQFIPWRPWTAITGGLDSKLAVWDFSKGRTLFSIDYGSPEMQNGSSGGQCFNPPFVHSIAVSEEGILGGSYKVCAVARGDGAVDVVDLEYELAPAKSKGLPRMADLSLSSKRTDLGDGCGSQSQGNRIHLDYTVGGHTSSVSCVTFSAFGEKGKFLVSGGNDSSIKLWDWSKGFSSETNNSAELVLDIKVNKKVNWLCTTPTDSDNLIVCDTSKVVKVYNLP

SEQ ID NO: 63907 - protein, 564 aa, Escherichia coli
MSTLKITGMTCDSCAVHVKDALEKVPGVQSADVSYAKGSAKLAIEVGTSPDALTAAVAGLGYRATLADAPSVSTPGGLLDKMRDLLGRNDKTGSSGALHIAVIGSGGAAMAAALKAVEQGARVTLIERGTIGGTCVNVGCVPSKIMIRAAHIAHLRRESPFDGGIAATTPTIQRTALLAQQQARVDELRHAKYEGILEGNPAITVLHGSARFKDNRNLIVQLNDGGERVVAFDRCLIATGASPAVPPIPGLKDTPYWTSTEALVSETIPKRLAVIGSSVVALELAQAFARLGAKVTILARSTLFFREDPAIGEAVTAAFRMEGIEVREHTQASQVAYINGEGDGEFVLTTAHGELRADKLLVATGRAPNTRKLALDATGVTLTPQGAIVIDPGMRTSVEHIYAAGDCTDQPQFVYVAAAAGTRAAINMTGGDAALNLTAMPAVVFTDPQVATVGYSEAEAHHDGIKTDSRTLTLDNVPRALANFDTRGFIKLVVEEGSGRLIGVQAVAPEAGELIQTAALAIRNRMTVQELADQLFPYLTMVEGLKLAAQTFNKDVKHLSCCAG

SEQ ID NO: 63908 - protein, 464 aa, Synechococcus sp. RS9917
MVLPLELAQLPEILTQLSSHDLEVAETLIGVIRFLLIFVAARTMAEVLVRLQLPTILGELLAGVIIGASGLHLLVPPDTQAQLSQSFVSLISGLAAIPPDTIPEIYNETFPSLQAVATLGLYALLFLTGLESELDELVAVGGQALTVAVAGVVLPFALGTFGLMSLFHVELIPAIFAGASMTATSIGITASVFGELGYLKTREGQIVIGAAVLDDILGIVILAVVVSLASGGSLAIAPIVKLVAAAIVFVVAAIGLSRTAAPAFDWLIDKLKAPGEVLVASFVILSFSCFAATAIGLEAALGAFAAGLILSGSKHNHAIQQAVLPIVTLFATIFFVLVGAGMDLSVINPLDPASRSALVVAGFLLVIAIVGKIASGWAFLSDKPTRRLVVGLGMMPRGEVGLIFLGLGTSAGLLSPSLEAAILLMVIGTTFLAPILLRLVIGGDKPDDGDSVDEAVAADPVGLI

SEQ ID NO: 63909 - protein, 345 aa, Streptococcus pneumoniae R6
MKSAVYTKAGQVGLASIERPQIIEADDVIIRVVRACVCGSDLWRYRNPETKAGHKNSGHEAIGIVEEAGEAITTVKPGDFVIVPFTHGCGECDACLAGFDGSCDNHIGNNLGGDFQAEYIRFHYANWALVKIPGQPSDYTEGMLKSLLTLADVMPTGYHAARVANVQKGDKVVVIGDGAVGQCAVIAAKMRGASQIILMSRHEDCQKMAMESGATAVVAERGQEGITKVREILGGGADAALECVGTEAAIEQALGVLHNGGRMGFVGVPHYNNRALGSTFMQNISVAGGAASATTYDKQFLLKAVLDGDINPGRVFTSSYKLEDIDQAYKDMDERKTIKSMIVIE

SEQ ID NO: 63910 - protein, 372 aa, Aspergillus oryzae
MARLRSGMLTQLFSGHDDAFAILLAAHHPSLNLLGITTVHGNASLENTTNNATRILEAIGRPEIPVYPGHKKPFCRPAIHAPNIHGDSGIDGTELLPKATKSPITDKNPILAMRDALLAQPKGTPWVIATGTLTNVALLFATFPEVAEHIQGLSIMGGGVGGGFTDAPMSRLVGEESRIGNITPLAEFNIYCDPEASQSIFSNPVLASKTTLITLDLTHQVLASHSVQSRVLHGGDDLSVPPTVLRQMLFDLLVFFASTYENVFGLTSGPPLHDPLAVAVILSTLNPEYAKRHPDQVLKFDDRNGERFDVDVVTDGLHGTDVELVGELGRSKVISGTTGVAIPRGVDLDAFWNMILDCLRRADECNAARKLA

SEQ ID NO: 63911 - protein, 413 aa, Bacillus cereus ATCC 10987
MGKLFLKICFFALVAVCSLVAKITYAEESQQNNYPIILVNGFAGWGREEMLGVKYWGGVHDIQEDLKRNGYTVHTAAVGPVSSNWDRACELYAQINGGTVDYGAAHAEKHGHNRFGRTYSGFAPNWSETNKVHLVGHSMGGQTIRTLVQLLKEGSFEEKNYVKNHPNTKISPLFEGEKSYVHSVTTLATPHNGTTLADGSLLLPFVKDLLITAASFGGNDNLSLYDFKLDQWGIKKNVGESFFQYSNRILNSSLWKNTKDISQWDLSTDGAKELNNWVKTQPNVYYLSYSGHASQAAPITGLHLPHITMNKVLMGNAFFLGSYARYEENRPLIDTTWWQNDGVVNTSSMIAPSSNATVNNNESLQIGKWNHIETKANWDHLDMVGLSISDTLGFSNIQEFYRTIAEKLSRLPK

SEQ ID NO: 63912 - protein, 131 aa, Populus trichocarpa
MEELFTGVHGKGAFLNGKPIKVSSQSELVKSLLATEAGTKRDKSTVDATTNIINSLLFKVRSLRMTGSCALNLCGIACGRIDLFYETGYGGPWDVAGGAVIVKEAGGIVYDPHLVKILTSLLKESQLQTRF

SEQ ID NO: 63913 - protein, 333 aa, Candida albicans SC5314
MSYPTIPWPTFADLKQMLHGFWASKPTYTESQYPDLQDKVVIVTGGNTGLGYETVKSLAGSTKARIYVFSRNKEKTLAAIKQIQLEIAEEYNVSNSDIRFIQVDLSDLTTIKPAVEEFLKQEQRIDIIIHNAGIMGPPVGSKSKQGYELQWGTNVVGPHLLQRLLDPLFIKTSETNPPGFSRIVWVSSTAHLFAPQGGVFWDNVNYENLKLSQTQVRTTLYAQSKAGNLIQARTWSRKHNYPNVISSSLCPGYLYTDLIRNLNSFEQCFVKRLIYPRRYGAYTELYAAFSPDVKDGAHTIGFGVPSHARTDLTSEAVGDKTWAYLDKETDAYL

SEQ ID NO: 63914 - protein, 233 aa, Zea mays
MAGNEGLKVLGLQVSPFVLRVCMALNTKGVSYEYVEEDLSNKSELLLKSNPVHKKVPVLIHNGKPICESLVIMQYVDELFAGRSILPTDPYERATARFWAAYADDKLLPAWYGMVKAQSAEERAEKVEETLSAIQHMEVAFAKCSGGNAAFFGGDSIGYVDIVLGSFLFWFEAVRRVYDLEIINASNTPLLAAWAERFVGTVEAKEVVPVPDVDMAVQCINKLHAPAAAISSQ

SEQ ID NO: 63915 - protein, 227 aa, Zea mays
MAGADDLKVLGLWTSPFVIRVRIVLNLKGLAYEYVEDDLGNKSALLLSSNPVHKTVPVLLHAGRPVNESQIILQYIDEVWAGTGPAVLPRDPYERAAARFWAAYIDDKVKSAWLGMLFECRDEGERAEAVARAGEALGTLEGALRGKPFFGGDGVGFVDAVLGGYLGWFGAVGRIIGRRLIDPTKTPLLAAWEDRFRAADVAKGVVPDDVDKMLAFLETLLANYYSK

SEQ ID NO: 63916 - protein, 604 aa, Cryptococcus neoformans var. neoformans JEC21
MIALTDEIYFLWVKTLKQLVSITLDRQVTDITPSDPDMLWIRQLWPLGTKAINREKAEALCAQIGLQIKADGMLDITVFHDLIKASQTRPDINQVYRDLTLSGLLDKGRVVSFLTHIQRIPSSSVENVFNRYKSGDLWTIDSLTSFLSSSDNTPNQPQDMTHPLQHYFISSSHNTYLVGEQWKGESTVEGYIRVLLAGCRCVEMDVQSGDVEPVVYHRKTLTSSVPVRDICRAIKQYGFVTSPYPIIISTEIHCASEQQNRLAIILKEVFGDMLVSAPLVEEFSELPSPEDLKGKILFKAKPPKPELNSPKLEANLFYQESPSSTDSDTSFVRLARRLSIQSKTERPDIFSPQLSELLVYTHGVKYQGFSKLNEYLPSHQFSVSERTAAKILKENKVDWIKHNFKHISRVYPRGTRLGSTNFNPVDSWSAGCQIVALNWQTLDESILLNHAMFHDSNGYILKPLSLREKVVEVPEKYLLTVRIISGQRTPLCADLYVEAILNGKISKRTRALSQVTLNPLWDETLTFEITSTPSLLMLNFLHLEVRNKALQAQWMRPVSLAPRGYHHLPLYDSLLSRFVFATLFVKITVEKLQDVVENEKSNLI

SEQ ID NO: 63917 - protein, 223 aa, Zea mays
MDYRPSDSSGTDDDLPQFPHKSIRGSGRVSGNGRAVVPAGSYARAPTDMVAQVQQLEQEAYRSVLRAFKAQSDAITWEKEGLMTELRKELRVSDKAHRELLNRVNNDNIICSIREWRSTGGLQASLSNNPQLIHDSVPSPTTSGRKRQKTSQSVPALPAPPPAMHSQQLATPTQPSSSTARKAVPPGHKGKKMKPGQKVPGGSAAKPIPSSAGSSGRGPHMNR

SEQ ID NO: 63918 - protein, 149 aa, Pseudomonas syringae
TETRDLLVSLAGEVGLKDAIKAQYDGELVNSSEGRPVLHTALRRPVGDKLKVNGVDVMPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63919 - protein, 564 aa, Bordetella parapertussis 12822
MARGYAIGRAVVMGAAALEVAHYRIAPEDVAAESQRLTEALAKAQADLLQMADTLPEDAPRELGAMLNVHRLLLGDPLLAEQALALIAERHYNAEWALTAQGQILGQQFEAMEDEYLRERGGDVRQVIERALHVLAGTSAMLPDGAQLDGDDPLVVVAHDISPADMLRLRGGRFAAFVTDLGGPTSHTAIVARSMGVPAVVALGNVRELVRDGDMLIVDGADGVVVLNPSARILAEYQARQRVYADERAELALLRDEPAVTLDGIDIVLHANIELPEEASLSLACGAHGIGLFRSEFLFMGRPDLPGEEEQYEAYASVVKVMAGRPVTIRTLDIGADKTLDDEATVATNPALGQRAIRYCLARPEMFATQLRAILRASAHGPVRVLIPMIAHMHEVHAAYAALESARRELDARGQPYAARVEVGAMVEIPAIAIAIEPFVQPLDFLSIGTNDLIQYTLAIDRGDHDVAGLYDPLHPAVLRLVANTINAGERAGKPVAVCGEMAGDARLTRLLLGLGLTEFSMHPQQLLDVKREVRRAHSNALRVKVAAALNRALPIDPDTLDAL

SEQ ID NO: 63920 - protein, 331 aa, Lactobacillus plantarum WCFS1
MSILVLGGAGYIGSHMVDRLVEHGTDVVVVDNLVTGHRAAVNSAAKFYQGDLRDADFLNHVFDTEDIEAVVHFAAFSIVPESMSKPLKYFDNNTGGMITLLETMQAHDVKQIVFSSTAATYGTPKQIPIKETDPQLPINPYGASKLMMEQIMHWADVAYGIKFVALRYFNVAGAKPDGSIGEDHGPETHLVPIILQVAQGKRDELKIFGDDYNTPDGTNVRDYVHVVDLADAHILALKYLAAGNDSNAFNLGSSTGFSNKQMLAAAREVTGQPIPAKLAPRRPGDPDSLVAASDKARDVLGWQPNYDNVNDIIETAWAWTQKHPNGYDDRD

SEQ ID NO: 63921 - protein, 361 aa, Oryza sativa Japonica Group
MKALILVGGFGTRLRPLTLSFPKPLVDFANKPMILHQIEALKEVGVTEVVLAINYRPEVMLNFLKDFEDKLGITITCSQETEPLGTAGPLALARDKLVDGSGEPFFVLNSDVISEYPFAELIKFHKNHGGEATIMVTKVDEPSKYGVVVMEEATGMVEKFVEKPKIFVGNKINAGIYLLNPSVLDRIELKPTSIEKEVFPRISADAKLFAMVLPGFWMDVGQPRDYITGLRLYLDSLRKRSANRLATGAHIVGNVLVHESAKIGEGCLIGPDVAIGPGCVVEDGVRLSRCTVMRGVRIKKHACISNSIIGWHSTVGQWARIENMTILGEDVHVGDEVYTNGGVILPHKEIKSSILKPEIVM

SEQ ID NO: 63922 - protein, 405 aa, Thermoplasma volcanium GSS1
MAYIQVREDGTLLVPDKVTIGYIEGDGIGPDITKTTINVINAALEVAYGGKRSIEWHKVLAGDEAYDKTGNRLPDSSLEELKKCVVSIKGPLTTPIGEGFRSLNVTLRQYLDLYANIRPVRYFPGVPSPVLHPEYMNMVVFRENTEDLYAGIEWRYDSEDAEKVRAFLSSTFNINLTPDTGIGIKPISKFKSTRLVRKAIQYAIANGRKSVTLVHKGNIMKYTEGAFRDWGYEVARTEFGDYTVTEAEYLKDPEKYANKIVIKDRITDNMFQQVLTRTQEYDVIATPNLNGDYLSDALAAQVGGIGLAPGANIGDHYAVFEAVHGTAPKYAGLDVANPTSLILSAEMMLDHIGWKEASKILDDAIMQTYRDQKLTQDIARLLNLKALKCSEFGEEIINRMKPIKS

SEQ ID NO: 63923 - protein, 211 aa, Arabidopsis thaliana
MPGPVIEEVNEEALMDAIKEQMKLQKENDVVVEDVKDGDEDDDDVDDDDDEIADAGENEASKQSRSEKKSRKAMLKLGMKPVTDVSRVTIKRSKNVLFVISKPDVFKSPNSETYVIFGEAKIDDMSSQLQAQAAQRFKMPDVASMIPNTDGSEAATVAQEEEDDEDVDETGVEAKDIDLVMTQAGVSRPKAVKALKESNGDIVSAIMELTT

SEQ ID NO: 63924 - protein, 286 aa, Thermoplasma volcanium GSS1
MKIIALRSSLKLAARIAEELKTEPVMPDERRFPDGELYLRYDEDLTGHNIFIIGNTHSDAEVMEMILTLSAIQDYRTKSVNIIAPYYGYARQHQRYKNGEPISSQILTEIYSSYSNSIATVDIHDEKTLSYSKVKFSDLHANDAIVRYYKNVDVDYVVSPDDGGLARVADISAKLGKKHFFIEKKRIDDRTVEMKVPNVDVNGKKLLIVDDIISTGGTIAKSSGLLREKGASKIYVSAVHGLFVNGSENKILQNADEIHVTDTVESKFSDISVYQEVCNYIRDIDA

SEQ ID NO: 63925 - protein, 172 aa, Synechocystis sp. PCC 6803
MKHTLSVLVEDEAGVLTRIAGLFARRGFNIESLAVGSAEQGDVSRITMVVPGDENTIEQLTKQLYKLVNVIKVQDITETPCVERELMLVKVSANAPNRAEVIELAQVFRARIVDISEDTVTIEVVGDPGKMVAILQMLAKFGIKEVARTGKIALVRESGVNTEYLKSLESKF

SEQ ID NO: 63926 - protein, 146 aa, Vitis vinifera
MDLERLKDLVHLVGKQRLVLDLSCRKKEGKYAIVTDRWQKFSDVCLDQEILDFLASYSDEFLVHGVDVEGKKLGIDEELVALLGKYSPIPVTYAGGVTVMADLERIKVAGSGRVDVTVGSALDIFGGNLAYRDVVNWHAQQEALTV

SEQ ID NO: 63927 - protein, 127 aa, Arabidopsis thaliana
  misc_feature (47)..(47): Xaa can be any naturally occurring amino acid
AGWMGMDNGPSSTQAFIGALGPSQTVIWKGPMGAFGREKFSGGSKGXRSQLAKVSEKGVAPIIGGGGSVAAVEKVGVAGVLCHISRGGGASLDLLEGKVLPGGVAPDEATPVPGLELLPSIRPPLDA

SEQ ID NO: 63928 - protein, 238 aa, Clostridium difficile 630
MKHIKIAAGLAHVNYGHISAVVKEAMDAGVDYVHSDAADMHDLKNMQLMGGHQIIEAIRPVTDKPIECHIYTRDCDRLFIEKIAAAGCNLLIIPAEHFLGAPLAYIINYCREFGMKVGLTIGCYTPLCFVDEAIYDIDRLQIVVHGVDETDGKDNWGWRKSAVDLVKRARKMIDEKNPKCELAIDGGLRADNMEPLIECNPDVVILSSAIFKDKDGITAGVKNCRKAIDEAATKFGLE

SEQ ID NO: 63929 - protein, 461 aa, Alteromonadales bacterium TW-7
MSLGKVVQIIGAVVDIEFSQDNVPAVYDALKVTDGDLAGLTLEVQQQLGGGVVRTIALGTTDGLRRGAAVSNTGEAIQVPVGKATLGRIMNVLGEPIDEAGPIGEEDRMSIHRAAPSYEEQSSSVELLETGIKVIDLVCPFAKGGKVGLFGGAGVGKTVNMMELIRNIAIEHSGYSVFAGVGERTREGNDFYHEMNDSNVLDKVSLVYGQMNEPPGNRLRVALTGLTMAEKFRDEGRDVLFFVDNIYRYTLAGTEVSALLGRMPSAVGYQPTLAEEMGVLQERIASTKTGSITSIQAVYVPADDLTDPSPATTFAHLDATVVLSRDIASLGIYPAVDPLDSSSRQLDPLVIGQEHYDTARGVQTVLQRYKELKDIIAILGMDELSDEDKQLVSRARKIQRFLSQPFFVAEVFTGASGKYVSLKDTIAGFKGILNGEFDDLPEQAFYMVGSIEEAQEKAKSM

SEQ ID NO: 63930 - protein, 195 aa, Novosphingobium aromaticivorans DSM 12444
MRIMFIETETTPNPATLKFLPGEQVMASGTREFVSHEEAEASPLAQALFDLGDVTGVLFGRDFVSVTAAPGVAWADLKPQVLSLLLDHFVAQAPLFAPGSAGGIVVPADADEDFADDPADADIIDQIKDLIETRVRPAVANDGGDIIYRGFREGVVYLKMQGACSGCPSSTATLKNGIESLLKHYVPEVSEVRAA

SEQ ID NO: 63931 - protein, 233 aa, Streptococcus pneumoniae R6
MTKTILVTGGTSYIGSHTVKALLNAGYQVHILDNLSTGNRAAVDSRASFKELDVYDASALKAYLEENQIDAVLHYTGEIVVSESIENPSKYFTANVAGMNQVLKVLSEVGIQKIMFSSTASLYGNNCIDKPVTEDTLLDPVNPYAETKLMGERMIYWMANRYDWKYVIFRYFNVAGAEMDASNGLRVKNPTHIIPNINKTALGQNDSLKIFGDDYDTRDGSCIRDYIYVLDLA

SEQ ID NO: 63932 - protein, 758 aa, Ehrlichia chaffeensis str. Arkansas
MVDLENNGFDEKRKEALEFHCKDLKPGKVSLLPTKPLLTQRDLSLAYSPGVAVPCLEIARNPDLVYEYTARGNYVAVISNGTAVLGLGNIGPLASKPVMEGKAVLFKRFADIDAVDIEVNTSDVDEFVNTVKYLGLSWGGINLEDIKAPECFIIEKRLSEIMDIPVFHDDQHGTAIIVAAGLINALDITGKSFKDVKIVINGAGAAGIACLEMIKLIGVPAENITLCDQNGVIYKGRQLGMNEWKEKHAIETENRSLKDALIMADVFLGLSVKDVLSKDMLLSMNRDPVIFALANPDPEINPNVAHEIRPDAIIATGRSDYNNQINNVMGFPYIFRGALDVRAKSVNNEMKIAAANAIAMLAREYVSDEVSDAYGGRKMNYGKDYIIPTPFDPRLITVVSPAVAKAAIDSGVARKNIENWDEYTKQLASRLSLTSNILSMMYSAVKCDPKRVIFSEGEEEKVIEAAVQWRNQEYGLPILVGRIDKVQEAFDRLGIKDTKGIEIANAAISQRNNEYTDYLYKKLQREGYLYRSCVRDVKTDRNVFAACMLACGDGDVLITGMTRGYYASINDVQKVIGSQGVVFGLSIIVMKERTIFVADTAIHESPTPEQIAEIAIQASVQAKKMGYEPRVSFISSSNFGSHSQEDAKKMRQAIKILDSYNVSFEYDGEMSVDTALNPELLTLYPFCKLTGEANVLVMPTLHSASISSKLLQRAAGVSVIGPILIGMEKPVQIVQMSSSVSEILNLTVLASLVNNTNF

SEQ ID NO: 63933 - protein, 167 aa, Zea mays
  misc_feature (83)..(83): Xaa can be any naturally occurring amino acid
  misc_feature (104)..(104): Xaa can be any naturally occurring amino acid
  misc_feature (107)..(107): Xaa can be any naturally occurring amino acid
  misc_feature (117)..(117): Xaa can be any naturally occurring amino acid
  misc_feature (129)..(129): Xaa can be any naturally occurring amino acid
PATARCLSVAKSCWAAERSSSSFVLSAPATGLRQSGSRVLSIRAKVATGLQRACIADDGAERPWKLSDARLVLEDGSVWTAKXFGASGTQVGEVVFNTSLTGYXEIXLTDPSYAGQXALLTIPSYWETXALNPGGGKIQPKGFLGGFILKNSKALVPSQRGGAKKTL

SEQ ID NO: 63934 - protein, 312 aa, Aspergillus oryzae
MSASQSDKSVFGMPGFVVDFMMGGVSAAVSKTAAAPIERIKLLIQNQDEMLRAGRLDRKYNGIMDCFRRTAASEGVASLWRGNTANVIRYFPTQALNFAFRDTYKSMFAYKKDRDGYAKWMMGNLASGGAAGATSLLFVYSLDYARTRLANDAKSAKGGGERQFNGLVDVYKKTLASDGIAGLYRGFGPSVLGIVVYRGLYFGMYDSIKPVVLVGPLEGNFLASFLLGWTVTTGAGIASYPLDTVRRRMMMTSGEAVKYNSSFDAFRQIVAKEGVKSLFKGAGANILRGVAGAGVLSIYDQVQLILFGKKFK

SEQ ID NO: 63935 - protein, 230 aa, Brassica napus
  misc_feature (188)..(188): Xaa can be any naturally occurring amino acid
  misc_feature (214)..(215): Xaa can be any naturally occurring amino acid
MTFPKMMSFREKTPRSPKSPLRRRRSSWTSSWLNNSTTSFKQVVSAVMQSQSPRSISKPQTPTDFEFSSNTDRTLSLPDSLLLKILHKLPESQNDDVSLVCKRWLNLQGRRIGTLRVLDLDFLLSGKLLSRFPKLTNVDLSNACIYPSRNSAILLSQKSISFRVSSNWDFVEENLLHSETVDRGLRVXGRGSCDLLRLVVINATEMGLLGLAEXXCDLQELELHKVHDNL

SEQ ID NO: 63936 - protein, 315 aa, Bdellovibrio bacteriovorus HD100
MMKGLKIFSANANPTLAKKVAEAAGVELGYCEVSSFADGEIQVEIHESVRGQHVFVVQSTCPPVNQNYMELFVMLDALRRASAASITAVIPYYGYARQDRKVAPRAPISAKLMADLLTTAGADRVVSVDLHAAQIQGFFNVPVDHLFAIPTLARAWRDAYGQGSEFVAVSPDAGGVERTRAFAKRIESSMAIIDKRRSGPNEAKALHLIGDVTGKTAVIVDDMIDTAGTLTQAVDSLYKNGAKRVFAVATHPVLSGPAINRLKESPIEKVWVTDTIPLSEAAKNCGKIEVVSVAPVLAEAMKRIHGNDSVSSLFD

SEQ ID NO: 63937 - protein, 362 aa, Novosphingobium aromaticivorans DSM 12444
MKAAVLVEPGKPLDIQHLSVSKPGPHEVLIRTAACGLCHSDLHFIEGAYPHPLPAVPGHEAAGIVEAVGSEVRTVKVGDAVVTCLSAFCGHCEFCVTGRMSLCLGGDTRRGAGEAPRLTRTDDGSAVNQMLNLSAFAEQMLVHEHACVAINPEMPLDRAAVIGCAVTTGAGAVFNAAKLTPGETVCVVGCGGVGLATVNAAKIAGAGRIIAVDPMPEKRELAMKLGATDVMDAGPDAAAQIVEMTKGGVHHAIEAVGRPASGDLAVATLRRGGTATILGMMPLAHKVGLSAMDLLSDKKLQGAIMGRNHFPVDLPRLVDFYMRGLLDLDTIIAERIPLEGINDGFEKMKQGHSARSVIVFDQ

SEQ ID NO: 63938 - protein, 250 aa, Triticum aestivum
MKLNIANPTTGGVKKVEIDDDQKLRNLYDKRISQEVVGDLLGEEFKGYIFKIMGGCDKQGFPMKQGVLTSGRVRLLLHRGTPCFRGFGRRNGERRRKSVRGCIVSQDLSVINLVIVKKGENDLPGLTDTEKPRMRGPKRASKIKKLFNLGKDDDVRSYVNTYRRTFLNKKGKKVSKAPKIQRLVTPLTLQRKRARIADKKKRIAKKKSEAAEYQKLLAQRLKEQRDRRSESMAKRRSKLSAATKAPAASA

SEQ ID NO: 63939 - protein, 366 aa, Bdellovibrio bacteriovorus HD100
MALQVGIVGLPNVGKSTLFNALTSAKAEAANYPFCTIDPNVGVVTVPDPRMDKITEFIKPQKVVPTTMEFVDIAGIVKGASQGEGLGNQFLSHIRQTDAIVHVVRCFDDPNIIHVAGSVEPIRDIEIINTELLLADLDSVEKRLQRTEKQAKNSTDKKLKLDVEVAKKIKEALGKGLPARAVVLDEMEQVALKEMHLLTAKPVLYAMNVNDADFAAGGNDWTKAVEARAAEENNKTILICSAMEAEIALLPPEERKDFLDALGAEEPGLNRLIREAYTLLGLQTYFTAGVTEVRAWTIRANTKAPQAAGVIHSDFERGFIKAETYHCEDLFKYKSEQAIKDAGKYRIEGKEYVVKDGDVLFFKFNV

SEQ ID NO: 63940 - protein, 279 aa, Triticum aestivum
  misc_feature (139)..(139): Xaa can be any naturally occurring amino acid
  misc_feature (210)..(210): Xaa can be any naturally occurring amino acid
  misc_feature (217)..(217): Xaa can be any naturally occurring amino acid
  misc_feature (239)..(239): Xaa can be any naturally occurring amino acid
  misc_feature (258)..(258): Xaa can be any naturally occurring amino acid
  misc_feature (260)..(260): Xaa can be any naturally occurring amino acid
MAKEVSEEPEHAAPAHKDYSDPPPAPLFDMGELRMWSFYRALIAEFVATLLFLYITVATVIGYKVQSAADPCGGVGVLGIAWAFGGMIFVLVYCTAGISGGHINPAVTFGLLLARKVSLLRAVMYIVAQCAGGIVGAGXIVKGIMKDAYQANGGGANMVASGFSRGTALGAEIVGTFVLVYTVFSATDPKRSARDSHVPVLAPLPIGFAXVFMVHLXATIPITGTGINPARSSGAAVIXNKKAARDNHWFFWVRPFVXRXAAAAYTHPPGRRHQVLEQN

SEQ ID NO: 63941 - protein, 304 aa, Klebsiella pneumoniae
MRFCQALMTELYRHLGADTDVPAGDIGVGGREVGFMAGMMKKLSNNTACVFTGKGLSFGGSLIRPEATGYGLVYFTDAMLKRHGLGFEGMRVAVSGSGNVAQYAIEKAMALGARVITASDSNGTVVDEAGFTTEKLARLCQIKSQQDGRIADYAKEFGLTYLEGQQPWGVSVDIALPCATQNELDAPAARILIANGVKAVAEGANMPTTIEATDLFLEAGVLFAPGKAANAGGVATSGLEMAQNAARMGWKAEKVDLRLHHIMLDIHQACVEYGGEDKQTHYVRGANIAGFVKVADAMLAQGVL

SEQ ID NO: 63942 - protein, 576 aa, Oryza sativa Japonica Group
MASSALICDTEQWKGLQIGRAHYDFVFWCGEQAHVGEIQKTHLRHLMHDVERCKAMTACLLIDSEYEGIYLDYSRQRATGETMEKLFKLAEAAKLKEKIEKMFRGDKINSTENRSVLHVALRAPRDEVINSNGVNVVPEVWGVKDKIKQFSETFRSGSWVGATGKALTNVVSVGIGGSFLGPLFVHAALQTDPEAAESAKGRQLRFLANVDPVDVARSIKDLDPETTLVVVVSKTFTTAETMLNARTLKEWIVSSLGPDAVAKHMIAVSTNLELVEKFGIDPKNAFAFWDWVGGRYSVCSAVGVLPLSLQYGFPIVQKFLEGAASIDKHFRSSSFEKNIPAILPYSQALEKFAPHIQQLSMESNGKGVSIDGVQLPFESGEIDFGEPGTNGQHSFYQLIHQGRVIPCDFIGVVKSQQPVYLKGEIVSNHDELMSNFFAQPDALAYGKQFTGYFQTPEQLHSEKVPEHLIPHKTFQGNRPSLSLLLPSLSAYEIGQLLAIYEHRIAVQGFLWGINSFDQWGVELGKSLASQVRKSLHASRVEGKPVLGFNSSTTSLLTRYLAVEPSTPYNTTTLPKV

SEQ ID NO: 63943 - protein, 566 aa, Bacillus pumilus SAFR-032
MNNVKKTKEGYLETTLTGKDVLSIPTLNKGVAFSEEERQELGLEGLLPPTVLTLEQQAERAYKQFLAQPDRLRQNVYLSDLQNRNEVLFYKLISDKLREMLPVVYTPTVGEAIQEYSHEYRRPHGVYLSIDNIDGIEKAFENLHATAGDIDLIVATDSESILGIGDWGVGGINIAIGKLAVYTAAAGIDPSRVIPVVLDVGTNNEKLLNDPLYIGNHHKRVQGEKYEEFIDAYVKAALKFFPKALLHWEDLGNKNARNIMKKYNDNILTFNDDIQGTGAITLAGVLAAVKKTGTQLKDHRVMIFGAGSAGIGIADQMRDTMVLEGLTEEEANNAFWTLDYRGLLTDQFEDEVFDFQKPYLRSSDEVEGWARDEKGQISFAEAVRQVKPTILIGTSGQGGAFTEEIIKEIAAHTERPVIMPMSNPTPLAEAVPEDLFKWTDGRALVATGSPFENVEYNGIEHEIGQSNNAFVFPGLGLGSIVTESKIITKGMFVASADAIAEMVDHDKPGAGLLPSIDKLQEVSIKVAIEVAKAAIKDGVARKTPDDIEQAVKDAMWIPEYKKIVRA

SEQ ID NO: 63944 - protein, 175 aa, Burkholderia vietnamiensis G4
MSFNHVPAGKDLPHDFNVIIEIPAQSDPVKYEADKELGLLVVDRFIGTGMRYPVNYGYIPQTLSGDGDPVDVLVITPFPLLAGSIVRSRVLGMLQMTDESGVDAKLVAVPHDKVCPMTANLKSIDDVPEYLKDQIKHFFEQYKALEKGKWVKVEGWAGIDAAHKEIADGAANYKK

SEQ ID NO: 63945 - protein, 660 aa, Lactobacillus plantarum WCFS1
MILLQVQQVMRRFGADVLFDNVQMDIQEHARVALVGRNGAGKSTLLKMIAGETVPDEGQISMRKGLTIGYLAQDQGLDSNNTIWEEMSSVFAELHAIEKRMHQLENQLSDPAIMNDEQAYQQTLKTYDQIQTEFQQKNGYGYQAEIRGVLHGFQFDADVYDKSVTALSGGQKTQLALAKLLLEKRDLLILDEPTNHLDVETLTWLESYLQSYSGALLIVSHDRYFLDRVVNEVYDLSHHEMVHYTGNYDQFVQEKAARIQAQWKHYEKQQAEISKLEDFVNRNIVRASTTKRAQARRKQLAKMDRLDRPDSDEKTAHFGFHAAKQSGNIVLTVKDAAVGYDGQILSEPDNLNIKKHEAIAIVGPNGIGKSTFLKSILGQIPFIKGQAVFGTNVVTGYYDQEQRNLNDKKTVLSELWDEHPTTPEKDIRTILGSFLFTGEDVDKPVHALSGGERARLLLTKLAMQNDNFLILDEPTNHLDIDSREVLEVALNDFDGTLLFVSHDRYFINQVATSVVEVSPEGTELFLGDYDYYIDKKQEQAEIAAAAASQAAEKAAEAGAADSTSATTAAPRSKGQQNYQASKQQQREKRKLERSVAALEEQMTALDEQATQIQTEMAQPEVSADVGKLQDLQKELEAINTQQEQVETEWTEQAEALEELS

SEQ ID NO: 63946 - protein, 479 aa, Burkholderia vietnamiensis G4
MEQAKHFIAGEWTLPAQLEPIAVVDPSDGRPFATIARGTAPDIERAVAAARDAFAGPWGAASAAERGRVLMRLSARVTDCIEELATIEARDTGKPLKQARADAAALARYFEFYAGAADKLHGETLPYQAGYTVLTVREPHGVTGHIVPWNYPMQIFGRSVGAALAAGNACVVKPAEDACLSVLRVAELAIEAGLPAGALNVVTGYGHEAGAALARHPGIDHISFTGSPATGKLVAQMAAENHVPVTLELGGKSPQIVFADADLDAALPVLVSAIVQNGGQTCSAGSRVLIEHAAYEPLVERLATAFNALRVGPSRADLDCGPLINAKQQQRVWDFLSDAQHDGIPMAAQGQVVADAPESGFYQAPALLRDVPPSHRLAQEEVFGPVLAAMRFVDEEEAVALANGTPYGLVAGIWTRDGARQLRLARRVRAGQVFINNYGAGGGVELPFGGVGHSGHGREKGFEALYGFTALKTIAIRHG

SEQ ID NO: 63947 - protein, 175 aa, Coxiella burnetii RSA 493
MTFLVSAGKGIDDFNVIIEIPANGGEVKYEYDKELGFLTVDRFMPTSMRYPCNYGFVPSTLAQDGDPLDVLVLTPVPVQPGVLMRVRALGIMKMEDEAGEDSKVLAVPVVKACRAYEAIQSLKDISSLLLDAISHFFERYKDLEPNKWAKVKGWEDKEAAKKEFEASIVRFKEKK

SEQ ID NO: 63948 - protein, 313 aa, Populus trichocarpa
MAMLSTSLSGPKSATSYCAPEFSGLRRLCPNNNTNNSHSQSFLRFSSPRKPLRGVFAMAGTGQFFVGGNWKCNGTKESITTLISDLNSAKLESDVDVVVAPPFIYIDQVKSSLTDRIEISAQNSWVSKGGAFTGEISVEQLKDIGCKWVILGHSERRHVIGEDDQFIGKKAAYALSQGVGVIACIGELLEEREAGKTFDVCYQQLKAYADAVPSWDNIVIAYEPVWAIGTGVVATPAQAQEVHVAVRDWLKNNVSAEVASKTRIIYGGSVNGGNCAELAKQEDIDGFLVGGASLKGPEFATIVNSVTSKKVAA

SEQ ID NO: 63949 - protein, 287 aa, Streptomyces peucetius
MTASTPHHGTPRGGLSGRTVLVTGATSGIGRAAALAVARQGARVVLVGRDPERLRTVTNEVARTAGPAPDAFRADFAELRQVRDLGERLRDRYPRIDVMASNAGGMFWSRTTTQDGFEATIQVNHLAGFLLARLLRERLAGGRLILTSSDAYTQGRIDPDDLNGDRHRYSAGQAYGTSKQANIMTAAEAARRWPDVLAVSYHPGEVRTRIGRGTVASSYFRFNPFLRSAAKGADTLVWLASAPAEELTTGGYYSDRRLSPVSGPTADAGLAAKLWEAGAAAVGDTAH

SEQ ID NO: 63950 - protein, 495 aa, Pisum sativum
MALQVLTLPSWVTLFTTFAILLLFSRRLRRRQYNLPPGPKPWPIIGNFNLIGTLPHQSLHGLTQKYGPIMHLWFGSKRVVVGSTVEMAKAFLKTHDATLAGRPKFSAGKYTTYNYSDITWSQYGPYWRQARRMCLLELFSAKRLESYEYIRKQELHVFLHELFDSRNKTILLKDHLSSLSLNVISRMVLGRKYLEKVENSIISPDEFKNMLDELFLLNGILNIGDFIPWIHFLDFQGYVKRMKVLSKKFDGFMEHVLEEHIERRKGVKDYVAKDMVDVLLQLAEDPDLEVKLERHGVKAFTQDLIAGGTESSAVTVEWAISELIRKPEIFKKATEELDRVIGRERWVEEKDIANLPYVYAIAKETMRLHPVAPMLVPREAREDCNINGYDIPKGSLILVNTWTIARDSNVWDNPNEFMPERFLGKDIDVKGHDYELLPFGAGRRMCPGYPLGIKVIQSSLANLLHGFNWRLSDDVKKEDLNMEEIFGLSTPKKIH

SEQ ID NO: 63951 - protein, 368 aa, Zea mays
MPFCLLPFPPVPSTPSPKGGCGKDRCAFSHATRASSSSSGPPLQRRHWFWGFFFQALLYGVAWASWVPYFSSSLGIIYVLAKPAIYAIISGEVLSTDQGKAQGFIATVQSITILLAPQFMSPLTSYFISKEAPFDCKGFSFIVASFFLGFAIGSAALVSLALFGAFISRAGVKVVHVLSPKVFIGLIVGAMLPYWFSAMTMKSVGSVALKMVEEVRRQFNTIPGLMEGTAKPDYATCVKISTDASIKEMIPPGALVMLTPLIVGTLFGVETLSGVLAGALIAIFAPNIGGAWDNAKKYIEAGASEHARTLGPKGSDCHKAAVIGDTIGDPLKDTLGPSLNILIKLMAVESLVFAPFFATHGGLLFKYL

SEQ ID NO: 63952 - protein, 483 aa, Aspergillus oryzae
MSSTTADQQPIETRLFINGEFQPSTDGKTFKLINPYTHEPVTDVHEASEQDVDKAVAAAKAAFPAWRDLTPDDRGVYLRKLSALIRENIPELARLESIAMGKPVSLYIDGKLAADTFAYYAEAGWHAQGTSSVNTPSVLGLSLRQPYGVVGAIIPWNMPLALLSIKVAPALAAGNTVVLKSSEKAPLTSAFAAKLIAEAGFPPGVVNIISGFGSPAGSAIASHMDVRCLSFTGSTATGQKIQIAAAKSNLKVVHLELGGKTPAIIFEDADIEKAAEKTQFSIHFTSGQTCFANSRIYVQESVADKFIAVFKEKFGAAARMGNPLEPTTNHGPQADNIQYERVKSYLEIGEKDGKLTMGGDGGMGFIKPTVFENVPDDSRLMKEEVFGPVVAINTFKTEEEAIERANASEFGLYASVFTKDMDRAVRLSKLLEAGTVGVNCTSPTIVKDMPMGGYKQSGLGREGLLSGLDSYLETKTVLISTSS

SEQ ID NO: 63953 - protein, 123 aa, Picea sitchensis
MPVKSMLRGVREMDPLVWHKVAGISGIAALGLGTYGAHMFKPANPAYKEVWHTASLYHLIHTAAMLAAPATKHPHIFGALLTSGIIAFSGTCYTVALLEDRKYSSMAPFGGFAFIGAWASLLF

SEQ ID NO: 63954 - protein, 536 aa, Glycine max
MASSLRISRLISRSFSSTSFFSRGGNGFLGSRHCKYSTSSAIEEEPVKPSVQVEHTQLLIDGKFVDAASGKTFPTLDPRTGEVIAHVAEGHSEDVDRAVAAARKAFDHGPWPKMTAYERQRILLRAADLLEKHNDELAALETWDNGKPYEQAAKIEVPMLVRLIRYYAGWADKIHGLTVPADGPYHVQTLHEPIGVAGQIIPWNFPLLMFAWKVGPALACGNTIVLKTAEQTPLSALYAAKLFHEAGLPAGVLNVVSGFGPTAGAALASHMEVDKLAFTGSTDTGKVVLELAAKSNLKPVTLELGGKSPFIVCEDADVDQAVELAHFALFFNQGQCCCAGSRTFVHESVYDEFVEKAKARALKRVVGDPFKGGIEQGPQIDSDQFEKILRYIRSGVESGATLETGGDKLGNKGFYIQPTVFSNVKDGMLIARDEIFGPVQSILKFKDLGEVVQRANNTRYGLAAGVFTTNMDTAYTLTRALRVGTVWINCFDTFDAAIPFGGYKMSGQGREKGEYSLKNYLQVKAVVNPLKNPAWL

SEQ ID NO: 63955 - protein, 162 aa, Mycobacterium avium subsp. paratuberculosis K-10
MEFDVTIEILKGQRNKYEVNHETGRLRLDRYLYTAMAYPTDYGFIEDTLGEDGDPLDAMVLLPQSVFPGVIVEARPVGMFRMTDEKGGDDKVLCVPAGDHRWEHIQDIGDVPEFELDVIKHFFVHYKDLEPGKFVKAADWVGRAEAEAEVQRSIERFKAQEH

SEQ ID NO: 63956 - protein, 165 aa, Ricinus communis
MAAADIEYRCFVGGLAWATSDKALEEAFSAYGEVLESKIINDRETGRSRGFGFVTFNNEKSMRDAIEGMNGQNLDGRNITVNEAQSRGGGGGGGGGYRNGGGGGYGGGRREGGYGGGGGYSRGGGGYGGGGGGYGGGRDRGYGGGGDGGSRYSRGGGASEGNWRS

SEQ ID NO: 63957 - protein, 369 aa, Oryza sativa Indica Group
MAKILHLSTTQSSVNKRLVWVGADDDGEREAAQAVRCCLPREPVPDGGVRRAGPYAGDHGPIAACRRVRRTTVHGARRTGTTKRTSSESFIEEQPSWLDDLVNEPETPGAAAGAYANGFEGMGGGGGGGQAAPWGGVQEYYAKPSSFGRHQGRPWEQGMNNLVNYRQSGGPPMPAKEKVGGHHGSPSVLRDHDHGMDRRSSDESGHDQKVGPERKEGVPPKHAQSEADTKRAKQQYAQRSRVRKLQYIAELERKVQALQSEGIDVSAEMEFLSQQNIMLDLENKALKQRLESLAQEQLIKRFQQEMFEREIGRLRSLYQQQQQQQKQPQPTTTLSRSNSRDLDSQFANLSLKHKDPNSGPLRTQSSSIL

SEQ ID NO: 63958 - protein, 173 aa, Ricinus communis
MAANPKVFFDMTVGGAPAGRIVMELFADTTPRTAENFRALCTGEKGVGRSGKPLHYKGSSFHRVIPGFMCQGGDFTAGNGTGGESIYGAKFADENFIKKHTGPGILSMANAGPGTNGSQFFICTAKTEWLDGKHVVFGRVVEGMDIVKAIEKVGSSSGRTSKPVQIADCGQLS

SEQ ID NO: 63959 - protein, 182 aa, Mesorhizobium loti MAFF303099
MTVKKKVPFVTFRTRVRDDSIEGPNPYRWEDKTSDDYFRGKRIILFSLPGAFTPTCSTLQLPDFEMLYDEFEKEGIDAIYCVSVNDAFVMNAWGKALGLQKVQLIPDGSGEFTRKMGMLVAKDNLGFGMRSWRYAAVINNGVVEQWFEEDGFCDNCEADPYGVSSPQNVLETLRAAKAVTAA

SEQ ID NO: 63960 - protein, 149 aa, Pseudomonas syringae pv. tomato
AETRDLLVALAGEVGLKDAIKAQYYGELVNSSEGRPALHTALRRPVGDKLKVNGVDVIPDVHRVLNQMTELVGRIHDGLWRGYTEKPITDVVNIGIGGSFLGPELVSEALVAYAHKGVRCHYLANIDGSEFHELSMKIRAETTLFIVSS

SEQ ID NO: 63961 - protein, 261 aa, Archaeoglobus fulgidus DSM 4304
MSKLRYNLWFGVYDGKEIKLSENFEESFLKAENPSPLPFNVSEVGAKALGKDYYRILRKTALAVSEKMVEKELRREDRYVVALVKALEEIDESINMLNEKLEDIRAVKESEITEKFEKKIRELRELRRDVEREIEEVMEKIAPNMTELVGAKVAAKLLERAGSMERLVRLPASKIQVIGAEKSLYKAFARMKKGKKAKIPKHGIIFLHPFIRTLPKAKRGKMARFLAAKLAIAAKIDYFRGEIDESLYESIRRRYEELRRK

SEQ ID NO: 63962 - protein, 429 aa, Geobacter metallireducens GS-15
MNSLNRTVSVVGLGYVGLPVAVAFGKVRKTVGFDINPVRIRELKEGHDRTGEVETEDLKAADILFTDSIDELKQADFHIVAVPTPVDEANQPDLTLMLKASETVGKALEKGDIVVYESTVYPGVTEDECVPVLERVSGLKSGSDFTVGYSPERINPGDKEHTFTKIKKVVAGQDAATLETVAQVYESVVTAGVHRAASIKVAEAAKVIENTQRDLNIALMNELAIIFGRLGIDTNDVLEAAGTKWNFLKFRPGLVGGHCIGVDPYYLTHKAEKIGYIPQVILAGRRINDGMGKYIAQQAVKGMIHAGHCVRGCTVTVLGLTFKEDCPDLRNSKVIDIIRELEDYGVEVQVHDPLADAGEASHEYGVRLVPFGELRPAAAVVAAVAHRDYRELSVEGVKGLMGDGPVLVDVKGIYDPAAVRAAGIRLWRL

SEQ ID NO: 63963 - protein, 340 aa, Glycine max
  misc_feature (118)..(118): Xaa can be any naturally occurring amino acid
  misc_feature (131)..(131): Xaa can be any naturally occurring amino acid
  misc_feature (144)..(144): Xaa can be any naturally occurring amino acid
MKPKVPADRMSQPSRAILIFYKVNGIDFEDVKVDLSKHHQLSPQFRAINPLMKVPAVVDGRFKLFERHRFCAMAEERQVIGVHTGDAWKGNSRMQKTPKNCTGRGKTFDMRNDRERTXGVEGGSGSGKDKXIDSLGRLPDTNFXRHMGIWNLNFGLCGSGGYVKVNDLLKLNLKTFANIPLKLHTIDDIREAVRKDNKQRFSLLEENGELLIRANQGHTVKAVETESLLKPILSAEEFPVCVHGTYRKNLESILGSGLKRMKRLHVHFSCGLPTDGEVISGMRQDVNVLIFLDVRKALEEGMKLYISDNKVILTEGFDGVVPAKYFEKIESWPSRQPIPF

SEQ ID NO: 63964 - protein, 336 aa, Mycoplasma suis
MTIHKVAINGFGRIGRLLFRNLLSSQGVQVVAVNDVVDIKVLTHLLVYDSAQGKLKDWEVSCDSEYIRLKNVNTGEVREVRVFNFNTEKIYHWGELEIDCVVECSGRFLTKEAVKCHLDAGAQKVLISAPAKDDTKTVVYNVNHTQITSSDNVISGASCTTNALAPIVKIIHRKFGINSGFMTTVHAFTSDQRLQDSPHSDLRRARAAAGSIIPTTTGAAAAIGRVIPELNGKLDGIAHRVPVLTGSLVDLCLKINKSVSAEEINEAIKDGENETLAYVEDPIVSADIIGDTHGSVFDSSLTKVLPTGEVKLYAWYDNESSYVNQLARTLKYYISL

SEQ ID NO: 63965 - protein, 303 aa, Zea mays
MDEAVPALATGQASTDGVTEQPVNVYIWDMDETLILLKSLLDGSYAGAFDGLKDHEKSTEIGKRWENLILELCDEHFFYEEIENYNEPYLNALNEYDDGRDLTSYDFEADCFSSPYDDANKKKLAYRHRAIGEKYAKGLEKVLDGHMVKVCNDQYSLTDKYTDGWLSSAHKLLEEALGKSASAPSANSSSINCIVTSGSLIPSLAKCLLYHLDDVVSSENVYSSWEVGKLQCFKWIKERFDGPNVRFCAIGDGHEECSAAQVMKWPFIKIEFRPEAHHRFPGLDLPTVQTYMDVIYESSSKDG

SEQ ID NO: 63966 - protein, 572 aa, Staphylococcus aureus subsp. aureus MRSA252
MSKLIKGIAASDGVAIAKAYLLVEPDLTFDKNEKVTDVEGEVAKFNNAIEASKVELTKIRNNAEVQLGADKAAIFDAHLLVLDDPELIQPIQDKIKNENANAASALTDVTTQFVTIFESMDNEYMKERAADIRDVSKRVLSHILGVELPNPSMIDESVVIVGNDLTPSDTAQLNKEFVQGFATNIGGRTSHSAIMSRSLEIPAIVGTKSITQEAKQGDMIIVDGLNGDVIVNPTEDELIAYQDKRERYFADKKELQKLRDADTVTVDGVHAELAANIGTPNDLPGVIENGAQGIGLYRTEFLYMGRDQMPTEEEQFEAYKEVLEAMDGKRVVVRTLDIGGDKELSYLNLPEEMNPFLGYRAIRLCLAQQDIFRPQLRALLRASVYGKLNIMFPMVATINEFREAKAILLEEKENLKNEGHDISDDIELGIMVEIPATAALADVFAKEVDFFSIGTNDLIQYTLAADRMSERVSYLYQPYNPSILRLVKQVIEASHKEGKWTGMCGEMAGDETAIPLLLGLGLDEFSMSATSILKARRQINGLSKNEMTELANRAVDCATQEEVIELVNNYVK

SEQ ID NO: 63967 - protein, 350 aa, Triticum aestivum
  misc_feature (235)..(235): Xaa can be any naturally occurring amino acid
  misc_feature (266)..(266): Xaa can be any naturally occurring amino acid
  misc_feature (276)..(276): Xaa can be any naturally occurring amino acid
MVFGHPRGRLGQTIALDYYIPQVDGMVAEFTDINRGMEKTGTFTMERKKLFQLVGKANSNLADVILKLGLFERSDIAWKNANYAQIWEFLRDEYELTQRFGNLDFKLKFVELCKGLAVILLLVHLLVQLFPSAVNYLALIPARTIPFAWNLITAGYVEQTIPGVIISIIGLLLFGKLLEPLWGTKELSKFVFIVNFSTSMCVFVTAIAVYYVTQQESYLYTPLSGFYGVLSRLLXVGLQPPYAQRWELNFFGAEQLRERLITDTVXRMTLFDVIVXSDMFIFVPTQWIPSLIALISVVVSFFMKDLVSYLPVILFGVYMSWIYLGYSQKRLETGPERDPAEESSFSSFFP

SEQ ID NO: 63968 - protein, 491 aa, Helicobacter pylori J99
MELNQPPLPTEIDDDAYHKPSFNDLGLKESVLKSVYEAGFTSPSPIQEKAIPAVLQGRDVIAQAQTGTGKTAAFALPIINNLKNNHTIKALVITPTRELAMQISDEIFKLGKHTRTKTVCVYGGQSVKKQCEFIKKNPQVMIATPGRLLDHLKNERIHKFVPKVVVLDESDEMLDMGFLDDIEEIFDYLPSEAQILLFSATMPEPIKRLADKILENPIKIHIAPSNITNTDITQRFYVINEHERAEAIMRLLDTQAPEKSIVFTRTKKEADELHQFLASKNYKSTALHGDMDQRDRRSSIMAFKKNDADVLVATDVASRGLDISGVSHVFSYHLPLNTESYIHRIGRTGRAGKKGMAITLVTPLEYKELLRMQKEIDSEIELFEIPTINENQIIKTLHDAKVSEGIISLYEQLTEIFEPSQLVLKLLSLQFETSKIGLNQQEIDAIQNPKEKTPKPPNKKTQHEPAHSFKKSHHRDRHPKTNRYSKKHKRR

SEQ ID NO: 63969 - protein, 533 aa, Thermoplasma volcanium GSS1
MNGATKNVSFENSITNSNLIENEERKFRRKLGLLDLFMIGITGVIGSGWLFSPLYAANAAGPASIASWVLGGALVLMVGLVFSQLMRFKSEAGGITRYPYYTNGALAGTITGWTLWLAYSMNPPSESSGLVQYMSSYVPGLYINGALTPVGLAIAISFMGLFVLVNYFGVVIFSKIINAITALKLVVPTITMVTLFLVSFKLRNFSAYGVAPYGPFSVVSAIVTSGIVYSYLGFQAVINLAGESRNPKRDGPLSLILVIIFSVVFYVVLQIAFIGSVPASDISKGWAFLSLPSPFADIAVSFNMFWLYTLIIADSIYSPSGSSMAAVASNSRNLYALSKNGTLPSFFLRVDNNTGIPRRALLFNFVISLIVLVTLKSWHQIIETLGILLLISFIGSAVSSGVIGSIKRYSSIKMPFIVIVSAIVFVFSGLIISISSFSKVLVVSLLLVPSLLLFAVSSGRGNRVIADVKAGLWFIIYVMEIAILSFIYNEHYVSGYIFLGAYLLSSTITFILARRSGVKFMHQAGEYDIAEIP

SEQ ID NO: 63970 - protein, 362 aa, Helicobacter pylori J99
MPIDLNEHLKKKNSQRENPTPNTPNNGGRFIPPSNSFNSKKLSVLIVIVLLGVIAFLAKPFEVISSGEIGIKITAGKYEPTPLQPGIHFFVPIIQDILIVDTRIRNINFSRTEDMGVAGKNQGIFRNDAINVMDSRGLTVSIELTVQYRLNPQTTPQTIATYGLSWEQKIINPVVRDVVRSVVGRYPAEDLPIKRNEIAALINSGINKEVSKLPNTPVELSSIQLREIVLPAKIKEQIEKVQIARQESERVKYEVERSKQEAQKQAALAKGEADANRIKAQGVADAIVIEAKAKSQANLSISQSLSDKLLRLRQIEVQGQFNEALKTNNNAQIMLTPGGAVPNIWIDTKSKVKSSIAESKEP

SEQ ID NO: 63971 - protein, 128 aa, Triticum aestivum
HACANACATARGRRHARRLAHGCRTREGNADEYITRTKASNNVEINLDINRKLCMIKGVVNGEPNRKAEENHKTYYHIYDIILVVDDLVIENLIEMMVHSKKVRKAVAKDIGDLADKLLDRSPNHTLD

SEQ ID NO: 63972 - protein, 505 aa, Oryza sativa Indica Group
MELTTISPVFLISLLGVPLLYLLWSKASKSPSGAPAAPPPPPGPTPFPVIGNIPDLLRGGELHRALTGLAASYGPVMSLRFGMASTVVLSSPDVAHEALHKKDGAISSRWVPDNANVLGHQDVSMAWLPSSSPLWKHMRTLASTLLFTSRRLGASRGIRERKARELVDYLGARSGRPVRVGLAVFGSVLNFMSNVFFSEDVVELGSETGQEFQQLIADSVAETAKPNISDFFPFLSALDLSRRRRAAAKNLKKFYDFFDDVIDRRLSSGEKPGDLLDSLLELHAKSQLERPLIRALMTDLFIAGSHTTTTTVEWALAELLRNPSKMAKARAELGEAFGRGAIEEGELARLPYLNAVIKETLRLHPPAPLLLPHRVSSDSEPAGGVTLGGYSVPSGARVLINAWAIGRDPAAWSPEPDAFSPERFLGREADYWGRTLEFIPFGSGRRACPGIPLAVAVVPMVVAAMVHSLEWRLPEGMAPGDVDVGDRFGAVLELATPLWAVPVKV

SEQ ID NO: 63973 - protein, 378 aa, Coxiella burnetii RSA 493
MKVFKLPDLGEGLPDATIREWYIAVGDEVKIDQPLVAMETAKALVDVPSPLAGKIEKLFGEVGDVIETGSPLIGFEGEAETEEPKDTGTVVGAIETSDTVLEESGAGIPVKKAAEKKNFKATPAVRMLAKQLGVDLTKITPKSSLISAEEVKQAAQITKTGKTQKIEGELTPLSPVRRAMAQSMSQSHREVVPVSLMDDGDLSAWKGEQDITLRIIRAIEAACQAVPIMNAHFDGETLGYKLNETINIGIAVDTPQGLYVPVLKDVSHQDDTALRNQINRFKELAQSRSFPPEDLRDATIMLSNFGAFAGRYANPILLPPMVTIIGVGRTRDEIVPVDGKPAVHRILPLSVTSDHRVITGGEIARFLKQLIDSLEKAS

SEQ ID NO: 63974 - protein, 487 aa, Arabidopsis thaliana
MESAALSRIGLAGLAVMGQNLALNIAEKGFPISVYNRTTSKVDETLDRAAVEGNLPVSGQYSPRDFVLSIQRPRSLIILVKAGAPVDQTIDAFSEYMEPGDCIIDGGNEWYQNTERRISEAEQKGLLYLGMGVSGGEEGARNGPSLMPGGSFQAYDNIKDILEKVAAQVEDGPCVTYIGEGGSGNFVKMVHNGIEYGDMQLISEAYDVLKNVGGLSNEELAEIFTEWNSGELESFLVEITSDIFRVKDEFGDGELVDKILDKTGMKGTGKWTVQQAAELSVAAPTIAASLDCRYLSGLKDERENAAKVLREAGLKEEIGSASSGIDKKRLVDDVRQALYASKICSYAQGMNLLRAKSLEKSWNLNFGELARIWKGGCIIRAVFLDRIKKAYQRNPDLASLVVDPEFAKEMVQRQAAWRRVVGLAVSAGISTPGMCASLAYFDTYRRARLPANLVQAQRDLFGAHTYERTDRPGAYHTEWTKLARKNH

SEQ ID NO: 63975 - protein, 517 aa, Lolium rigidum
MDKAYIAILSCAFLFLVHYVLGKVSHGRRGKKGAVQLPPSPPAIPFIGHLHLVEKPIHATMCRLAARLGPVFSLRLGSRRAVVVSSSECARECFTEHDVTFANRPKFPSQLLASFNGTALVTPSYGPHWRNLRRVATVQLLSAHRVACMSGVIAAEVRAMARRLFHAAEASPGGAARVQLKRGPFELSLSVLMETIAQTKATRSEADADTDMSVEAQEFKEVVDKPIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTERAMSLLLNHPAALKKAQAEIDASVGTSRLVSVDDMPSLAYLQCIVNETLRLYPAAPLLLPHESSADCKVGGYNVPADTMLIVNAYAIHRDPAAWEHPLEFRPERFEDGKAEGLFMIPFGMGRRRCPGETLALRTIGMVLATLVQCFDWEPVDGVKVDMTEGGGFTIPKAVPLEAVCRPRAVMRDVLQNL

SEQ ID NO: 63976 - protein, 302 aa, Triticum aestivum
MSPRAAGDRRGSETLAKVSLSSVSAAAAEVSTFPLDALKTRLQLHRSTGGGGGGGGGVLRVAGELVRDGGLYRGLSPAVLRHLFYTPLRIVGYEHLRSSLASGGREVGLLEKAVAGGASGVAAQVVASPADLIKVRMQADSRLLTQGIRPRYTGILDAFTKITRAEGLLGLWKGVGPNAQRAFLVNMGELTCYDQAKHFIIRKQICDDNLYAHTLASVASGLSATTLSCPADVIKTRMMNQGLEAKALYRNSYDCLVKTVKHEGLTALWKGFLPTWARLGPWQFVFWVSYEKLRQASGISSF

SEQ ID NO: 63977 - protein, 314 aa, Sphagnum cuspidatum
VGINGFGRIGRLVARVISDRDDIELVAVNDPFISAEYMAYMFKFDSVHGQWKNHDIKAQNENSLLLGGKPVAVYGLKDPSEIPWGKHGADYIVESTGVFTDKAKAAAHLKGGAKKVVISAPSKDAPMFVMGVNEDKYTADLDIVSNASCTTNCLAPLAKVINDKFGIVEGLMTTVHSTTATQKTVDGPSHKDWRGGRAAGVNIIPSSTGAAKAVGKVLPELNGKLTGMAFRVPTIDVSVVDLTVRLEKPASYDAIKAAIRAEANGKMKGILGYTEEDVVSTDFITDSRSSIFDAKAGIALTDNFVKLVAWYDNE

SEQ ID NO: 63978 - protein, 168 aa, Glycine max
MGLVKGKWKQNMISKAWEGCRLTSRRPHLKLKSLSENDDDHEKKGSQIAPHGCFSVHVGPERQRFVVKTKYVNHPLFQMLLEETEQEYGFESDGPIWLPCNVDLFYKVLAEMDGEENNNNIIIHGFRRSFITMAKVFPFLVLRSPPRLLSHMNKDHGAYSVMDSELLR

SEQ ID NO: 63979 - protein, 211 aa, Sinorhizobium meliloti 1021; identical to SEQ ID NO: 1183

SEQ ID NO: 63980 - protein, 168 aa, Triticum aestivum
MATREAGKKMIMLKSPDGMEFEVEEAVAMESQTIRKMIEDDCADTAILIPNINSKILSRVIEYCNKHVPTTGATGAAASDTVAPAALAEDLKIWDAEFIKVNRATRFDLIQAASYLNIKGLLDLTSQTTIDTISDNSLEEIRSFLSTKNDYLPEEEQTIRRENQWAFQ

SEQ ID NO: 63981 - protein, 517 aa, Lolium rigidum
MDKAYIAILSCAFLFLVHYVLGKVSHGRRGKKGAVQLPPSPPAIPFIGHLHLVEKPIHATMCRLAARLGPVFSLRLGSRRAVVVSSSECARECFTEHDVTFANRPSSRRKLLASFNGTALVTSSYGPHWRNLRRVATVQLLSAHRVACMSGVIAAEVRAMARRLFHAAEASPDGATRVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVLSLAYLQCIVSETLRLYPAAPLLLPHESSADCKVGGYNVPADTMLIVNAYAIHRDPAAWEHPLEFRPERFEDGKAEGLFMIPFGMGRRRCPGETLALRTIGMVLATLVQCFDWEPVDGVKVDMTEGGGFTIPKAVPLEAVCRPRTVMRDVLQNL

SEQ ID NO: 63982 - protein, 407 aa, Medicago truncatula
MYDTVAGKQEGTSKAKTLIIIFVSITVAVALLSCWVYSYWRKNRLSKGGMLSRTITPISFRNQVQRQDSFNGELPTIPLTIIEQSTDDFSESYKLGEGGFGPVYKGTLPDGREVAVKRLSETSSQGSEEFKNEVIFIAKLQHRNLAKLLGYCIEGDEKILVYEYMPNSSLDFHLFNEEKHKHLDWKLRLSIINGIARGLLYLHEDSRLRVIHRDLKASNVLLDDEMNPKISDFGLARTFDKDQCQTKTKRVFGTYGYMAPEYAMAGLFSVKSDVFSFGVLVLEIIYGKRNGDFFLSEHMQSLLLYTWKLWCEGKCLELIDPFHQKTYIESEVLKCIHIGLLCVQEDAADRPTMSTVVRMLGSDTVDLPKPTQPAFSVGRKSKNEDQISKNSKDNSVDEETITIVSPR

SEQ ID NO: 63983 - protein, 305 aa, Sphagnum cuspidatum
GFGRIGRLVLRICLQHDDIEVVAVNDPFIDSKYMAYMFKYDSTHGIAKVDVHAVDDKTLQIGSKTVKVFGSRDPSEIPWGSAGADFIVESTGVFTTTAKAEAHFKGGAKKVIISAPSADAPMFVMGVNHESYKSGMNIVSNASCTTNCLAPLAKVVHDNFGIIEGLMTTVHATTATQKTVDGPSGKDWRGGRGASQNIIPSSTGAAKAVGKVLPELNGKLTGMSFRVPTPNVSVVDLTCRIEKGASYDEIKAAMKAASEGPMFGYLGYTEDDVVSTDFVGDSRSSIFDAKAGIALNLNFIKLVSW

SEQ ID NO: 63984 - protein, 517 aa, Lolium rigidum
MDKAYIAILSCAFLFLVHYVLGKVSDGRRGKKGAVQLPPSPPAIPFIGHLHLVEKPIHATMCRLAARLGPVFSLRLGSRRAVVVPSSECARECFTEHDVTFANRPKFPSQLLASFNGTALVTSSYGPHWRNLRRVATVQLLSAHRVACMSGVIAAEVRAMARRLFHAAEASPDGAARVQLKRRLFELSLSVLMETIAQTKATRSEADADTDMSVEAQEFKEVVDKLIPHLGAANMWDYLPVMRWFDVFGVRNKILHAVSRRDAFLRRLIDAERRRLADGGSDGDKKSMIAVLLTLQKTEPKVYTDTMITALCANLFGAGTETTSTTTEWAMSLLLNHPAALKKAQAEIDASVGTSRLVSVDDVPSLAYLQCIVNETLRLYPAAPLLLPHESSADCKVGGYNVPADTMLIVNAYAIHRDPAAWEHPLEFRPERFEDGKAEGLFMIPFGVGRRRCPGETLALRTISMVLATLVQCFDWEPVDGVKVDMTEGGGFTIPKAVPLEAVCRPRAVMRDVLQNL

SEQ ID NO: 63985 - protein, 348 aa, Marchantia polymorpha
MAGSTEPSTISSGKVKIGINGFGRIGRLVARVALERDDIELVAVNDPFISTEYMAYMFKYDSVHGRYTKNTIEAKDDKTLLFGKFPVSIFQCRDPAEIPWGQTGAEYVVESTGVFTTKDKAAAHLKGGAKKVVISAPSADAPMFVMGVNEKEYTTDIDIVSNASCTTNCLAPLAKVIHDKFGIVEGLMTTVHSITATQKTVDGPSAKDWRGGRGASFNIIPSSTGAAKAVGKVLPALNGKLTGMSFRVPTADVSVVDLTVRTEKKATYEEVKAAIKAESEGEMKGIMGYTEDDVVSTDFIGDSRSSIFDAKAGIALNDNFMKLVSWYDNEWGYSNRVVDLILHMASTQ

SEQ ID NO: 63986 - protein, 628 aa, Medicago truncatula
MSQMNMTCTARFLSFILLHIFLFTLTNAQSPYYRLNFCQNSTEKTNNTSYRSNVRNLLLWINTDSATGSVSNHIAINSNKTNSNDNDGDVVYGFYDCRGDVTGSFCQFCINAAVRAIAQCCPNGVSAMIWYDICVIGYSDHNTSGKISVTPSWNLTGTKNTKDSTELEKAVDDMRNLIGRVTAEANSNWAVGEFDWSDTEKRYGWVQCNSDLTKDGCRYCLETMLDKVPQCCGTKVKWAVVSPSCGMEIDDNKFYNFQTESPPSLPNPGGLLLRTITPKSFRDHVPREDSFNGDLPTIPLTVIQQSTDNFSESFKLGEGGFGPVYKGTLPDGTEIAAKRLSETSGQGLEEFKNEVIFIAKLQHRNLVKLLGCCFEENEKILVYEYMPNSSLNFHLFNEEKHKHLDWKLRLSIIKGIARGLLYLHEDSPLRVIHRDLKASNVLLDDEMNPKISDFGLARAFEKDQCHTKTKRVIGTYGYMAPEYAMAGLFSVKSDVFSFGVLVLEIIYGKRNGDFFLSEHMQSLLLYTWKLWCEGKSLELIDPFHKKTYVESEVMKCIHIGLLCVQEDAADRPTMSIVVRMLGSDTVDLPKPTQPAYSIGRKSKNEDQSSKNSKDNSVDEETLTIVSPR

SEQ ID NO: 63987 - protein, 432 aa, Marchantia polymorpha
MAASSMISSTLASSISTTLQSGAKAEGRNANSQSMVAFSNQGRSVNMQTKGSFFSSTELLSSGTPSRKQQLSGPIRATATQTPTISKKSGSKEKAKIGINGFGRIGRLVLRIALSRDDVEVVAVNDPFLTADYVRYLFKYDSTHGVYPGEVEVIDENTLSVDGHKIKFFGSKTPADIPWGDSGVDYVVESTGVFTNIAKASAHLQGGAKKVIISAPSEDAPMYVMGVNEEKYSADQNIVSNASCTTNCLAPLAKIVHQEFGIVQGLMTTVHATTATQKTVDGPSGKDWRGGRGAGQNIIPSSTGAAKAVGKVLPELNGKLTGMAFRVPTPNVSVVDLTCRLEKKASYDDIKKVIKAASESSMKGILGYTEDAVVSSDFIGDARSSIFDAHAGIGLGDGFMKFVSWYDNEWGYSNRVVDLIEHIAAVVSAKKN

SEQ ID NO: 63988 - protein, 228 aa, Ehrlichia chaffeensis str. Arkansas
MLTKKNSFNRGKVVEVSSSILSADFANLGKSVEMLTDAGVDYIHVDVMDGNFVPNITIGPVVVSAIKKYTTIPFDVHLMINSPGNYIEAFVDAGADMITIHAESDIHLDRIIQKIKSYKKSAGLSLVPTSHYNILEYIIFELDLVLIMTVNPGFGGQQFITSQLDKISCVRNLIEKYSLKTKIAVDGGVNIKNAKSVIEAGADILVVGSAIFNANNMLDYVQQLKSSF

SEQ ID NO: 63989 - protein, 430 aa, Physcomitrella patens
  misc_feature (217)..(217): Xaa can be any naturally occurring amino acid
LEGRPTPRSSAALGSSSLRASSTSRGHVSVSTSGVCAQKKNVSFSAEDSFAGSVKSLRVAASPVSRSISRSFTVRATATEFPVRTTKSGSQEKIRIGINGCGRIGRLVLRVILARDDVEVVAVNDPFIDTKYMAYLLKYDSTHGLLKSEVNAVDDNTLQVGSQTIKVFGCRDPAEIPWGSVGADFVVESTGVFTAVDKASAHFKGGAKKVVISAPSXDAPMFVMGVNQQSYKDSMNVVSNASCTTNCLAPLAKVIQDNFGIEEGLMTTVHATTATQKTVDGPSGKDWRGGRGAGQNIIPSSTGAAKAVGKVLPELNGKLTGMAFRVPTPNVSVVDLTVRLKKSGSYEDIKAAIKAASEGPMYGILGYTEDDVVSNDFVGDARSSIFDAKAGIALSDKFVKLVSWYDNEWGYSNRVVDLDLHMAGVKANLY

SEQ ID NO: 63990 - protein, 248 aa, Bdellovibrio bacteriovorus HD100
MYKLVLIRHGESVWNQENRFTGWQDVDLSEKGRAEALKGGKALREKGFSFDVAYTSVLKRAIKTLNFVLDEVDQVWLPVHKDWRLNERHYGALQGLNKAETAARHGEEQVKIWRRSYDTPPPPMEVSDPRHPSHDPRYKNVDAQLLPSNESLKDTVARFLPLWDGTIAPAVKSGKNVLIVAHGNSLRALMQHLEGMTPDEIMGVNMPTGIPMMYELDANLKVLKKEFIGDPDEVKAAIEAVANQGKAK

SEQ ID NO: 63991 - protein, 133 aa, Mycobacterium avium subsp. paratuberculosis K-10
MADRIELRGLRVRGQHGVFDHERVDGQDFVIDVTVWIDLVGAAASDELADTYDYAALAQLAADVVAGPARNLIETVGAQIADQVMDDERVHAVEVVVHKPQAPIPQQFADVAVVVRRSRRGGRGSVVPAGGAL

SEQ ID NO: 63992 - protein, 419 aa, Bdellovibrio bacteriovorus HD100
MKQEIKVPAVGESITEATIGSWTKKSGDFVKRNEVLMLLETDKASVEVVAENDGVLTINPGCEAGAVVQIGATVATLDTDAKPAAGAAAPAAETAKAAAPASAPAGAAALPAAAGKDASAHLSPAVNRIVNEKGLDPSAIQGTGKDGRLTKGDVLEAQPGAKPAAPKAAPASAPTGAPALPAAASKQGDKKLVPMTTIRKRISEKLKEAQNTAALLTTFNEVDMGKVMELRSKYKDKFKEKYGVNLGFNGFFVKAVVEALKDFPAVNAWINGTDIEYHNYYNIGIAVSTEKGLMVPNVKDADTLSLAGIELAIRDLAAKGRDGKITPNDLGGGTFSITNGGVFGSLLSTPILNFPQSAILGLHKIQDRPMAINGKVEIRPMMYLALTYDHRIIDGKEAVSFLVKIKELVEDPERLLLEV

SEQ ID NO: 63993 - protein, 272 aa, Picea sitchensis
MAMADGAFTLGFIGAGKMAEAIARGLDKSGVLPSSRMRTAHTRLPRRETFASFGVTIMESNSKVVEECEVIVLGVKPQVVKEVLVDLKPILSEDKLLVSIAAGVKLKDLEEWAGKARVVRVMPNTPCLVGESAAVMSLGEKATAEDEKLVKVLFEAVGKIWTAKEKLLDAVTGLSGSGPAYIYLAIEALADGGVAAGLPRELALSLASQTVLGAAKMVIDTKKNPGQLKDEVASPAGTTITGIHELEKGGFRATLMSAVIAATKRSEELSKT

SEQ ID NO: 63994 - protein, 265 aa, Rhodococcus sp. RHA1
MGFGRKRKVVPFRTAGELDAMAAAGAIVGAALVAVRDAAKPGVSTLELDEVAESVIRGAGAVPSFKGYHGFSGSICSSVNDRVVHGIPSAEDILAEGDLVSIDCGAILDGWHGDSAWTFGVGDIIEADQQLSEATRLSMEAGIAAMLPGNRLTDISHAIELGTRAAEVAHDRKYGIVDGYGGHGIGREMHMEPFLANEGAPGKGPQLVVGSVLAIEPMLTLGTTDTVVLEDDWTVVTSDGTRAAHWEHTVAVTEDGPRILTLRPE

SEQ ID NO: 63995 - protein, 469 aa, Bdellovibrio bacteriovorus HD100
MADTQFDLIIIGSGPGGYVGAIRAAQLGLKTAVIEKDKTYGGTCLNVGCIPSKALLESSEHYQAAQHDLAAHGVKVSKVDLDLPTMQARKDKVVKTNTEGIAFLFKKNKITPFNGMGKIVAAGKVEVKGADGNTQILTAKNIVIATGSVPVELPFLKYDEKRIVSNTGALALDQVPKSMIVVGGGVIGLELGSVWQRLGAKVTVIEYANRLGGTMDQDCMNVLKKSMEKEGMSFLLSTKVTGSKVGNDGVEVTYESLTDGKASSMKADVVLVSTGRKAFSAGVGCEEMGIQKDPQGRIIVDKHYQTNVPGIYAIGDVIAGPMLAHKAEEEGVALAEILAGGAGHVNYDTVPGVIYTHPEIASVGITEEFAKEKGLEINVGKFPFMANGRARAKGYTEGFVKIIADKKTDKILGAHMVGPSVSELIHEVIVCMEFGGSSEDLARSFHAHPTLSEVVREAALAVEKRQRQM

SEQ ID NO: 63996 - protein, 811 aa, Archaeoglobus fulgidus DSM 4304
MGDNMEITLKVNQAYPSDSGRGIARLDPDTMLKLQISPGDIIEIEGARKTVAKVWRAPKRDWGKNIIRIDRFIRENAGVGVGDVVKVRKVEYQPAKTVILAPLKKMDLRIYGVDIGEYLKHQFLKRPVVEGDLVPLVGSPALSGFGRYNQQNQAVVFVAVKTEPKGPVVIDETTKVVYRDRPAKGFERFGKAGITYEDIGGLKEELQKVREVIELPLRYPELFQRLGIEPPKGVLLYGPPGTGKTLIAKAVANEIGASFFTINGPEIMSKFYGESEQRLREIFEEAKENAPSIIFIDEIDSIAPKREEVTGEVERRVVAQLLTLMDGLEERGQVIVIGATNRIDAVDPALRRPGRFDREIEIGVPDREGRYEIFQIHTRNMPLEAKYSREFVLDAIERFKRQVDDPELIKNLDFLYDEIKNSETEEEVKGAVKNLLPQEVIDELEVEITKAMLRSLADQTHGFVGADIEALCKEAAMKALRRYLPQIDLNEDEIPIELLESIRVTWDDFMDALREIEPSAMREVFVEIPKVTWNDVGGLEDVKREIIEAVEWPLKYPEKFKKFGIKPPKGVLLYGPPGTGKTLIAKAVANESEANFISIKGGQILSKWLGESEKAVRKIFRKARQVAPCIIFFDEIDAIAQMRGIDEGSRAVERVLNQLLTEMDGLEELHGVVVIGATNRPDILDPALLRPGRFDRMVYVRPPDKKSRLAIFKIHTRDMPLSEDVDLEELADLTEGYVGADIEAICREAVMLAIRENINAEKVEMRHFLEALKKIKPSVNEAMLNFYERFEEKMRTERMQVAATKPFMGYG

SEQ ID NO: 63997 - protein, 395 aa, Geobacter metallireducens GS-15
MDIQKIRGDFPIFERRINGKPIVYFDSAATTQKPRQVIDTLSNYYANHCANIHRGVHTLSQESSELYEEARRTVARFINADEREIVFVRNTTEAINLVSTCLKGEGQILSTVTEHHSNLLPWGRSRKVDYVDIDAQGRIDVADLKEKLLKPTLLVAVTHVSNVLGLVNPVEEVIAEARKNGALTLVDAAQSAPHMEIDVKAMGCDFLVFSGHKMLAPSGIGVLYVREELYERMEPYLMGGSTIKEAHLGSYVPEEPPTCYEAGTPNIEGAIALASAIDYLNDIGMDNVLAHDKALMALALERMKAIDNVELYGSLDPTDRLSVITFNVKGMGCHGVAKVLNLRENIMIRSGFHCAQPLHDRLGIGPTARMSFYIYNTPEEIELAAELLGKIAEFM

SEQ ID NO: 63998 - protein, 266 aa, Oryza sativa
MEWRDSFLDLILIPLSLLVPMAYHVWLWRAVRLTPLRTAAGINSATRRLWAISMTKDNEKNAVLVVQSLRNVIMGSTLVATTAILFCTGIAAVLSSTYTIKKPLSDAVFGAHGEYMMALKYVALLLLFLVAFLSHSLAICFLNEASFLINTSPTLLAGGDGAGDDGGRRLLGLPSTRDYMEEALEKGFTLNFVGNRIFFAGVPLLLWIFGPLLAFLSSLVMIPILYNLDVVNVKSHRGGDCGCGCGNGKSSVDKNGAAAAMDCTLV

SEQ ID NO: 63999 - protein, 174 aa, Thermoplasma volcanium GSS1
MSLVNKAAPDFEANAFVNGEVKKIRLSSYRGKWVVLFFYPADFTFVCPTEVEGFAEDYEKFKKKNTEVISVSEDTVYVHKAWVQYDERVAKAKYPMVEDRKGIIARAYDVYNEETGNAQRGLFIINPDGIVKYVVITDDNVGRSTDETLRVLEALQSGGLCPVNWHEGEPTLKV

SEQ ID NO: 64000 - protein, 133 aa, Prevotella bryantii
MEDNVTIIGIAGGTGSGKTTVVKKIVEALPPHYVAVVPLDSYYNDTTHMTEEERHAINFDHPDAFDWKLLTKQINELRLGHAIEQPTYSYLQCNRLPETIHVEPKPVIIIEGIMTLLNKKLREIMDLKIFVDC

SEQ ID NO: 64001 - protein, 579 aa, Candida albicans SC5314
MFKKEDQAVSKEVRPEELGSFTGSEEKYSSNEFLNTESKTGFQNFIDSFRRKQATEDESAGQQLAKGISKRHLILMSLVTGIGTGLLVGTGQVLRKSGPLFLVVGYAIAGSFVYPTLQAAGEMAVNYSELSGGYNSYTRMFVEDSINFAISWNYCIQWLSVISIELVTAAITIEYWISETRVNPDAWVAIFYVVIVVIHFIGSKAYGEFEFIIGSIKVCLLVGFIIMGIVVDTGGGPTGEFIGGRYWRDPGPTKNGFKGFCSVFVTAAFSYGQSEFVALSAAEQPNPRKAIPTACRLIFWRIIVLFLGSLTIVGLLVPSNSDHLMSEGGGSNTSPFVLSAALHGVKAVPSIINAVILMSVTSVASSSLYSASRTLQSLAEQGFAPTWFNYIDRAGRPTRALLVSAIIGLFAFIAAYKKQVTVFNWLLAISGLSQVFTWSGICLSHVRFRQALKYNNISTDALGYKASTGVWGSYYALVWYALVLISQFWIALFPIGASKPDANNFFQSYLGAIVLVVFYIGHKLYTRKWRLLIPISEIDINNERTIFDEEILNLERQEEQDKWDRAPWHKKIMIFAFSH

SEQ ID NO: 64002 - protein, 465 aa, Pseudomonas putida GB-1
MTMTSASGAGNQLAQGFKQRHVTMLSIAGVIGAGLFIGSGHAIAAAGPSAIVAYALAGALVVLVMRMLGEMAVASPDTGSFSTYADRAIGRWAGFTIGWLYWWFWVLVIPIEAIAAGVVLNNWFPHIDAWFFALSMTVLLTATNLFSVAKYGEFEFWFAMLKVIAIVAFIALGAAALAGVLPGREVSGLPRLLEQQGGFMPNGWTAIIGALLTTMFSYLGTEAVTIAASESKDPARNIAKATRSVIWRISVFYLLSIFVIISVVPWNDPLLPVQGSYQRALEIMSIPYAKQLVDIVVLVAVASCLNSSIYISSRMLYSLSKRGDAPGFIQRTSKVGVPRAAVIGSTLIGMLATIVNYFAPAEVFAFLLASSGSIALLVYLAIACSQLRMRAILQRQNVEIAFRMWLYPWLTYAVIGFIIFALGTMFVMPKHRMEVSLTLALALVILVLGVVTSKRHARREALATA

SEQ ID NO: 64003 - protein, 493 aa, Campylobacter upsaliensis RM3195
MRINLAQNYCEVKMLKKTKIVATVGPASESEEVLRQMIINGVNVFRLNFSHGTHEYHKENLEKIRKVASELNTRIGILQDISGPKIRTGELKEPFDLKKGDRLDFYRSKILGERVDGAHYKLSINQSDILNMLKIGEYVYLYDGSIRAKIVSVNENFIQSVVENDGFLNSNKGINFPNTRINIDVITQKDKRDLLWGIENGVDFLAISFVQNAHDIDEVREILAQNGAKIAIFAKIEKFDAVENIDEIIASSDGIMVARGDLGIEVPYYKVPNIQKSIIQKANNASKPVITATQMLFSLAKAKTATRAEISDVANAVLDGTDAVMLSEESAVGIDPANAVDVMCKTIVEVEKNYPYNKFNRFDYLDDTDKIMQSSTHLAADLNADAIFALTSSGKSAIKIARYRPDIEIIAIAHSEKTLNFLSIVWGVNPAILVNKSDELTKLLKDAVRSSVERGFMSEDKCYILSAGFPTGVEGTSNLIRILKKEQIAYYLR

SEQ ID NO: 64004 - protein, 430 aa, Staphylococcus aureus subsp. aureus MRSA252
MAFEFRLPDIGEGIHEGEIVKWFVKAGDTIEEDDVLAEVQNDKSVVEIPSPVSGTVEEVMVEEGTVAVVGDVIVKIDAPDAEDMQFKGHDDDSSSKEEPAKEEAPAEQAPVATQTEEVDENRTVKAMPSVRKYAREKGVNIKAVSGSGKNGRITKEDVDAYLNGGAPTASNESAASATNEEVAETPAAPAAVSLEGDFPETTEKIPAMRRAIAKAMVNSKHTAPHVTLMDEIDVQALWDHRKKFKEIAAEQGTKLTFLPYVVKALVSALKKYPALNTSFNEEAGEIVHKHYWNIGIAADTDRGLLVPVVKHADRKSIFQISDEINELAVKARDGKLTADEMKGATCTISNIGSAGGQWFTPVINHPEVAILGIGRIAQKPIVKDGEIVAAPVLALSLSFDHRQIDGATGQNAMNHIKRLLNNPELLLMEG

SEQ ID NO: 64005 - protein, 535 aa, Saccharophagus degradans 2-40
MTLKVHELLNNARLNKGTAFTLEEREELGLSGLLPPHVSTMKEQVERALSSIRRKESDIDRYIFLSALQKRNERLYYRLLIDHTKELMPLVYTPTVGQACLEFASIFRETSGFYLSYADKGLIQKRLANWPEQDVRLIVVTDGERILGLGDLGANGMGIPIGKLALYCACAGVKPEQCLPIMLDLGTNNESIRNDPLYLGVPEPRKRGSEYDDFLEEFVRAVEKQFPNALLQFEDFATGNAVNLLEKYRDQLLCFNDDIQGTASVVLAGLMATTRISKIPLQEQRFLFLGAGSAATGIGHLLTTALEREGITTDEARARLFFIDRKGLVTQCRDDLPGHVAPFAANMPPMDLKQAIDTIKPNALIGASGTAGVFTEEIIHTVASCHRNPTIFALSNPTSKAECTAEDAYKFSDGRAIFASGSPFDVVHINGEIKVPGQGNNAYIFPGLGLGAIHGKITRITDDQLITAAQELAGSVSDKQIQHGCLYPPLDEIRNVSVKIAAAVARDAERTGLTSEPVPENFEELLTAELYDPLY

SEQ ID NO: 64006 - protein, 155 aa, Triticum aestivum
  misc_feature (76)..(76): Xaa can be any naturally occurring amino acid
  misc_feature (117)..(117): Xaa can be any naturally occurring amino acid
HYRTSLYKKAGWYRSGIPGISSTHASGLVGKWNHSEGTPQVAYTFDAGPNAVLIARNRKTAALLLQRLLYCFPPQXNNLDSYMVGDKSILSDAGVQSLADIEALPPPREMKTPTQKXLRGDVSYFICSRPGAGPKVLTEESHTLIDSATGLAKGV

SEQ ID NO: 64007 - protein, 592 aa, Solanum tuberosum
KPPHTDVGCLPTVNAVTIHNPAVPFNSPESTLGRHLARRLVQVGVTDVFGVPGDFNLTLLDHLIDEPGLNFVGCCNELNAGYAADGYARARGVGACVVTFTVGGLSVLNAIAGAYSENLPLICIVGGPNSNDYGTNRILHHTIGLPDFTQELRCFQTVTCYQAVVNNLEDAHELIDTAISTSLKESKPVYISISCNLPGIPHPTFSREPVPFFISPRLSNKMGLEAAVEAAAEFLNKAVKPVIVGGPKMRVAKACDAFVELADASGYAVAVMPSAKGMVPEHHPHFIGTYWGAVSTAFCAEIVESADAYLFAGPIFNDYSSVGYSLLLKREKAIIIQPDRVTVGNGPTFGCILMKDFLAALGKRLKHNPTAYENYRRIYVPEGHPLKCEPKESLRVNVLFEHIQRMLSGDTAVIAETGDSWFNCQKLKLPKDCGYEFQMQYGSIGWSVGATLGYAQAAKEKRVIAFIGDGSFQVTAQDISTMLQCGQRTIIFLINNGGYTIEVEIHDGPYNVIKNWNYTGLVDAIHNGQGKCWTTKVRCEEELVEAIETATETKKDSLCFIEVIVHKDDTSKELLEWGSRVSAANSRPPNPQ

SEQ ID NO: 64008 - protein, 496 aa, Pseudomonas putida GB-1
MAELLSKEQYAAIAAELQLRTKAFIDGEFRDAISGKTFVTTNPATGKQLAEVAACDVNDVNVAVAAAKRVFEAGTWSKMQPSDRKHVLQKFAQLLEDNAHELAVLEALDSGKPVSECQTVDVPETIHTLRWHAELIDKIYDATAPTGNAAVTMVVREAIGVVGLVLPWNFPLLMLAWKIAPSLAAGCSIVVKPAKETTLSALRVAELAHEAGIPAGVFNLVPGGGREVGEAIGRHMDIPMVSFTGSTDTGRLFLKYAAESNLKRIVLELGGKNPAVVMNDVEDLDEVAQFVTAGAFWNMGENCSASSRLIVHKDVKDELLSLIAKHLKGWKLGDPLDPDNRLGAMVSKSHFEKVKSYLEYAAEQKLSIVQGGETEDGVFVQPTIVDNVGRDNKLFVEEIFGPVLSVTSFETIDEAIELANDTVYGLAASAYTGSLRNALRLSREIRAGVVTVNCFGEGDVTTPFGGYKESGFGGRDKSIWAHDQYTELKTIWINAS

SEQ ID NO: 64009 - protein, 406 aa, Coxiella burnetii RSA 493
MQKPFDNIETAIVALRQGKMIILVDDESRENEGDLIIAAEHATPEHINFMTLYGRGLICLPMCSSDFERLNIPMMTSRNGSRYETPFGVSIEAAYDVTTGISAHDRARTIQIAIDEKSTPEDIIMPGHMFPLKANDAGVLARAGHTEGSVDLCRLAGLKPAAVLCEILNKDGSMARLPDLQLLAKQFRLPLVSIQDLITYRINHETLIDEVSESLLPIKNRGRFTIKTFRSRVDHLEHVALVNQKIEEDKPCLVRVHSECLTGDVFGSARCDCGGQLEAALDEIATQGGVLLYLRQEGRGIGLANKIKAYALQEAGLDTVEANHHLGFGADLRDYGLAAQMLRVLGIREIRLLTNNPNKVESLTRYGISVAERVALETAPTCDNIRYLKAKREKLGHLLNLIGEAK

SEQ ID NO: 64010 - protein, 379 aa, Bradyrhizobium japonicum
MNTLSNTITVAVVGGEGIGPEVTDQSHRILKWFSDRRGAPVILREAQYGLIPYLATGKVLPDDTVEAMEEADAILWGATGGPETTEVPPAARKAGSLLSLRSKYDLYANLRPIVANPALADSAPLKAAVLKDVDFIIIRELTSGIYFGEPRGIETLPDGQRRGFNTQQYTTSQIRRVARTAFELARTRKGRVCSVDKANVLETSVLWREEVTALHEAEFSDVELTHLYVDNAAMQIVRAPSQFDVMVTCNIFGDILSDCAAMASGSLGMLPSVSLGPPDRLGRRKALYEPVHGSAPDIAGKGIANPLGSILSVAMMLRITLHRPEDAALLEKAVDTALAAGARTADIAEPGAKRLSTQEMGDAVLNALDKVVGKEREHA

SEQ ID NO: 64011 - protein, 151 aa, Coxiella burnetii RSA 493
MTESSFKLAIVVSQFNRAVTEKLLNGVLQRLTELGVQANQIKTVWVPGAVEIPLLAKRLAKSKHYQAVVCLGAVIRGETDHYNYVCQQVSFGCQQVALEYEVPIIFGVLTTTTKEQAFARAGGERGNKGADWADAAVSMIKLMKEIEITDE

SEQ ID NO: 64012 - protein, 470 aa, Geobacillus kaustophilus HTA426
MQPVQELKRELKSRHLFMIALGGVIGTGLFLGSGYTIHEAGPGGAVVAYLFGGLVMYLTMLSLGELAVRIPDAGSYQTYATKFISPAVGYCIGWLSWLNWSVTVGIELLTVSILMKRWFPDVPTWVFCAVFALLLFLINALSVKGFGEVEFWFSSIKVLTVIAFIVLGLAAMFGVIHMKNGQPAPFFSNFTDHGGLFPNGFWAIFTTMILVNFSFQGTELVGVAAGESREPEKTVPVALRNTVWRILIFFILAIFVLAGLFPWEKAGVVESPFVEVFDNIGIPYAADIMNFVIITAVLSVANSGLYATSRVLWSMSRQGMVTPFFSKLSKRGVPINALIASIAIGCLSLLCSVYAEDTVYVWLTAIAGFGAVTVWASIALSSYFGRKAFLREGGDVRDLKYRTPLYPFVPLAAFALNMATIIGLAFIPDQRIALYCGIPFLLACYGYYHLVAKKRVQPLAAEEGELKAAK

SEQ ID NO: 64013 - protein, 504 aa, Oryza sativa Indica Group
MLGSCAPTTAGPPPDEATTPEPFRSLQIATASAGSAKKKRRPAGTPDPDAEVVSLSPRTLLESDRYVCEICNQGFQRDQNLQMHRRRHKVPWKLLKREAGEAARKRVFVCPEPTCLHHDPSHALGDLVGIKKHFRRKHSGHRQWACARCSKAYAVHSDYKAHLKTCGTRGHSCDCGRVFSRVESFIEHQDTCNASRGQAAAVAEGGNVSTAACGGVAVLEQEKQLDLQAPAAASLSRTASSTSPSSDVVASPVAWPGAWAPSMPSPKAAAFRGRFDMAPSPPPPSYDHYRGGAGAHNLELQLMPPFNAGGAAAAPGGMGACFYAAAHQHHPTGVSQCNDASTQLQLSIGRGEVMGAAGTSDEASAAATAKEQAREQLRQAMAEKEAAGEARAQARRQVELAEQELATARRMRHQAQVELSRAHALRDHAVRQVNATLLQITCFSCRHKFRAAAAGAPLPAAMSSDVACSYVSSVVTEGGDADEPLDVVDATRRRLQHANSMGIM

SEQ ID NO: 64014 - protein, 399 aa, Geobacillus kaustophilus HTA426
MTTKSQQLIEQTERYGARNYHPLPIVISEAEGVWVKDPEGNRYMDMLSAYSAVNQGHRHPKIIEALKKQADRVTLTSRAFHNDQLGPWYEKVCRLTKKEMVLPMNTGAEAVETALKAARRWAYDVKGVPDNQAEIIVCEGNFHGRTLAAVSLSSEPAYKRGFGPLLSGVKIIPYGDIEALKAAITPNTAAFLVEPIQGEAGIRIPPQGFLKAAYDVCKANNVLFIADEIQTGLGRTGKLFACDWEEVVPDMYILGKALGGGVFPISCVVANRDILSVFEPGSHGSTFGGNPLACAVSIAALEVIEEERLAERSLELGEYFLSKLKQIRNDDIKEIRGRGLFIGVELHVPARPYCEALKEQGLLCKETHETVIRFAPPLIITKEELDWAFERIANVLSRP

SEQ ID NO: 64015 - protein, 435 aa, Geobacillus kaustophilus HTA426
MGVRTDCECLVPSINRVKEANETMEENMFLSTQRVIKEALAKLGYGEEMYELLKEPLRVLTVRIPVRMDDGTVKVFTGYRAQHSDAVGPTKGGIRFHPDVTEEEVKALSMWMTIKAGIVGLPYGGGKGGIVCDPRNMSMGELERLSRGYVRAISQIVGPSKDIPAPDVFTNSQIMAWMMDEYSRIREFDSPGFITGKPLVLGGSQGREKATALGVTICIEEAAKKAGIELQGARVIIQGFGNAGSFLAKFLHEAGARVIGISDAYGALYDPNGLDIPYLLDRRDSFGTVTTLFENVITNQELLEKECDILVPAAVANQITRDNAANIRAKIVVEAANGPTTLEATKILTERGVLLVPDVLASAGGVTVSYFEWVQNNQGYYWTEEEVVEKLKEKLTSAFHRVYELAESRRVDMRMAAYMIGLRQTAEAARYRGWV

SEQ ID NO: 64016 - protein, 261 aa, Arabidopsis thaliana
MQDSKIPPFSEAKRMKIPTPKQPLTQLPPRIGKKVSNRSKSNQVHAISHQLEMSPNSDSSPGNEYRALRRKYLLLEEDSFALERELKEAEDEVKALEDEKLELLDKLVVMEGHHPLAGRRKGHLLHYERSTVRRLVVTAATEGSKKSKESEPSWANPDSDEPPPWARNEGRSSTSQESFEVPFFVYLLASAITAIAAIGSVFEYTSKNPVFGILESDSIFYTPVLGFFALTGIPTSVFLWFKSVEAANKEAQEQDKRDGFL

SEQ ID NO: 64017 - protein, 523 aa, Cryptococcus neoformans var. neoformans JEC21
MRSRPASARLHNIHTPSLSIQPTSHLFFVYITKMGIVNNIVTGVTHPMELRAIVNFAIWHDTRDITDTVELPTTHYDRPTMRKCWDFLDLTSRSFARVIRELEGELARTVCLFYLVLRALDTVEDDMTIPNDVKIPLLRAMHTKLYEPGWTFKESKEKDKIVLEEFDAIQTEFSLLDHKYQTVIADICKKMGAGMADFAALATPGKPVAEINSIADYDLYCHYVAGLVGEGLSGLFAASGKERSFIADQLTLSNSMGLLLQKTNIYRDLHEDVIDGRGFWPRAIWSKYGFNSMKELIDPERETEAMWAASEMVLDALRHATDALDYLTLLRCQSVFNFVAIPAVMAIATLERTFMNKKILKENVKIRKGETLRLIMRAMNPRDVSYIFREYARKIHAKVHKDDPNLLKLSIACGKIEQWAEHHYPSFIQIGNAAGNGVQSAIDPAAIKARQEKFMADLRAKGLIKEKSGETDGDEEAKKRYEAIQNEQAVSWLMIIGVIVGMLALMAAMGGIVVWVILTVYDE

SEQ ID NO: 64018 - protein, 542 aa, Cryptococcus neoformans var. neoformans JEC21
MRSRPASARLHNIHTPSLSIQPTSHLFFVYITKMGIVNNIVTGVTHPMELRAIVNFAIWHDTRDITDTVELPTTHYDRPTMRKCWDFLDLTSRSFARVIRELEGELARTVCLFYLVLRALDTVEDDMTIPNDVKIPLLRAMHTKLYEPGWTFKESKEKDKIVLEEFDAIQTEFSLLDHKYQTVIADICKKMGAGMADFAALATPGKPVAEINSIADYDLYCHYVAGLVGEGLSGLFAASGKERSFIADQLTLSNSMGLLLQKTNIYRDLHEDVIDGRGFWPRAIWSKYGFNSMKELIDPERETEAMWAASEMVLDALRHATDALDYLTLLRCQSVFNFVAIPAVMAIATLERTFMNKKILKENVKIRKGETLRLIMRAMNPRDVSYIFREYARKIHAKVHKDDPNLLKLSIACGKIEQWAEHHYPSFIQIGNAAGNGVQSAIDPVSNDARAALFTRLAKEAQEAAIKARQEKFMADLRAKGLIKEKSGETDGDEEAKKRYEAIQNEQAVSWLMIIGVIVGMLALMAAMGGIVVWVILTVYDE

SEQ ID NO: 64019 - protein, 205 aa, Malus x domestica
GHIKDKRIAAVQALSGTGACRLFADFQKRFRPESQIYIPVPTWANHHNIWRDAHVPQKTFHYYHPETKGLDFAGLVDDIKNAPNGSFFLLHACAYNPTGVDPSEEQWKEISKLIKEKGHFPFLDMAYQGFASGDPERDTKAIRIFLEDGHLIGIAQSYAKNMGLYGQRVGCLSVLCEDEKQAVAVKSQLQMLARPMYSTHLFMER

SEQ ID NO: 64020 - protein, 319 aa, Triticum aestivum
  misc_feature (19)..(19): Xaa can be any naturally occurring amino acid
  misc_feature (286)..(286): Xaa can be any naturally occurring amino acid
  misc_feature (299)..(300): Xaa can be any naturally occurring amino acid
  misc_feature (305)..(305): Xaa can be any naturally occurring amino acid
  misc_feature (311)..(312): Xaa can be any naturally occurring amino acid
  misc_feature (316)..(316): Xaa can be any naturally occurring amino acid
RWESLRRSRKYQNLVRWFXSVAVDYALEEVTSVYVGKRAIGKSPAPCLKEKMPGLKNTSGHEIDLPGAKVGEVCVRFAPEPSGYLHIGHAKAALLNQYFADRYKGRLLVRFDDTNPSKESSEFVENVLKDIETLGVKYDAVTYTSDYFPKLMEMAECLIKQGKAYVDDTPKDKMNTERRDGVESKCRNSTVEENLLLWSEMVNGTKRGTQCCVRGKLDMQEPNKSLRDPVYYRCNPDPHHRVGSKYKVYPTYDFACPFVDALQGVTHALRSSEYHDRNAQYYRILXDMGLRRVEIFEFXXLNMGXIYTVLXXRTLXWFV

SEQ ID NO: 64021 - protein, 507 aa, Rickettsia sibirica 246
MDSVDSNFTIWNKARNSKFRHIVWPIRSYELTKFIPMALLMFFILLNQNLVRSIKDSFVVTLISSEVLSFIKLWGEMPMGILFVIFYSKLCNIMTTEQVFRIITGTFLFFFAIFGFILFPYREFFHPDPELMKHYITVLPHLKWFLIIWGQWSLVLFYIMGELWPVIVFTLLYWQLANKITKVEEAPRFYSFFTLFGQTNLLISGTVIIYFAKSEHFLLPLFSHLNDTNEILLKSFITVILISGLICLALHKLIDKSVVEADKNIKFKNQRMDILKLSLVDSAKVILTSRYLGFICLLVMSYSMSISLIEGLWMSKVKQLYPATKDFIAYHGKVFFWTGILTLVSAFLGSSLIRICGWFWGAIITPIMMFGAGVMFFSFTVFENHLGNIVNTLGYSAPLVVIVFIGGLWHVLSKSVKYSLFDATKEMVYIPLDSEMKTKGKAAVDVMGAKIGKSIGAIIQFISFSIFPNAIHNDIAGLLMFSFIIVCLLWLYGVKVLSKYYNKMIQR

SEQ ID NO: 64022 - protein, 585 aa, Listeria monocytogenes str. 4b F2365
MKKTKIVCTIGPASESVDTLVQLIEAGMNVARLNFSHGDFEEHGARIVNIREASKKTGKQVAILLDTKGPEIRTNDMVGGKLEFQTGDVVRVSMTPVEGTKEKFSVTYGELYDDVEIGSSILLDDGLIGLEVIEKDEANRELVTKVLNPGVLKNKKGVNVPNVSINLPGITEKDAADIRFGLEQGIDFIAASFVRRATDVLEITKILEEHNATHVQIIPKIENQEGVDNIDEILQVSQGLMVARGDLGVEIPAEEVPIVQKELIRKCNKLGKPVITATQMLDSMQRNPRPTRAEASDVANAIFDGTDAIMLSGETAAGDYPVEAVKMMAKIAVRTEEVLVAQDKFALKLHENTDMTEAIGQAVGHTAKNLNVQTIVAATQSGHTARMISKYRPKSHIVAVTFNEHVYRGLALSWGVYPRLATPVSNTDEMFDLAVKESLASGVAKQGDLIIITAGVPVTESGTTNVMKIQLIGEKVVKGQGIGSKSVIGKAIVAKSNAEALEKAEEGGILIVKTTDKEMLPAFEKSAAVVVEEGGLTSHAAVVGINLGIPVIVGAKDATSLVKDGEIITVDSRQGVVYNGKTATH

SEQ ID NO: 64023 - protein, 106 aa, Malus x domestica
TDVPAPDMGTNAQTMAWILDEYSKFHGHSPAVVTGKPIDLGGSLGREAATGRGVVFGTEALLAEYGKSCKGLTFVIQGFGNVGSWAAKLIHEKGGKVIAVSDITGA

SEQ ID NO: 64024 - protein, 457 aa, Ostreococcus tauri
MDASAAEAPMRSPNAIANTKTVAAVILGGGAGTRLYPLTKSRAKPAVPIGGAYRLIDVPMSNCLNSGISKVYILTQFNSASLNRHLARTYNFGNGIMYGGNGFVEVLAATQTPGQGGKEWFQGTADAVRQYSWLFNDVKNKDVEDIVILAGDHLYRMDYMKFVEAHRESNADISVGTLPIDEARASDFGLMKIDSTGRIVEFTEKPKGDALQAMKVDTTVLGLTADEAKEKPFIASMGIYVFKKSALVKFLEKDYPEDNDFGGEIIPRAAADGAKVQAYLFNDYWEDIGTMKSFFEANLNLAKDPPNFEFYNAEAPIYTSPRFLPPAKVERCHVKESIISHGASLADCQVEESIIGLRSVVNKGCRIKRAMIIGADFYESDEKKASLLASGEVPVGIGEGTIIENAIIDKNARVGKNCVITNAAGVEDLADEERGVFIRNGIITILRNCTIPDGTII

SEQ ID NO: 64025 - protein, 1205 aa, Arabidopsis thaliana
MAAMIAGDGDRIGPSWRMASSLAQSRISNLQNHLSPLEANNKLRSLVKISPQVSEALSNGRAVVALESTIISHGMPYPQNLQTAKEVESIVRENGAIPATIAILNGVPCIGLSEEELERLASLGKSVQKTAGRDIANVVATRGNGATTVSATLFFASMVGIQVFVTGGIGGVHRHANHSMDISSDLTALGRTPIAVISAGVKSILDIPKTLEYLETQEVYVAAYKSDEFPAFFTEKSGCKAPSRVNSPEDCARVIGKCSLSLKISSFKTYLCTLIPYHLEIKPLLPDANMKLNRQAGILFAIPIPKHHSAAGNLIESATQRALTEAREQNVTGNAETPFLLARFWTTMAAITVDFQLCFIFILLGIFSLFCLSAFFFKKPKDPQLQGCGLPPSPPSLPVIGHLHLLLSVPCHKSFQKLSSKYGPLLHLRAFNIPIVIVSSGSMANEVLRTQDLNFATRQREVSIMEKSLLFGSFGFVSAPYGDYWRFMKKLLVTNLFGSHSLEQTRLIREKELKTFRTMLFDKAAKKGTVDVGKEMMKLTNNSICRMIMGRRCSEENSEAEKVEDLVIKSFSLVKKVLIANTVGRLLKKFGISLFEKEIMEVSQRYDELLEKIIKEHEEDPNKKEDRDMMDVLLEVCADDKAEVKITRNQIKALIVELFLGGTDTSAQTIQWIMAELINHPEILKILREEIESVVGTTRFIQETDLSNLPYLQAVMKEGQRLHPHSPMLVRNATKGCKIGGYYIPQNTTMLINTYAMMIDPDSWENPDKFQPERFMVSPSKGKDDEREQLALNFIPFGSGRRACPGEKLGYLFTGVAIGTMVQCFDWIIDGDKVNVEEAGEMTLTMAHPLKCTPVTRVNPLASFESEDPKWLMEEFDIRKLPSLPLQSAMSGSVLSITADWMLFTSTKPVSELANSSESKQVVENNGSNHHLLSALLHLHPPRYLLTLLSLCFFLQETKRATTPRLWSTTEPTIYTGHRSSSPSPLCSMSQILSETLLQVWSPPSPPRFQYPNSSSLVGLHGQRIPYGDYWRFMKKLLVKKLLGSHSLEQTRLLRGKELQTFRAMLFDKATKNETVDVGKEMMKLTNNSICRMTMGRSCSEENDEAEQVRGLVTKSLSLTKKFLIASIVGHFSKLVGISLFGKEIKEHSQRFDELLEKIIKEHEKDPNNGEDRDMMDVLLEVCADDNAEFKISRNQIKALFVVMS

SEQ ID NO: 64026 - protein, 238 aa, Archaeoglobus fulgidus DSM 4304
MILDFEESLRAFRKGSPVLIYDFEDREGETDIAIPAIHVGKDEVAMMRIDGGGLICVAIHPVAAEKLGLPFMHDVLRIASEKLPEIRKVADADDIKYDSRSSFSLWVNHRDTFTGITDVDRALTIRRIGEVVDEVMMGKKVDFGREFRSPGHVALLRAADKLTYERVGQTELSVALAEMAGIAPAVAICEMLDAETGKALTKEKAMEYAEEKGIPFIDGRTIVEHYRKFREVEVSLFV

SEQ ID NO: 64027 - protein, 581 aa, Oryza sativa Japonica Group
MGGRARSILRWLRHHRSRRVSSSSFHLTTTGDDTVKDLHDPRREDAEGDGWEEVHEGPESDPEEYIALVSEDAGTHLPVRTEPRRMDPSKKEPDFFTEYGEANRYKVSEVIGKGSYGVVAAAVDTQTGERVAIKKINDVFDHVSDATRILREIKLLRLLRHPDIVEIKHIMLPPSRREFRDIYVIFELMESDLHQVIKANDDLTPEHHQFFLYQLLRGMKYIHAASVFHRDLKPKNILANADCKLKVCDFGLARVSFNDTPSAIFWTDYVATRWYRAPELCGSFFSKYTPAIDIWSVGCIFAELLTGKPLFPGKNVVHQLDLMTDLLGTPSAESLAKIRNEKARRYLSNMRKKPRVPFTKKFPGVDPMALHLLERLLAFDPKDRPSAEEALTDPYFNGLANSEREPIAQPISKLEFEFEKRKLAKDDVRELIYREILEYHPHMLQEYLRGGDQMSFMYPSGVDRFKRQFAHLEEGVSKGEKSSPQLRQNASLPRERAIGNKHGDDEYHAKLNVGEKPCHASVTDGISKPLMSARSLLKSESISASKCIGEKPKQDRDEDSLTESMDETADEVSEKVAQLKT

SEQ ID NO: 64028 - protein, 429 aa, Acidobacteria bacterium Ellin345
MNISIVGLGYVGAVSAACLASRGHNVWGVDINADKVAALNEGKSPIIEPKLAELLSAAVSSGKLRATCDMSEALAQTDICFVSVATPSRKNGQIDAGHLLRACQQIADVIKLLDRKQVIVIRSSVLPSVFEEATKLFATHVPGLAELCINPEFLREGSAIADYENPPFTVIGTDKPEVEKMLRDLYSDLSAPVYVLGAKEATLVKYASNAFHALKVAFANEIGAVCHENGIDGDAVMEVFCKDNKLNISHRYLRPGFAFGGSCLPKDVRALLYAGKVADIELPLLRGVLDSNECVIERAFDAILETGARRIGLVGLSFKKNTDDLRESPFVELAERLVGKGLALRIYDPNVSVARLVGANREYIQQRLVHLSSLLTESIEELAVACDLIIIGHKFEGVEKLQAHRDRYHILDLTGPFALHPRQSAAKAG

SEQ ID NO: 64029 - protein, 628 aa, Marinobacter sp. ELB17
MTAYFIQAFIYLLAAVIAVPLAKRFGLGSVLGYLIAGVVIGPVMGLVGQETSTIQHFAEFGVVMMLFLIGMEIDPKALWAMRVRLLGLGGLQVTLTAAAGMAGAWWLGLQWQTALAVGLIFALSSTAIVLQTLDEKGLSKTEGGRNTFSVLLFQDIAVIPMLALIPLLALPGLKGNPTSRSSQDAGLSLVAGLPGWAHALVVVGAVAAVIVGGYYLSRPLFRYVVKSGLREVFTATALMLVIGIAALMSVVNLSPALGAFLAGVVLANSEFRHELEANIEPFKGLLLGLFFITVGAGINFEVLLAEWGAIVSLGAAVIVVKALILFALAKMFGIHSSNGWLFTLGLAQAGEFGFVLLTYSVQNDVIPLEISQILSLVVALSMFLTPLLFIVYDRIVLPRYRRSQNDDRDADTIDEQAPVIVAGVGRFGQIVCRLLRANSVPIVVLDHEIEQIENVRRINIRSFFGDASRPDLLEKAGIEQARLLIVAIDDRDRAVAMVTHVKKFFPGVWVLARAFDRGHGYQLLEAGADDVMSETYHSALELGGYALTAMGVHPMRAKQMTWAFVENERAHDAELFEAWKEIEEGINFSPRYGELFMKLEESLSTSMQRDWEAPKPEDVPVWTPPGKD

SEQ ID NO: 64030 - protein, 335 aa, Bacillus sp. SG-1
MTVKIGINGFGRIGRNVFRAALNNDNIEVVAVNDLTDANMLSHLLQYDTVHGKLDQEVSVDGDYLVVGDTKVKVLAERDPAQLGWGDLGVDVVVESTGRFTKRADAAKHLEAGAKKVIISAPASDEDITIVMGVNEDKYDAASHDVISNASCTTNCLAPFAKVLNDKFGIKRGMMTTIHSYTNDQQILDLPHKDYRRARAAAENIIPTTTGAAKAVSLVLPELEGKLNGGAMRVPTPNVSLVDLVAELGKEVTVDEVNSALKEASEGDLKGILGYSEEPLVSTDYNGNPDSSTIDALSTMVMEGNMVKVISWYDNESGYSNRVVDLVGYIASKGL

SEQ ID NO: 64031 - protein, 515 aa, Candida albicans SC5314
MAYVLTETAAGYALLKAADKKIHKSSSLVEDLNTAEKVAEQFKIHRFEKFQSAANALEEANAIIEGKVSENLQKLLEDAKSDKKATLIVSEAKLGNAINKLGLNFQVVSDAASLDLQRAIKQFLPELLPGLDDSALKQMSLGLAHSMGRHKLKFSADKVDTMIIQAIALLDDLDKELNTYAMRCKEWYGWHFPELAKMITDSVAYARIILTMGVRSNASETDLSEILPEEVEEQVKAAAEVSMGTEITEDDLNNIKALAEQIVDFAAYREQLSNYLSSRMKAIAPNLTAMVGELVGARLIAHAGSLTSLAKAPASTVQILGAEKALFRALKTKHDTPKYGIIYHASLVGQASGKNKGRIARTLAAKAAVSLRYDCFDEERDESDDFGLENRAKVEGRLSQLEGRDMRTTSKVVREQPKVEITEARAYNADADSTAAAAAAPTADSDDEESETEEVEEKKSKKDKKKDKKEKKDKKKDKKRKRDDDKEDKESSKKSKKDKKEKKEKKEKKAKKEKK

SEQ ID NO: 64032 - protein, 394 aa, Bacillus sp. SG-1
MNKQTIKDIDLKGKRVFCRVDFNVPMSEGNVTDETRIKAALPTIQYLSEQGAKVILASHLGRPKGQVVEELRLTPVAKRLSELLGKDVAKTDEAYGDTVKAEIEKMSEGDVLLLENVRFYPGETKNDADLAKEFAALADVYVNDAFGAAHRAHASTAGVAEHLPAAAGFLLEKELEVLGKALTTPERPFTAIIGGAKVKDKIGVIDNLLEKVDNLIIGGGLAYTFVKAQGHEVGKSLLEEDKIDLAKQFMKKAEDKGVKFYMPVDVVVADDFSNDANTKVVPIEEIPSDWEALDIGPKTQEQYASVIKNSRLVIWNGPMGVFEIEKFANGTKAVAQALADAADTYSVIGGGDSAAAVEKFDLADKMSHISTGGGASLEFMEGKELPGVSALNDK

SEQ ID NO: 64033 - protein, 253 aa, Bacillus sp. SG-1
MRKPIIAGNWKMNKTMSEAKKFAEDVNGLVPSSEKVESVICAPALFLERLVDITKEYQVEIGAQNMHFEENGAFTGEISPAALQDLGVKYVILGHSERREMFNETDESVNKKTHAAFNYNLTPIVCVGETLEQREADQTKQIVGDQVKKALEGLTEDQVKATVIAYEPIWAIGTGKSSTSEDANEVCSHIRQTVAEQFSQEAAEALRIQYGGSVKPNNIGEYMAQSDIDGALVGGASLEPQSFLQLLEAGSNE

SEQ ID NO: 64034 - protein, 450 aa, Staphylococcus aureus subsp. aureus MRSA252
MNNKRHSTNEQLSLDEINNTIKFDHRSSNKQKFLSFLGPGLLVAGGYMDSGNWITSMQGGAQYGYTLLFGNLISRLSAMLLQSMTVRLGIATGMDLAQMTRHYLSRPIAIIFWIIAELAIIATDIAEVIGSAIALNLLFNIPLIVGALITVLDVFLLLFIMKYGFRKIEAIVGTLIFTVLFIFIFEVYISSPQLNAVLNGFIPHSEIITNNGILYIALGIIGATIMPHNLYLHSSIVQSRTYSRHNNEEKAQAIKFATIDSNIQLSIAFVVNCLLLVLGASLFFNSNADDLGGFYDLYHALKTEPVLGATMGAIMSTLFAVALLASGQNSTITGTLAGQIVMEGFLRLHIPNWLRRLITRSLAVIPVIVCLIIFKGNAAKIEQLLVFSQVFLSIALPFCLIPLQLATSNKDLMGPFYNKTWVNIISWTLIIILSILNVYLIVQTFQELQG

SEQ ID NO: 64035 - protein, 511 aa, Bacillus sp. SG-1
MSKSPVALIILDGFACREEDKGNAVTQAKKPNFDRYWNQFPHSTLKASGEAVGLPEGQMGNSEVGHLNIGAGRVVYQSLTRVNVSIREGEFEKNETFVNAIEHAKSKNKALHIFGLLSDGGVHSHIEHLFALLRIAAAEGLKEVYVHGFLDGRDVGPKTAETYILQTQEVMRELGVGEFATISGRYYSMDRDKRWDRVEKAYRAMVYGEGPEYSNPLEVVVDSYDNGIFDEFVLPSVIKRDNGEPVATIDEEDAVIFYNFRPDRAIQISNTFTNDDFRSFERGPKHPKNLHFVCLTHFSETVDGYVAFKSVNLDNTLGEVLSQNNLKQLRIAETEKYPHVTFFMSGGREDEFPDETRILINSPDVATYDLKPEMSAYEVTEALMEEIKNDRQDAIILNFANPDMVGHSGMLEPTIKAIETVDECLGQIVDLIVEKGGTAIITADHGNADEVVTPEGNPMTAHTTNPVPVIVTKEGVSLREGGILGDLAPTMLDLLNLNKPAEMTGETLIKK

SEQ ID NO: 64036 - protein, 430 aa, Bacillus sp. SG-1
MPFITDVYAREVLDSRGNPTVEVEVYTQSGAFGRALVPSGASTGEYEAVELRDGDKDRYLGKGVQKAVDNVNNEIAEEIIGMDVTDQVAIDRAMMELDGTENKGKLGANAILGVSMAVARAAADFFGVELYQYLGGFNAKQLPVPMMNIVNGGEHADNNVDIQEFMVMPVGAPTFKEGLRMGAEIFHSLKSVLKSKGYNTAVGDEGGFAPNLKSNEEALSTIIEAIEKAGYKPGEEVLLAMDVAASEIYNKEDGKYHLSGEGVVRTSAEMVDWYEEMCNKYPIVSIEDGLDENDWDGHKLLTDRIGNRVQLVGDDLFVTNTNKLSQGIEQGVGNSILIKVNQIGTLTETFDAIEMAKRAGYTAVISHRSGETEDSTIADIAVATNAGQIKTGAPSRTDRVAKYNQLLRIEDQLAHTAQYLGAKTFYNIKK

SEQ ID NO: 64037 - protein, 141 aa, Streptococcus pyogenes M49 591
MNWLITSQPYKELNMKAATYLSTGNLQLIDKPKPVIIKPTDAIVQLVKTTICGTDLHILGGDVPACKEGTILGHEGIGIVKEVGDAVTNFKIGDKVIISCVTSCHTCYYCKRSLSSHCEDGGWILGHLINGTQAEYVHISH

SEQ ID NO: 64038 - protein, 571 aa, Oryza sativa
  misc_feature (482)..(482): Xaa can be any naturally occurring amino acid
MRIPRRKGVAGPLVGAPSRRAQVAAVFALALLLGVSVLYDSAHIAASLRRHGVGGGGSSGGGGGGGGDGARAYTNTKLSATTEEAEAEAAEVRSPPAQGVESAVEATDRGEAPPEQPVAADSGASSAETPPSLLEQVTETPPPSPSSSSAAAAAAEAQVGGDHGGESCDVYKGRWVYDEANAPLYKESACEFLTEQVTCMRNGRRDDDYQKWRWQPDGCDLPRFDAKLLLEKLRNKRLMFVGDSLNRNQWESMVCLVQSEAPWEKKSLVKNDSLNVFRLEEYNATIEFYWSPFLVESNSDDPNMHSIVDRIIKPTSIAKHAANWEGVDYLIFNTYIWWMNTPEMKILHGGSFSKKPVKYDEMERVAAYRKVLKTWSRWVEKHVDPKRSTVFFMSVSPVHMQSEGWGKPDAIKCFSETQPAINYTKKLEVGTDWDLFSTAHHVTKAMKRVPVHFINITALSEIRKDAHTSVNTLRQGKLLTKXRRRTPASSRTASTGAYLGCQTHGTSSFTVTSSRALKGGRLSRLRINLRDNSEEFVYLESIRSFSEEEVAAEAINYFLGLGIYAVDSPRV

SEQ ID NO: 64039 - protein, 121 aa, Arachis hypogaea
DGITHVGGDMFVSVPKADAIYMKWILHDWSDQHCIKILKNCRKAIPENGKVIIVDHVLQPEGNDLFDDTGFAFDMMLLAHNAGGKERTEENWKWLFAETGFPRYNIIKIKALPSIIEAFPN

SEQ ID NO: 64040 - protein, 513 aa, Geobacillus kaustophilus HTA426
MTTHVQVHHFPLFIDGQWQPATSGETFHVYNPATGEVVATVAKATADDVDRAVKAARKAFDETDWKAMKPKERARVLNAIAQAIAANAQELAYLEAISSGGTIRRISSIDILQTVDLFQTMANIVQEYPFSETLPIPPFPGPAHNFVWREPIGVCAAITPWNLPLMIASWKIAPALAAGNTIVVKPASYTPLSTLKLAEIISSFVPPGVINVVAGPGADVGEALVRHPQVDKVAFTGSTEVGRRIMALAAETVKNVTLELGGKSPNILLEDADLDLAVPGSLFGVFLHSGQLCESGTRLFVPDRLHDEVVERLVALTKTLQIGHPLDPATDVGPVISKRQKETVLSYIEAGKQEGATIVCGGHEVEVPGCEGGHFVAPTIFSNVTNDMKIAQEEIFGPVLSIIRYHDVEEAVTMANDTIYGLAAGVWTRDVNKAYAIAGRLQAGVVWINDWHMLRNDAPFGGYKQSGIGREMGKYSLDAYTQLKHVHTSMVPELGKRKWYQVLFSRLHTMMKK

SEQ ID NO: 64041 - protein, 537 aa, Rhizobium sp. NGR234
MAEALEIAGTAASPGVGLGPVHRATDVTAEVLALPDTVAAERDKLRQAVATALAELQALADRSDEESAGILGFQIEMLLDPALAEMAEDRIVAGDGAALAWIGALDEYIAGIKEAPDEQLRARAVDIVDIRNRVMSALTGRPLDGFAPGSVFVGKDLEPSRFLAHDWTAGGGIVLFEGSVSSHVAMLARGRCVPMVVATGQFEVADGARVLIDANNGRVVVAPDDSHVRQAKPARAEATPIAARRAGGVVETADGVAIRLSAIINDPAELKAVDPASFAGIGLMRTEFLVASPADAVDEQRHYDIYRQALEWAGDAPAIVRMLDLGGEKTLPGMGDRKSESFLGLRGIRLLLARPALARAQVRALLRAAVHGDLGVLLPMVTVPDELDAMRTYFEEERADLFRHGVETRMPEIGMMVEVPAAALMLERFSHSAFFSFGTNDLAQYLMAAARDDQSVAALYDAATSAVLRVIAQGVGHAEAMKKPIGICGEMASDPRHIPALMAAGLRHFSVAPNRVTDIRSTIGGFYSDGRAAAEMK

SEQ ID NO: 64042 - protein, 639 aa, Cryptococcus neoformans var. neoformans JEC21
MPRLSSLFLASATAASVAMAAVHDLYWNITYATANPDQLHNKTQAIGVNGTWPPPPIVVNQGDTLTVHAFNGLESVGTTLHSHGNYFNGSNYYDGAAAVTQCPIPPGETLVYEIPVNDQWGTYWIHGHYKGQYVDGLRAPLIIMPNETNERTDITWDEDFTIIMGDWYHDTSPYLVSSYFLNWVNPTGAEPVPDSVTFYVMNTTSGEYLSSNVAQGVDVTADVNNNAAIPFEPGKKYRIRFINMSALSMLHIYMGGHTFDIIEVDAVDIEPYQSANLTISVAQRYSVLVEALNTTDANYAIMFYQDTDMYDTVPDTLAVNNSVTLQYDASLGPADMFNITDDTWPILDDTRFVPLQAKGSAEADVSYELGAYFDTFDDGTNRAAFNNVTYVMPTTPSLFTQLSMGTDAWDTRIYGQQTHALMMPHLEMIELVIVNWDTGYHPFHLHGHEFQIMGKSFDVTSNDSSINPPVLENQSNPARRDTIMVPPGGSVHIRFRADNPGAWIFHCHIDWHMDSGLAVIMITDPSYSQSKLEIPQTMKDHCAYWGYSATGNVVGLNSTTDFKGEAVGPFPLVMGWTTKAKGALAGCIIAALAGFASVVWYGAEHLDEEEIEAEIRRKAEIKAASGGKFGMIKKVVKRE

SEQ ID NO: 64043 - protein, 470 aa, Ehrlichia chaffeensis str. Arkansas
MFLSIEDTLNYIKKNAINFIDLRFTDSNGKWHHITRSAETINAQVLLAGVNFDSSSIPGWQSIEKSDMILLPDVSTAFMDPFSAQSTLVILCNIVDPYKQSQYSKDPRYIAQKAYKYMLSTGIADKCYFGPEVEFFIFDNAQFYAGMYNSYFKIDSAEHDILFQKREFSNNSHRPKVKGGYMPTPPIDSLHDIRSEMLTMFKEVGIIPLIHHHEVAASQCEVGFQHDELLLSADNVQKCKYIVHGVASSYGKTATFMPKPVIKDNGSGMHCHQSLWKDNVNIFVNPDGSISETCLYYIGGIIKYGKAINAFTNPSTNSYKRLVPHFEAPTWLTYSYENRSSAIRIPYVPKNDLNAKRIEARFPDPLANPYLCFSAQLMAGLYGIQNKIHPGPAIDKNLYSLDKEELQQFTSVASSLEEALDSLDNNREFLLVGDVFTNDQIDAYINLKMLEVKDLQLHPHPIEFINYYSS

SEQ ID NO: 64044 - protein, 172 aa, Oryza sativa
MAAAAAEATTDGGGKMIILISADGKRFEVTEAVASQSQLISNMIEDDCTENGVRLPNVDGDILTMVVDYCNMHAGDAAAAGDTMKASSTEEELKKFDAELVQALENPVLFKLILAANLLNIKSLLDMTCQRVADMMSGKTPEQMRETFSFENDFTPEEEAAIRQENAWAFDD

SEQ ID NO: 64045 - protein, 774 aa, Alteromonadales bacterium TW-7
MNKSFFTTLAPNQLYFNQSFVTELNFSLHFLLKASTLIEMQTHRTSLSSSTRENKMLYKSDSFEVSFLKENIAEFKFCVAGSVNTLSQKTLSDCAAALKELAANSDIKGMVFTSDKDHFIIGADIFEFLPTFTKPEEDLVVWIKNATDVFDAIEDLPFPTLSVVNGLALGGGCEWALATDYRVASESAKMGLPEVKLGIMPGFGGTVRLPRIIGADNAMMWITSGAENRAADALKVGAFDAVVSADKLLESSVATLELAIAGKLDWQAKRNAKLQPLKLNRVEQGMSFAMAEGMVMGKTKGHYPAPVMAVRTIKAAANCTRDEAMAIENANFAKLARTNEAAAQTGIFLNDQFIKGKARKLAKHSDVEIKQAAVLGAGIMGGGIAYQSAYKGTPIIMKDIQQDALDLGMGEASKLLGAKVKRGHMPMEKMLATLSKIKPTLNDADLQDANIIVEAVVENPKVKQAVLADLEKNMPEGTVLTSNTSTICIDLLAEALDKPENFCGMHFFNPVPKMPLVEIIRGAKTSDKTINAVVDYALKLGKSPIVVNDCPGFFVNRVLFPYFAGFSKLVVEGANFAKVDKVMENVFGWPMGPAYLLDVVGIDTAYHCTGVMADGFPERMARAEKDPVTVFANEKRFGQKNKAGFYKYETDRRGRLKKSSDATAVELLAPITDAPKEFDKQEIIDRCMIPMINEVLLCLQEGIVASPQEADMALVYGVGFPPFRGGAFRYLDQTGLANFVAAADKYAHLGAIYQVSEQTRKWAEEGRVFYKVEG

SEQ ID NO: 64046 - protein, 153 aa, Streptococcus pneumoniae
EHFIRGQYRSGKIDGMKYISYRSEPNVNPESTTETFTSGAFFVDSDRFRGVPFFFRTGKRLTEKGTHVNIVFKQMDSIFGEPLAPNILTIYIQPTEGFSLSLNGKQVGEEFNLAPNSLDYRTDATATGTSPEPYEKLIYDVLNNNSTNFSHWD

SEQ ID NO: 64047 - protein, 1072 aa, Aspergillus oryzae
MGVFRPRGRSDSRVSGLPFRRSPFVDDEAPDAIEPPVEQANNGSPPRTPLGIESLVSGGTSHRTPSRSFYHRSFNSTADPARYSSQGLREQTAELASYALSLNGSSLPEERNTLPPSLDIFHPIQDTDLSSSPADTVVTEALDTEPPTGPIASSSALTEMIRNPSDSLDGVNGRGSAPKWSGLGEGGASVGISGTASGMHEAPSTEQTSLLPKSPHTKPFRSYGITEDVESQDTIRERKQNAFHKMLSSCMICFQGLLHPKSWNGRTVWEQGVIYPFSLLPSVFLGLLLNILDALSYGMILFPLGEPIFSDLGSDGISMFYVSTIIAQLVFSCGGSIFRGGVGSEMIEVVPFFHQMAFTILARVGQDNPRSVIATTILAFSASSVLTGLVFFLMGTCKLGSLIGFFPRHILIGCIGGVGFFLLMTGVEVSARLPGSLEITIPTLEKLSRPDTVPLWLVPLLLAIGLLVLKRFVRSNFLVGGYFIAVAVIFYIVKLSAKVPMDTLRKSGWVFEAPSSNNPWWHFYTLYDFAAVDWAAFLDTIPAMFALTFFGVLHVPINVPALGISTGEDNLNVDRELMAHGVTNALSGFSGSIQNYLVYTNSLLFIDSGGNSRLAGIMLAAATLGILLVGPVIVGFIPVMVVGALIFLLGIELMEEALVDTWGKLQRHEYMTVVIIVVTMGAWDFVVGIFVGIILACMSFVVQTSRKSAIRATFSGKIAGSTVRRPPIQQRFLREAGQQTLIIKLGGYLFFGTIVDVENTMRGLIEEEAFNKRPIRFIILDFSRVYGIDFSAAEAFTRINRILRKRNVLMTISGLNTGGDVGRSLQNVGLFESENGVQIFEDFNSALEFCENDYLKVFYSHREALLKRKDTSSTFLEVPGSHTQHHLHESIVSSPRHRHLQQAATTTLREDETAVVPPTAWASMRQPLPLLLQTFQGLTSRNEDFWFRACTYFVRDTYAAGTVLFQEGDVPNGFYLLESGMLRAEYEMPQGRYFELIVAGRPCGELPFFSETRRTATVKAEQDCVAWRLTTAKWRDLREREPEIARELLTVSLKLTTERMDSITSYVLTMAA

SEQ ID NO: 64048 - protein, 797 aa, Rickettsia sibirica 246
MLPEIASSMPIASARNDEKLKQTNKTGISKMDEMNKINYAEALEYHEKDKPGKIAISATKSLVTQQDLSLAYSPGVAAPCLEIAKNLEDVYKYTARGNLVAVISNGTAVLGLGNLGAAASKPVMEGKAVLFKKFADIDAIDLEVNTEDPEEFINAVKYLSYSFGGINLEDIKAPECFIIEEKLKSLMDIPVFHDDQHGTAIITAAGLINAAYLTNRKLEDLKIVVNGAGAAAIACIDLLIALGADKSKIIVCDTKGVVYKGRLEGMNKWKELYASDTKFRTLAQSLNNADVFIGLSVKGAVTKDMVSRMASNPIIFAMANPDPEITPEDIQLVRDDAIIATGRSDYNNQINNVMGFPYIFRGALDIRAKTINTEMKIAAAKAIADLARRPVPEEVYKAYSGRKMVFGKEYIIPVPFDPRLITVVAAAVAVAAIESGVARVKDFSIGKYKKELGSRLNPTANYMNFLAEKIHNAPLKRIVFAEGEEEEVISAALMMRDKKYGHPIIIGRVERIEAMLKKIGQDISLDGIQIMNAALSDSLEKYTDYLYKRLQRKGYLYRDCAKLVKTDKNIFAACMLACGDGDALLTGVTKSYIDSLEDIMKVIAPKTNRSILGYSIMIAKDNNIIIADNCITEYPNSWELAQIATQTAEIAKNMGITPRVALLSFSTFGNSSKAKTARIREAVNILDNFSKDKEELSGMKVDFEYDGEMSVKVALDGDLRKLYKFCRLSGSANVLIMPGLNSAAISTELLQEFSSNSFIGPITNGFEKPVQILQAAATANEILKIATFACVEAINEV

SEQ ID NO: 64049 - protein, 139 aa, Triticum aestivum
LIFFGGIANTFMLAAGLSIGKSLAEADLVNEAKAIIDEARERGASVPIPTDVVTAKEFSPTAAATVKQVADIEADDMILDIGPDTAKALASQLEKAGTIVWNGPVGVFEFDQFGNGTKTLAEAIAKSSAFSIAGGGDTL

SEQ ID NO: 64050 - protein, 381 aa, Triticum aestivum
  misc_feature (207)..(207): Xaa can be any naturally occurring amino acid
MEDKRPKPIRCRAAVCRAAGEPLAVEEVVVDPPKAHELRLKIVCTSLCHSDVTFWRMKDFPGVFPRIFGHEAFGVVESTGEHVEGFAAGDAVVPTFLAQCSECADCRSSRSNVCSKYRFAVRPGMPRDDTTRFRDGDGNPIHHLFGVSSFSEYTVVDVTQVVKVDPAVPPATACLLSCGATTGVGAAWKLAKVEPGSSVAIFGLGAXGLAVAEGARICGASKIIGVDLNPDKEELGKKSHASDFINPKELGEKTVSQVIIEMTDGGADYCFECIGLAALMNDAFQSSRAGWGKTIILGVERHGAPLTISSLEILHGKCVMGSLFGGVKPKQDIPILADKYLNKELELDKFITHEVGLKDINTAFDLLLQGKSLRCTIWMDK

SEQ ID NO: 64051 - protein, 316 aa, Listeria monocytogenes str. 4b F2365
MTMYAKNNTAGKDMLSLLEWNKEELTDIIKLAVAMKTNPAHYSHILSGKILGMIFDKPSTRTRVSFEAGILQLGGQAIVMSSKELQIGRGEPIKDTAHVMSEYIDAIMIRTFSHEKVEELAYHAEIPIINGLTDLHHPCQALADLMTIYEWKDQLEGVKLAYIGDGNNVCHSLLLAGAMVGIDICLAMPKGYEVDETILAKAENLAKQSGGKIFVTEDPKLAVTDADFIYTDVWTSMGQEDENAKRLADFGEKYQVNAELVSGAKPDYHFLHCLPAHREEEVTAEIIDGNHSVIYQQAGNRLHAQKALLAAILEAK

SEQ ID NO: 64052 - protein, 210 aa, Bdellovibrio bacteriovorus HD100
MVAPSILSADFANLEKEIKAVAQAGADWIHVDVMDGRFVPNITIGIPVVKALKKVSPLPLDVHLMIEEPERYVEEFVKAGSDYLTIHVESTKDAAGTLKRIRELGAKPGITLRPRTAVEEVLPLLPLCDLVLVMTVEPGFGGQSFMNDQVAKITRLRQEISSENLSCLIEVDGGINAETAKICHEADVFVAGSYVFGKEYGSAIASLKGS

SEQ ID NO: 64053 - protein, 275 aa, Staphylococcus aureus subsp. aureus MRSA252
MALYGFAQGLIQEAGIRIKQLMEQNLTIETKSNPNDLVTNVDKATEDFIFDTILETYPNHQVLGEEGHGHDIDTSKGTVWVVDPIDGTLNFVHQQENFAISIGIYIDGKPYAGFVYDVMADVLYHAKVGEGAYRGSQPLKPLNDSNLRQSIIGINPNWLTKPVLGEIFKDVVNISRSARAYGSAALEIVSVATGNLEAYMTPRLQPWDFAGGLVILNEVDGLASNLLREPLTISGPNSILVGNRGVHREILGVYLEPHRDALIQLHEQRFKRKSK

SEQ ID NO: 64054 - protein, 386 aa, Listeria monocytogenes str. 4b F2365
MKHVFPTYKRFPIDLVNGTGTVVTDKNGKTYLDFTSGIAVCNLGHCPANVAEAVQQQLTNIWHTSNLYECALQDSVAELIADGKDRLVFFCNSGTEANEAALKLARKYTGKEKIITFEKSFHGRTFGSMSATAQAKIHQGFGGLVPGFTYVPYNDIEAFRAEIDEHTAAVMLEVIQGEGGVIPANAAFLLEVQLLCKKMGVLLIIDEVQTGLGRTGTLYGFEQIGLEPDIFTLAKGLGNGLPIGAMVGKANLSSAFGPGSHGSTFGGNKLALAAAKEILRTMKQAGFLEEVNAKADYFRYLLEVHLEALDNVSVIRGGGFLIGIELENTAEPVVTELRDKGLLILTAGANVLRILPPLTVSYAEIDQAIYLLKSVLENQLIGSEEG

SEQ ID NO: 64055 - protein, 373 aa, Bacteroides thetaiotaomicron VPI-5482
MKIERKILLNPGPATTTDSVKMAQVVPDICPREKEFAGMMKQLRDDLVRVAHGNLEKHTAVLFCGSGTINIDICLNSLLPEDKRVLIVNNGAYSTRAVEVCQYYGLPHINLEFSVYERPDLSVVENVLQENPDIAMVYTTHHETGTGILNPIREMGAIAHKYQAKFVVDTTSSLGMIPFDIEKDNVDFCMASAQKGLQAMTGLSFIIGNEEQIKFSKKYPKRSYYCNLYLQYENFERTGEMHFTPPVQTIYATRQALNEYFEVGEEAKFARHKRVFEAIHSGINEIGLKSVIKREWQSGLVVSVQYPEDPNWDFEKIHDYCYERGFTIYPGKISTEDTFRICALGEIEVDDIENFFKVLKAALNHYNVTLPMS

SEQ ID NO: 64056 - protein, 410 aa, Oryza sativa Japonica Group
MAEAMLLDPPMIRAAREGHKLKVTLALFGKWDEECGKWMLFPFFIFPPFGCGWEWDIESYLIEAWLVGRRSCLCFDDKSENAWKSRVGVLYVMHPITFFTNIIGVVTIVLISIVSILGLICLCHSLNFQLLIKRRRRNYYQANDEQLSYFNGPWLTRITLILVALWWGVGEVLRLTFVNGEGRFISDQTWQANVCKFYIVSNLGFAEPGLFLLLAFLLSAALQNQEVGALNRKWNQRTICAVFMLCSPSLIWEACVVFIGPHIASNDGQTSKVAKYWYSASSVHDGDVACTYPLLSSIFLGTFYTVLTLYVIFVGGQILSLVINKGLRRRIYMLIFATGILLPRAMFLGFSVLPWPGEIVHESLVFVSFLVLMIAAMLGIVILVYFPVAETFEVRNQEHIELQTSHSIAL

SEQ ID NO: 64057 - protein, 184 aa, Zea mays
  misc_feature (30)..(30): Xaa can be any naturally occurring amino acid
  misc_feature (39)..(39): Xaa can be any naturally occurring amino acid
  misc_feature (109)..(109): Xaa can be any naturally occurring amino acid
  misc_feature (164)..(164): Xaa can be any naturally occurring amino acid
LAISYPELTDMQDRAIFEAVIAVTNLGVQXFHQIMAPLXVETPHELVNQETLIHQIADKVFANVNKTIDYEIATMIDIPRAALVCDDIAHHVEFFSFGTNDVTLMTFGXYSTHDEQKLIPVYLDQGILQHDPFEVLNQNAVSELMKSATERSRRATTNLKVFIXVQLRAEPSSVTFFAKAVLDY

SEQ ID NO: 64058 - protein, 654 aa, Oryza sativa
MNPKLLFFPLLATLLLLCHHAHAVCEPATCGDLTIKYPFWLSGPDLNRSSLAIAACGHPSFELWCSRDGVASLRGSQILVLGIDYTNSSFVAGHKRVADGGDGVCRTDFNISSSLALSPFTISSSNRAICFLYSCNGTEPPEIDGLVNATISNCSKPIYAYLGGSYDRDKPPAIKAGNCTYSYLPVLWPESPVNLTAGTNYSPLFKKGFVLEWQKNGFGDCDACNASGGQCRYNNDSAAAFACLCSDGELRGTICAAPTRYKYSEVTKITSFLNYKLGEGGYGVVFKGRLQDGRLVAVKFLHDSKGNGEEFVNEVMSIGRTSHINIVSLFGFCLEGSKRALLYEYMPNGSLDDYIYSENPKEILGWEKLYGIAIGIARGLEYLHHSCNTRIIHFDIKPQNILLDQDFCPKIADFGLAKLCRTKESKLSMTGARGTIGFIAPEVIYRSFGIVSTKSDVYSYGMMLLEMVGGRKNAKSMVENSSEKYFPDWIYDHFALDDGLQACEVTILPMHRPTITQVLDMFERSLDELEMPPKQNFSELLKYRTGCPSPRLPVACVCNPSPIRRPNQSPPPPTQRRRTLALFGDSLNAYGRAAGVYCCGSRSETAAAAILHGCTAADGDAAAAPGRREQPNKGCTDASQNSGPYYVMGQNLGP

SEQ ID NO: 64059 - protein, 487 aa, Desulfovibrio vulgaris subsp. vulgaris str. Hildenborough
MSTVNGANIQSEEQHTGGCSAGCSGGSTGGSTDGSTGGNTQQGCSCDTHDEQRDGSVAAQTFGEEGPVKTLGRIGSKLVVLSGKGGVGKSTVAVNLAVGLARAGRKVGLLDVDVHGPSVPRLLGLTGTRPMIGEDAMYPVGWRNNLRVMSLGFFLPDPEQAVIWRGPVKMGLIRHFLTEVRWGDLDHLVVDCPPGTGDEPLSVLQLLGTDAQAVIVTTPQGVAVDDVRRSVGFCRELGNPILGIVENMGGYVCPKCGELTPLFPAGGGEALAAEQGVTFLGRIPLHPDLTSAGDAGRSLYEADAAHPIVRALAPIVERAAATLHASDIRHESTTGPQSEAAPGTGKTAATMPTAPTRNESCAPATNHPDTNGDTTMKIAIPVAGDVLCQHFGHCERFALIDVDPATGSVTGRNDVTPPPHEPGLLPVWLSEKGANLVIAGGMGARARALLEERGVKVLIGAPAAAPEAIVAAHMAGTLTLGANTCDH

SEQ ID NO: 64060 - protein, 324 aa, Pseudomonas putida GB-1
MSRIFADNAHSIGNTPLVQINRIAPRGVTILAKIEGRNPGYSVKCRIGANMVWDAESSGKLKPGMTIVEPTSGNTGIGLAFVAAARGYKLMLTMPASMSLERRKVLKALGAELVLTDPAKGMKGAIEKANEIVASDPAQYFLPGQFENPANPAIHEKTTGPEIWNDTDGAVDVLVAGVGTGGTITGVSRYIKHTQGKAILSVAVEPVSSPLITQTLAGEELKPSPHKIQGIGAGFVPKNLDLSIVDQVATVTDEESKAMAIRLMQEEGILCGISCGAAMAAAVRLAEKPEMQGKTIVVILPDSGERYLSSMLFSDLFSEQENQQ

SEQ ID NO: 64061 - protein, 168 aa, Ralstonia eutropha JMP134
MIAVGQRVPDATLQEFFDTQSEGCSLGPNAFSVSDLVKGRKIVVFALPGAFTPTCSAKHVPGYVAEAQALRDAGVDEVWCVSVNDAFVMGAWGREQHTEGKVRMMADGSAEWTRALGLDQDLSARGMGVRSKRYAMVLDDGVVTHLQVEAPGEFKASSAEAMLEALRG

SEQ ID NO: 64062 - protein, 214 aa, Paeonia cambessedesii
  misc_feature (146)..(146): Xaa can be any naturally occurring amino acid
  misc_feature (150)..(150): Xaa can be any naturally occurring amino acid
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGXSRIXGVDLNPKRFEEAKKFGVTEFVNPKDYNKPVQEVIAEMTGGGVDRSVECTGSIMAMISAFECVHD

SEQ ID NO: 64063 - protein, 214 aa, Paeonia mlokosewitschi
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNKPVQEVIAEMTGGGVDRSVECTGSIMAMISAFECVHD

SEQ ID NO: 64064 - protein, 187 aa, Enterococcus faecalis V583
MNLINQKLFDFECDAYHDGEFTRVSTEDILGKWSIFFFYPADFSFVCPTELGDMQEHYAHLQELNCEVYSVSEDSHYVHKAWADATETIGKIKYPMLADPNGQLARFFGVLDEASGMAYRASFIVSPEGDIKSYEINDMGIGRNAEELVRKLEASQFVAEHGDKVCPANWQPGEETIAPSLDLVGKI

SEQ ID NO: 64065 - protein, 352 aa, Novosphingobium aromaticivorans DSM 12444
MKIAVLPGDGIGPEVTREAVRVIEALGLGDIEMKEAPVGGAAYKAYGHPLPPETLEIARLSDGILFGAVGDPDCDSLERHLRPEQAILGLRKALTLFANLRPARVFKGMEDFSALRPEVAGAIDLLIVRELNGDVYFGEKGFRTAANGDREGYDVMSYSESEVRRIAHVAFRAAMGRKKRLCSVDKANVLETSQLWRDVMLEVAKDYPEVALEHMYVDNAAMQLVRAPGNFDVVVTGNLFGDILSDQASMCVGSIGLLASASLGERETEYGTFGLYEPIHGSAPDIAGKGLANPMATILSAAMLLRHSLGLEVAADRIEAAVAKALADGVLGRDLGGTAGTTEIGDAVLARL

SEQ ID NO: 64066 - protein, 223 aa, Glycine max
MVGFFFLGGQLCDFWVDNRAAALAPPPGLEGSQPVDLQKHPSGIVPTLQNIVSTVNLDCKLDLKTIALQARNAEYNPKRFAAVIMRIRDPKTTALIFASGKMVCTGAKSEQPSKLAARKYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQ

SEQ ID NO: 64067 - protein, 97 aa, Triticum aestivum
MDSSTTQSEGSQPPVPPKSPTMSSCRKKKTDDDATFLKDVKEHIDEFIHASMDEHKTCFKKTIQKMFGMSKAVAERSAAAKEAEVESALPLETSVSR

SEQ ID NO: 64068 - protein, 444 aa, Volucribacter psittacicida
MATGKIVQIIGAVIDVEFPQDAVPKVYDALNVETGLVLEVQQQLGGGVVRCIAMGSSDGLKRGLSVTDTKKPISVPVGTKTLGRIMNVLGEPIDEKGEIGAEESWSIHRAPPSYVEQSNSTELLETGIKVIDLICPFAKGGKVGLFGGAGVGKTVNMMELIRNIAIEHSGYSVFAGVGERTREGNDFYHEMTDSNVLDKVSLVYGQMNEPPGNRLRVALTGLTMAEKFRDEGRDVLFFVDNIYRYTLAGTEVSALLGRMPSAVGYQPTLAEEMGVLQERITSTKTGSITSVQAVYVPDDDLTDPSPATTFAHLDSTVVLSRQIASLGIYPAVDPLDSTSRQLDPQVVGQEHYDVARGVQGILQRYKELKDIIAILGMDELSEEDKLVVARARKIERFLSQPFFVAEVFTGSPGKYVSLKDTIRGFKGILDGEYDHIPEQAFYMV

SEQ ID NO: 64069 - protein, 416 aa, Helicobacter hepaticus ATCC 51449
MVAFSLHFQTQHQKVCDTLFESICEERDSQKSGYYDLPFTEVAVDESSCFVNDNKAFLQTLSHLVIIGIGGSSLGLKAIDSMLEHLPHRNKLKLSFLEHTDPISITKSLQGIKRENTLFIVISKSGTTIETSSLLKFVLEEYNLLQNVQSKRHLLVITDRDSPLEHWAKVEKLTYFGIPPNVGGRFSVLSMVGILPLSILGFDTRAILRGAAGITQRFFERKEEHILHKALTYFTHKNHISMNVLFSYSSLFTHFNAWYVQLWGESLGKINAMGERVGLTPIALIGSIDQHSFLQLIVQGVRDKSVTFLSLNPTHSAQPSIPNLQIPFLESTNFVNTQSFATLLNNQRIATMQTIENEGILTDCIEVMSLCEESVGILIAYFEILTSCMGQLFEINTYDQPGVEFGKARLKKLFES

SEQ ID NO: 64070 - protein, 327 aa, Helicobacter hepaticus ATCC 51449
MAIKLAINGTGRIGLCAARIIGQRDDVELVAMNTTADIDTLVHLLRYDSVHRSYDIEKIDKQTLCIGKSKNVKIVSDRDPRNLDFGAAVGVLECTGKFNSLEKSSLHLKDNIKKVIISAPADDAPTFVYGVNHTNYQGQSVISNASCTTNCLAPIVKVLDSHFGIENGLMSTIHSYTNDQNLLDVKHKDLRRARAAALNMIPTSTGAAKAIGLVLPHLAGKLNGISVRVPTPDVSLVDLSVNLKSKVSKESINEAFYKAQEGAMKGLIIVDDEQRVSSDFIGSSASAIIVSDKSIAIDKSAKILAWYDNEMGYTHRLVDMSVYVCRT

SEQ ID NO: 64071 - protein, 444 aa, Mannheimia sp. P373
MATGKIVQIIGAVIDVEFPQDAVPKVYDALKVESGLTLEVQQQLGGGVVRCIALGSSDGLKRGLKVENTNKAIEVPVGTKTLGRIMNVLGEPIDEAGPIGEEERWTIHRAAPSYEEQANSTEFLETGIKVIDLVPPFAKGGKVGLFGGAGVGKTVNMMELIRNIAIEHSGYSVFAGVGERTREGNDFYHEMKDSNVLDKVSLVYGQMNEPPGNRLRVALTGLTMAEKFRDEGRDVLFFVDNIYRYTLAGTEVSALLGRMPSAVGYQPTFAEEMGVLQERITSTKTGSITSVQAVYVPADDLTEPSPATTFAHLDSTVVLSRNIASLGIYPAVDPLDSTSRQLDPLVVGEEHYNVARGVQGTLQRYKELKDIIAILGMDELSEDDKRLVARARKIERFLSQPFHVAEVFNGVPGKFVPLKETIRGFKGILEGEYDHIPEQAFYMA

SEQ ID NO: 64072 - protein, 583 aa, Arabidopsis thaliana
MEVQSSSNNGGHSSFSSLRVYLNSLSATPSRLSRRAISVSTSSDEMSRVRAVSGEQMRRTLRWYDLIGLGIGGMVGAGVFVTTGRASRLDAGPSIVVSYAIAGLCALLSAFCYTEFAVHLPVAGGAFSYIRITFGEFPAFFTGANLVMDYVMSNAAVSRSFTAYLGTAFGISTSKWRFVVSGLPKGFNEIDPVAVLVVLVITVIICCSTRESSKVNMIMTAFHIAFIFFVIVMGFIKGDSKNLSSPANPEHPSGFFPFGAAGVFNGAAMVYLSYIGYDAVSTMAEEVENPVKDIPVGVSGSVAIVTVLYCLMAVSMSMLLPYDLIDPEAPFSAAFRGSNGWEWVTKVVGIGASFGILTSLLVAMLGQARYMCVIGRSRVVPFWFAKIHPKTSTPVNASTFLGIFTAALALFTDLNVLLNLVSIGTLFVFYMVANALIFRRYVPVGPTKPWPTLCFLTLFSITSLVFTLIWKLVPEGKPKAFMLGASAVVAIAIVLSFQCVVPQARKPELWGVPFMPWTPCVSIFLNIFLLGSLDAPSYVRFGFFSGLIVLVYLFYGVHASSDAEANGSFGVKDGQVMKELIEV

SEQ ID NO: 64073 - protein, 423 aa, Myxococcus xanthus DK 1622
MTFASLGLSDALTRAVAGLGYDEPTPVQRATIPVVLRGGDVWASAKTGSGKTAAFLLPILEALRARPGGSVRPVRAFILVPTRELAAQIVDSIQRYGQHLKKPLKTCLAVGGVSANPQMLALRGGADIVVATPGRALDLVHQNALRLDQVETLVLDEADRLFSLGFADELNSLLALLPTRRQNLLFSATFPPAVRKFAEQLLHEPTRIDVDDGELPSTEFILQRALQVDVPRRTMLLRHLLETHAWSHVLTFVASRYTADHVALKLNRAGIVATSLHGELSQGARTRALADFKAKRVRVLVATDVAARGLDIAQLPAVVNYDLPRSTADYVHRIGRTGRAGDKGVAISFVSAGTEAHFRLIEKRHQLDLPREQVPGFEPTEEVSTTTPPRDPNGGVKGRRKSKKDKLREAAAAAATRPPKQGP

SEQ ID NO: 64074 - protein, 552 aa, Cryptococcus neoformans var. neoformans JEC21
MPSGAVTSEQIRASDIGTTILKAGGSAADAIIATVLAVNTLSPYHSDIGGGGFAIVKEPGDSGQVKCLDFRQCAPEGATPELFKTSNTSTSVGGLAVAVPGELKGLEELHKAYGTLPWSRLFKESIELAEGGMEVRGDLYDFITQEANPAGSSNMRGTWMMEDPTYTSLITKDGQAIPIGSIWKRPEYATTLRKIAAEGAAAFYQGEIAEGLVKAVRARDGVMTVDDLKNYKLKWREPLSTKFKDYTLYAPPAPASGAIWLSVMGMLSQFEPAGYGSVTDLHRLTEALRLAYGQRTALGDPAYIDGVEEKQRDWLTEKRIKARARMIDENHTKEPDYYKPPKVALDFDNGTSNITATDSSGLTISITTTVGLGWGSRIMVPGYGFVLNGSMDDFSVEGRPNGFGYEPQVTNYVAGGKRPLSSSCPYIITNSTGKVIASGGAAGGSTIISSNAQVALFVLVYGFSASQALAANRLHNQILPNVTKVERGSNVRGVRVEGFSEEQVEGLKQKGHVIEWVDKSFSTPCVMVWTDDGWEGDGDPRKHDSGGSVYHE

SEQ ID NO: 64075 - protein, 673 aa, Zea mays
MAAERFCVRNSGAQAVVEGIGDHGCEYMTGGTVVILGKTGRNFAAGMSGGIAYIYDVDGMFSTRCNHELVDLYSVDEEDDITTLRVMIEQHRLNTESVLAKYILSNFEDILPKFVKVFPRDYRRVLENMKAEKVAKEAEQKRRKKGWDKKAGEMIKAPNGVSVITKEVQNKKSSSRPTQVLNAEKPRGFVKYEREGISYRHENERIKDWDEVINELVCGPLINTQSARCMGCGTPFCHQYFKAVIYADIKRTSNIVLENFGAGCPLGNKIPEFNELVYQNRWREALYRLLETNNFPEFTGRVCPAPCEGSCVLGIIENPVSIKSIECAIIDKGFKEGWMVPCPPLHRTGMTVAIIGSGPAGLAAADQLNKMGHYVVVFERDDRIGGLMMYGVPNMKADKATIVQRRVDLMDKEGVKFIVNAHVGTDPRYSIERLQAENDAVILACGATRPRDLSIPGRELSGIHYAMDFLHANTKSLLDSNLEDGTDCIGTAIRHDCSNLVNLELLPEPSKERAPDNPWPQWPRIFRIDYGHQEAASKFGKDPRTYQILTKRFIGDENGKVRALEVVRVEWSKVDGRFQSKEIEGSQEIIEADLVLLAMGFLGPETDIAKKLGLEQDSRSNFKAEFGNFATNVEEGREAAAAVDKYLTREKTNADEDVAGPSSSGCLVQPVAA

SEQ ID NO: 64076 - protein, 250 aa, Listeria monocytogenes str. 4b F2365
MENTIVVKLGGVASDNLTEDFFQQIIQWQAANKKIVLVHGGGHYITKMMKSLAIPVETKNGLRVTNKATLEVTKMVLIGQVQPAITTAFQKRNISVIGLNAGDTGLLEADFLNDANLGFVGKITKVKTDLIEQLLSENIITVIAPLGINSEYDWLNVNADTAACEVASALQAEALYLLTDVPGVKKGSEIIGEIATDEIEKLQNAGVIKGGMIPKLASAAFAAENGVGKVIITDSLNTSGTKIKNKVAIG

SEQ ID NO: 64077 - protein, 448 aa, Oryza sativa Japonica Group
MTRKKERSGWGSLFRGCLSGGGAAGSRKVRPGPRTAAAAAAKHGGGASSAAAQRLSFTDVMSTASEQELSVSLVGSNLHVFTVGELKAATQGFLDGNFLGEGGFGPVYKGNVADKAKPGLKAQPIAVKLWDPEGAQGHKEWLSEVIFLGQLRHPNLVKLIGYCCEDEHRLLVYEYMAKGSLENHLFKKFPSMLSWSTRLNIAVGAAKGLVFLHDAEKPVIYRDFKTSNILLDPEYKAKLSDFGLAKDGPEGDDTHVSTRVMGTHGYAAPEYILTGHLTAKSDVYSFGVVLLEILSGRRAVDKTRPSREQHLVEHMRSWLKDPQKLSRVMDPALEGQYFATAAHKAALVAYKCLSGNPKNRPDMCQVVKDLEPLLNVTDDVSDESVAPIAPVREDNAVRKERTARRRPGERDGGKLRQSKMRSPQKVVRRRPGQSEEFWVWHMPGEVKC

SEQ ID NO: 64078 - protein, 452 aa, Pseudomonas fluorescens Pf-5
MRLERTSFGKRLGGYAQAVSLPGQPILEGRLLRMVGLTLEAEGLRAAMGTRCMVINDDSYHPVKVEAEVMGFSGSKVFLMPVGSVAGIAPGARVVPLADTGRLPMGMSMLGRVLDGAGRALDGKGAMRAEDWVPMDGPTINPLKRDPISQPLDVGIRSINGLLTVGRGQRLGLFAGTGVGKSVLLGMMTRFTEADIIVVGLIGERGREVKEFIEHILGEEGLKRSVVVASPADDAPLMRLRAAMYCTRIAEYFRDKGKNVLLLMDSLTRFAQAQREIALAIGEPPATKGYPPSVFAKLPKLVERAGNAEAGGGSITAFYTVLSEGDDQQDPIADSARGVLDGHIVLSRRLAEEGHYPAIDIEASISRVMPAVISPDNMARAQYFKQLWSRYQQARDLISVGAYVAGGDRDTDTAISLHPAMVAYLRQGLNDNISLGHSQTHLEMLFAPAAGG

SEQ ID NO: 64079 - protein, 475 aa, Aspergillus oryzae
MGPRYRSVAVIGTGPSGVSAVKALNDEKIFDTIRVFERRDRVGGLWHYDPIPDPFPTSTSSSVKQSKIPLSFPTFTPPVPEDTTARTAIYDTLDSNVGAGAMAFTHSSFPEVNSALSVRQYGKSNPSRPFRVVSSYLEDLFKEYLHLVSFNTTVERVEKEDDKWTITLRKRGQFHNNQPADYWWQEHFDAVVIASGHYNVPWIPDIAGLDQAASTHPTKFEHSKAFRSANDYVDKKVIVVGGSISSADLVADLHPIVKGPLYLSLRGKNEALQAAWDLPNVEGKPTIERVQTTERGINVIFADGSVVENVDKLIFATGFKLAYPFLSPNPTTPNNRVAGFYQHVFKIGDPSLALVGQVRAAISFRVYEYQAVAVARYFAGRNANALPSPQEQDLWEVERLKYKGPSSLFHEIKPDFKEYFDFLRDLAGPPAPGTTAYELPPWDDKWAELGFGVLGLKDQYWRSLKAAAEQVRAKL

SEQ ID NO: 64080 - protein, 159 aa, Mycobacterium avium subsp. paratuberculosis K-10
MNTTPRIGLGVDVHPIQPGRPCRLLGLLFDDADGCAGHSDGDVGAHALCDAVLSAAGLGDVGAVFGVDDPRWAGVSGADMLRHVADLTARHGFRVGNAAVQVIGNRPKVGPRRAEAQRVLSELLGAPVSVAATTTDGLGLTGRGEGLAAIATALVVPTG

SEQ ID NO: 64081 - protein, 478 aa, Acidobacteria bacterium Ellin345
MKIAVIGSGYVGLVSAACFAEIGHEVISVDNDHAKVNALRNGEVPIHEQFLPELLAKHRGKGLKFSTSVGDATAWADAVFITVGTPQSATGEADLSYVEAVAHEIATAIHGSKLVVEKSTVPVRTCEAIRKVLQLCGAPADLFSVASNPEFLREGSAVLDFLHPDRIVIGVDTEFSRGLMEQIYWPLTSGEYYKRSDALGAGPRFSECAPLIVTSPKSAELIKHASNAFLAMKISFINAVANIAESVGADIDEIRAGIGADSRIGNRFLNAGVGYGGSCFPKDVQAFHAVAQECGYRFGLLNEVIEINAEQRRRFILKVRSAVWTLRGKTLAVLGAAFKGGTDDIRESPAIAIVDELLAQGSSVRLFDPAALPKAKAVLGDSVQYASDAYDAATGTDALLILTEWPEFAQLDLERLRKAMKFPIIVDGRNLYRPSFMAKAGFAYHSIGRPELAAEKSAQGVRRDDWIYVNKSGAASAD

SEQ ID NO: 64082 - protein, 327 aa, Salmonella enterica subsp. enterica serovar Paratyphi B str.
MATRIEFHKHGGPEVLQTVEFTPAEPAEHEIQVENKAIGINFIDTYIRSGLYPPPSLPAGLGTEAAGVVSKVGNGVEHIRVGDRVVYAQSTLGAYSSVHNVPADKAAILPDAISFEQAAASFLKGLTVFYLLRKTYEVKPDEPFLFHAAAGGVGLIACQWAKALGAKLIGTVGSAQKAQRALDAGAWQVINYREESIVERVKEITGGKKVRVVYDSVGKDTWEASLDCLQRRGLMVSFGNASGPVTGVNLGILNQKGSLYATRPSLQGYITTREELTEASNELFSLIASGVIKVDVAENQRYALKDARRAHEVLESRATQGSSLLIP

SEQ ID NO: 64083 - protein, 534 aa, Rhodococcus sp. RHA1
MGMSLGMSTGASGVGSALVTTASNGSQNVEFRYLSADQAHTDLGDLVRSSISLMTTQVPADPTTPDAFAVAYRTAEQAHSIRSAVSRQRHRVHLVPETAATLTYLRHTGEVAQHATVAIVDFGESGLSVAVVDQVDGTVLHTDRTSRVSGTGIDDLVFHHVVGSLSTPHPLRHLDRDLLSARCRVAKEQLSSEPNAHVDIDLQGIRPIEISRTRFDEIAAPTVRVAVEFIRATVADSPRQPDALALVGGGANIPAITAAVTDAFAARVVVMPEPDTATAKGAALLAVSSAIRDYPATESNRPGSTAKVSGALVGALVVGGLVLGYGVKELAPAPDPNVSPAGTDMFQTTEQVTTTTTDEPPATRIPSYDPTPTSEFHPNQVAPPTSEPQTDRTSEQTPDSPSETTTPRTTTPVPTPTAPPRPTLPGTNPSQPSWPHIEWPAIPPLWPQVPGESTPNEPSPVAPAPDVPEAAPPPAETPAAPAEPSTPATPEGLFPMVPAPGTVAPNPDASQPSGAQPGAALTPPATQTVTIPVS

SEQ ID NO: 64084 - protein, 214 aa, Paeonia peregrina
  misc_feature (151)..(151): Xaa can be any naturally occurring amino acid
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVTIFGLGAVGLAAAEGARIAGASRIIXVDLNPKRFEEAKKFGVTEFVNPKDYNKPVQEVIAEMTGGGVDRSVECTGSIMAMISAFECVHD

SEQ ID NO: 64085 - protein, 214 aa, Paeonia peregrina
IVESVGEGVTDLKPGDHVLPVFTGECKECRHCKSEESNMCDLLRINTDRGVMLNDGKSRFSINGQPIFHFVGTSTFSEYTVVHVGCVAKINPEAPLDKVCVLSCGISTGLGATLNVAKPKKGSSVAIFGLGAVGLAAAEGARIAGASRIIGVDLNPKRFEEAKKFGVTEFVNPKDYNTPVQEVIAEMTGGGVDRSVECTGSIMAMISAFECVHD

SEQ ID NO: 64086 - protein, 113 aa, Triticum aestivum
RRVVFDTLGRRGGDSLLKMIHPDDLKQVLLHKGYTHLLIQMGRGTYKPSKASGNSSLQVEHYNYSPSITDNILEASLVISHASSSSIFETLRLSKPLILVVNQNLMDHHQSEL

SEQ ID NO: 64087 - protein, 445 aa, Azoarcus sp. EbN1
MDNGLTNAQWFLLVGGLLLVRGLTSSMIRRLPVTAAIIYLAVGLIVGPTVLNLFHFNPLKESALLEVLTEAAVLISLYAAGVKMPVPVSLARWRAPILLAFASMAVTVGLVAAFGHYALGLPLGAAVLLGAILAPTDPVLATDVQTRHPGDRDRLRFTLTCEAGMNDGSAFPFVMLGLGLLGLHELGDFGLRWALVDVVWATVAGLAIGVACGVTMAHVVARLRRAGAAHGLLDDFLGLGLIGIVYGLSVMANAWGFLAVFFAAVALRQTERKLAGAAPDKADRLQTADGAAHAAPVHDVPTLSEGSLIFKEHLERLSELLLILLIGGTLFVDSWSWRAVGMALFLFLVARPVSVMIGLVGTRTPWRIRGLAGWFGVRGIGSLYYLMYAIQHGLPKDVALELIHMTLIVVTLSVIFHGTSVKPLMERFWPEGRSAAIGPHRRGAG

SEQ ID NO: 64088 - protein, 362 aa, Methylococcus capsulatus str. Bath
MSGTPPSQPARHEHLSDDEFQAHFLDGVSRTFALTIPRLPEGLARPVSNGYLLCRIVDTIEDEVALTSTQKRRYCEHFARVVAGTAPAAPLADELFPLLSDQTLAAERELIAAIPRVISITHGFAAPQQEALAECVATMSRGMAEFQDKDLRHGLEDLRQMGDYCYYVAGVVGEMLTRLFCHYSPEIAAHRSRLMELACPFGQGLQMTNILKDLWDDHARGVCWLPQEVFTECGFSLTELRPHHANPDFVRGFERLIGVAHAHLRNALEYTLLIPRHETGIREFCLWALGMAVLTLRKIHRHPYFSDSAQVKITRQAVKATIVTSRLTRGSDTLLKATFRLAGLGLPAAVPAAVLQPRPIDI

SEQ ID NO: 64089 - protein, 501 aa, Arabidopsis thaliana
MFNYVIILPLALFLLAYKFFFTSKKQRYYLPPSPSYSLPILGHHLLIKPPVHRLFHRLSNIHGPIFYLRLGSRRAVVISSSSLARECFTGQNDVIVSNRPRFLTSKYIAYNYTTIATTSYGDHWRNLRRICSLEIVSSKRLANFLHIRKEEIQRMLTRLSRDARVGKEVELESILYDLTFNNIVRMVTGKIYYGDDVSDKEEAELFKKLFTFITTNSGARHPGEYLPFMKIFGGSFEKEVKAAAKVIDEMLQRLLDECKSDKDGNTMVNHLLSLQQDDPEYYTDIIIKGLMLGIMVASSETSALTIEWAMASLLNHPKVLDKVKLEIDEIIGQDRLIEESDIANLPYLQNVVSETLRLHPAAPVLVPRSTAEDIKIGGYDVPRDTMVMVNAWAIHRDPDLWTEPERFNPERFNGGEGEKDDVRMLIAFGSGRRICPGVGLAHKIVTLALGSLIQCFDWKKVNEKEIDMSEGPGMAMRMMVPLRALCKTRPIMNKLPAYTKV

SEQ ID NO: 64090 - protein, 369 aa, Rhodobacter sphaeroides 2.4.1
MANPSLLILAGDGIGPEVMAEVKRIIGWFGEKRGVSFDVSEDLVGGAAYDAHGTPLADETMARAQEVDAVLLGAVGGPKYDVLDFSVKPERGLLRLRKEMDLYANLRPAQCFDALADFSSLKRDIVAGLDIMIVRELTSGVYFGEPRGIFPDNEGGRFGVNTQRYTTEEIRRVARSAFELARRRNNRVCSMEKANVMESGILWREEVQWVHDNEYPDVELSHMYADNGAMQLVRWPRQFDVIVTDNLFGDILSDCAAMLTGSLGMLPSASLGAPMANGRPKALYEPVHGSAPDIAGQGKANPIACILSFAMALRYSFDMGEEATRLEKAVETVLADGVRTADLMGPEGGTPVSTSGMGDAVLAALDASL

SEQ ID NO: 64091 - protein, 297 aa, Rhizopus niveus
DDNLVGGMTLDLPSDAPPISLSSSTNSASDGGKVVAATTAQIQEFTKYAGIAATAYCRSVVPGNKWDCVQCQKWVPDGKIITTFTSLLSDTNGYVLRSDKQKTIYLVFRGTNSFRSAITDIVFNFSDYKPVKGAKVHAGFLSSYEQVVNDYFPVVQEQLTAHPTYKVIVTGHSLGGAQALLAGMDLYQREPRLSPKNLSIFTVGGPRVGNPTFAYYVESTGIPFQRTVHKRDIVPHVPPQSFGFLHPGVESWMKSGTSNVQICTSEIETKDCSNSIVPFTSILDHLSYFDINEGSCL

SEQ ID NO: 64092 - protein, 145 aa, Glycine max
VAEKYPEITYEEVIIDNCCMTLVKNPGTFDVLVMPNLYGDIISDLCAGLIGGLGLTPSCNIGEGGICLAEAVHGSAPDISGKNLANPTALMLSAVMMLRHLQFNDQADRIHNAILQTIAEGKYRTADLGGKSSTSDYTKAVCDHI

SEQ ID NO: 64093 - protein, 365 aa, Salinibacter ruber DSM 13855
MDDTRSYDIAWLPGDGIGPEVTREALRVLEAVGSAHGFSVTATEHRMGGVALDETGMPLPDSTRDACLESDAVLLGAVGGPKWADNTGDQRPESGLLALRKALGVYANLRPVRVPAALADASPLRPDRVGGTDILFVRELTGGIYFGTPEGRTDDGARSTMAYSDDEIERIAHVAFQRARRRDGNVTSVDKANVLEVSELWREVVTEVHDDCPDVTLRHLYVDNAAMQVVRDPRQFDVVLTGNLFGDILSDLAAALPGSLGLLPSASVGGTVGLFEPVHGSAPDIAGQDVANPTAAILSAALLLDEVGETAAADAVRHGVDAALDAGFRTADLAADNEEDASTSAFGREVATRAADSVPQNAPTP

SEQ ID NO: 64094 - protein, 169 aa, Triticum aestivum
MAPTVMASSATSVAPYQGLKSTAGLPVSRRSNGASLGSVSNGGRIRCMQVWPIEGIKKFETLSYLPPLSTEALLKQVEYLIRSKWVPCLEFSKVGFIFREHNTSPGYYDGRYWTMWKLPMYGCTDSTQVINEVEEVKNEYPDAYVRIIGFDNMRQVQCVSFIAFKPPGC

SEQ ID NO: 64095 - protein, 106 aa, Malus x domestica
TDVPAPDMGTNAQTMAWILDEYSKFHGHSPAVVTGKPIDLGGSLGREAATGRGVVFGTEALLAEYGRSCKGLTFVIQGFGNVGSWAAKLIHEKGGKVIAVSDITGA

SEQ ID NO: 64096 - protein, 458 aa, Pseudomonas fluorescens
MTTTSSSLADKDMRHQLHPYTNARAHEELGPLVIDRGDGVFVIDENGKPYIEAMAGLWSAALGFSNKRLVAAAEKQMSTLPFYHLFGHKAHAPSIELAEKLINMAPVPMSKVFFTNSGSEANDTVIKLVWYLNNAQGKPARKKIISRIGGYHGITLASASLTGLLANQRGFDVPLPGFLHVGCPHHYRHALPHETEEQFADRLAAELDALIVKEGPETIAAFVGEPLMGPGGVIVPPRTYWEKIQRVCRKHDILVVADEVICGFGRTGKDVRQPDFGIEPDIMILSKQLSSSYQPISAILINDRVYQGIADQTKSFGALGHGFTGGGHPVAAAVRLENLKIIDEENLVVHAAHMGELLRRGLQGFSDHPLVGEVRGAGLIAAVELVADRATKAPLDAPGTLGRFLAGRAQEHGMITRNLGDAIAFCPPLIINEDEDEVQSIVDRFGMALDDTSKWVNG

SEQ ID NO: 64097 - protein, 181 aa, Listeria monocytogenes str. 4b F2365
MAERLVGTQAPRFEMEAVMPNQTFGKVSLEKNIEDDKWTILFFYPMDFTFVCPTEIVAISARSDEFDALNARIIGASTDTIHSHLAWTNTPIKEGGIGRLNYPLAADTNHQVASDYGVLIEEEGVALRGLFIINPKGEIQYEVVHHNNIGREVDEVLRVLQALQTGGLCPINWQPGEKTIV

SEQ ID NO: 64098 - protein, 394 aa, Oceanicola granulosus HTCC2516
MIPSILPTYNRAPLSFEKGAGSWLWTTDGRRFLDLGAGIAVNALGHAHPALVETLTEQAGKVWHLSNLFEIPQQTRLADLIVDKTFADTVFFTNSGTESCELAVKMARRYWSDRGAPERSRILTFTGAFHGRSSAAIAAAGSEKMTKGFGPLLPGFTVLPFGDHDTLREAAAAPDIAAILVEPIQGEGGIRVLPDVCLKGLRDLCDETGALLIFDEVQCGVGRTGKLFAHEWAGVAPDIMMIAKGIGGGFPLGAVAATEAAARAMTAGTHGSTYGGNPLGCAIGARVLEIVGDDAFLAEVNRKAGALRQRLEGLVAAHPEVFEEVRGTGLMLGLKCKPPAADLVAAGYAEEVLTVAAADNVVRLLPALNISDEDIAEAAARLDRAAARLETAAA

SEQ ID NO: 64099 - protein, 308 aa, Oceanicola granulosus HTCC2516
MTHFLDIHCTDPAQLRGIIDAARAMKDARAGRPKGTPDDETPLAGRMVALIFEKPSTRTRVSFDVGVRQMGGETMVLSGSEMQLGHGETIADTARVLSRYVDLIMIRTFEEQTLLEMAEYADVPVINGLTNRSHPCQIMADIMTFEEHRGPIRGRKVVWSGDGNNVFTSFAHAAGQFGFDLTFTGPPPLEPERELLEEVRAAGGKVEVVRDPAEAVAGADLVVTDTWVSMHDPQSARERRHNQLRGYQVNAALMARAKPDALFMHCLPAHRDDEATSEVMDGPHSVIFDEAENRLHAQKAIMRWCLGA

SEQ ID NO: 64100 - protein, 178 aa, Malus x domestica
LPKHFTIYGYARSKMTDAELRDMVSKTLTCRIDKRENCGEKMDQFLQRCFYHSGQYDSQDHFAELDKKLKEHEVGRVSYRLFYLSVPPNMFIDAVRCASSSASSGNGWTRVIVEKPFGRDSESSAALTKALKQYLEEDQIFRIDHYLGKELVENLSVLRFSNLIFEPLWSRQYIRNVQ

SEQ ID NO: 64101 - protein, 257 aa, Saccharophagus degradans 2-40
MNTNTKRKPIVIANWKLNGGLELICTSVASFIGKHFEADIAICPPYIYMRDMLTFLQHSEISIGSQNVSKFKSGAYTGETSAQMLKEAGCKLCLIGHSERRSMFKENNLSCQIKIGNALNHGLMPILCVGENKEEHDAKITKDVIFRQVTECLEGVELDGRKICIAYEPIWAIGTGASATPEIAQDVHSFIRQELIKLYGEETANSIRLLYGGSVTKDNAKDLLAKEDVDGLLVGGASLDPGHFLAICQHASDSSAS

SEQ ID NO: 64102 - protein, 354 aa, Podospora anserina
MGSCMSTSGEESEQRKRSNKIDRDLEEDSKRLRRECKILLLGSGESGKSTIVKQMKIIHLKGYSHEELKNYRPTVFKNLLECAKSVASAMRQFDIEPVLDENKRHLDFLIDYSLDTNPQTIDAKVSVAIQSLWNDPAKEQLMERQTEFYLMDSAEYFFDEAARIAHKEYIPNEMDVLRARTKTTGIYETRFKMGQLSIHMFDVGGQRSERKKWIHCFENVTSIIFCVALSEYDQVLLEESSQNRMMESLLLFDSVVNSRWFMRTSIILFLNKVDIFKQKLGRSPLSNYFPDYSGGNDVNKAAKYLLWRFNQVNRAHLNLYPHLTQATDTSNIRLVFAAVKETILNNALKDSGIL

SEQ ID NO: 64103 - protein, 354 aa, Thermoplasma volcanium GSS1
MQIESQSPTDVVASYKAKIDESISRFFDRKEEETKDVLSKRVIKIIRDYTEGGGKRLRPIFMILGYRLFSPEEKGIFDASISIELAQSYLLIHDDVIDKSDVRRGKPSMHIRLEDAFVAGCPQSRSTAEGLAIVAGDLAESYAHEALLRSGFYSENLVKADLELSKTIEMTGYGQFLDILSTTMDDFNEGDLIRLHLWKTAKYTLEGPLAMGAILSGTEYDITALREYGRVLGIAFQLKDDILGLFGDEKTIGKSVYSDVNEGKKTLLMIKAMEWGDRDDANFIRKMLRKGNVTNEEFERIKKLVMDTGSYDYSINLMGKLVDKSKEYLAKVSGDNYVKKILDWLSDYLISRDH

SEQ ID NO: 64104 - protein, 211 aa, Thermoplasma volcanium GSS1
MLVSPSIVAASLTKFQAQVKECEDAGAYSFHLDVMDGNFVPNITVGPDFYFALRSISKIPIDTHLMVDRPDYYYEKFLSQNDRVLIHYESPINIKGLIKKMENEGVKYGLVINPNTPFSKVSDLLERAEILLIMSVYPGFSGQKFIDVSEKIKEARNYIKEMGLRTMIEVDGGINENTAKIVKNAGADIVVSASYLFSGDITDRIKTLSSI

SEQ ID NO: 64105 - protein, 416 aa, Xylella fastidiosa Dixon
MDRINTSAAPPTSPDWERLRADFPLLQRHVHGKPLIYFDNANTAQKPQAVITATDTFYRRHNANISRAVHTLGTEATEAYEATRAALATLLNVPMHELVLCSGTTFAINLIAYSWALPRLRTGDVILVSRMEHHANIVPWQLIAERTGARIQVADILPNGTLDLDALHTLMTPQVKLLAITHVSNVLGTVNPIHHICRQARQRGITTVVDGSQAAPHRHIDIPAIGCDFYAITGHKLYGPTGTGALWARREHLHIMPPFLGGGEMIKEVSFDGTLFNTPPHKFEAGTPNIAGFIGLSAAVDYVRRIGIDQIETRETELLAHLTEELQKIDGMRLFGTAPNKAAVVSFMIEGTHAHDLATLLDLEGVAVRSGQHCAHPLLQYYGVTATCRASLAFYNTHEEIERFITALLKVRKLLG

SEQ ID NO: 64106 - protein, 132 aa, Brassica napus
MASSASTLEIEARDVVKIVLQFCKENSLQQTFQTLQNECQVSLNTVDSIDTFIADINAGRWDAVLPQVAQLKLPRKKLEDLYEQIVLEMAELRELDTARAILRQTQVMGVMKQEQPERYLRLEHLLVRTYFN

SEQ ID NO: 64107 - protein, 345 aa, Burkholderia vietnamiensis G4
MIATRILRRPRALIVGCGDVGLRCVAQWRAARRDLRIVALTSHPDRRDALRAAGVTPIVGNLDQRATLERIARVARTILHLAPPQSDGRDDRRTRALIAALSMPARRLHAPAVASVGRLRTLRAATRQAGVVPRAARIVPEALRAPTLVYASTTGVYGDCGGARIDETQPLRPANPRAFRRVSAERQLRAATVRGVVSARIVRIPGIYAANRLPLARLERGTPALLPADDVYTNHIHADDLAAILRRAAVRGRPARAVHASDDSELRMGEYFDRVAQAFGLPPPPRISRADAEGRLEPTLLSFMRESRRLSNARLKAELCVTLRYPTVDEFLQTLAQRRASGEGR

SEQ ID NO: 64108 - protein, 455 aa, Oryza sativa Indica Group
MPLNPSSSASFLLSSLRRSLVASLRKASPAAAAALSPMASASTVAAENGAAKAAAEKQQQQPVQSTLGPGVTVAKRLEKFKTTIFTQMSMLAIKHGAINLGQGFPNFDGPDFVKEAAIQAINAGKNQYARGYGVPELNSAIAERFLKDSGLQIDPEKEVTVTSGCTEAIAATILGLINPGDEVILFAPFYDSYEATLSMAGANVKAITLRPPDFSVPLEELKAAVSKNTRAIMINTPHNPTGKMFTREELEFIATLCKENDVLLFADEVYDKLAFEADHISMASIPGMYERTVTMNSLGKTFSLTGWKIGWAIAPPHLTWGVRQAHSFLTFATCTPMQAAAAAALRAPDSYYEELRRDYGAKKALLVNGLKDAGFIVYPSSGTYFVMVDHTPFGFDNDIEFCEYLIREVGVVAIPPSVFYLNPEDGKNLVRFTFCKDDETLRAAVERMKTKLRKK

SEQ ID NO: 64109 - protein, 361 aa, Tagetes erecta
MSLVNPTSLFYGSPIMTRSPIFLNPTRKSQPVSSFSASNFPQISAILTKEHQSNAPEDKIKETQSKFEFDFKSYMLEKANLVNQALDLAVPLKDPIKIHESMRYSLLAGGKRVRPVLCIAACELVGGDGLTAMPAACAVEMIHTMSLMHDDLPCMDNDDFRRGKPTNHMVYGEEIAVLGGDAMLSFAFEHMATATKGVSSDRILRAIGELAKCIGSEGLVAGQVVDICSEGADVGLEHLEFIHLHKTAALLEGSVVLGAILGGGSDGEIEKLRKFARSIGLLFQVVDDILDVTKSSEELGKTAGKDLVSDKTTYPKLLGIEKSREFAEELNKDAQEQLSEFDPRKAAPLIALANYIAYRQN

SEQ ID NO: 64110 - protein, 537 aa, Oryza sativa Japonica Group
HGGGAPVRGRRAGLAGGRRSPQGGEGAAAAVVLNKDDAASVAAAAASSATGFTVAMKFGGSSVASAERMREVADLILSFPEETPVVVLSAMGKTTNNLLLAGEKAVSCGAPKASEIPELAVIKELHVRTIDELGLDRSIVSGLLEELEQLLKGVAMMKELTPRTRDYLVSFGECMSTRIFAAYLNKLGKKARQYDAFDIGFITTDDFTNADILEATYPAVAKRLQGDWIDDPAIPIVTGFLGKGWKSCAVTTLGRGGSDLTATTIGKALGLREIQVWKDVDGVLTCDPNICANAIPVPYLTFEEAAELAYFGAQVLHPQSMRPAKEGDIPVRVKNSYNRRAPGTVITKTRDLSKSILTSIVLKSNITMLDIVSTRMLGQYGFLAKVFSIFEDLGISVDCVATSEVSISLTLDPSKLWCRELIQQELDHVVEELEKIAVVHLLQHRSIISLIGNVQRSSLILEKAFNVLRRNGVNVQMISQGASKVNISLVVHDSEAKQCIQALHSAFFENGFLSEVEEEDLQHNGSPVSPNGVIYGN

SEQ ID NO: 64111 - protein, 320 aa, Prochlorococcus marinus str. MIT 9215
MKKRIGLGTWSWGNKLFWDYQSTNDNDLRETYDEALRRGFDLIDTADSYGTGNLQGRSELLIGKFLLNTSSAKKKRIQVATKLAPYPWRIGDRGFNKPFFKSLERLNKKLDIVQLHWSTAKYNPWQELDLLNNLCDLKDQGFDFQIGLSNIGPRRLKKLINFLVKRDQRLKSVQIQFSLLAPDLNKQYKVKKICEENNIEFLAYSPLSFGILCIDPDKEENKEKSFIRNALFESYKKPTYELRRCLKRIANQRSVSQAQVAINWCCYQGAIPIVGMRKKSQVIDVSNIFKWDLNKNEFIALQEVSKNCLKKMPKNPFSSI

SEQ ID NO: 64112 - protein, 430 aa, Clostridium difficile 630
MSVIELVYAREVLDSRGNPTVEVEVVLEDGAMGRAIVPSGASTGAFEAVELRDGDKGRYLGKGVETAVANVNEIIAPEIEGMDAFDQPAIDAIMIELDGTPNKGKLGANAILGVSMAVARAAADEIGLPLFQYLGGVNAKQLPVPMMNILNGGEHADNNVDVQEFMILPVGACCFKEGLRMGAEVFHSLKKVLGEKGLACGVGDEGGFAPNLGSNREALELIVEAITKAGYKPGEDVMLGLDVAATEMYNKETKKYVLAGEGKELTAAEMVALYEDWSNNFPIITIEDGLDEEDWDGWKLLTEKLGNKLQLVGDDLFVTNTERLEKGIENGVANSILVKVNQIGTITETLDAIEMAKRAGYTAVISHRSGETEDSTIADLAVAVNAGQIKTGAPSRTDRVAKYNQLLRIEEMVGEQARYCGLKSFYNLKK

SEQ ID NO: 64113 - protein, 178 aa, Alteromonadales bacterium TW-7
MAIRSYKGITPAFNKSVYIDESSVLVGDITIGDDSSVWPLVAARGDVNHIRIGERSNIQDGSVLHLSRATKSNPDGYPLIIGDDVTVGHKVMLHGCVLGNRILVGMGAIVMDNVIVEDDVIIGGGSLVPPNKRLESGYLYVGSPAKQARPLTEQELAFLKISADNYVQLKDEYLAEAN

SEQ ID NO: 64114 - protein, 288 aa, Oryza sativa Indica Group
MARARRGRQNAAASPPSLALQLQVASLVIVFVFAFSSAITPTRADHVEGHMSREMFGYENDATGPAKWGSLHKEWAVCGDGKKQSPIDITTVEPQKVKEPLMQAYKAGATTIQNRGHDYMLKWKDGNSKLTVQGKEYTLKQVHWHEPSEHTINGTRFDAEMHMVHEDPSMARAVVSVLLSTKAGQPNAVLTEMAPHFKNLAGKEKAEEEVKEPVDPSTWVDKTSGYYRYDGSLTTPPCTEGVIWTIMSKIGDASKEQIDLLKTVVTTVEPNARPAQKLNDRIVRYFEV

SEQ ID NO: 64115 - protein, 510 aa, Clostridium difficile 630
MMKKPVALIIMDGFGYNKDVKGNAIAESKTPNLDRIKKEYPNTLINASGLDVGLPDGQMGNSEVGHTNIGAGRIVYQDLTRITKSIKDGDFFTNKVLCEAMDNAKENSLHVMGLLSDGGVHSHIDHLKAIIKMAKDKGVQKVYVHAFTDGRDTDPQSALEYAKEVQASMDEIGVGEFATVSGRYYAMDRDKRWERVELAYNAMVRGIGEKANSIEEAIQNSYDDGKNDEFIMPTVIMKDDKPVGSIKENDSIIFFNFRPDRARQITRALVCEEFDGFKREDIKNFFVCLTEYDITIENVHIAFGPQSLANTLGEYLAKNGKTQLRAAETEKYAHVTFFFNGGVEEPNKGEERLLIPSPKVATYDLKPEMSAYELTDKALDKLGEDKFDFIVLNFANPDMVGHTGSIEAAIKAVETVDTCVGKLIDKIVELGGSAIITADHGNAEYMLDPETGKTVTAHSINPVPFIVVGQEYESAKLLDGGRLSDIAPTILDMMKLEKPEEMTGHSLISK

SEQ ID NO: 64116 - protein, 247 aa, Clostridium difficile 630
MRKPIIAGNWKMHKTIKEALEFVNEIKDKVNSDKVEAVICAPFTLLKDLKEATKGTNIKIGAQNMHFEEKGAFTGEVSPLMLKEIDMDYVVIGHSERRQYFNETDETVNKKVLKALEVGIDPILCVGETLEQREAGKTKDVCKVQVEKALENVLKDDLAKVVVAYEPIWAIGTGKTATAEDANDVISYIREVIKGLYGELANEVRIQYGGSVKPSNVAEIMGQSDIDGALVGGASLASNDYLDLVNF

SEQ ID NO: 64117 - protein, 400 aa, Clostridium difficile 630
MSMLNKKTIEDIDVCGKKVLVRCDFNVPLQDGVITDENRLNGALPTIQYLISKGAKVILCSHLGKPKGEAKPELSLAPVAKRLSEMLGKEVVFAADDNVVGENAKKATEKMENGDVVLLENTRYRKEETKNEENFSKELASLAEIFVNDAFGTAHRAHCSTVGAGEFLQERVCGYLIQKELKFLGEAVANPVRPFTAILGGAKVSDKLAVINELLEKVDNLIIGGGMAYTFLKAQGYEVGTSLLEIDKVEYAKEMMEKAKNKGVNLLLPVDVVMADHFAPDATPIVTEDANVKEDYMGLDMGPKTIANFVKTIKESKTVVWNGPMGVFEFENFANGTLSVARAMAELTDATTVIGGGDSAAAVNQLGFGDKMTHVSTGGGASLEFLEGKELPGIAALDNK

SEQ ID NO: 64118 - protein, 530 aa, Nicotiana tabacum
MGDIEGEPGSSMHGVTGREPVLAFSVASPMVPTDTTAKFSVPVDTEHKAKIFKFYSFSKPHGLTFQLSWISFFTCFVSTFAAAPLVPIIRDNLNLTKMDVGNAGVASVSGSILSRLVMGAVCDMLGPRYGCAFLIMLSAPTVFCMSFVSSAGGYVAVRFMIGFSLATFVSCQYWMSTMFNSQIIGLVNGTAAGWGNMGGGATQLIMPIVYDIIRRAGATPFTAWRIAFFIPGWLHIVMGILVLTLGQDLPDGNRGDLQKKGDVSKDKFSNILWYAATNYRTWIFVLLYGYSMGVELSTDNVIAEYFFDRFDLKLHTAGIIAATFGMANLLARPFGGFSSDYAAKRFGMRGRLWVLWILQTLGGVFCVLLGRSNPLPIAVTFMILFSIGAQAACGATFGIIPFISRRSLGIISGMTGAGGNFGSGLTQLLFFTSSKYSTATGLTYMGLMIIGCTLPVTFCHFPQWGSMFFPPTKDPVKGSEEHYYAAEYTEAERQKGMHQNSLKFAENCRSERGKRVGSAPTPPNLTPNRV

SEQ ID NO: 64119 - protein, 390 aa, Arabidopsis thaliana
MENGNSSSDNKSSHKPIRCKAAVSRKAGEPLVMEEIMVAPPQPFEVRIRIICTALCHSDVTFWKLQVPPACFPRILGHEAIGVVESVGENVKEVVEGDTVLPTFMPDCGDCVDCKSHKSNLCSKFPFKVSPWMPRYDNSSRFTDLNGETLFHFLNVSSFSEYTVLDVANVVKIDSSIPPSRACLLSCGVSTGVGAAWETAKVEKGSTVVIFGLGSIGLAVAEGARLCGASRIIGVDINPTKFQVGQKFGVTEFVNSMTCEKNRVSEVINEMTDGGADYCFECVGSSSLVQEAYACCRQGWGKTITLGVDKPGSQICLDSFDVLHHGKILMGSLFGGLKAKTHIPILLKRYLSNELELDKFVTHEMKFEEINDAFQLLLEGKCIRCVLWMG

SEQ ID NO: 64120 - protein, 302 aa, Cryptococcus neoformans var. neoformans JEC21
MTSPPLPFYLLNAFAPTFHSGNQAAVVFFDSASHPQSTDEQFMTLVARDFNFAETAYLIPLEGNGEGCVGKYGLRWFTPEEEVALCGHATLAASQAVFSINPDFETIEFTTRFSGVLTARKIESKQVEITLPSLPKNVLEAFDGKSSKEDLRKVSSVFGVKEEEIVAVSPFAFGTRSSVIVSLAPEVDLAKVEASEANLLAFSDGMIIVTQVAREQPDDQLHINSRVFAPGLGVIEDPVAINPYLEIADRIRPCLSHWVLRKFTIDCQASPEKVCRQPAHDCTQWDTVEQKRRKTHLYMGRL

SEQ ID NO: 64121 - protein, 335 aa, Clostridium difficile 630
MVKVAINGFGRIGRLALRKMMEQQDKFEVVAINDLTDAKMLAHLFKYDTAQGRFNGEIEVKEGAFVVNGKEIKVTAERNPADLPWAELGVDIVLECTGFFTSKDKAEAHIQAGAKKVVISAPATGDLKTIVFNTNSDILDGSETVISGASCTTNCLAPMAKVLNDKYGIEKGLMTTIHAYTNDQNTLDGPHPKGDLRRARAAAGNIVPNTTGAAKAIGLVIPSLKGKLDGAAQRVPVVTGSITELVCTLGKNVTVEEINAAMKEASNESFGYTEEMLVSSDIIGISYGSLFDATQTKVMEVDGKQLVKVVSWYDNEMSYTSQLIRTLGYFAQLAK

SEQ ID NO: 64122 - protein, 530 aa, Nicotiana tabacum
MVDIEGSPGSSMHGVTGREPVLAFSVASPMVQTDTTAHFKVPVDSEHKAKVFKFYSFSKPHGLTFQLSWISFFTCFVSTFAAAPLVPIIRDNLNLTKMDVGNAGVASVSGSILSRLAMGAICDMLGPRYGCAFLIMLSAPTVFCMSFVSSAGGYVAVRFMIGFSLATFVSCQYWMSTMFNSQIIGLVNGTAAGWGNMGGGATQLIMPILYDIIRRAGATPFTAWRIAFFIPGWLHVIMGILVLTLGQDLPDGNLASLQKKGDVSKDKFSKILWYAATNYRTWIFVLLYGYSMGVELTTDNVIAEYFFDRFDLKLHTAGIIAATFGMANLLARPFGGWSSDIAAKHFGMRGRLWNLWILQTLGGVFCFLLGKANTLPMAIAWMIIFSLGAQAACGATFGIIPFISRRSLGIISGMTGAGGNFGSGLTQLLFFTTTKWSTETGLSYMGIMIIACTLPVSLVHFPQWGSMFLPPTKDPVKSTEEHYFTSEYTEAEKQKGMHQNSIKFAENCRSERGKRVGSALTPPNVTPNRV

SEQ ID NO: 64123 - protein, 257 aa, Rhizobium sp. NGR234
MTSSALPRTPSFRLDGKTALVVGASSGIGQAAAVALAEAGANVTLAARSIDKLERTVEALQHMELSATALALDVEDVEATELTIESGAAFDILVNSAGLACHGPALETTIADFDTVMGINVRGAYFVTRAVARKLVATGRTGSLINISSQMAHVGGIDRAVYSATKHAVEGFTKSMAIEWGMHGIRVNTICPTFIRTPLAERTFANPERVRWIEEKIKLGRIGELEDIMGPVTFLASEAAAMITGSALMVDGGWTAD

SEQ ID NO: 64124 - protein, 254 aa, Populus alba x Populus grandidentata
TNYRTWIFVLLYGYSMGVELSTDNVIAEYFYDRFDLKLHTAGVIAATFGMANLVARPFGGYSSDVAARYFGMRGRLWVLWILQTLGGVFCIWLGRANSLPLAVTAMILFSIGAQAACGATFGIIPFISRRSLGIISGLTGAGGNFGSGLTQLVFFSSTSLSTAAGLSWMGVMICGCTLPVALVYFPQWGGMFFPPSKDVVKSTEESYYASEWDEDERQKGMHQQSLKFAENSRSERGNRIASAPTPPSTTPNRV

SEQ ID NO: 64125 - protein, 352 aa, Prochlorococcus marinus str. MIT 9215
MSLSNTSANKNGPNSVPSERLWLRSELMGTQVITTDTGRRLGVVGEVVVDIDRREVVALGLRDNPLTRFLPGLPKWMPLESIKQVGDVILVDSLDSLSESFSPERYGKVINCQVITESGQLLGRVLGFSFDIETGDLISLVMGAVGVPLLGEGVLSTWEIPVEEIVSSGTDRIIVYEGAEEKLKQLSSGLLEKLGVGGSSWDEREANGYSANLVPVENQLLSGSESEGQQNIMVEQYEEVLEQDDYEDDYEDDYEDELEYVEIKSSADEKNNRKKLYMDNDYSDQTQNQNSVYQIDEKNNIDFKQNKESTTNLASKRPIQNATETLDIEPLDEKNLVQDNKKSDKFEIDDPW

SEQ ID NO: 64126 - protein, 587 aa, Aspergillus oryzae
MPRSRQPARFSSEAPSESSSSTSPDRNVDDDTDFFTAQANDSQSSVGGIATSRDVHAQNEHYVLPPIGRLPPELLIAIFAKLSSPADMLSCMLVCRGWAANCVGILWHRPSCSNWVNMKSITMTVGKEDSFFSYSDLIKRLNLSALMEEVSDGTVVPFAQCNRIERLTLTNCSKLTDKGVSDLVEGNRHLQALDVSDLRSLTDHTLYTVARNCPRLQGLNITNCVKVSDDSLIVVSENCRHIKRLKLNGVIQVTDRAITSFARNCPAILEIDLHDCKSVTNRSVTSLMATLSNLRELRLAHCTEINDLAFLELPKQLSMDSLRILDLTACENIRDDAVERIISSAPRLRNLVLAKCRFITDRAVWAICKLGKNLHYIHLGHCSNITDAAVIQLVKSCNRIRYIDLACCVRLTDRSVQELATLPKLRRIGLVKCTLITDRSISALARPKASPHSSISSLERVHLSYCVNLTMPGIHALLNNCPRLTHLSLTGVQEFLRDELTKFCREAPPEFTHQQRQVFCVFSGDGVKQLRDHLNRTVPPAREMNEATMYDDDEELDEDEGQVTGLMHATAINDDDDDYIDIGHPQG

SEQ ID NO: 64127 - protein, 301 aa, Shewanella oneidensis MR-1
MNKLTDFERYVIEEKGTERPFSGQYYQHDAKGVYLCKKCHTPLYRSEDKFNAHCGWPAFDDEIPGAVSRHIDADGRRTEIVCSQCGGHLGHVFEGEFLTPKNIRHCVNSVSMLFKAQDEAEDIAPKHAFATFGAGCFWCVEAIFKSLKGVLNVRSGYSGGEASDADYKSVCSGQTGHAEVVHIEFDPEQIAFTTLLQVLFESHDPTTLNRQGNDKGPQYRSVVFAHDATQVDEANAMIAKLTEARVFDAPIVTQVVAFESFYPAEAYHNDYFALHGEQPYCQIVVRPKVEKIRALFAELQV

SEQ ID NO: 64128 - protein, 76 aa, Zea mays
  misc_feature (23)..(23): Xaa can be any naturally occurring amino acid
MTCPNHLAPGNGIIPTRGHFFCXDGRIKAASQIIMAPTLDLRQQALDRFLPNKRSDFKGIFRPLDGLPVTIQLLNL

SEQ ID NO: 64129 - protein, 158 aa, Brassica napus
  misc_feature (12)..(12): Xaa can be any naturally occurring amino acid
  misc_feature (14)..(16): Xaa can be any naturally occurring amino acid
  misc_feature (19)..(19): Xaa can be any naturally occurring amino acid
  misc_feature (21)..(22): Xaa can be any naturally occurring amino acid
  misc_feature (26)..(26): Xaa can be any naturally occurring amino acid
  misc_feature (32)..(32): Xaa can be any naturally occurring amino acid
  misc_feature (35)..(35): Xaa can be any naturally occurring amino acid
  misc_feature (50)..(50): Xaa can be any naturally occurring amino acid
  misc_feature (54)..(55): Xaa can be any naturally occurring amino acid
  misc_feature (57)..(57): Xaa can be any naturally occurring amino acid
  misc_feature (60)..(62): Xaa can be any naturally occurring amino acid
  misc_feature (65)..(65): Xaa can be any naturally occurring amino acid
  misc_feature (92)..(92): Xaa can be any naturally occurring amino acid
  misc_feature (94)..(94): Xaa can be any naturally occurring amino acid
  misc_feature (100)..(100): Xaa can be any naturally occurring amino acid
  misc_feature (105)..(105): Xaa can be any naturally occurring amino acid
  misc_feature (114)..(115): Xaa can be any naturally occurring amino acid
  misc_feature (118)..(118): Xaa can be any naturally occurring amino acid
  misc_feature (121)..(121): Xaa can be any naturally occurring amino acid
  misc_feature (126)..(126): Xaa can be any naturally occurring amino acid
  misc_feature (137)..(140): Xaa can be any naturally occurring amino acid
  misc_feature (144)..(144): Xaa can be any naturally occurring amino acid
  misc_feature (149)..(149): Xaa can be any naturally occurring amino acid
MVSSMLSSAAVXTXXXQDXMXXPFTXLKSSAXFPXTRKANNDITSIASPXGRVXXMXVGXXXGKXKFETLSYLPDLTEVELYKEVDYLLRNXWXPCDEFXLQNGXVYREHGSTXXYYXGRXYWTMXKLPLVACADSXXXXNESXECKTXYPNAFIKII

SEQ ID NO: 64130 - protein, 523 aa, Rhodococcus sp. RHA1
MADIEQQRPVLVVDFGAQYAQLIARRVREAKVYSEVVPHTATVEEIAAKNPLAVVLSGGPSSVYADGAPQLDPALFDLDIPVFGICYGFQAMAGALGGTVAHTGTREYGRTDLKVQGGLLHEGLPASQPVWMSHGDAVTEAPAGFEVTATSEGAPVAAFEDRARKLAGVQYHPEVLHSPHGQQVLSRFLHEIAGIPPAWTAANIADALVEQVREQVGDGKAICGLSGGVDSAVAAALVQRAIGDNLTCVFVDHGLMRAGERAQVEQDFVAATGAKLITVDAADTFIGELAGVSDPETKRKIIGREFIRSFEGAVSDVLGENAAHGDTVEFLVQGTLYPDVVESGGGTGTANIKSHHNVGGLPEDLQFTLVEPLRLLFKDEVRAVGRELGLPEEIVGRQPFPGPGLGIRIIGEVTQDRLDILRHADSIAREELTAAGLDGQIWQCPVVLLADVRSVGVQGDGRTYGHPIVLRPVSSEDAMTADWTRLPYDVLERISTRITNEVHDVNRVVLDITSKPPGTIEWE

SEQ ID NO: 64131 - protein, 427 aa, Burkholderia xenovorans LB400
MAIVEVKVPQLSESVSEATMLQWKKKPGEAVAQDEILIEIETDKVVLEVPAPSAGVLAQVIANDGDTVTADQVIAKIDTEGTASAAAVEAEVKPAPQAAPAPAAAPAPAAQAASATGANTAASPAAGKLMAEKGLGAGDVAGTGRDGRITKGDVLTAGAPAAKAAAPAPAAAPKAAKPSLPDVKAPASAEQWLKDRPEQRVPMSRLRARIAERLLESQQTNAILTTFNEVNMAPVMDLRNKYKDKFEKEHGVKLGFMSFFVKAAVHALKKFPLVNASIDGNDIVYHGYFDIGIAVGSPRGLVVPILRNADQLSLAEIEKKIAEFGQKAKDGKLSIEEMTGGTFSISNGGVFGSMLSTPIINPPQSAILGVHATKERAVVENGQIVIRPMNYLALSYDHRIIDGREAVLSLVAMKDALEDPARLLLDL

SEQ ID NO: 64132 - protein, 476 aa, Burkholderia xenovorans LB400
MSKEFDVVVIGAGPGGYIAAIRAAQLGKTVACIEKWKNPAGALKLGGTCLNVGCIPSKALLASSEEFENASHHLADHGISVENVKVDIAKMMARKEGIVEKMTKGIEFLFRKNKITWLKGHGKFTGKTDAGVQIEVSGEGETETVTAKNVIIATGSKARHLPNIPVDNRIVADNEGALSFESTPKKLAVIGAGVIGLELGSVWRRLGAEVTVLEALPEFLGAADQALAKEAAKQFKKQGLDIHVGVKVGEVKTTDSGVTIAYTDKDGNAQTLEADRLIVSIGRVPNTDNLGLEAIGLKANERGFIDVDEHCATAVPNVYAIGDVVRGPMLAHKAEDEGVLVAEIIDGQKPHIDYNCIPWVIYTEPEIAWVGKTEQQLKAEGREIKTGQFPFMANGRALGINKADGFVKMIADAKTDELLGVHIISANASDLIAEAVVAMEFKAASEDIGRICHPHPSLSEVMREAALAVDKRALNM

SEQ ID NO: 64133 - protein, 717 aa, Novosphingobium aromaticivorans DSM 12444
MVREIKGDANVNLVVLSIILGLLAVVYGFVTSRQVLGAPAGNSKMQEIAAAIQEGAQAYLKRQYTTIAIVGVVVAVIIAATLGTISATGFVIGAVLSGVAGFIGMNISVRSNVRTAAAAQNGLQAGLTLAFRAGAITGMLVAGLALLAIAVFYHYLTDIAGYTVGGDDRTVVDGLVALAFGASLISIFARLGGGIFTKAADVGADLVGKVEAGIPEDDPRNPAVIADNVGDNVGDCAGMAADLFETYVVTVGATMVLTALLLKGLGAALAPMMALPLLIGGVCIVTSIIGTYFVKLGSSNNIMGAMYKGFLVTAVLSVGAIWWAISYALGDMETSMSYTILDNTVTFSGRVLFYCSLLGLVITGLIIWITEYYTGTNYRPVRSIAKSSETGHGTNVIQGLAISLESTAMPTIVICAGIIIAYQLAGLIGIAYAATAMLALAGMVVALDAYGPVTDNAGGIAEMAGLDDSVREKTDALDAVGNTTKAVTKGYAIGSAGLAALVLFAAYTTDLREFFPNLAVSFSLENPYVIVGLLLGALLPYLFGAMGMTAVGRAAGDVVIDVRDQFRENPGIMAGTSKPDYARTVDLVTKAAIKEMIVPSLLPVLAPIAVYFVIAAVGGQANGFAALGALLLGVIVGGLFVAISMTSGGGAWDNAKKYIEDGNHGGKGSDAHKAAVTGDTVGDPYKDTAGPAVNPMIKITNIVALLLLAALAAHAAG

SEQ ID NO: 64134 - protein, 139 aa, Bacillus cereus E33L
MTRVRDVMSTHIVQCTPLDNVYEAAVKMKEESIGLIPVVENEQVVGLVTDRDLVVRGIAEKHPGSNKITNVMTTNIISVSPDDSIEKATELMAQHQIRRLPVVESGQLVGMLALGDLAIRESADDQAGFALSEISEHTK

SEQ ID NO: 64135 - protein, 390 aa, Gibberella zeae PH-1
MPSDATPGSPAGSNSALPPFYSPKTEPADASTPAHHHNDTLEQSIDSLSLSPAPSTPASAPVSAHPDPETPIGLEPPPSLLSPSFTPPSTPGTSTPTTAGLRGVPVDSSIPSGGCGSKRPKLLPTLPEVECIVRARIPTVAGTEMFLHLYTNNVDNKEHLAIVFGKNIRSKSLDAVREGETEMDRMVRGAYTGRLFPGRTTSGIGPATPQEEQPPQPSDEPPLVRIHSECYTGETAWSARCDCGEQLDEAARLMSLPGNKAGGIIIYLRQEGRGIGLGEKLKAYNLQDLGSDTVEANLLLRHPADARSYGLATAMLLDLGHPEVRLLTNNPDKIRAVEGPNREVVVKERVAMVPLSWKGRGGFRSQEVEGYLKTKIEKMGHMLDMASVPR

SEQ ID NO: 64136 - protein, 407 aa, Rhodopirellula baltica SH 1
MYPTNQSLVQGLGGRDNLVQAIKCRCNTCNRTKPPYRRESTLSAESSGSTAHWRTMFANMPLDARTITIVRCSFSLVAVFSRIRRQSRQFGEPTRLHILFALHFHPMSNSLLIVGCGYLGRRVGRLAQRAGWQIHATTRSRFETLAAEGFHPIAFDWNDSRTFDRLPTTTHVLIAVAYDRHSRVDRYASQVDGLARLIRHLDNGRPTDQSADVCYISTTGVYHQTGGVWVDETSPTHPTREGGKAHLAAEAKLRSLRVGRPTTTLRLAGIYGPDRVPRAADVIAERPIASPPHGHLNLIHVDDAATAVMNSFDNQRFASRARSPLYVVADDEPVVRREFYREIARATRSAEPTFVDPAADSGVRFRSETDKRIWNRRVRRDLLPQMRYPTYREGLRDVLENNVSNEA

SEQ ID NO: 64137 - protein, 270 aa, Oceanicola granulosus HTCC2516
MQRVNGMPALGLGTYKRRGEEGTELIRRALEVGYRHLDTAQLYENEADVGEALRRSDLPPGEVWITTKIAPANFGDGLLVPSLEESLERLGLDAVDLTLIHWPSPNNEVALPVYLEQLAEAKAQGLTRTLGVSNFPIALIDEAREILGDGEIKTNQVELHPYLQNRALADHCAAHDIAVTCYKPIADGSVAEDRVLREIADKHSATPTQVCLSWQLAEGWVAIPTTSRADRLEENFGAQQVALDDEDRERIARLDAGKRYVDPDTAPDWD

SEQ ID NO: 64138 - protein, 269 aa, Oceanicola granulosus HTCC2516
MRDAIARNNVTLAGREDGPAMVFVHGFGCDQSMWRQVVPAFADRYRIVTYDLTGMGRSDLAAYDFDRYDRLEAHADDLIGILAALELEDVILVGHSIGASIAVLAANAAPERVARLALVSPSPAFVNDDASGYVGGFTREELEGLIAFLEENHLGWSSQMAPTIMGQPEDGEEAQELTQSFCRTDPDIAAHFGRLTFLTDCRDAMARAARPSLIVHCREDALVPMAAAEWMEREIPDSTLTVLEARGHCPHMTVPGDVVAAIRDGLGRR

SEQ ID NO: 64139 - protein, 709 aa, Desulfovibrio vulgaris subsp. vulgaris str. Hildenborough
MFVRSVIAFATPNPTGLTMFLNEHQSKRLFEEAGIETPQGIMTDSAGIEGCLPPFDAPWFVKAQVLAGGRGKAGGVRRADDLAGLRDVAKDILGMRIGGHAVPFVRIEPATAIARECYVSFMVSRKRRELLFTASGSGGVEVESGQGALVCAVPLTGEMPEHVIRSAFFCIGVGREHWAGFREFVLRLHGAVRDYGLLLAEVNPLVLTGDGRWLALDGKVEVDDNVVDIRPDLLRFHTPEHLAPEENAAREAGLSYVELKGWVGLLVNGAGLAMATMDLLNFSGLAAANFMDLGGAADVPRMRRALELLFGNPQVRVVCVNLFGGIVSCAAVAGALVEALGDGRAAKPVVVRMDGFEAAEGRQLLERRAHPDVHVARDIDHALDLLRHLRPADAPDIVFTPGTEKPVPRIHGGAAGTRRGTPHLGKGARVLVQGITGRSAQLHTRLMLDYGTNIVAGVTPFKGGQVTQGVPVYDSVHEACRQHDIDATILFVPAAFAADSLLEAVAEGIPWAVCITEGIPQKDMLRALRVARGARTRIIGPNTPGIIVPGACKVGIMPGNVFSPGPLAVFSRSGTLTYEAAARLSAAGIGQSLCAGVGGDPYIGSDFVSLCELVRDDEATQGVLVLGEVGGTAEEELAAWVRETAFPKPVVSFVAGRTAPPGRRLGHAGAILDEADGGIAGKVRALCDAGIAVCPDLGSLPAAVRQALG

SEQ ID NO: 64140 - protein, 606 aa, Arabidopsis thaliana
MWKNIAGLSKAAAAARTHGSRRCFSTAIPGPCIVHKRGADILHDPWFNKDTGFPLTERDRLGIRGLLPPRVMTCVQQCDRFIESFRSLENNTKGEPENVVALAKWRMLNRLHDRNETLYYRVLIDNIKDFAPIIYTPTVGLVCQNYSGLYRRPRGMYFSAKDKGEMMSMIYNWPAPQVDMIVITDGSRILGLGDLGVQGIGIPIGKLDMYVAAAGINPQRVLPIMLDVGTNNEKLLQNDLYLGVRQPRLEGEEYLEIIDEFMEAAFTRWPKAVVQFEDFQAKWAFGTLERYRKKFCMFNDDVQGTAGVALAGLLGTVRAQGRPISDFVNQKIVVVGAGSAGLGVTKMAVQAVARMAGISESEATKNFYLIDKDGLVTTERTKLDPGAVLFAKNPAEIREGASIVEVVKKVRPHVLLGLSGVGGIFNEEVLKAMRESDSCKPAIFAMSNPTLNAECTAADAFKHAGGNIVFASGSPFENVELENGKVGHVNQANNMYLFPGIGLGTLLSGARIVTDGMLQAASECLASYMTDEEVQKGILYPSINNIRHITAEVGAAVLRAAVTDDIAEGHGDVGPKDLSHMSKEDTVNYITRNMWFPVYSPLVHEK

SEQ ID NO: 64141 - protein, 1112 aa, Ralstonia eutropha JMP134
MLGRVPHASPLSDMNPPKLLIANRGEIAIRIARAAAALDMPSVAIHSEDDRDALHVRKADDAVALPGSGPRAYLDIEQVVAAARRAGCQLVHPGYGFLSENADFAQACLDAGLIFVGPAPDVLRLFGDKARARALAREHGVPVVPGTTGPTTLAEAHAFFADLPNGTGMMIKALAGGGGRGMRAVHDVAQIDEAWTRCASEATAAFGNGAVYVEQIVTAPRHIEIQVVADTNGQVVTLGERECSLQRRHQKLVEVAPSPALDDATRARLAEAAATLARAAAYRGIGTFEFLVQERDGQPPAFWFMEANPRLQVEHTVTEMVTGVDLVQTQLAIAMGADLAQLSMARAPVPRGVAVQLRINAEHLDGQGNLRPAAGTLTAFEAPSGPGVRVDSAGYAGMAANPRFDSLLAKLIVHEPSGNYARALGLAYRALCKFRIEGINTNRRLLQDLLQQDAVQRNAVHTQYLDHALPALAAADSDHPALHATATAIPEQHPDDEDGLPTDAFAVQAPMDGALAALHVKPGDTVRRGQPLAVIEAMKMEHPVEAPAAGTVLAVRTEAGATVRAGATLVLIEAGDDTGHAEQACAAADLEHIRADLREALERHALGHDAARDAAVAKRHAQGGRTARENIAQLCDADSFIEYGALAIAAQRQRRTEDDLIRSTPADGIVTGIGTVNAEQLPDADARCMVLAYDYTVLAGTQGYYGHKKLDRMLALARQWRLPVVLFAEGGGGRPGDTDMPVVAGLDCTSFIQFARLSGQVPLVGIVHGRCFAGNAALLGCADVIIATRSATIGMGGPAMIEGGGLGVYAPEEVGPVGVQAPNGVIDVVVDDEQAAVDTARRYLAYFQGDAPGWRGEDPRHLRHAIPENRLRSYDMRAVIHALADTDSVLELRAAFGTGIITALIRIEGRAFGCIANNPRHLGGAIDSAAGDKAARFMQLCDAHGLPILSLCDTPGFMVGPQAEKSATVRHVSRLFVVAGALRVPFFTVVLRKGYGLGAQAMAGGSFAAPFFTAAWPSGEFGAMGLEGSIRLGFRKELEAVADPDEREALFARMVDAAYQRGRALNMASHLEIDAVIDPADTRRWLLRGLASVPPRSLGRRTGEDRRFIDTW

SEQ ID NO: 64142 - protein, 320 aa, Oryza sativa Indica Group
MDSSSAEILIDLGGFRLYKDGHADRAGGMESVPAGYDDETGVTSKDVVIDAVTGVSARLYLPPCIQPATDDDGKKLPILLFFHAGYFVVGSASWPPVHRYTNSVVASARVVAVSVNYRLAPEHLLPAAYDDSWAALSWAVSGADPWLSAHGDTGRVFLSGASAGGNIAHNMTIAVGVRGLDAVVPEPRIEGTILLHPSFCGETRMEVEPEEFWGGVKKRWAVIFPGANGGLDDPRMNPMAAGAPSLTKLACERMLICSAGFDPRRTRDRAYYDAVKASGWGREVDWFESEGEGHHFFVDKPGSHEASKLMERVAAFIAGH

SEQ ID NO: 64143 - protein, 333 aa, Desulfovibrio vulgaris subsp. vulgaris str. Hildenborough
MSLNLGINGFGRIGRYLVRLLAEDNELSIAAINARADNASLAHLFKYDSCHGRFNGEVGHDADGLIVNGRHIAVTREKINEWRWGELGIDLAVETSGTVKDRAGLAQHIARGAKKCVISAPGKDADVTIVMGVNHGDYDPAKHDVISAASCTTNCLAPAAKVVHETFGIRHGIMTTVHSYTMSQRILDGSHKDLRRGRAAALSMIPTTTGAAKATALVYPALAGKLDGMAVRVPTPNVSLVDLTCELERETTVEEVNAALKAAAAGPMLGNMGFCEEPLVSIDFMGSTFGGVVDAQCTSVIDKTMLKLIIWYDNEAGFTNQLVRLLRMVGKSL

SEQ ID NO: 64144 - protein, 716 aa, Shewanella sp. MR-4
MIYQSPTIQVELLEDNIAKLCFNAPGSVNKFDRETLASLDAALDSIKQQSNIQALVLTSGKDTFIVGADITEFLGLFAQDDAVLLSWVEQANAVFNKLEDLPFPTASAIKGFALGGGCEAILATDFRIADTTAKIGLPETKLGIIPGFGGTVRLPRVIGADNALEWITTGKDQRPEDALKVGAVDAVVAPEALEAAAIQMLKDAVAEKLDWQARRQRKMSPLTLPKLEAMMSFTTAKGMVFAVAGKHYPAPMAAVSVVEQAATKGRSDALQIEHQAFIKLAKTDVAKALIGIFLNDQLVKGKAKKAGKLAKDVKSAAVLGAGIMGGGIAYQSASKGTPIVMKDIAQPALDLGLGEAAKLLSAQVARGRSTPEKMAKVLNNITPALDYAPVKHADVVVEAVVEHPKVKAQVLAEVEQYVSEDAIIASNTSTISINLLAKSMKKPERFCGMHFFNPVHKMPLVEVIRGEHSSEETIASVVAYASKMGKTPIVVNDCPGFFVNRVLFPYFAGFNGLLAEGGDFAAIDKVMEKQFGWPMGPAYLLDVVGLDTGHHAQAVMAEGFPDRMGKSGNDAIDVMFENKRLGQKNGKGFYAYSVDSRGKPKKDVDPTSYELLKAAFGEQKAFDADEIIARTMIPMIIETVRCLEEGIVASPAEADMGLVYGLGFPPFRGGVFRYLDTMGVANFVALADKYAHLGGLYQVTDAMRTLAANNGSYYQA

SEQ ID NO: 64145 - protein, 319 aa, Oryza sativa Indica Group
MDSSSSEILVDAGSFRLYKDGHADRTGDMETVPAGFDADTGVTSKDVVIDAVTGVFVRLYLPPIQAATDDDGKTKLPILVFFHGGYFVVGSASCPKRHRNINDIVARARLIAVSVDYRLAPEHLLPAAYDDSWAALNWALSGADPWLSEHGDTGRVFLAGVSAGGNIAHNMTIAVGVRGLDAAVPARIEGTILLHPSFCGETRMEGEPEEFWESVKKRWSIIFPDAKGGLDDPRMNPMAAGAPSLTKLACERMLVCAASEDPIRPRERAYYDAVKRSGWGGEVDWFESEGEGHAFFVRKYGSSKAVKLMDRVIAFLAGH

SEQ ID NO: 64146 - protein, 287 aa, Thermobifida fusca YX
MNSVAARVTELTGREVAAVAERGHSHRWHLYRVELADGTPLFVKALPDDAPALDGLFRAEALGLDWLGRSFGSPVPQVAGWDDRTLAMEWVDERPPTPEAAERFGHQLAAMHLAGAESFGATWDGYIGPLPMDNTPRSTWPEFYAEQRILPYLRRAADRGALTPGDVRLVEKVLDALDHLAGDPEPPARIHGDLWNGNVLWQDDGAVVIDPAAHGGHREADLAMLALFGLPYLDRVRDAYNEVAPLAEGWRARIPLHQLHPLLVHVCLFGAAYRTTLVDTARAALRA

SEQ ID NO: 64147 - protein, 137 aa, Streptomyces coelicolor A3(2)
MTQRSLVLLKPEAVRRGLTGEIISRIERKAGWQITALELRTLDTETLEQHYGEHKGKPFYEPLVEFMASGPVVAMVVEGERVIEGVRALAGPTDPIAAAPGSIRGDYGVIVRENLIHASDSEESAERELKIFFPGRV

SEQ ID NO: 64148 - protein, 464 aa, Arabidopsis thaliana
MESGSMKTPLVNNQEEARSSSSITCGLLLSTSVAVTGSFVYGCAMSYSSPAQSKIMEELGLSVADYSFFTSVMTLGGMITAAFSGKIAAVIGRRQTMWIADVFCIFGWLAVAFAHDKMLLNIGRGFLGFGVGLISYVVPVYIAEITPKAFRGGFSFSNQLLQSFGISLMFFTGNFFHWRTLALLSAIPCGIQMICLFFIPESPRWLAMYGRERELEVTLKRLRGENGDILEEAAEIRETVETSRRESRSGLKDLFNMKNAHPLIIGLGLMLLQQFCGSSAISAYAARIFDTAGFPSDIGTSILAVILVPQSIIVMFAVDRCGRRPLLMSSSIGLCICSFLIGLSYYLQNHGDFQEFCSPILIVGLVGYVLSFGIGLGGLPWVIMSEVFPVNVKITAGSLVTVSNWFFSWIIIFSFNFMMQWSAFGTYFIFAGVSLMSFVFVWTLVPETKGRTLEDIQQSLGQLS

SEQ ID NO: 64149 - protein, 201 aa, Neorickettsia sennetsu str. Miyayama
MNLVPMVVDQTPRGERAYDIFSRLLKERVVFLTGPIEDGMASLIVAQLLFLEAENPDKDIFMYINSPGGVVTAGLSIYDTMQYIKPSVSTVCVGQAASAASLILASGAEGKRFALPHSRVMVHQPSGGVRGQATDMEIHVKEILQLKRMINEIYQKHTGETIKKIETLLERDTFLSPEEAKKVGIIDDIITQRKENSGKQE

SEQ ID NO: 64150 - protein, 244 aa, Rhizobium sp. NGR234
MQRFANKVALVTGASTGIGLETIKRIREEGGTVFAAHRRGKIDIEGVASISLDVTDEGNWTRAISKVVSAAGRLDILINNAGVRESGSVEETSLEQWRRLIDTNLTSIFLGCRAAVPAIRQAGGGAIVNVGSITGIRGTENMVAYSASKSGITSMTSSLALDLASDNIRVNAVCPAAIRTRMVTNWLNSSQDTDAAEAAVLAKHPIGRIGRPDEVASVIAFLASDDSSFMTGMSIPVDGGRSIR

SEQ ID NO: 64151 - protein, 641 aa, Geobacillus kaustophilus HTA426
MIILQVHGLTKYFGADLILSNIKLEIQSHDRIALVGRNGAGKSTLLKIIAGELSFDSGKIIKPNHIKIGYLAQNSGLDSPRSIWDEMLEVFTPLLGLEKQLAELSMQLGDPDVLADPARYEKTLKTYDELQEQYKEQGGYQYEADIRSVLHGLQFSSYDYKTTPISSLSGGQRTRLALGKLLLSKPDLLILDEPTNHLDLETLSWLEQYLQAYPGAVLVVSHDRYFLDKIVTDVYELSNATLKHYAGNYSRYLELRAEQYEQELRRYEKQQEEIARLQDFIQRNIARASTAKRAQSRRKQLEKIERLERPVGDEKSASFSFSIDRPSGYEVLTAEDIAVGYGDGAPIIRQISFRITRGESVALVGPNGIGKSTLLKAIARKLPIQTGELRYGANVQIGYYDQDQADLSSNKRVLDELWDAYPEKTEKEIRTVLGNFLFSGDDVLKPVSALSGGEKARLSLAKLMLQKANVLLLDEPTNHLDLDSKEVLEQALIDYPGTILFVSHDRYFINRIATKVFELSSGGLTEYLGDYDYYIAKKEEMRELALLNVRPTETASDSAKTTYEQEKEEKKRRRQRQRRLDEIEAEIATLEAQIAEIEQQLCDPSVYGDYETMQRLTQENDERKQRVEMLLAEWEQLYTSL

SEQ ID NO: 64152 - protein, 405 aa, Thermus thermophilus
MALVVQKYGGTSVGDLERIHKVAQRIAHYREKGHRLAVVVSAMGHTTDELIALAKRVNPRPPFRELDLLTTTGEQVSVALLSMQLWAMGIPAKGFVQHQIGITTDGRYGDARILEVNPARIREALDQGFVAVIAGFMGTTPEGEITTLGRGGSDTTAVAIAAALGAKECEIYTDTEGVYTTDPHLIPEARKLSVIGYDQMLEMAALGARVLHPRAVYYAKRYGVVLHVRSSFSYNPGTLVKEVAMEMDKAVTGVALDLDHAQIGLIGIPDQPGIAAKVFQALAERGIAVDMIIQGVPGHDPSRQQMAFTVKKDFAQEALEALEPVLAEIGGEAILRPDIAKVSIVGVGLASTPEVPAKMFQAVASTGANIEMIATSEVRISVIIPAEYAEAALRAVHQAFELDKA

SEQ ID NO: 64153 - protein, 284 aa, Sinorhizobium meliloti 1021
MTAKTNRISFQGDYGANSDMACRDMFPSMEPLPCQTFEDAFLAVENGEADLAMIPIENTIAGRVADIHHLLPESRLHIVGEYFMPIRFQLMVLPGVGREEIRTVHSHIHALGQCRKIVRANGWKPVVAGDTAGAAKLVKEVGDRSMAALAPRLAADLYGLDIIAENVEDTDSNVTRFVVLSREESRVARTSKDELIITTFVFNVRNIPAALYKAMGGFATNGINMTKLESYQLGGKFVATQFYADIEGHPDDIGVRHAMDELRFFSENVRILGTYPAHPMRGVL

SEQ ID NO: 64154 - protein, 593 aa, Zea mays
MAFWWPLLVLAAAYALCRLLLFLIPPTVPSIDVDASDVLAKEDSFIYIPRRGKSTQTDKVQCYEPATMKYLGYFPVVTPDEVKEHVAQSRKAQRIWAKSSFKQRRQFLRIVLKYILEHQDLICEVSSRDTGKTMVDASLGEIMTTCEKITWLLDEGEKWLKPEYRSTGRSMLHKRAKVEFYPLGVIGAIVSWNYPFHNVFNPVLAAVFSGNAAVIKVSEHATWSGCFYFRIIQAALSAVGAPENLVHIITGFAETGQALVSSVDKIIFVGSPGVGKMIMKRASETLIPVTLELGGKDSFIVCEDVDLPSVVQVATRAALQSSGQNCAGAERFYVHDDIYSAFVSQIVKTVKSISVGPPLSGRYDMGAICMIEHSEKLQNLVNDALDRGAEIAVRGSFGNLGEDAVDQFFPPTVLVNVDHTMKIMQEETFGPIIPIMKFSSDEEAIKLANDSKYGLGCAVFSGNQKRAIRIASQLHCGVAAINDFASSYMCQSLPFGGVKDSGFGRFAGVEGLRACCLVKSVVEDRLWPYIRTVIPKPIQYPVSEHGFEFQQLLVETLYGYSVWDRLRSLVNLIKMVTEQNSAPASNATTKKRR

SEQ ID NO: 64155 - protein, 297 aa, Alkalilimnicola ehrlichei MLHE-1
MSYPTVEAFVGNTPLVRLQRMVPPERNNRILAKLEGNNPAGSVKDRPAVHMIRRAEERGRIRPGDTLIEATSGNTGIALAMAAAIKGYRMVLIMPENMSTERRASMAAYGAELVLVSQEEGMEGARDLAARMAEEGRGLVLDQFANPDNSAAHYESTGPEIWRDTEGTITHFVSSMGTTGTIMGCSRFFKEQSEAVQIVGVQPEDGSSIPGIRRWPEAYLPKIYEPARVDRILDVSSDDAITTTRRLAAEEGIMAGMSSGGCLHAALRLEREVENATIVVIICDRGDRYLSTGLFEG

SEQ ID NO: 64156 - protein, 311 aa, Nostoc sp. PCC 7120
MKNEKWNAENIPPQKGRLAIVTGSSSGIGYETARVLANKQASVIIAVRNLDKGNKALAKILQQNKDADVKLMELDLANLASVKNFAENFRKNYLRLDLLINNAGVMIPPYSKTTDGFELQFGTNHLGHFALTGQLLEFLISTEGSRIVNVSSGAHNMGKIDFDDLNWEQRSYAKWKAYGDSKLANLYFTYELDRKLKDNGIDTLVTASHPGWTATELQRTAGGIVKYLNGIVAQDITMGALPTLRAAIEAGLKGAEYFGPNGFMEMRGYPIKVESNELSKDQALAKKLWVVSEKLTDVKFEFNKKAQSAGK

SEQ ID NO: 64157 - protein, 463 aa, Myxococcus xanthus DK 1622
MAEAFDVVVIGAGPAGEVAGARAAEAGLSVALVEHELLGGECSYWACIPSKALLRPSEARWLAEHAAGVREKLQEGIDARAVLAHRDSMVNNYQDDSQVKWAENAKLKVVRGTGKLTGPRKVRVEDKDGAVRELEARKAVVLATGSHPRIPDIPGLKDAQPWDNRQGTAARQVPKRLVVLGGGAVGVELAQAWRSLGSEVTLVQRGKRLLSRAEPFAGEQVAQALRDAGARVLLGMNATRVQRPGGKGEVTVTLSNGEQVVADEILVAMGRVPRTEGIGLETVGLVGGKPVEVDDQLRAKGVDGGWLYACGDTNGRNLLTHMGKYQARMVGDVIAGKQARAWADAKATPQVVFTHPQVASVGLTEAKAREAGLPVRTVEQQLQDVSGTSLVGKGLTGTVKWVVDEKRRVLVGATFTGPEVGEMLHAATIAVAGEVPLDTLWHAVPSFPTMSEVWLKLLEAYGL

SEQ ID NO: 64158 - protein, 439 aa, Acidobacteria bacterium Ellin345
MPLLRTLTLRDVVLLIVGTVIGSGIFLVPGPVLRNVHNRVDLALAVWLLGGLLSLMGALTYGELGAMKPQAGGLYVYLRDCFGRPLAFLYGWALFFMMSSGSVATLAVAFSTYLRQIVPLNDIEAKIVASAMIVVVGVINVIGTRKSANVQNVATALKVAAILAMTVVLFALGGHSSATVTATTTQTGTLYSGFGLAMISVLWAYEGWQYCTFSAGEIADPQKTFPRALLVGSLVLVSVYVLANLGYLAALGAGGAAASNRVASDAIGAVLGPGFAKLISLAILVSMFSAANGLILTSPRVYYAMAQDGVFFRKLAEVHPRYQTPAFAVIAGCAWSIVLAVSGTFEQLLTYVIFTGWIFYAFGALAVFVYRRREPDAERPYRVPGYPVTPILFVLAATALVVNTVIAQPARAAVGLGLVLAGAPVYFIWNARSKRQAKD

SEQ ID NO: 64159 - protein, 257 aa, Magnetospirillum magnetotacticum MS-1
MISIEGAKEMKFEDKVALITGGASGIGYCTVKSMAELGADVLIADINVEAGEKAATELKAKGLKAEFVRLDVTDKANIARVKEHVLATRGRLDILCNVAGWGHIQPFVDNDDAFIAKVMSLNLTGPIELIRAFFPLMIEKKTGKIVNVASDAGRVGSLGESVYSAAKGGLISFSKALAREGARYNINVNAICPGPTDTPLLKSEPEKFLEAFLKVIPMRRFGQPQEVADSIVFMASNRADYITGQVLSVNGGITMVG

SEQ ID NO: 64160 - protein, 317 aa, Magnetospirillum magnetotacticum MS-1
  misc_feature (291)..(291): Xaa can be any naturally occurring amino acid
  misc_feature (296)..(296): Xaa can be any naturally occurring amino acid
MLETGFFSLGTPGRLDADLEFILAKVAELKLPKLYELGPVGARTEFALRLSRSNPPAPHGVEAEDITIAGIPARRYQPQGGPKAKAMLLYFHGGGFVVGDLETHDPHCRALAAESGSVVVALHYRLGPEHPYPAAIQDGIAALKWAAAEYAGWTLGVAGDSAGGTLSAVVALHARDLNIPLALQMLIYPAVDQKGDFPSRTRLADGYLLTQGDIEWFTQQYFVGHEGPVLEPDASPLRAASHGGLAPALVLTCGFDPLVDEGDAYAQALIGAGVPVRHVRLEGSIHGCLGXWPGLXVALGQASLGGGLRGLAVRSSP

SEQ ID NO: 64161 - protein, 406 aa, Physcomitrella patens subsp. patens
MHVTISRDNLRVASIHGRINQTVNGLTRSRSRDRQTKVPSQDFQAPVVSGLSLGSGEYFIRISVGTPPRRMYLVMDTGSDILWLQCAPCVNCYHQSDAIFDPYKSSTYSTLGCSTRQCLNLDIGTCQANKCLYQVDYGDGSFTTGEFGTDDVSLNSTSGVGQVVLNKIPLGCGHDNEGYFVGAAGLLGLGKGPLSFPNQVDPQNGGRFSYCLTDRETDSTEGSSLVFGEAAVPPAGARFTPQDSNMRVPTFYYLKMTGISVGGTILTIPTSAFQLDSLGNGGVIIDSGTSVTRLQNAAYASLRDAFRAGTSDLAPTAGFSLFDTCYDLSGLASVDVPTVTLHFQGGTDLKLPASNYLIPVDNSNTFCLAFAGTTGPSIIGNIQQQGFRVIYDNLHNQVGFVPSQCN

SEQ ID NO: 64162 - protein, 387 aa, Geobacter metallireducens GS-15
MNIHEYQAKAILRRFGVPVPDGHVCYNGASAREWAKRLGDGPWVVKAQIHAGGRGKGGGVKLARTSQEVQLIARNMLGMTLRTHQTGPDGKLVTRVLVENGCNIDRELYISLLVDRSTSKVTVMASTEGGMDIEEVAATTPEKIFKEAIDPLVGLSPFQCRNLAFSLGLTGKLLPKAQKLLENLYATFIACDCSLLEINPLVVTKEGDLLALDAKFGFDDNAIFRHLQISDMRDYDEEDPNEVEASQHDLSYVSLNGNIGCLVNGAGLAMATMDIIKFSGGEPANFLDVGGGATIERVTEAFKIILSDKNVKGIFVNIFGGIMKCDVIATGVIEAARQVSLQVPLVVRLEGTNVALGKQLLSESGLNIVAADGMADGAQKIVQAVAA

SEQ ID NO: 64163 - protein, 725 aa, Tagetes erecta
MALCGALKGGFVPIAQNGYTSSSLLNPSANAIMPSNKRKFLGIVAVSKEHATNEHEDLTTMDKTTSTTLKYSGDKPKTPILDTINYPIHMKNLCVEELVKLADELREEIVYTVSKTGGHLSSSLGVVELTVSLHHVFNTPEDKIIWDVGHQAYPHKILTGRRSRMRTIRQTFGLAGFPKRDESNHDAFGAGHSSTSISAGLGMAVGRDLLGKNNHVIAVIGDGAMTAGQAYEAMNNAGYLDSNLIIVLNDNRQVSLPTATIDGPAPPVGALSRSLTRLQTSQKFRQLREAAKEVTKQLGDKTHEVAAKMDSLVKGMVGGQGASMFEELGLYYVGPVDGHNLEDLVYVFDKIKSMTAPGPVLVHIVTEKGKGYPPAEVAADKMHGVVKFDTQTGKQKKNKTKTLSYTQYFVDSLVAEAKEDDKIVAIHAAMGGGTGLNTFQKEFPARCFDVGIAEQHAITFAAGLATEGLKPFCAIYSSFLQRGYDQVVHDVDLQKLPVRFAMDRAGLVGADGPTHCGAFDTTFMACLPNMVVMAPSCEAELMNMVATAVAIDDRPSCFRYPRGNGIGSILPANNKGTLIEVGTGRVIKEGNRVALLGYGTIVQSCLAASEVLKKIGISVTVADARFCKPLDGNLIKQLANEHEVLITVEEGSIGGFSSHVSHFLALNGLLDGHLKWRAMMLPDRYIEHGAQSDQIEEAGLSSKHIAATVLSLIGGSKETLHALNV

SEQ ID NO: 64164 - protein, 407 aa, Oryza sativa Indica Group
MGKQMAALCGFLLVALLWLTPDVAHAQTQILFQGFNWDSWKKQGGYMPGRLYDLNASKYGTKAELKSLIAAFHAKGIKCVADIVVNHRCADDKDGRGVYCIFKGGGPRGCLDWGPSMICCDDTQYSDGTGHRDTGADFAAAPDIDHLNPLVQRELSDWLRWLRRDVGFDGWRLDFAKGYSAAVARTYIQNARPSFVVAEIWNSLSYDGDGKPAANQDGQRQELVNWVKQVGGPATAFDFTTKGILQSAVQGELWRMRDKDGKAPGMIGWYPEKAVTFVDNHDTGSTQRMWPFPSDKVILGYAYILTHPGVPCIFYDHVFDWNLKQEINALAATRKRNGINAGSKLRVLAAESDMYVAMVDERVITKIGPRIDVGNIIPSDFHIVAHGNDYCVWEKSGLRVPEPEGRR

SEQ ID NO: 64165 - protein, 501 aa, Helicobacter pylori J99
MKMILFNQNPMIEKLLESVSKKLELSIENFNHYQELSARLKGDPEWLLIADDECLEKLDQVDWLELKETISQNKNSVCMYKKGNEAQPFLEGFEMKIKKPFLPTEMLKVLQKKLGSNASELEPSQNLDPTQEILETNWDELENLGDLEALAKEEPNNEEQLLPTLNEQEGETPKEEAQEEVKKEEVKEMQEEVKEKQKQEVAENPQDEEKPKDDETQGSVEPPKDEEVSKELETQEELETPKEETQEQEPIKEETQEIKEEKQEKTQDSPSAQELEAMQELVKEIQENSNDQENKKETQETQENTETPQDIETQELEIPKEEETQEVAEKTQVQGLEKEEIAETPQEKEIQETQDETPQELEAQDEKLQENETPKDESMQESAQNLQDKETPQEETQEDHYESIEDIPEPVMAKAMGEELPFLNEAVAKIPNNENDTETPKESDIKAPQEKEESDKTSSPLELRLNLQDLLKSLNQESLKSLLENKTLSIKITLEDKKPNE

SEQ ID NO: 64166 - protein, 413 aa, Prochlorococcus marinus str. MIT 9215
MKTIQNFPEITKKDFPLLKSNEQIIYLDHAATTQKPIQVLRKIDEYYRKFNANVHRGAHQLSAKATEEFENARFLISKYIKANSTKEIIFTRNATEAINLAARTWGESSLRENDEILLSIMEHHSNIVPWQMVAAKNKCKLKFIGINKDGKLDLDDFKSKLTSRTKLVSLVHVSNTLGCCNPIKEITKLAKQKGSLVLIDACQSLAHQKLDVIDLDIDFLAGSGHKLCGPTGIGFLWSRKEILEKIPPLFGGGEMIQDVFEETSTWAELPHKFEAGTPAIAEAIGLAEAINYINTIGLNEIHEYEKNITKYLFEKLSQIENIEIIGPSPEIDPERASLATFYIKNIHSNDIAEILDSKGICIRSGHHCCQPLHRHIGIKSTARVSMNFTTNKKEIDIFIEKLKDTIDFLKINS

SEQ ID NO: 64167 - protein, 437 aa, Oryza sativa Indica Group
MAKHSTTMSCLLFFVLLCLGSHLAQAQVLFQGFNWESWKKQGGWYNFLHSHVDDIAATGVTHVWLPPPSHSVAPQGYMPGRLYDLDASKYGTGAELRSLIAAFHSKSIKCVADIVINHRCADYKDSRGIYCIFEGGTPDSRLDWGPDMICSDDTQYSNGRGHRDTGADFGAAPDIDHLNTRVQRELSDWLNWLKSDVGFDGWRLDFAKGYSATVAKTYVDNTDPSFVVAEIWSNMRYDGNGEPSWNQDGDRQELVNWAQAVGGPASAFDFTTKGELQAAVQGELWRMKDGNGKAPGMIGWLPEKAVTFIDNHDTGSTQNSWPFPSDKVMQGYAYILTHPGVPCIFYDHVFDWNLKQEISTLAAVRSRNGIHPGSKLNILAADGDVYVAMIDDKVITKIGTRYDVGNLIPSDFHVVAHGNNYCVWEKSGLRVPAGRRH

SEQ ID NO: 64168 - protein, 330 aa, Enterococcus faecalis V583
MSILVLGGAGYIGSHAVDQLISKGYAVIVVDNLLTGYRSAVHEQATFYEGDIRDKAFLRSVFEKESIEGVLHFAANSLVGESVEKPLMYFNNNVHGTQIALEVMQEFGVKHIVFSSTAATYGEPKAMPITEETPTNPKNPYGESKLMMEKIMKWCDNAYEMKYVALRYFNVAGAKKDASIGEDHTPETHIVPIILQVALGQRAELSIFGDDYDTPDGTCIRDYVYIEDLIAAHILALEYLKNGGESDVFNLGSNNGYSVKEMLDAAREVTGQEIPATIAPRRAGDPSTLIASSEKAKRVLGWQPEVTEVKDIIATAWQWHQAHPHGYQEK

SEQ ID NO: 64169 - protein, 180 aa, Glycine max
MQHRNLTSGRPSGTDGSDYSYRMVVDSRYQLVAKGKKRLSLYFITEAVLLLIGVTLTYLPGIEADAPNTVAYSSVIVSVVSLIIGNIGRRRSRSGLLRFYAAVSSIAMLLLIASLAQQHLLLKAIQDSKLWKTGKYDVNELSHFQIGLLLYMVTLSVLKLCTVNAVVSLLFNMAPPKKTS

SEQ ID NO: 64170 - protein, 502 aa, Rhizobium sp. NGR234
MDESVRNYLDQYGVSDATRRFLAKPQKMFIDGAWSDSSNGATFDIFEPSTGGLITRAPSGTPEDLDRAVRAARRQFDGGAWRRLKPLERERLLHSLADLIEAHSDELAEIEAIDMGKSVTFAREIDIRGTVDTFRYFAGWASKLHGRTVEPSLPGNYLAYTRKEPLGVVAAIVPWNFPLQTLAWKLAAALAVGCTAIVKPAELTSLSTLRFAELVQEAGIPDGVVNIVTGKGSIIGAAMSTHPGINKVTFTGSTPVGQEVGRTAVGNLKHVTLELGGKSPVLVLDDADLQSAAVAVANGVFFNSGQVCDAGTRVYVQGSVHDAFLDELVSVTSALKIAPGLDRDCYIGPLVSAQQKKVVSGYIEAGRREGAELIHGGASLHRQGHFIEPAIFSHCKPQMSIVREEIFGPVLVTSPFDDLDDAVSLANDTPFGLAAAIYSNDLSRVHTLIPRLHAGSIYVNAHSTIDPAMPFGGFKASGFGKDLGPEQLDYLMETKAVWITLP

SEQ ID NO: 64171 - protein, 626 aa, Sinorhizobium meliloti 1021
MSDEAPTSSPILPVEKPAAYRVLARKYRPKDFSDLMVGQEPMVRTLTNAFETGRIAQAYMLTGVRGVGKTTTARILARALNYKTAEIDKPTIDLRVPGEHCQAIMDGRHVDVIEMDAASHTGIDDIREIIEQVRYRPVSARYKVYIIDEVHMLSTQAFNGLLKTLEEPPEHVKFIFATTEIRKVPITVLSRCQRFDLRRISASDLVGLFSTILGKEGVPFDPEALAMVARAAEGSARDGLSLLDQAIAHGGGSVEIETVRSMLGLADRARIVDLFEHVIKGDVAGALDEFAAQYEAGANPTVVLTDLADFTHLVTRLKYVPDAVNDQSLSEIERTRGAEFAGSVAVTTLSRVWQMLLKGIPEAESSARPAGAAEMVLIRLAHAAHLPSPEEAARRLLDLSGGEGGGRPAPNGGGGGGGAQAPAGTPVEARAVETAVSRPSGNGATMLRAVPSSAPPQPISVGRIEERTVASAAAKPEPKVPVNSIGDIADLCAKNRDIKLKTMVRGFLRLVHIEPGRLDVNLPEDAPKTLLNELAVKLKEWTGIHWVVSYSREQGEPTLVEAEQRAQEQRVNDARQDPDVAAILARFPGARITDVRIRAAEEELESLAPAAAESEDGDIVPDDDIE

SEQ ID NO: 64172 - protein, 429 aa, Azoarcus sp. EbN1
MSAIVDIIAREILDSRGNPTVEADVLLESGVMGRAAVPSGASTGSREAIELRDGDAARYLGKGVLQAVENVNTEISETLIGLDAEEQAFIDRTLIELDGTENKSRLGANATLAVSMAIAKAAAEEAGLPLYRYFGGSGPMAMPVPMMNVINGGAHANNSLDIQECMIMPVSMTSFREALRCGAEIFHHLKKLTDKKGYPTTVGDEGGFAPNVGGTEEALNMIQDAIAAAGYEPGRDVLLALDCAASEFYKDGQYVLAGEGLTLSSEGFADYLATLADRFPIVSIEDGMAENDWAGWKTLTDKLGRRLQLVGDDLFVTNTRILEQGIDQGVANSILIKINQIGTLSETFAAVEMAKRAGYTAVISHRSGETEDSTIADIAVGLNAMQIKTGSLSRSDRISKYNQLLRIEEDLGDTVSYPGRRAFYNLRVR

SEQ ID NO: 64173 - protein, 510 aa, Geobacillus kaustophilus HTA426
MNQEMIVVLDFGSQYNQLITRRIREFGVYSELHPHTIRAEEIRALNAKGIIFSGGPNSVYDEQAFTCDPAIFELGLPILGICYGMQLMAHHLGGKVEKATHREYGKALIQVKNDSLLFHGLPDEQVVWMSHGDLVTAPPAGFAVDATSPSCPIAAMSDERRKWYGVQFHPEVRHSVYGNDLLKKFVFEVCGCRGDWTMENFIDEQVRRIREQVGGKKVLCALSGGVDSSVAAVLVHRAIGDQLTCIFVDHGLLRKGEAESVMKTFREQFQMNVIKVDAKDRFLAKLKGVTDPEQKRKIIGNEFIYVFDDEAAKLEGIEFLVQGTLYTDIIESGTATAQTIKSHHNVGGLPEDMKFELIEPLNTLFKDEVRALGTQLGIPDEIVWRQPFPGPGLGIRVLGEVTEEKLEIVRESDAILREEVKKAGLDREIWQYFTVLPDIRSVGVMGDARTYDYTVAIRAVTSIDGMTADWARIPWDVLERISTRIVNEVPHVNRVVYDITSKPPATIEWE

SEQ ID NO: 64174 - protein, 217 aa, Oryza sativa Japonica Group
MAVLARTSRPAPTLLAATSPAVSRRPAAVSFAAAASPGSRGRVALSAAWGGRAARGRVSAAGRIVASSVEQSYIMIKPDGVQRGLVGEIISRFEKKGFVLKGLKLFQCPKDLAQEHYKDLKEKPFFPGLIEYITSGPVVCMAWEGNGVVASARKLIGATNPLQAEPGTIRGDLAVQTGRNVVHGSDSPDNGKREIALWFKEGELCEWESVLTPWLVE

SEQ ID NO: 64175 - protein, 346 aa, Glycine max
  misc_feature (234)..(234): Xaa can be any naturally occurring amino acid
MPGLSATVGEQIAALKRVAGKTEEKKNCCRRGGAVSENSLTHSLASKKKESQARRKMEGKEQDVSLGANKFPERQPIGTAAQSQDDGKDYQEPAPAPLVDPTEFTSWSFYRAGIAEFVATFLFLYITVLTVMGVAGAKSKCSTVGIQGIAWAFGGMIFALVYCTAGISGGHINPAVTFGLFLARKLSLPRAIFYIVMQCLGAICGAGVVKGFEGKTKYGALNGGANFVAPGYTXKGDGLGAEIVGTFILVYTVFSATDAKRSARDSHVPILAPLPIGFAVFLVHLATIPITGTGINPARSLGAAIIFNKDLGWDEHWIFWVGPFIGAALAALYHQVVIRAIPFKSK

SEQ ID NO: 64176 - protein, 367 aa, Prochlorococcus marinus str. MIT 9301
MVLLDKIKNKLRFNYRKKRWPGLIEAYKQYLPVTKKTPIISLNEGNTPLILSELISNLIGNGTKVFLKYDGLNPTGSFKDRGMTMAISKAKEEGREAVICASTGNTSAAAAAYASRGGLKPYVLIPEGFVAQGKLAQALMYGAEIISINGNFDKALEIVRDLSSEHPVELVNSVNPYRIQGQKTAAFEIVDDLGYAPDWLCIPMGNAGNITAYWMGFKEYSKIKKNLKLPIMMGFQSEGSAPLVKNIIVKDPETIATAIRIGNPVNREKAKKVRKESKGDFQSVTDKEIIDAYKILAKEGVFCEPASAASVAGLIKNKNRIQKESTIVCVLTGNGLKDPDCAIKNNDAIFRKNIEPSLKNITKILGY

SEQ ID NO: 64177 - protein, 183 aa, Alkalilimnicola ehrlichei MLHE-1
MQLNWPNALTLFRIALIPVLGLCFLLPAPWMNVLAVIVFSAAAVTDWLDGYLARRLQQTSAFGAFLDPVADKLMVAVALVALVAVHPGPWLAVPASIIIGREIAVSALREWMANLGARASVAVSMAGKVKTTAQMAAIIMLLYGQSLGPIPLFELGVVLLYVAAVLTVYSMALYLRAAWEQLA

SEQ ID NO: 64178 - protein, 201 aa, Listeria monocytogenes str. 4b F2365
MILLIDNYDSFTFNLEQYLAEFSEVVVKRNDAADLMEIAALADGIVLSPGPGKPSDAGLLEEVVAKFAKEKPLLGICLGHQAIGEVFGGDVKRAAKIRHGKVSTMRQTAGAIFANLPEEMPVMRYHSLIVDKNTLPQVLEVLAVATDDAEVMAMKVKDYPVYGLQFHPESIGTNDGKQMMENFIHIVEGARENGNLTTKSI

SEQ ID NO: 64179 - protein, 448 aa, Bifidobacterium longum DJO10A
MLTDEYIKRVYDQVVARDGDQPEFLQAVREVFETLQPVVEKHPEYEKAGVLERIVEPERTIKFRVAWVDDEGKVQVNRGYRIQFNSAIGPYKGGLRFHPTVTESVVKFLGFEQILKNSLTTLPMGGGKGGSDFNPKGKSDAEVMRFCQAFMTELSRHIGQFTDVPAGDINVGGREIGYLFGQYKRIRDEYSGVLTGKGLEFGGSLARTEATGYGVCYYTQEALRVLRNDSFEGKTVVISGSGNVATYAAQKAEQLGAKVVTVSDSNGYIYDPNGINVEVVKQIKEVERGRIKEYAERVPGSEYHEGSKGVWTVKGDIALPCATQNEVDGESAQKLVDNGVTVVVEGANMPSTPEAIEVYQKNGVLYGPAKAANAGGVAVSGLEMSQNSYRLSWTFEEVDAKLKSIMEEIVANSLAAAKEYGHEGDLMLGANAAGFVKVANAMVAQGVL

SEQ ID NO: 64180 - protein, 269 aa, Oceanicola granulosus HTCC2516
MDMNDVKTRGLVLLGCGKMGSAMLAGWLRGGLPPEAVWVIDPKPSDWLQAQGVNLNAGLPPSPAILLVAVKPQMMDDALGAAEIDARTLVVSVAAGTLLARFEATFGADTPVVRAMPNTPAAVGRGITALIGNAAANDDHLALAEALLSAVGQTVRLESESQMDAVTAVSGSGPAYVFHLIETLAAAGEAEGLSPELAMQLARATVGGAGQLAEDADETPGQLRINVTSPNGTTQAALEVLMDAESGFPALLRRAVHAAAERSRELGRG

SEQ ID NO: 64181 - protein, 351 aa, Ophiorrhiza pumila
MHSSEAMVVSILCALFLSSLSLVSSSPEFFEFIEAPSYGPNAYAFDSDGELYASVEDGRIIKYDKPSNKFLTHAVASPIWNNALCENNTNQDLKPLCGRVYDFGFHYETQRLYIADCYFGLGFVGPDGGHAIQLATSGDGVEFKWLYALAIDQQAGFVYVTDVSTKYDDRGVQDIIRINDTTGRLIKYDPSTEEVTVLMKGLNIPGGTEVSKDGSFVLVGEFASHRILKYWLKGPKANTSEFLLKVRGPGNIKRTKDGDFWVASSDNNGITVTPRGIRFDEFGNILEVVAIPLPYKGEHIEQVQEHDGALFVGSLFHEFVGILHNYKSSVDHHQEKNSGGLNASFKEFSSF

SEQ ID NO: 64182 - protein, 212 aa, Shewanella oneidensis MR-1
MNSQQCVIIAIAGASASGKSLIAKTIFDELRRDLGTDQIGVINEDAYYRDQSHLSMDERVLTNYDHPKALDHQLLCTHLQLLKSGEAVDIPCYSYTEHTRMAETVKMTPKKVIILEGILLLTDPKLRELMDASVFMDTPLDICFLRRLTRDVAERGRTMESVISQYKKTVRPMFLQFIEPSKQYADIIVPRGGKNRIATDILKTRIQHLLAK

SEQ ID NO: 64183 - protein, 186 aa, Gibberella zeae PH-1
MGGQFSKMMGKIFGSKEMRLLMLGLDAAGKTTILYKLKLGQDVTTIPTVGFNVETVTYKNVKFNVWDVGGQDKIRPLWRHYFSGTQGLIFVIDSSDKNRMEEARQELHRIINDREMKDSLLLVFANKQDLAEAMSPQEVTEALQLSKLKDKVWYVVPSCATTGEGLLEGLAWLSNNVKAPPTPAKK

SEQ ID NO: 64184 - protein, 131 aa, Triticum aestivum
  misc_feature (63)..(63): Xaa can be any naturally occurring amino acid
  misc_feature (72)..(73): Xaa can be any naturally occurring amino acid
  misc_feature (81)..(81): Xaa can be any naturally occurring amino acid
MGDYTIQISTKLIDQLARDDEKVKRKARKPKPKKKPTVQPHEEPLEFPREPKTTSLATAPGWXLQPPPMFLXXTPAPPQPXAKCRRWHSSVLKEMRRSNWETRNWGTDSETRDCKGSSRTSLKGGLKHGKF

SEQ ID NO: 64185 - protein, 238 aa, Methanosarcina barkeri str. Fusaro
MNKISIYGKIIDITTPISPFTQIFPGDPIPEIEKVCTLEEKGCAVSKLSFGSHTGTHVDAPSHILKNGLTIDKLELKNLMGTALILDFSSLSGELTAGILETAFRKMEAPENIPILLLKTGVFSRKQGNAGKVSFPGEESDPQSMEFEKEKFGSAYLDESGAAWILENGFKTIGIDSFSVDNFYSETLPAHHILLSGNVNIVECLELSSIEAGTYFFICLPLKIEGCDGAPARTLLVT

SEQ ID NO: 64186 - protein, 200 aa, Debaryomyces hansenii CBS767
MSEQQFKPVTVDKPIPNTYDLGNLATFDPNPLDNDKLKDESQKEEYLTSVTRDNVQLLINQILSLPVKTTTDSQGSSTGQNSTMTLIQLPDPTTQLPREKAIPKTKAPTKWEQFAARKGIKAKAKDGKMVFDEATGEWVPKWGYKGKNKELDDQWLVEVDDKVKGTEDELIDPRTLNRAERKRLVKKNELQHKRNLKNQS

SEQ ID NO: 64187 - protein, 459 aa, Burkholderia vietnamiensis G4
MTQQQRSFDNIVAREQGLRHALTSGQMAMIAIGGAIGTGLFLGSGFAIGLAGPSVLVSYAIGALIALLLMGALAEMTVAHPTAGSFGAYAEHYVGPLAGFLVRYAYWFAVVFAIGTEISAIAVFMKYWFPAVPGWYWVIGFSALLIAVNLASVTLYGSVEYAFSLLKIAAIIVFIVLGAYLVWSAPPASGIGFANYTGHGGFMPKGPWGTWVAVIVAIFSYMSIEAVAIAAGEARDPQHAVTRAFRSTVFRLVLFYLLTLALMLAIVPWTQAGTDESPFVKVMAATHVPYAAGVINFVLLIAALSAMNSQLYVTTRMMFSLSRARLAPAVFGRVGDNGVPRAALWISTSGVAVAAVLVALSPGTAFTVMMAIAMFGALFTWLMIFVTHLRFRARYSGPALAFRMWAHPFGSLLGAALVGAILLTTAFTHEFRMTMVVGVVFVVLLTLAYALHYRHQHAR

SEQ ID NO: 64188 - protein, 797 aa, Oryza sativa Indica Group
MLHPPPVRRCVSRMPRKVVSGPDYDDEYDDDYDEYDEDYDDYGETGHSDDIQHPVKEEKGIMSKHIKLTASSTAPLISNIMSPLYCAESSKKSSIHGIPSDFGTPSMPKSDCTKMPVNTRTTDFDGDPEIKNASISHEKVGSTQYTSAGSSSGAGKKVKHIALPEDVPVERTAQLISDHFQLKEDQSSRASSSAQNEDVAQKLSSDIQKLGLEKNEVDTAKPYLPEEYKPEKWMFANEESGVLSQLNLAIVGHVDSGKSTLSGRLLHLLGRISKKDMHKNEKEAKEKGKGSFAYAWAMDESSEERERGVTMTVAVAYLETKKYRVVLLDSPGHKDFVPNMISGATQADAAILVVDACTGSFEAGMDGEGGKSVGQTKEHAQLIRSFGVEQLIVAVNKMDAIGYSKERFEFIKVQLGSFLRSCNFKDSSVTWIPLSAVENQNLIKIPSDVRLTSWYQGFCLLDAIDSLQLPSQDVSKPLILPICDVIKSQSTGQFAAFGKLETGAIRIGSKVLISPCGEVAAVKSIERDSNSCDIARAGDNVAVSLQGIDGSKLIPGGILCNPGFPVPVSNFLELRVLVLDVTIPILIGYQVEFHIHHVKEAARVTKIVALLDKAGKPSKTAPRFLKSKQNAVVQVTLDAPVCVQEFSKCRALGRAFLRSSGSTIAVGVVTRPCFGAHIVADSKRDIKDPEHPYSLEELNVVTEDSVEINDELSHVRVTFTPTVEHCSMATVIGLCLRVKLMRSLPPRYKVDIRVAPGSHATETAVNKQLNDKERVAAALENPNLLDIVEECLSPTFA

SEQ ID NO: 64189 - protein, 621 aa, Vitis vinifera
  misc_feature (262)..(262): Xaa can be any naturally occurring amino acid
  misc_feature (555)..(555): Xaa can be any naturally occurring amino acid
MPKHYRPPGKKKEGNAAKYITRSQAVKHLQVSLPLFRRLCILKGVFPREPKKKVKGNHHTYYHTKDIAFLQHEPLLEKFRNIRAYDKKVNKAKAKKNRDLAERLLTRRPNYTLDRLIRERYPKFTDALRDLDDCLTMVHLFASLPALESEKIQVKRIHNCRRLSHEWQAYICRTHKLRKTFISVKGIYYQAEVEGQKITWLTPHTLQQVLTDDVDFNVMLTFLEFYETLLAFVNFRLYHSINVKYPPILDSRLEALAADLYXLSRYFAANSSATVLGSQAVSSSGAEQIDITKDGTQPDESELRLAQLQHQLPSNEPGTLMHLVEDASCEDEDDEETRECKTLFKNKKFFLSRELFSIALAKDAWVAEVPRESLLFVIPAFGGVVSWEGEGAPFKEADQSITYQIVDRPTQGHIFLSREYVQPQWVFDCVNARIILPTDAYMVGRVPPPHLSPFIDNEAEGYVPEYAEMIKRLQAAARKEVLPIPGAGKEDLDDPQNLLVEGIISRTEANEVAERKQKMLALENQYHNELQLELQGVQYSSSVSNMNKQSSVEDXEAWEESLPBMQQIAEDTTTMSKVVMSRKKRRLYEAMQIGKERKRAHVNLLKERKQKIEAAQGSEKS

SEQ ID NO: 64190 - protein, 559 aa, Thiocapsa roseopersicina
MSAPIHENERIKARSNCLRGTLRESLADTLTGAISPEDTQISKFHGFYQQDHRDRRQARPEQYLEPYFGFMLRAPLPGGVCTPAQWLAIDGMGRELGGGSLRLTTRQSFQYHGILKRDIASVIRGINAVMIDSIGGCGDVNRNVLCNPNPVESALHREVYDWAKRISEHLLPRTRAYHEIWLDGEQVGGGEDVEPIYGRTYLPRKFKTAVGVPPHNDVDVYANDLGFAAVADGSRLIGFNVSAGGTGRNTGIPATFPRLADVLGFVEPERTLAVAEAVVTTQRHFGDRLDRTQARLKYTIERMGLDAFRDEVERRAGIRFAPARPIGFTDQGDRTAWVRGQDGRWHLTLYIESGRLIDGPGQSSMQGLREIARIHQGDFRITPNQNLIVARVPEPGKSEIEALARKYGLLDKGIALRLNGMSCVALPTCPLAMAEAERYYPDFLAQVERLTRKHGLAEQEIVTRMTGCPNGCARPYLAELALVGKGPGRYNLMLGGNGRRYRLNRLYRENLDEAAILAEIDTLLGRYAACRQPGERFGDYLIRDGIVRPVVNPAEDFHE

SEQ ID NO: 64191 - protein, 180 aa, Azoarcus sp. EbN1
MAIYALGERVPDFGEGCWVADNATVIGQVHAGRNVSIWYNVVIRGDNDPIVIGDNTNIQDGSILHNDDGVPLTIGSNVTVGHMAMLHGCTVGDGSLIGINAVVLNHAVIGKDCIVGANALIPEGKVIPDRSLVVGSPGRIIRELSDDDIAGLRTNAANYVANAQMYAAESRHINPLKPVK

SEQ ID NO: 64192 - protein, 182 aa, Shewanella sp. MR-4
MSEPLRTYQGIHPQLGDNVYVDPASVLVGDIALDTDASIWPMVAARGDVNHIRIGKRSNVQDGSILHVTRKSASRPEGHPLLIGDDVTIGHKAMLHGCKVGNRVLVGMGAIILDGAILEDDVILGAGSLVPPGKVLQSGYLYVGSPAKQARPLTEAELKFLPESADNYVRLKNEYLAEPQPE

SEQ ID NO: 64193 - protein, 418 aa, Burkholderia vietnamiensis G4
MPYQHIKVPEGGDKITVNKDFSLNVSDQPIIPYIEGDGTGFDITPVMIKVVDAAVAHTYKGKRKIHWMEIFAGEKATKVYGPDVWLPDETLQVLKEYVVSIKGPLTTPVGGGIRSLNVALRQELDLYVCLRPIQYFKGVPSPVREPQKIDMVIFRENSEDIYAGIEWAAGSEQAKKVIKFLQDEMGVKKIRFPETSGIGIKPVSTEGTERLVRKAIQYAIDNDRKSVTLVHKGNIMKFTEGLFRDAGYALAQKEFGGELIDGGPWMRVKNPKTGAEIVIKDSIADAFLQQILLRPAEYDVIATLNLNGDYVSDALAAQVGGIGIAPGANLSDSVAMFEATHGTAPKYAGKDYVNPGSEILSAEMMLRHLGWTEAADTIIAAMEKSILQKRVTYDFARLMEGATQVSCSGFGDVLIENM

SEQ ID NO: 64194 - protein, 118 aa, Arabidopsis thaliana
MPEEESIDIKFRLYDGSDIGPFRYSAASTVDFLKQRVVSDWPKGKTVVPKGINEVKLITSGKILENNKTVGQCKTPFGDIAGGVIVMHVVVQPSLAKSKTEKKVDKAPKAVICTCTIL

SEQ ID NO: 64195 - protein, 207 aa, Brassica napus
AMLTVDFWVLFVSFLCGVGTGLAVMNNMGQIGLALGYTDVSIFVSMTSIWGFFGRILSGTLSEHFLKKAGTPRPLWNAASQILMAVGYLLMALAVPNSLYIGSMVVGVCYGVRLAITVPTASELFGLKHYGLIYNILVLNLPLGSFLFSGLLAGFLYDAEATPTPGGGNTCVGAHCYRLIFLVMALASVIGVGLDILLAYRTKEIML

SEQ ID NO: 64196 - protein, 441 aa, Bifidobacterium longum DJO10A
MGHDLSQDAEIWDDAYKLDRAHVFHSWHAQRNLDPTEVVTGHGVWLKYGDGREMLDFTSQQVNVNIGYQHPKVIEGIKKQAELLCTVGPDYANLARGRAASLVARRAPEGFDKVFFTNAGADANENAMRAARLFTGRDKILSSYRCYHGNTGAAISATGDWRRKPNDYSRGHVHFFTPYLYRSEFSATTQEEECERALAHLEHVIQFEGPDTIAAVLLESVPGTAGIIIPPKDYFKGVREITKKYSILMITDEVMAGFGRTGFWFALDDYDYTPDIISFAKGCNSGYVPAGGVIMSDPVAHRFDDIVFPGGLTYSGHPLAMGAIVATQEAMEEEHIVDNAYTIGKDVLGPQLTALYDKHPKIGEVRGKGVFWAVEMVADRTTKEPLDDATMKQIVAEGDKRGLILGVHNNRIHVTPPCVISADEATQGVEILDQVLTAAGC

SEQ ID NO: 64197 - protein, 358 aa, Ostreococcus tauri
MRARCVERGVEERRASVRFERKCRATRSSRGSSLKTRSASSGVVSMATFKQFSEVFANLFPIWTILAAVVGVLRPESFAFMTSNGYTGCLALLMFSMGITLTIDDFKRVFAKPGLIGLGFIMCYVIMPALAFFIGNALGLSGPLLAGLILVGSINGGQASNLCAYIARGDVALSVLMTTATTVGCIFMTPLICKLALGAVVDVDAVGMAISTIQVVLVPVVVGLTLNKYVPKFCRSVEPFSPIVGVTMTIILVGGAVANCAAGILGAGMTLQIAAFALHLIGGLAGYWGARAFKYGETTCRTVAIETAMKSSAFGFLLASLHFPEYLVRVPSAVSVVWMAVLGSTMAVVWRFIPVKEG

SEQ ID NO: 64198 - protein, 129 aa, Glycine max
MAVDHQEPNQHQPSMFPWQLRRRVPLLRRRKVQTVRLGGKKPRRRISGILRMFRRMRLRWLKLQYVRMLKRLKEQYRNIVKDLVEAGSTIETFQQRLFMESTFAIPVGVNLSTYPSRFGSDHRPRTIFM

SEQ ID NO: 64199 - protein, 471 aa, Pseudomonas fluorescens Pf-5
MTPDKKVKILATLGPAIDGIEDIRELVQAGVNIFRLNFSHGAHADHAQRYEWIRQVERELNYPLGILMDLQGPKLRVGTFAEGKVQLVRGQALRLDLDATPGNAQRVSLPHPEIIAALEPGMDLLLDDGKLRLRVIAKQADAIETTVLNGGELSDRKGVNVPQAVLDLSPLTAKDRRDLSFGLELGVDWVALSFVQRPEDIREARALIGDKAYLMAKIEKPSAVTQLREIAELSDAIMVARGDLGVEVPAESVPQIQKNIISTCRQLGKPVVVATQMLESMRFSPAPTRAEVTDVANAVAEGADAVMLSAETASGEYPLEAVQMMSKIIRQVETGPDYQAQLDVSRPQAEATVSDAISCAIRRVCSILPVAVLVNYSESGSSTLRAARERPSVPILNLTPNLATARRLTVAWGVHSVVNDRLRQVDEVCATALEIAQAQGLAKRGDTVVITTGVPFGQPGTTNSLRVETLL

SEQ ID NO: 64200 - protein, 339 aa, Saccharophagus degradans 2-40
MTVLVTGGAGYIGSHTCIELIEAGFDVVVVDNLRNSKSESLKRVEKIVGKTIPFHKVDICDKAALSDVFASYKVSSVIHFAGLKAVGESCEMPLEYYRNNVGGTVTLCEVMDEHSVHNLLFSSSATVYGDPASVPILESFPTGATNPYGRSKLIVEEILRDVCKIPNSNWRISLLRYFNPIGAHISGTIGEDPQGIPNNLLPYVAQVAVGKLPKLGVFGSDYDTVDGTGVRDYIHVVDLAKGHVKALQKLEKSEPAAYTYNLGTGQGYSVLQVVEAFEKASGKKVPYELKPRRPGDIAECYADPALAASELGWKAEFGIERMVEDTWRWQSSNPQGYEG

SEQ ID NO: 64201 - protein, 137 aa, Haloarcula marismortui ATCC 43049
MVQLGLVVAQYDKHGAVIEEMEHGAYEAAADNDAEIVASIDVPGSYDTPLAADRLARRSDIDAVAVLGAIISGDTDHDQIIGNAAAQGLTDVSLDRDTPVTLGIIGPGMSQDEAEARTDKGDSAVRSAIELATELEQ

SEQ ID NO: 64202 - protein, 602 aa, Physcomitrella patens subsp. patens
MAQLPNLDNGPVNLSNLREQAQRELGEVLDSMRGKKVLVLDPQLSGPLALIAQTSLLKEHGVENLYYVDADPVQTECKNVIYLVRPRIPLMKQIVAHIEQDNGRQLQKSYSVIFMPRRTIVCEKVLDEVKAVGNVTIREFPLYFIPFDEDVLSLELERSFKETKVDGDTSSLWYMARAITKLQELYGVIPNVKGKGKAASQVSDILLRMQREQAPPLPASAKPPEIDTLILIDRQVDMVTPMCSQLTYEGVIDEINNGAVEVEPSVMGAPPSNNAQVSTKKVKVPLNSSDKLYREIRDLNFGVVGQVLRQKAVSIKQDYSDVTAADNQSISDVKDFVKKLNVLPEITRHVNIAQHLSKFTTKPTFLSRLSMEQTLVEGQNYDASFTYVEEMIHRQEPIESVLRLLILLSVTNNGLPKKHYDYLRRELLHSYGFEHMFTLSNLEKAGLLIKQEAKSNWQAVKKGINLVPEENDDINPSDIAYVFSGYAPLSIRLVQWALRGEWQQSEFLRLLPGATFERFEKNQEVNIIRRETVPSTDSVPGTDARRLVILVIFIGGVTFAEISALRFLESQEGMKYDFIIATTKLVNGTTLVKSLIDDPSAS

SEQ ID NO: 64203 - protein, 386 aa, Haloarcula marismortui ATCC 43049
MTMDFASRVERVEPSATLAISNKAAELEAEGKDVVDLSVGEPDFDTPENIKDAAKDALDAGHTGYTSSNGIPELKEAIANSLHDDGLTQYGPDNLIVTPGGKQALYEIFQTIIDDGDEVALLDPAWVSYEAMAKLAGGTLTRVNTAAHDFQLEGALDDLADAVSDETELLVVNSPGNPHGAVYSRDALEGVRDLAVEHDITVISDEIYKEITYDGVEAVSLGTLEGMEDRTITLNGFSKAYSMTGWRLGYFAAPEELVSQAGKVHSHSVSCAVNFVQHAGVEAITNTDDAVEEMRQAFAERREFLMGLFEDHGVHVPEPQGAFYMMPEIAPDGDDTEWCDQAISEAQVATVPGTAFGTPGYARISYANSKERLQEAVDRLAEADLI

SEQ ID NO: 64204 - protein, 543 aa, Zea mays
PRVRPFFLFIELALVLCFITLYYRHLQSKKTSPLEPTEWPVVGHLPGLVANIHRFHDWATGVLAGVGCNFEARGGRTGLRYFITCDPSNVRHIFTSNFANYPKGEEYAAIFDVLGGGIFNADGESWRRQRVKAQMLMTGPRFRAFTARCSRDKVERSLLPFLAHHAAADDEGRPTPCDLHDVFLRLTFDMTCTLVFGVDPGCLALGLPGVPFARAMDDALETLFLRHITPTACWKLMSVLGVGQEKKMAAARRTIDCFVATTVAKRRADKLREGEGEGVCSSFDLLSSFICHEDDSSENDDDDDVFLRDTTVNLLLAGRDTTGAALSWFFYLVSKNPRVEQKLLDELAPIVASRRRAGGAAADAASGMVTFDADELGSGLVYLHAALSECLRLYPSVPFEHKVAAAALVLPSGGPRLPGPKVLVFNYSMGRMEGVWGKDCTEFRPERWLNEDGTKLRYEPSYKFISFNAGPRTCLGKEMAFVQMKAVAAAVLWNFAVEVVPGHVVEPKLSIILHMKNGLAVKVRRRDGTYGAAPPSSVTPLLF

SEQ ID NO: 64205 - protein, 635 aa, uncultured marine proteobacterium ANT8C10
MSFKELGLSEPILKSLEDLEHTKPSEIQQQAIPVILAGKNIMAAAQTGTGKTGSFVLPMLEMLHEQAKPYSKNVHALVLTPTRELAAQVRESVHSYGKLTNITSTAVFGGAKIFPQKAKLKKGVDILVATPGRLLDLVNQKAVKLDQVQILVLDEADHMLDMGFIHDIKKIIAMTPPTRQNLLFSATFSPEIKKLAQSLGDGLVEISAQSPNTTVSKIKQIVYHVDKNKKSDLLAHMIEEEQWDQALVFSKTKHGCEKIADYLNAAGIETGTIHGDKTQGARTKALREFKGKFVRVLVATDVAARGIDISNLPFVVNFDMPTYPNDYIHRIGRTGRAGQEGTAISLMSSDEHKFLRGIEGLLKIKIDQTSHEAFKPNDKPSGGGRGDSRSRSPRGRKPAFSRNNRSSDGKSGNSYSKPGGSSSRPGNAEGRPERSGAGRPNSGGAGRPSNGGGRPNSGAGRPERSGAGRPNSGAGRPERSGAGRPSSGGAGRPSNGGGRPNSGAGRPSNGGGRPNSGAGRPERSGAGRPNSGAGRPERSGAGRPNSGAGRPERSGAGRPSSGGAGRPSNGGGRPNSGAGRPERSGAGRPSGNSANKPYDKKQDQSQKLAGKRIKSFWSISPDNQLIARVISFLRS

SEQ ID NO: 64206 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPAYAGQDKVNPGSIILSAEMMLRHMGWTEAADLIVKGMEGAINAKTVTYDFERLMDGAKLLKCSEFGDAIIENM

SEQ ID NO: 64207 - protein, 514 aa, Shewanella sp. MR-4
MTTTKRPIALLILDGWGYRENTHMNAIYHANTPVLDRLNAQYAHGLISGSGLDVGLPDGQMGNSEVGHINLGSGRIVYQELTRISKAIADHEFEQNPALCDAVDVAVKAGGAVHIMGLLSPGGVHSHEEHIEAMCRMAVARGATKVYLHAFLDGRDTPPRSAKGSLSHFDDLFTTLGHGRIASIIGRYFAMDRDNRWDRVSQAYDLITQGKAKFQYDNAVTALEAAYERNENDEFVSSSAITDSEGKVASLNDGDALIFMNFRADRARQITRSFINADFDGFERAVTPKVNFVTLTEYAADIKAPIAYPSENLVNTLGEVLQNRGRTQLRISETEKYAHVTFFFNGGKEEPFNGEDRILINSPKVATYDLQPEMSSTELTDKLVAAIESAQYDVIICNYPNGDMVGHTGNFDAAVKACEAVDACIGRVVDALAKVGGECIITADHGNAEQMTDETTGQAHTAHTSELVPFVFVGRDATIDEGGKLSDVAPTILHLMGETIPAEMTGKPLIHVKE

SEQ ID NO: 64208 - protein, 365 aa, Zea mays
MSLAVPVTLKTTQSGENERLEYAVSAMQGYRLNMEDAHAIVLNLDAATGTSFFGVYDGHGGPAVSKYCARHLHAELRRHESFRDNLQTAIERTFLRMDEMMRDRRAGRELSGYGGNDNWKAYRKAINMSLFLPFCQKPAYQGPVMDGCTACVVLIRDNRIIVGNAGDSRCVLSRNNQAIDLSTDFKPNLPDERQRIEAAGHVVTFSERGNVHRIDDGIAGSRSLGDLMYKDNNDLGPLPQAITAFPEVRTEEITQDDQFLIIACDGIWDCLTSQQAVDFIRIYSFADVGLASICEALLAHCVAQPRGRDNMTVILVRFKTPGACQVRASNVPPPPIRQDAAASQAAGSQAAAASQAAGSQAAAGH

SEQ ID NO: 64209 - protein, 800 aa, Delphinium 'MagicFountains dark blue'
MEMLGKRSNYSLLSQFPDDDTHHHQPPYHHSNFPYESHSADGKKNKGKLDWDGDHRHQLGGGRIAGFAPSIGLQRQSSGSSFAESSISGDYGVPTNDPEVFGCFQDEMLQSGELAAARGREAAASSSTKSWAQQTEESYQLQLALALRLSSDATCADDPNFLDTLPDESNRSSLVSAEVLSHRFWVNGCLSYFDRIPDGFYLINGMDPYVWTICTDMQKNGRVPSIESLKAMHPGDNSLVEVVLIDNHTDYRLKELHSRVISLSQSCNSSNELVEQLGRLVCIHMGGAASPDESDLAPRWKECSEVLKDCLDSVVIPVGSISIGLCRHRALLFKVLADIIDLPCRIAKGCKFCRTADASSCVVRVGLDREYLVDLIEKPGCLYEPDSLLNGPSSILIPSPLRLPNFNPVERTEDSKSLAKKYLMDCQSLNLVFSDAPAGLSDNMQHQTDPSFEHLDGTHADMVNLMSVSGSADSSVSLPPKVAQSEEHGWQRVRPTHTSRDPGSQVVPSTEFSFDVEDLDIPWDNLIIKEKIGAGSFGTVHRADWNGSEVAVKILMEQDYHATCFKEFIREVALMKRLRHPNIVLFMGAVTRRPHLSIVTEYLARGSLYRLLHKSDPREIPDEFRRISMAYDVAKGMNYLHRRNPPIVHRDLKSPNLLVDNMYTVKVCDFWLSRLKANTYLSAKSAAGTPEWMAPEVLRDEHQTEKCDGYSFGVILWELMTLQKPWNNLNQAQVVAAVGFKHKRLPIPSSLDPDIAVLIEACWSKDPSKRPSFSSIMEYLQSLVAPPTPQPAHSAFSTLT

SEQ ID NO: 64210 - protein, 338 aa, Shewanella sp. MR-4
MKNSADITVLGAGSYGTALAISLASNGHKTLLWGHDPAHMQTLAQDKCNQAFLPGIAFPECLHIEADLAKALAASNNVLVVVPSHVFGSVLAQAKPLLRQDARIVWATKGLEPETGRLLQDVARDVLGEQYPLAVLSGPTFAKELAMGLPTAISVAGTCPKFTAELVELLHSPKRLRVYANDDFIGLQLGGAVKNVIAIGAGMSDGIGFGANARTALITRGLVELTRLGEALGASTATFMGMAGLGDLVLTCTDNQSRNRRFGLALGKGCDVDTAQAEIGQVVEGYRNTKEVFTLAKRMGVEMPITEQIYQVLYQGKAPLDAAKELLSREKKSETPAQ

SEQ ID NO: 64211 - protein, 172 aa, Streptococcus pyogenes M49 591
MVTTVKMTSGYEIPVLGFGTYQAADGEEAYQSTLAAIKAGYRHIDTAAIYKNEESVGRALKDSGVLREDLFITTKLWNDAHSYEGAKDALAASLDRLGLDYVDLYLIHWPNPKALRNTWKEANAQAWQYMEEAVEAGLIKSIGVSNFMVHHLEALQETAKITPAINQIRLAP

SEQ ID NO: 64212 - protein, 618 aa, Helicobacter pylori J99
MILQNKTFDLNPNDIAGLELVCQTLRNRILEVVSANGGHLSSSLGAVELIVGMHALFDCQKNPFIFDTSHQAYAHKLLTGRFESFSTLRQFQGLSGFTKPSESAYDYFIAGHSSTSVSIGVGVAKAFRLKQTLGMPIALLGDGSISAGIFYEALNELGDRKYPMIMILNDNEMSISTPIGALSKALSQLMKGPFYQSFRSKVKKILSTLPESVNYLASRFEESFKLITPGVFFEELGINYIGPINGHDLGTIIETLKLAKELKEPVLIHAQTLKGKGYKIAEGRYEKWHGVGPFDLDTGLSKKSKSATLSPTEAYSNTLLELAKKDEKIVGVTAAMPSGTGLDKLIDAYPLRFFDVAIAEQHALTSSSAMAKEGFKPFVSIYSTFLQRAYDSIVHDACISSLPIKLAIDRAGIVGEDGETHQGLLDVSYLRSIPNMVIFAPRDNETLKNAVYFANEHDSSPCAFRYPRGSFALKEGVFEPSGFVLGRSELLKKEGEILLIGYGNGVGRAHLVQLALKEKNIECALLDLRFLKPLDHNLSAIIAPYQKLYVFSDNYKLGGVASAILEFLSEQNILKPVKSFEITDEFIMHGNTALVEKSLGLDTESLTDAILKDLGQER

SEQ ID NO: 64213 - protein, 510 aa, Arabidopsis thaliana
MEKLLAGQTNNGSLKSKTKIVCTLGPASRSVEMVEKLLKAGMNVARFNFSHGSHSYHQETLDNLRTAMENTCIPCAVMLDTKGPEIRTGFLKEGKPVELIQGQEITISTDYTMEGDSNTISMSYKKLAEDLKSGDVILCSDGTISLTVLSCDKNLGLVRARCENSAVLGERKNVNLPGIVVDLPTLTEKDQEDILQWGVPNKIDIIALSFVRKGSDLVEVRKLLGENAKSIMLMSKVENQEGVMNFDKILEYSDAFMVARGDLGMEIPIEKMFLAQKMMIQKANALGKPIVTATQMLESMTKSPRPTRAEATDVANAVLDGTDCVMLSGETAAGAHPETAVLTMSRICKEAEDFIDYDTMHKKIQDIVSLPLSPIESLAASAVSTARSLCAAAIVVLTKGGYTVELVAKYRPSVPILSVIVPEITRTDDFEWSCSESAAHVARRGLIYRGIVPVMATGASARSSNKDSTEETIQFAIEFAKKKGICKTGDSIVALHKIDGSSVVKILNVE

SEQ ID NO: 64214 - protein, 315 aa, Thermobifida fusca YX
MRFDSLLDSLGGTPLVGLPNLSPSPEVRLWAKLEDRNPTGSIKDRAAFYMIEQAEKDGLLTPGCTILEPTSGNTGISLAMVARLRGYKMVCVMPENTSAERSQLLRMWGAEIYYSPAEGGSNEAVRVAKRMAAENPDWVMLYQYGNPANARAHYETTGPELLADLPEITHFVAGLGTTGTLMGVGRYLREHRPDVQIVAAEPRYGELVYGLRNLDEGFVPELYDETILSSRYSVPSDAALRRTRELLDKEGIFAGISTGGVLHAALGVAQKAVKAGQRADIAFVVADAGWKYLSTGAYEGTLEEAAQRLEGQLWA

SEQ ID NO: 64215 - protein, 542 aa, Prochlorococcus marinus str. MIT 9215
MIRFEGVSKIYSTDIVLKNINWEIKKGEKVGLVGSNGAGKSTQFKILIGEEEQTSGKIVKEGNPKIAYLKQEFDCNLTFSVRQELESSFKDIQIVAIKLLEIENKMRSLDIKKNSDELAIFVNQLAKYQAKFEALGGYKMKSDVEKILPKLGFSIEDADKLVGNFSGGWQMKIALGKIILQKPDLLLLDEPTNHLDLDTIFWLEGYLSSLKISVIIISHDRYFLDKLCKKIIFVDRGTSEIYNGNYSFFVEQKSLNEESKNKAYQLQKKEIELQKRYIDRFRASATRSSQAKSREKQLQKITKIEAPIAKSKSPVFNFPECPRSGKLVLNIKNLSHSFEDKILFLDVNLKISSGDKIALLGPNGCGKSTLLKIIMKKISPEIGEINLGKHNIITSYYEQNQAETLSLEEKVIDLVCDKSPEWSQKRVRTFLGGFGFQNETVFKYIKQLSGGEKARLALALMIINPSNFLLLDEPTNHLDLQSKENLELAIENYKGSLLIISHDRYFISKVANRIVEIKDSKLFSYDGNYEYFLEKTQTHKKI

SEQ ID NO: 64216 - protein, 628 aa, Alkalilimnicola ehrlichei MLHE-1
MSVSIDDYPLLAQVPDPEALRTLPAHRLPALAKELRHYLLHSVARSGGHLAAGLGAVELTLALHYVFNTPEDRLVWDVGHQCYPHKILTGRRERLGTIRKYGGLAGFPKRAESPYDTFGVGHSSTSISAALGMALAARQAGEQRKAVAIIGDGGMTAGEAFEAMNHAGDAGADLLVVLNDNEMSISENVGALSQHLTRILSGRWYHQLRSGSKEVLRRLPPPVHELARRTEEHLKGMVVPGTLFEELGFQYFGPVDGHNVDALVEVLGNLAHQRGPRLLHVVTCKGKGYRPAEQDPIAYHGVGQFDPEQGLPKKSGGSLAYNQVFGRWLCAMAEQDPRLVAITPAMREGSGMVEYARRFPERYHDVGIAEQHAVTLAAGLACESVKPVLAIYSTFLQRGYDQLVHDVALQNLPVLFAVDRAGLVGADGPTHHGSFDLSYLRCVPNMTIAAPSDEAECWRLLSTGYHHDGPFAVRYPRGSGPGAALPEADLDPLAIGKGVCRRRGRRIAVLAFGTLVVPALAVAEALDLTVADMRFVRPLDEALIRELADTHDLLVTVEENAVAGGAGSGVSEYLARAGLDVPVRHLGLPDRFVDHGTPAELLAEVGLDEAGLQRSLQGWLDTLPGASR

SEQ ID NO: 64217 - protein, 269 aa, Enterobacter nickellidurans
MTQPAQNWLVINYRLEQAMPCEELDIVWNNIKAEARALADCEPMLASFYHAALLKHENLGSALSYMLANKLASPIMPAIAIREVVEDIKAEARALADCEPMLASFYHAALLKHENLGSALSYMLANKLASPIMPAIAIREVVEEAYAADPEMIASAACDIQAVRTRDPAVDKYSTPLLYLKGFHALQAYRIGHWLWNEGRRALAIFLQNQVSVTFQVDIHPAAKIGRGIMLDHATGIVVGETAVIEDDVSILQSVTLGGTGKTSGGHHR

SEQ ID NO: 64218 - protein, 741 aa, Bacteroides thetaiotaomicron VPI-5482
MQNKARKNYIIYVLMLLLFGGLIYVAIEEGDRFSHHAANTLNTVQDGPFAMFLQFMQDNLHHPLTTLLIQIIAVLLMVRLFGYLFSLIGQPGVIGEIVAGIVLGPSVLGLFFPEAFHFLFPVHSLTNLELLSQVGLILFMFVIGMELDFSVLKNKINETLVISHAGILVPFFLGILSSYWIYETYAADHTPFLPFALFIGISMSITAFPVLARIIQERNMTKTPLGTLAIASAANDDVTAWCLLAVVIAISKAGSFASALYSVGLAVAYIAVMFLVVRPFLKKVGEVYANKEAINKTFVAFILLILIISSCLTEIIGIHALFGAFMAGVVMPSNLGFRKVMMEKVEDISLVFFLPLFFAFTGLRTEIGLINSPELWMVCLLLVTVAIVGKLGGCAIAARLVGESWKDSLTVGTLMNTRGLMELVALNIGYEMGVLPPSIFVILVIMALVTTFMTTPLLHLVERFFVHREEKLSLKRKLIFCFGRPESGRSLLSIYDLLFGKQLKKEHVIAAHYTVGTDLNPLDAQHYESESFALLNQRAVELNIQVDNHYRVTDKLVQEMIHFIRKEHPDMLLLGAGSHYRPEMPGTPGAILWLTLFRDKIDDIMEQVKCPVAVFVNRNYREGALVSFVLGGMIDVFLLSYLNIMLQNGHSVRLFLFETDDEEFHQCIDDLLAHYADQIVVVWFAGVEELVTKERDGLLVMSHLSYTKLSEDELVMRELSSLLVIRRNKNKGEKNERLEIG

SEQ ID NO: 64219 - protein, 128 aa, Zea mays
  misc_feature (61)..(61): Xaa can be any naturally occurring amino acid
  misc_feature (81)..(81): Xaa can be any naturally occurring amino acid
  misc_feature (90)..(90): Xaa can be any naturally occurring amino acid
PTAYDDSQARSSADKLELNQRDPVDGKAAQLLKIHAIKSKCRFEQLEYAQDTRQNAWQQFXTTGKAKKAGVFSCRMRESFXESPDDHIGXVGVTGIGKGLTDFHRREKLVLLTGGSCDAADDDQEYTE

SEQ ID NO: 64220 - protein, 377 aa, Ostreococcus tauri
MSACISASVTRARTARAPAARRAASKARASPRAVAARAGGVGTPYTTWILQQEMQENIDGELAVVLSSIGLACKQIASLVQRAGLAGMTGLAGEQNVQGEDQKKLDVISNDVFCNVLRQSGRTGVIASEEEDVPVAVEETYGGNYVVVFDPLDGSSNIDAAVSTGSIWGIYESDSSCIPDFGSDDSAKVEEKCVMNVCQPGSNLLCAGYCMYSSSTILVITIGQGVFGFTLDPTVGEFIMSHENIKVPDSGKIYSFNEGNYAMWSDGLKKYMDSLKTGGKDGGKPYSARYIGSLVGDFHRTILYGGIYGYPGDAKNPNGKLRLLYECAPMSMIAEQAGGKGSTGVARVLDIVPEKVHQRVPFFVGSKNEVAYLESFM

SEQ ID NO: 64221 - protein, 597 aa, Arabidopsis thaliana
  misc_feature (90)..(90): Xaa can be any naturally occurring amino acid
MVRSFMRGKKNCKTMKFFVLVLLLVLQFFSNKALSQSEEGEFGFNGYLYDNSGIAITNSKGLMKLTNSSEFSYGHVFYNSPVRFKNSPNXLSSEKASTAGYYEDDDGTFKNIRLINQKPIQAWIEYDSSRRQLNVTIHPIHLPKPKIPLLSLTKDLSPYLFDSMYVGFTSATGRLRSSHYILGWTFKLNGTASNIDISRLPKLPRDSRSTSVKKILAISLSLTSLAILVFLTISYMLFLKRKKLMEVLEDWEVQFGPHRFAYKDLYIATKGFRNSELLGKGGFGKVYKGTLSTSNMDIAVKKVSHDSRQGMREFVAEIATIGRLRHPNLVRLLGYCRRKGELYLVYDCMPKGSLDKFLYHQPEQSLDWSQRFKIIKDVASGLCYLHHQWVQVIIHRDIKPANVLLDDSMNGKLGDFGLAKLCEHGFDPQTSNVAGTFGYISPELSRTGKASTSSDVFAFGILMLEITCGRRPVLPRASSPSEMVLTDWVLDCWEDDILQVVDERVKQDDKYLEEQVALVLKLGLFCSHPVAAVRPSMSSVIQFLDGVAQLPNNLFDIVKARENVGAIEGFGEAAESLAEPCSVATLTFTEPFVSHGR

SEQ ID NO: 64222 - protein, 110 aa, Ostreococcus tauri
MRDRRRGAARRARAREWDGDAIWRRSARRTRGVTDDGRARDAQAASARVMNHRSKKFHGNIHRRGEVSAKDAKKKEFGVGPVMLGFFCFVVIGSSVLQVLRSASSGALGT

SEQ ID NO: 64223 - protein, 636 aa, Neisseria gonorrhoeae
MNILSVENASFAVGHVALLDKTSFQLDSGEKVGLIGRNGAGKSSFLKILTGVQKLDDGQIIVQNNLKIVYVPQESFFDKDATVFDTVAEGLGEICDLLRRYHHVSHELENGSSELLLKELNELQLEIEAKDGWKLDAAVKQTLGELGLPENEKIGNLSGGQKKRVALAQAWVQKPDVLLLDEPTNHLDIDAIIWLENLLKAFEGSLVVITHDRRFLDNIATRIVELDRGILRSYPGSFSKYSEKKAQELAVEAEHNRLFDKFHAQEEAWIRKGIEARRTRNEGRVRRLEELRRQRAERRNVQGQVNFKLDSGKKSGKIIAELEHASFAYDDKVIMDKFSAILQRGDKIGLIGPNGIGKTTFLKLILGELQPTYGRIRIGSKQEVAYFDQFRSALNENDTVFYTLGQGNDYVEVGGKKKHVMSYLEDFLFPPARAQSPVSSLSGGERNRLLLAKLFTRPANILVLDEPTNDLDIDTQELLEDLLRDYQGTVFLVSHDRMFLDNVITQSIVFEGQGRLKEYIGGYQDYIDAKSREDKIQTASAPKASDVEPAKEKPKANRTVKLSYKEQRELDALPDEIAALETEQAEINAQLSDPGIFKDYEKAGALQNRAEEIEMLLLEKLERWELLETKQNGNAV

SEQ ID NO: 64224 - protein, 110 aa, Zea mays
  misc_feature (22)..(22): Xaa can be any naturally occurring amino acid
  misc_feature (92)..(92): Xaa can be any naturally occurring amino acid
VPVSSFPLGLEFNKGSLQNFPXKKAGCGPFSAKLKFVSLGKQTCPLRTQSSKTQGPVDFRVGIQLAFFGPDKPKSVLNSWYKVSPLRQYPLXGLYPPPKDPLSGQFTKIF

SEQ ID NO: 64225 - protein, 321 aa, Oryza sativa Japonica Group
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEMHRHLRARVHRLLRHRSQAQRPRLTCSRKCINFPSICVCTLQQFAHCKNSSSLLLFNFDKSKVLAPLPIGFAVFMVHLATIPITGTGINPARSLGVAVVYNNNKAWSDQWIFWVGPFIGAAIAALYHQVILRASARGYGSFRSNA

SEQ ID NO: 64226 - protein, 228 aa, Saccharophagus degradans 2-40
MSIPQAKRDFKIAPSILSADFARLGEEVDAVLKAGADFVHFDVMDNHYVPNLTFGPMVCKALRNYGITAPIDVHLMVDPVDDLVKTFADAGATYISFHPDASRHADRTVKLIRDLGCKPGVVLNPAVTLESVKHLLDQVDMLLLMSVNPGFGGQKFIPYTLDKLKEARARLDDAGLEARLEVDGGVSTANIADVARAGADTFVAGSAIFGAQNYESVIKQMRDTLAQL

SEQ ID NO: 64227 - protein, 141 aa, Acidobacteria bacterium Ellin345
MKTLQRTLSIIKPDAVEKNAEGDIISILLNNNFRILGIKMLHLTKNQAEGFYAVHANKPFFHSLTDFMASGPIVVMCLEKENAIADYRKLMGATNPANAEEGTIRKKWAASIEKNAVHGSDADDTARFELSYFFAGYELAR

SEQ ID NO: 64228 - protein, 720 aa, Oryza sativa Indica Group
MVRQAPADLSAEQLVGLLRPLTPRLYSIASSQAENENEVHITVGVVRYDIDGRARSGGASGFLADRLEEDGDVRVFIEHNDNFRLPANPETPVIMIGPGTGIAPFRAFMQQRDADGAGGKNWLFFGNPHFTEDFLYQVEWQRYVKDGLLTRIDLAWARKCGAGFRKARTFTSAAMPIAWRKTWNTHYWNWWPEHGGMDTEQADEFLSELRLERPYSARCLLMSDKHPGPLVVEGKLADAERMKKESNFLRGTIAEDLNDGLTGGFNGDNFLLIRFHGMYQQDDRDIRAERAEQKLEPRHAMMLRCRLPGGVISPQQWLGIDKFAQESTLYGSIRITNRQTFQFHGILKGNVKPVHQLLNRLGLDALATANDVNRNVLCTSNPVESELHQEAYEWAKKISEHLLPRTRAYAEVWLDQEKVATTDEEPILGPTYLPRKFKTTVVIPPQNDVDLHANDMNFVAIAENGKLVGFNLLVGGGLSIEHGNKKTYARQSSEFGYIPLEHTLAVAEAVVTTQRDWGNRTDRKNAKTKYTLERVGVDVFRAEVEKRAGITFAPIRPYEFTGRGDRIGWVKGIDDQWHLTLFIENGRLLDYPGRPLKTGMAEIAKIHKGDFRLTANQNVIIAGVPESEKAKIDALARDHGLIDDQISEQRKNSMACVSFPTCPLAMAEAERFLPQFVTKVEGIMHRHGMGDEHIVLRITGCPNGCGRALLAELGLVPADC

SEQ ID NO: 64229 - protein, 297 aa, Marinobacter sp. ELB17
MYFPTIEDYVGKTPLVRLQRLPGDTSNVILAKLEGNNPAGSVKDRPAISMIQQAEIRGDIKPGDTLIEATSGNTGIALAMAAAIKGYRMVLIMPSNMSEERRASMRAYGAEIIAVSKEDGMEGARDLAERMQAEGKGKVLDQFANADNPLAHYRTTGPEIWQQTNGRVTHFVASMGTTGTVMGVSRYLKERNPDVRIVGLQPSEGAAIPGIRRWPEAYMPKIFDAKAVDQVMDIGQVEAETTMRALAEKEGIFCGVSSGGSIAAALRLSQTLENAVIVGIICDRGDRYLSTGVFPGA

SEQ ID NO: 64230 - protein, 290 aa, Oryza sativa Japonica Group
MGKDEVMESGCAAGEFAAKDYTDPPPAPLIDAAELGSWSLYRAVIAEFIATLLFLYITVATVIGYKHQTDASASGADAACGGVGVLGIAWAFGGMIFILVYCTAGISGGHINPAVTFGLFLARKVSLVRAILYIVAQCLGAICGVGLVKAFQSAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 64231 - protein, 516 aa, Oryza sativa
MLKSGLQRSLRASVRRPALRNQFQPVRSQFAPALTARYASTGSQKEGSIASVIGAVVDVKFEGEQLPAILNAITTQNGDNKLVLEVAQHLGENVVRCIAMDGTEGLVRGAKAVGTGAPITIPVGHGTLGRIMNVTGDPIDERGPIKTDKFAPIHADPPEFTEQSTSAEVLVTGIKVVDLLAPYARGGKIGLFGGAGVGKTVFIQELINNIAKAHGGFSVFTGVGERTREGNDLYHEMQETSVIQLEGESKVALVFGQMNEPPGARARVALTGLTVAEYFRDQEGQDVLLFIDNIFRFTQAGSEVSALLGRIPSAVGYQPTLAVDMGVMQERITTTSKGSITSVQAVYVPADDLTDPAPATTFAHLDATTVLSRGISELGIYPAVDPLDSKSRILDPRIIGQDHYDTATKVQQILQEYKSLQDIIAILGMDELSEADKLTVERARKIQRFLSQPFAVAQVFTGIEGKLVDLKDTIRSFKAILNGEGDDLPEGAFYMVGDMESARAKGEKILAELEKS

SEQ ID NO: 64232 - protein, 345 aa, Xanthomonas oryzae pv. oryzae KACC10331
MPAVFFYGSRSGQMQRTWQRAWGLVAMWCMSTAVWAQQPVAAVQSTPALVQTEKVMVSTDIGDDIDDAFALGLLLRSPQLQVLGIASAWGDTTLRAQLLQRLLQQAGRSEIPLAVGARTTSSIAFSQARWAARGQLPAALPDAATMILQQARQHPGEVTLLVLGPMTDAALAQQRDPVGFAKLKRVVAMGGSVRVGYGTSAYRPASALAPEYNILADVPAAQRVFAAGVPIVLLPLDATQITLEEPERIALFAHGDGLTDALTQLYYQWRNTDQPWASATPTVFDAVPVAWLLRPALCPTTPLHLDVDAQGYTREGAGKPNVQACLRVDKPALIEMYMRAVLELH

SEQ ID NO: 64233 - protein, 513 aa, Xylella fastidiosa Ann-1
MCSRWMVSAWNEEVTESLFMSRKHAFQFLDLPRQMPQRIPVELRTSGDWRELYGKFDKGEAQYQAGRCLDCGNPYCSWKCPVHNAIPQWLQLVQENRIDEAAALCHSTNPLPEVCGRVCPQDRLCEGSCTLEEFGAVTIGAVEKYIVDTALQQGWRPDLSHVQPTGWRVAVVGAGPAGLACADRLARAGVQAVVYDRYEQIGGLLQFGIPSFKLDKAVMSTRRQVLEGMGVEFRLGVEIGKDLGIEALLEDYDAVFLGVGAYRYTDGGLPGQDLKNVLPALPFLVQNGRIVSGNDPYGRPIAGWEDQVQLPDVAGKSVVVLGGGDTGMDCVRSAIRLGATKVTCIYRRDEANMPGSAREVANAREEGVRFLFNRQPLSIQSGTDKQAIGVTVVETKLAEPDANGRRNAVPIQGTEAVLEADVVIIAFGFSPMLLEWLTAQGVQASSNGRIVVALSDTGDRLTYQTTHPKLFAGGDCVRGADLVVTAVAEGRDAAESIVRWLRATAQVMDVAVI

SEQ ID NO: 64234 - protein, 284 aa, Xylella fastidiosa Ann-1
MPHVTLLPSPSPIAFIGGGNMARSLIAGMIRQGAPSTSICVIEPIAALRDALIADFNIKAVTTATEAATDTSTWVLAVKPQVMPDVCATLPLPVQPNTPLVISIAAGITTCKLKHWLGDTCAIVRAMPNTPALLGAGVTGLFTTSQTTGTQRTIAEELFNSVGKTLWITEEALMDAVTAVSGSGPAYAFLLAEAMETAAIMQGLSTANARTLVQQTLLGAARMMTESGETPAALRHRVTSPHGTTEAAITTFQENDFQALVAKAIDAATRRARALGKINDTDPT

SEQ ID NO: 64235 - protein, 118 aa, Nicotiana tabacum
MAVEELVEIKFRLADGSDIGPNKYASSTTVGSLKEKLMAQWPKDKDSGPRTTNDVKLINAGRILENSRTLGESRLPVAEVPGGVITMHVVVRPPIHDKNNDKLKEDSPTKGGCACTIL

SEQ ID NO: 64236 - protein, 510 aa, Thlaspi japonicum
MSESERARPFLESEEKAFEETDKVHVVGVDEDDDVGYDELGNAPPFSWKKLWLFTGPGFLMSIAFLDPGNLESDLQAGAIAGYSLIWLLMWATAIGLLIQLLSARLGVATGRHLAELCREEYPTWARMVLWIMAEIALIGADIQEVIGSAIAIKILSNGLIPLWAGVVITALDCFIFLILENYGVRKLEAVFAVLIATMALSFAWMFGQTKPSGTELLVGALVPKLSSRTIKQAVGIVGCIIMPHNVYLHSALVQSREIDPKKRFRVKEALRYYSIESTGALVVSFIINVCVTTVFAKSFYKTDIADTIGLANAGDYLQEKYGGGYFPVYYIWAVGLLAAGQSSTITGTYAGQFIMGGFLNLKMKKWIRATITRSCAIIPTMIVAIVFNSSATLLDELNEWLNVLQSVQIPFAVIPLLCLVSNERIMGSFKIKPLMQAISWLVAALVIAINAYLMVNFFSGAAKSVVMLVLVIIFVVAYVFFVLYLISRGFTYTPWQLVASEKVKERDDE

SEQ ID NO: 64237 - protein, 364 aa, Mycoplasma penetrans HF-2
MKSINLPTSMKALVFVEKNKIQIVNKPIPTVGPNDALIKVTTTTICGTDIHIVKGEYPVKPGLTIGHEAVGILAAVGDEVTGFELGERVLAGAITPSGYTAACQSGQSSQDGIGTKYGYKPTAGWKFGNIMDGCQAEYVLVKNAMANLARVPNALTDEQVLMCPDIMSTGFSGPENANIKLGDYVGVIAQGPIGLCATTGAKLMGASIIIAIDGNDRRLEIAKELGATHTINFRNVDVVQEVNRITDGRMLDSAIECLGSQSTFEQGFRLLRAGGTLSSLGVYSSDIKLPLDALAAGLGDHKISFALCPGGSERMRRLMSLIENKRVDLRSLVTHTLPFDRIAEGYNIFANQKDGVLKVAIKVS

SEQ ID NO: 64238 - protein, 471 aa, Arabidopsis thaliana
MSASTVSITANTAAATRRTPILAGEKKSNFDYPQSESLANGGVGEAGGTSRDLSRGEATLDRSQGQDLGPVTRRSVSAATGTNTTATQRRTRKVATPKSEKARWKTVVRIFAKQLGALLIIVGLIQLTRKMILKASSPSSPISSYETEMAFSGLESRIAEVDGLVKATTNSMQVQVELLDKKMEREAKVLRQEIERKASAFQSELKKIESRTESLEKSVDEVNAKPWVTKDELERIYEELKKGNVDDSAFSEISIDELRAYARDIMEKEIEKHAADGLGRVDYALASGGAFVMEHSDPYLVGKGSSWFATTMRRAHTNAVKMLSPSFGEPGQCFPLKGSEGYVQIRLRGPIIPEAFTLEHVAKSVAYDRSSAPKDCRVSGSLQGPESSAETENMQLLTEFTYDLDRSNAQTFNILESSSSGLIDTVRLDFTSNHGSDSHTCIYRFRVHGRAPDPVPVVGTNLDQDSSPESE

SEQ ID NO: 64239 - protein, 385 aa, Cyclamen persicum
AGGVAAGAALIFAAPAIAFAWWRRRKPQEYFYDVPAEEDPEVHLGQLKRFSLRELQVATDGFSNKNILGRGGFGKVYKGRLADGSLVAVKRLKEERTPGGELQFQTEVEMISMAVHRNLLRLRGFCMTPTERLLVYPYMANGSVASCLRERPPSAPPLDWPTRKRIALGSARGLSYLHDHCDPKIIHRDVKAANILLDGEFEAVVGDFGLAKLMDYKDTHVTTAVRGTIGHIAPEYLSTGKSSEKTDVFGYGIMLLELITGQRAFDLARLANDDDVMLLDWVKGLLKEKKLEMLVDPDLEKNYVEPEVEQLIQVALLCTQGSPVDRPKMSEVVRMLEGDGLAEKWDEWQKVEVLHEEVELAPHPNSDWIVDSTENLHALELSGPR

SEQ ID NO: 64240 - protein, 297 aa, Mycobacterium avium 104
MVVPRTAIVPAAGLGTRFLPATKTVPKELLPVVDTPGIELVAAEAAEAGAERLVIVTSEGKDGVVAHFVEDLVLESTLEERGKTAMLDKVRRAPRLIKVESVVQSEPLGLGHAIGCVEPRLADDEDAVAVLLPDDLVLPTGVLGTMSKVRAHYGGTVLCAIEVTPEEISAYGVFDVEPVPDDDPDVLRVKGMVEKPKAEDAPSMFAAAGRYVLDRAIFDALRRIDRGAGGEVQLTDGIALLISEGHPVHVVVHRGSRHDLGNPGGYLKAAVDFALDRDDYGPDLRQWLVARLGLSEQ

SEQ ID NO: 64241 - protein, 528 aa, Oryza sativa Japonica Group
MDSARSWFTKLQTREKSIGKKKELPPNGKEGTDEAPSSATKQRVAAAKQYIEKHYKEQMKNLQDRKERRCSLEKKLADANVSEEEQHNIVKQFEKKETEYMRMQRHKMSVDDFDLLTMIGKGAFGEVRVCREKNTGNVYAMKKLRKSEMLRRGQVEHVKAERNLLAEVDHHCIVKLYCSFQDSEYLYLIMEYLPGGDMMTLLMRKDTLTEDEARFYVGETVLAIEAIHRHNYIHRDIKPDNLLLDRHGHLRLSDFGLCKPLDYSNFPDLNEKDVTSTKPQSTNGDGRQQSMPKRTQQEQLEHWQKNRRTLAYSTVGTPDYIAPEVLLKKGYGMECDWWSLGAIMYEMLVGYPPFYSDEPMTTCRKIVNWRTHLKFPEEARLMTDAKDLISKLLCNVDQRLGTKGAEEIKEHSWFSGVEWDKLYEIEAAYQPQVTDELDTQNFEKFEESSDNIQCSAKAGPWRKMLSSKDLNFVGYTYKNFELVNDPEVLGMAELKKKEKAKRPSAKSLFGIPSRALAVLCSSSIRRHI

SEQ ID NO: 64242 - protein, 468 aa, Bartonella quintana str. Toulouse
MSYDVVVIGAGPGGYVAAIKAAQLGFKTAIIEKRMTLGGTCLNVGCIPSKALLHTSEVFAETQHGFEKLGISISKPKLNLEQMMAHKKAVVTANTSGISFLMKKNKIDTFFGTAKILSAGQIEVVARDGNKQTIATKNIVIATGSESSGIPGVNVKIDEKIIVSSTGALALEKVPMRMIVVGAGVIGSELGSVWSRLGSKVTIIEYLNKVLGSMDGEVSRQFQKLMEKQGIEYKTGTKVTAIMQSGSTAQVTFETIKGGASETLEADVVLIATGRFPYTEGLGLVEAGVKLDERGFIAIDANWQTNIPGIYAIGDVVKGPMLAHKAEEEGVAVAEILAGQKGHVNFDVIPSVVYTQPEIASVGKTEEELKAAGIDYNVGKFLFTANGRARAMQKSDGFVKILADKKTDRVLGGHILGFGASEMIHEIAVLMEFGGSSEDLGRCCHAHPTLSEAVREAALATFAKPLHI

SEQ ID NO: 64243 - protein, 410 aa, Bartonella quintana str. Toulouse
MTTGIRVPTLGESVTEATIGKWFKKLGEAVAVDEPLVELETDKVTVEVPSPVMGKLTEIIAKEGDIVEVNAVLGFVESGAAGISQSFSPSATSIPEAPSELEQSPSSSATPSGTMPPAPSAAKLMAENNIAKSDISGSGKRGQILKEDVLGALAQGTKASTSVATLTASSSSAAPIQEMREERVRMTKLRQTIARRLKDAQNTAAMLTTFNEVDMSAVMDLRKRYKDLFEKKHGVKLGFMGFFTKAVCHALKEFPTVNAEIDGTDIVYKNYVNAGIAVGTDKGLVVPVVRDADQMSLAEIEKEISRLGRLARDGKLAVSDMQGGTFTITNGGVYGSLMSTPILNAPQSGILGMHAIKERAMVVGGQIIICPMMYLALSYDHRIVDGQEAVTFLVRVKESLEDPERLVLDL

SEQ ID NO: 64244 - protein, 529 aa, Oceanicola granulosus HTCC2516
MSDEPTIHDLFVIGGGINGCGIARDAAGRGLSVALAEMNDLASATSSASTKLFHGGLRYLEFFEVRLVREALIERETLLRAMPHISWPLRFVLPYHRDMRFESSTPTSRILNTLAPWSRGRRPAWLIRLGLFLYDNLGGRRILPGTSTLDLRTAPEGAPLVDEFETAYEYSDCWVEDARLVVLNARDAEMRGARIMARTKVLGARRAGDLWEIEVEERDSGARRSERARMLVNAGGPWVGDIIHDRVQVDSREGVRLVRGSHIVTRRLFEHDKCYFFQGTDGRIMFAIPYETDFTLIGTTDAEHTDPSVRPVCTPEEQRYMIDFVNRYLKAPISEDDIVWTYSGVRPLHDDGANSATAATRDYTLKVDDTGGAPILNVFGGKITTYRRLAESALARLAPYVPQASGAWTAGVALPGGDFEVEEVEALIARLQERYGFLDARWARRLVRAYGTEADEVLGDAATAADLGRDFGATLTEREVRWLMDREYARTAEDVVWRRSKLGLRLDPPQIAALDGWMETARAHAAAAE

SEQ ID NO: 64245 - protein, 789 aa, Shewanella oneidensis MR-1
MQQYVLWYQELGMGDVNLVGGKNASLGEMISNLANAGVQVPGGFATTSYAFNEFLEQSGVNQKIYDILATLDVDDVNALAKVGAQIRQWVIDTPFQPALEQAIREAYEKLAAETSDASFAVRSSATAEDMPDASFAGQQETFLNVKGFDSVLVAIKHVFASLFNDRAISYRVHQGYEHHGVALSAGVQRMVRSDKAASGVMFTMDTESGNNDVVFITSSFGLGEMVVQGAVNPDEFYVHKPILSQGHKAVVRRNIGSKLIQMVYSDDAAHGKQVKIEDVAADKRRQFSINDAEVMELAKQAMVIEKHYGRPMDIEWAKDGNDGKLYIVQARPETVRSREDVQLIERYHLKSRGAVISEGRAIGHKVGSGVAKVLTSIADMDQIQPGDVLVTDMTDPDWEPIMKRASAIVTNRGGRTCHAAIIARELGVPAVVGCGDVTDRIKNGQWVTVSCAEGDTGFIYEGKQEFEVVSNRVDALPALPMKIMMNVGNPDRAFDFARLPNEGVGLARLEFIINRMIGIHPKALLEFNQQDAALQEEINEMIAGYDSPVEFYIARLVEGIASIGSAFYPKKVIVRMSDFKSNEYANLVGGDRYEPEEENPMLGFRGASRYISESFRDCFALECEAIKRVRNEMGLKNVEVMIPFVRTVKEAEQVIELLKEQGLERGKDGLRVIMMCEVPSNALLADQFLEHFDGFSIGSNDLTQLTLGLDRDSGIISHLFDERNEAVKILLSMAIKAAKAKGAYIGICGQGPSDHADFAAWLVEQGIDTVSLNPDTVIDTWLYLAEAHA

SEQ ID NO: 64246 - protein, 635 aa, Rhodopirellula baltica SH 1
MTDQKHPLLAGLQDATPLANWSSTELSNAAVEIRDVLCNLLATRTAHFASNLGVVELCLALHSEFDFRTDRLIWDTGHQVYPHKLVTGRYDRFETIRTAGGLMGYPNPHESVYDLFMTGHAGCSVSTAVGLRSGDILMDQKDRRTVAVIGDGAFPCGVVFEALNNAGELGDDLTIILNDNKMSICHRTGSVAQYLDRLRGNPFYTGLKHEVTKLLDRVPMFGDPAERLLAQMKEGVKAGLLGGMLFEELGIRYIGPIDGHDIPLMQKYLRLCKETPGPVLLHVVTEKGHGYKPAAEDPVFFHTPPAFEDRGGTPVTRGSDGRPPYTTHARDAIGEAMKRDSRVTVITAAMCQGNKLEPVREQFPERFFDVGICESHAVAFAAGQCKTGMRPIVDIYSTFLQRSYDQIFQEVALQDLPVVFMMDRAGLTAPDGPTHHGVYDIGYMRLFPNLVLMAPGYAEELSMMLDKALTLDHPSGIRYPKASALEATHTPAPIEIGKAEWIREGTDGTIVAYGAMLEQAIAAAEQLEGELEIGVVNARFVKPIDAEMVHKTLSDGRFVVTLEEGTRVGGFGSAFLESAVDQRLDTRAVHRLALPDEFVLHGDRSQLLDQSTLSAQKIAEVCREAASEVGSQVGI

SEQ ID NO: 64247 - protein, 398 aa, Bartonella quintana str. Toulouse
MNIHEYQAKRLLHEYGAPIANGVAVYSIEQAEKWAKKLPGPLYVVKSQIHAGGRGKGKFKELDLDSKGGVRLAKSVEEVVANVKEMLGKTLVTKQTGPEGKQVNRLYIEDGADIERELYLSLLVDRAVGRVAFVVSMEGGMDIETVAEETPEKILTLPVDPVQGVTSADCKRLCDALELHDNARKDGEKLFPILYKAFCEKDMSLLEINPLIVMKDGHLRVLDAKISFDNNALFRHPDILELRDLSEEDPKEIEASKHDLAYVALEGTIGCMVNGAGLAMATMDIIKLYGAEPANFLDVGGGASKEKVTAAFKIITADPNVKGILVNIFGGIMRCDVIAEGVVAAVREVGLKVPLVVRLEGTNIEQGKAIISDSGLNVISASDLDDAAQKIIAAVRGA

SEQ ID NO: 64248 - protein, 317 aa, Rhodopirellula baltica SH 1
MSVQASGDRREQPIDSNESLKDYMDARRPAVEAALQAACEDRPGVPERLAAAIRYAVLAPGKRLRPMLTIMAAEACGGDAESAMPSAVAVEMIHAYSLIHDDLPAMDDDDLRRGRPTTHIEFDEATAILAGDALQSMAFAHLHHSTSDATKSAALIGTLATAAGPAGLVGGQADDLDAEKYTVEDFGGADAALKHLEAIHHRKTGALFTACAAMGAISAGADTNAVSALTDYAKAFGLAFQITDDLLDCTSTDERLGKRTGKDDGRGKLTYPGLMGLDRARAHAESTIHMAHESLQLFGTAGQRLRKLADFVLERTN

SEQ ID NO: 64249 - protein, 401 aa, Shigella flexneri 2a str. 301
MNVFNPAQFRAQFPALQDAGVYLDSAATALKPEAVVEATRQFYSLSAGNVHRSQFAEAQRLTARYEAAREKVAQLLNAPDDKTIVWTRGTTESINMVAQCYARPRVQPGDEIIVSVAEHHANLVHWLMVAQQTRAKVVKLPLNAQRLPDVDLLPELITPRSRILALGQMSNVTGGCPDLARAITFAHSAGMVVMVDGAQGTVHFPADVQQLDIDFYAFSGHKLYGPTGIGVLYGKSELLEAMSPWLGGGKMIHEVSFDGFTTQSAPWKLEAGTPNVAGVIGLSAALEWLADYDINQAESWSRSLATLAEEALAKRPGFRSFRCQDSSLLAFDFAGVHHSDMVTLLAEYGIALRAGQHCAQPLLAELGVTGTLRASFAPYNTKSDVDALVNAVDRALELLVD

SEQ ID NO: 64250 - protein, 108 aa, Mycoplasma genitalium
KPTKPFVVVLGGAKVSDKLKVVENLLKLADNILIGGGMVNTFLKAKGKATANSLVEKELIDVAKQILDKDTHNKIVLAIDQVMGSEFKDQTGITLDVSDKIQEQYQSY

SEQ ID NO: 64251 - protein, 551 aa, Xylella fastidiosa Dixon
MTEIKEAFVPDIGDYSNVPVIEVLVAVGDTVSKGQSLITLESDKATMEVPSSTTGIIKEIKVKVGDTLSQGHVVALIEVSEETAEITTPMTVNTPTTRAHNTAPPEDGGSLIEVRVPDIGDYTNVPVIEVLVAVGDTVSKDQSLITLESDKATLEVPSSATGVIKQLKVNIGDTLSQGDIVVVLQSAESIPLTPATNKPALPPNSSPARDAISAPASPAGTPSTPPITFDANTVLPSKVPYASPAVRLLARQLDVDLSRIKGSEKNGRITREDVQKFVNATLGTGMAEGRTPSASITTNGGLNLLPWPNVDFSKFGEIETQPLSRIKKISGANLARNWAMIPHVTQFDQADITQLEALRVQINKENAASNKNGTGIKLTVLAFLIKASAAALKKFPTFNASLDATGETLTLKKYFHIGFAADTPNGLVVPVIRNVDQKGIVEIAQETSDLAKKARDGKLTPADMSGGCFSISSLGGIGGTAFTPIINAPEVAILGVSKSLIQPIWDGTQFAPKMLLPLSLSYDHRVIDGALAAHFTTYLSQILADMRRVLL

SEQ ID NO: 64252 - protein, 603 aa, Xylella fastidiosa Dixon
MTVIEIKVPDIGDYSKVPVIEVLVTVGDHVVKNQGILTLESDKATLEVPSMNNGVVKELKVNVGDLLSQGDVILLLETEDTTAPPSPSNAATSDTTSPPPPSPQPAASKPTAPDQQHSDIKCRMVVLGAGPGGYTAAFRAADLGLDTVLVERYPNLGGVCLNVGCIPSKALLHAAAVIDEAAHASTFGIDFGKPKITLDTLREYKQNVVNKLTAGLAVMAKQRKVRTVTGIAHFVSPNTLDITAADGSTQRLHFQQCIIATGSHPVKLPNFPWDDPRIMDSTDALELAEVPKKLLVVGGGIIGLEMATVYNALGSHVTIVEFMDQIIPGTDKDLVKPLADRMKKQGIEIHLNTKASHVKADKKGITVSFEAPTQGTQPALKTSTYDRVLVAVGRTPTGNNISAEKAGVNVTERGFIPVDRQMRSNVPHIFAIGDIVGNPMLAHKATHEGKLAAEVAAAETESGKHREWVARVIPSVAYTNPEIAWIGMTETEAKAKGLNIGVAKFPWVASGRAIGIGRTEGFTKLIFDEDTHRIIGGAIVGVHAGDLLAEIGLAIEMGAEAEDISHTIHAHPTLSESIAMSAEVYDGTITDLYLPKKSATSAK

SEQ ID NO: 64253 - protein, 333 aa, Synechocystis sp. PCC 6803
MSAVSRIATLTRQSMLSALSDNNRLRLFSGSSNPSLSQEVARYLGMDIGPMLRKRFADGELYIQIQESIRGGDVYLIQPCCHPVNDNLMELLIMIDACRRASARQITAVLPYYGYARADRKTAGRESISAKLVANLITGAGAQRVLAMDLHSAQIQGYFDIPCDHMYGSPVIIDYLKSKQLTDLVVVSPDVGGVARARAFAKKLNDAPLAIIDKRRQSHNVAEVLNLIGDVDGKTAVLVDDMIDTAGTLSEGSRLLRAQGARQVYACATHAVFSEPAINRLSGGLFEEVIVTNTIPVPDDHHFPQLTILSVANLIGEAIWRIHEESSVSSMFR

SEQ ID NO: 64254 - protein, 228 aa, Oryza sativa Japonica Group
MAAAAAAKIAPSMLSSDFANLAAEADRMVRLGADWLHMDIMDGHFVPNLTIGAPVIQSLRKHTKAYLDCHLMVTNPSDYVEPLAKAGASGFTFHIEVSRDNWQELIQSIKAKGMRPGVSLRPGTPVEEVFPLVEAENPVELVLVMTVEPGFGGQKFMPEMMEKVRALRKKYPSLDIEVDGGLGPSTIDVAASAGANCIVAGSSIFGAAEPGEVISALRKSVEGSQNKS

SEQ ID NO: 64255 - protein, 229 aa, Oryza sativa
MFFTLFPRKKNWGKRKEKKGKKTEGGKRRGGGKIPGGAPGPPPLPEPRGRIFLGEGFCPGAGKRLLGVGLRPAGGGAWRGGGRRRRLRPVAVVRRRGYHERVVDHYDNPRNVGTFDKDDPDVGTGLVGAPACGDVMKLQIRVDEESGRIVDACFKTFGCGSAIASSSVASEWVKGKQMEDAASIKNSEIAKHLSLPPVKLHCSMLAEDAIKAAVKDYEAKKAKLDKGNE

SEQ ID NO: 64256 - protein, 408 aa, Marinobacter sp. ELB17
MVASANHESSQAKSRTVKYRKTKASWNPAMQAVPVPGIRRMVNLAATMKDVIHLSIGQPDLPTPKHIIDAYVDALHAGQTGYTMDAGLPELVIALRDYYSKRYNRKLTRDNILVTNGATEAMYLAIAATAAPGRQFLVTDPSFLLYAPLIRMNGGEVKYVPTHVENNHQLDPNDVIRAIGPRTYALILNNPNNPTGAVYPRSTVEAILEECAYRGVQVYADEVYDHFIFDDDKFASVLNCAVDLDNIMCISSFSKTYSMAGLRVGWVISSQAAIKSLRRYHMFTTSVANTPAQFAGVAALNGDQQCVTDMLNIYRERRDKIVDLIAQTPHLNGYKPGGAFFAFPDLPPHVDGTDLALRMLKETGVCVVPGDSFGEGCTNALRFSFSTTCEKLDAAFDRIIPWMAKQNL

SEQ ID NO: 64257 - protein, 384 aa, Marinobacter sp. ELB17
MSATTNIAITPGDGIGPEVVNQAVNCLALLRQRFKLDLDWHQFPWPSHHWHQQHGESMPADALEQLGAFDAILLGALGDPGPVTDHNRYLLSDSVSLAPLLQIRKGFDQWACERPARLLPGARQYLADDRARDIDMLVIRENSEGEYVSQGGRLRQGTPHEVATQIEVFTHFASERIIRYGFEQARARAIHRKQHDETRQFQTLDGRVCDSQVCLVTKRNALRYWGDLYTEVFERMSLEYPDVATHHELVDAACMKFVQSPWAFDVVVASNLQGDILTDLAAVLSGGLGVAPSCNLNPTDPTMPSMFEPTHGSAPDIAGQGLADPTAMLFTTARMLDWLAHKDPTMAAAGHALFEATAADLAQHGGKRRSTAEIGAAVCARLNA

SEQ ID NO: 64258 - protein, 429 aa, Mycoplasma penetrans HF-2
MIKLNFTNFLEGNKSTEKIFKSYASKIETLNNSIEEKKCKGASMLGWMDYPSKYNKNEIKELINVSQEWYNNKKIKNVVVLGIGGSYIGVRAGIDWVLPEFNREKEIYYVSSMSSSYVYSLIEKLKKEDFYLIVISKSGTTLEIGVAFRLFYSLLFEKFGSEGAKERTVAITDKEKGTLRKIADTQDIQTFSIPDDVGGRFSAITPVGLFAMGVMGLDVNKVLKGCAKAIEDTKEPDIEKNTAYQYAALRHYMYSKKEKYNEVFCVYEDALRFFTEHLKQLFAESEGKEGKGLLPVNCLFTTDLHSVGQFLQEGNQIFFETCISIKNPLNDVVINEFLKDEDGLGFLNGKKLDYINKVAASSTIDAHHIDGKIDIIQINLDNRNEESFGYLYSWFSKVVAMSGLLLKVNPFDQPGVEAYKSRMFTKLKK

SEQ ID NO: 64259 - protein, 160 aa, Xanthomonas oryzae pv. oryzae KACC10331
MTIHVAERIPEIVLKRMRDGIEAVDTHTLFAGRTVLLFAVPGAFTPTCSAKHLPGYVEHFDALRKRGIEVRCTAVNDPFVMPAWGRNPLIPDGLHLLPDGNPELARAPDLEIDASGSGMGLRSRCYALYADDAVVEALFVEEPGEFKVSAADHVLQHLLD

SEQ ID NO: 64260 - protein, 222 aa, Zea mays
  misc_feature (198)..(198): Xaa can be any naturally occurring amino acid
  misc_feature (216)..(216): Xaa can be any naturally occurring amino acid
MSSSSKLFQSACKAARSFLASSSAPAAASSVLADGRNAALATLANLGRNSTLPAAYAHHLHTNAASSQGYAWIAAIPAAVYMLQDQEVHAAEMERTFIAIKPDGVQRGLISEIVSRFERKGYKLVAIKLVVPSKQFAEKHYHDLKERPFFNGLCDFLSSGPVLAMVWEGEGVIKYGRKLIGATDPSKSEPGTIRGDLXAVVVGRNIIHGSDGPETXKDEIAL

SEQ ID NO: 64261 - protein, 394 aa, Solibacter usitatus Ellin6076
MKLAERMSRIGIESAFDVLVRARALEAQGRSVIHLEIGEPDFPSPPHVIEAGKKALDEGWTHYGPTQGLPDLREAIAAHISRTRGISVGPQHVSVVPGGKPIIFFPMLALLEEGDEVIYPNPGFPIYESMIRFCGATPVPLPLEESRGFSFDLDRFESLLTPRTKMVVLNSPQNPTGGVIPREDLKAIAGLLGDRDIIVLSDEIYSEICYGERPVSITEFPGMLEKTIILDGFSKTYAMTGWRMGYGVMPEWLVEAVNKLMVNSNSCTASFTQRAGIAALTGPRDAVDAMVAEFRRRRDAFVAGLNQIPGFHCALPGGAFYAFANITGTGISSRELADYLLYEAGVAGLNGGCFGEYGDGYIRFSYANSLPNLMEAVSRIQKVSARWHSAVAAR

SEQ ID NO: 64262 - protein, 299 aa, Mycoplasma penetrans HF-2
MITTVWNFRRINMNKNNNTNISKFNLSSGTNHNPPLLTLNDGYQIPIIGLGTTSLHNQTCKNAIKAALEIGIRLFDTASLYGNEKEVGETIRESNINRNEIFVITKLYPGAQFANPEKAIEEALNKLNTDYIDMMLLHHPGENDVKAYKAIEKYIEKGKIKSVGLSNWYIKEINSFLPQINIKPSLIQNEIHIYYQEKEVVPYMHNLNIAMQAWYPFGGRGHTFSVLNNPTIVSIAKDHNKTSAQIISRWLLQRGIITIVGSSNPIHIKENISVFDFELSNQEMELIASLDKNEKHDWY

SEQ ID NO: 64263 - protein, 456 aa, Mycobacterium avium 104
MTKHFDAIIVGAGQAGPPLAGRLTAAGQRVAIIERKLIGGTCVNTGCIPTKTLVASAHAAHLARRGADYGVGTGAISVDMAKVKARKDEIMLGDRKGVEDWLAGMAGCTVVRGHARFRDPHTLQVGEDLLRAERIFLNVGGRAVVPDIPGLAEVDFLTNVSILELDRLPTHLVIVGGSYIALEFAQMYRRFGAAVTVVERGPRLASREDEDVSAAVQEILRAEGIDIVVNADDVRIAKTGNGFELTSRDGAPPIRGSHLLLAVGRRPNTDDLDLAVAGVRTDARGYILVDDQLKTNVEHIWAMGDCNGRGAFTHTSYNDFEIVAANLLDDDPRRVSDRITTYALYIDPPLGRAGMTVAQVRASGRRALVGKRPMTRVGRAVEKGETQGFMKVVVDADTREILGAAILGVGGDEAIHGILDVMSAKAPYTTLSRTMHIHPTVSELIPTMLQQMSPLA

SEQ ID NO: 64264 - protein, 470 aa, Thermobifida fusca YX
MASLPSVSYSITVRLEIDGRASAVSSLTNAVERVGGAVTALDVNSSGRERLRIDVTCAARDTNHAQAIVEALDAVEGVTVHKVSDRTFLMHLGGKIEMRSKVPLRNRDELSMAYTPGVARVSAAIAANPEDARRLTVKRNSVAVVTDGSAVLGLGNIGPEAALPVMEGKAALFKRFADIDAWPIALDTQDTDEIVRAVQLIAPGFGGINLEDISAPRCFEVEARLRELLDIPVFHDDQHGTAIVVLAALKNALRVVGKELGSVRIAMSGAGAAGTAILKLLLHAGAKDVVVCDVHGAVHQGRGDLDANLRWIAEHTNPDGYAGDLAGAVRGADVFIGVSAPNLLSGEEIAEMNEDAIIFALANPEPEVDPEIAALHAAVVATGRSDYPNQINNVLVFPGFFRGLLDAQSHRVTPDMMLAAASALAAVVTEEELSPHYIIPSVFHPGLAQRVAEAVREVALREGGVERHEN

SEQ ID NO: 64265 - protein, 284 aa, Mycobacterium avium 104
MRLRSVAETLAAEAAAFVRRRRAEVFGTEPGGASAPDGGAVRSKSTPTDPVTVVDTETERLLRDRLAQLRPGEPILGEEGGGPAEPSAPGDGTVTWVLDPIDGTVNFVYGIPAYAVSVGAQVDGESVAGAVADVVGDRVYSAAAGLGAHVSDGAGRQPLQCAAVDDVSMALLGTGFGYARQRRAAQAALLARMLPVVRDVRRIGSAALDLCMVAAGRLDAYYEHGLKVWDRAAGALIAAEAGARVVLPAPDGDGAGLVLAAAPGIADELLAVLERFDGLDPILD

SEQ ID NO: 64266 - protein, 427 aa, Mannheimia haemolytica
QNLILNMNDNGFKVVAYNRTTSKVDEFLEGAAKGTNIIGAYSLEDLAAKLEKPRKVMLMVRAGEVVDQFIEALLPHLEEGDIIIDGGNSNYPDTNRRVKALAEKGIRFIGSGVSGGEEGARHGPSIMPGGDESAWQYVKPIFQAISAKTDKGEPCCDWVGRDGAGHFVKMVHNGIEYGDMQLICEAYQFLKDGLGLSYDEMHEIFKEWKNTELDSYLVDITTDILAYKDEDGEPLVEKILDTAGQKGTGKWTGINALDFGIPLTLITESVFARCVSAFKDQRVAASRLFNKEIGKVEGDKKVWVEAVRRALLASKIISYAQGFMLIREASEQFGWDINYGNTALLWREGCIIRSRFLGNIRDAYEANPYLVFLGSDPYFKDILENCLADWRKVVAKSVEIGLPVPCMASAITFLDGYTSARLPANLL

SEQ ID NO: 64267 - protein, 308 aa, Neocallimastix patriciarum
MAQKKQQQKLGFYEDFLLAGVSATISKTAAAPLERVKLLVQNQGEMLKSGRLATPYKGIGDCFVRVAKEEGIASFWRGNGANIIRYFPTQALNIAFKERIKNAFAVDKEKEGYAKWLVANIASGGAGGALSQVFVYSLDYARTRLANDAKSANGGERQYKGLIDVYKKTYKADGIAGLYRGFTLSCVGIMVYRGLYFGLYDSMKPLLKNLGMEGSFAASFILGWGVTTVAGIASYPIDTIRRRMMMTSGEAVKYKSSIDCAKQVMQKEGVQAFFKGCGANILRGVAGAGVLSGFDKIKEVYINWRIKN

SEQ ID NO: 64268 - protein, 561 aa, Arabidopsis thaliana
MEKNQQKQEFLAETSEMKNTKNNDDCSVQQQQRFVWPWVGLVANIPTEVEPSGRRVGKSGSTLRDEFTMKGFNPTRVQPIWDFKGHSGFALVEFAKDFEGFESAMNFERSFNLDRHGKRDWEKGHRLRDNKLYGWVAREDDYNRSDTVGKNVKKKRDLKSISQIVEEDERKMVHLVENMSQTIEKKKQSKQELEQKVDETSRFLESLELHNVLLNKNYQEGFQKMQMKMEELYQQVLDGHEKSLAELEAKREKLDERARLIEQRAIINEEEMEKSRLEREMNQKAMCEQNEANEEAMKLAEKHQASSSLKEKEKLHKRIMEMEAKLNETQELELEIEKLKGTTNVMKHMVGSDGDKDIVEKIAKTQIQLDAQETALHEKMMTLARKERATNDEYQDVLKEMIQVWNANEELMKQEKIRVKRMGQLNPAPFLPAVMKKHKVTQSKAENKAMKLCSVWEANIGDVQWTPFRVDESDGTPKRVVDENDEKLRTLKNQYGEEVYNEVVRTKLEIEEHNASGSYVILELWNYEENRKATMEEATDVMLKIRSKLAAMKNKRKRLEV

SEQ ID NO: 64269 - protein, 513 aa, Glycine max
MSTLEIEARDVIKIVLQFCKENSLHQTFQMLQNECQVSLNTVDSIETFVADINSGRWDAILPQVSQLKLPRNKLEDLYEQIVLEMIELRELDTARAILRQTQVMGVMKQEQPERYLRLEHLLVRTYFDPNEAYQDSTKEKRRAQIAQALAAEVTVVPPSRLMALIGQALKWQQHQGLLPPGTQFDLFRGTAAMKQDVDDMYPTTLSHTIKFGTKSHAECACFSPDGQFLVSCSVDGFIEVWDYISGKLKKDLQYQADEVFMMHDDAVLCVDFSRDSEMLASGSQDGKIKVWRIRTGQCLRRLERAHSQGVTSVSFSRDGSQLLSTSFDSTARIHGLKSGKMLKEFRGHTSYVNDAIFTNDGSRVITASSDCTIKVWDVKTTDCIQTFKPPPPLRGGDASVNSVHIFPKNTDHIVVCNKTSSIYIMTLQGQVVKSFSSGKREGGDFVAACVSPKGEWIYCVGEDRNIYCFSYLSGKLEHLMKVHEKEVIGVTHHPHRNLVATFSEDCTMKLWKP

SEQ ID NO: 64270 - protein, 383 aa, Arabidopsis thaliana
MDHREKSDRRLLLWFFAVATAVKLLLIPSSRSTDFEVHRNWLAITNSLPLTKWYFDETSQWTLDYPPFFAYFERFLSIFARLVDPRIVDLQSGLDYNAESVIYFQRISVIVSDLCLLYGVYRLTRKLEPLKRNLICALVIWSPGLLIVDHIHFQYNGFLLGWLLLSISFLQEGRDLLVTGFRRLVTIGAVVVAVFAAAYGPFIYHGQIQQVISRMFPFGRGLCHAYWAPNFWVFYIILDKGLAVLLRKLGYEIQIPSASFTGGLVGDSSPFAVLPQITPLTTFAMVLLAISPCLIKAWKKPHSGLVARWVAYAYTCGFLFGWHVHEKASLHFTIPLAIVAVQSLEDAKHYFLVSIVSCYSLYPLLYEPRSTRSRFCCCYCIPW

SEQ ID NO: 64271 - protein, 248 aa, Zea mays
RERESASDLGQSVSVLGVSFSYPRPRRWVCAYRLIDVPMSNCINSGINKVYILTQFNSQSLNRHLSRAYDFSNGVAIGDGFVEVLAATQRPGTEGKRWFQGTADAVRQFDWLFDDAKSKDIEDVLILSGDHLYRMDYMDFVQSHRQRGAGISICCLPIDGSLWASDFGLMKIDDPGRVISFSEKPKGDELKAMQVDTTLLGLSKEEAENKPYIASMGIYIFKKDILLNLLRYVNSTYWSSQSFIKISM

SEQ ID NO: 64272 - protein, 826 aa, Oryza sativa Japonica Group
MAAARGGRRRRPWSSSSSCGSPFLMMLISCLLWLHREAAPSLAADTVTVGRPLSGRQVLVSRGGKFALGFFQPDNSSQRWYMGIWYNKIPDHTKVWVANRRAPLSDPDTSRLAISADGNMVLLDRARPPVWSTNVTTGVAANSTVGVILDTGNLVLADASNTSVVLWQSFDHFGDTWLPGGRLGRNKLTGEVTRLVGWKGYDDPTPGMFSLELDPGGASQYVMSWNGSSRLYWSSGNWTGGMFSSVPEMMASNADPLSLYTFNYVDGENESYFFYDVKGEVVLTRFVVDVTGQIKFMTWVDSAAQWVLFWSEPKAQCDVYSICGAFGVCAEDALPACSCLRGFHARQPRRWLQGDHTAGCARSTALQCGGGGGAQPAAQKTKSDRFFVMPNVNLPTDGVTAASASARDCELACLGNCSCTAYSYNGSCSLWHGDLISLRDTTGAGNGGGRSISIRLAASEFSGNGNTKKLIIGLVVAGVAAAVILAVVVTVLVRRSRRLKALRRVEGSLTAFTYRDLQVATKSFSEKLGGGAFGSVFKGSLPADGTPVAVKKLEGVRQGEKQFRAEVSTIGTIQHVNLIRLLGFCTERTRRLLVYEHMPNGSLDRHLFGHGGGVLSWEARYQIALGVARGLDYLHEKCRDCIIHCDIKPENILLDDAFAAKVADFGLAKLMGRDFSRVLTTMRGTVGYLAPEWITGTAITTKADVFSYGMMLFEIISGRRNVEQGQDGAVDFFPATAARLLFDGDLKGAVDGRLAGNADMGEVERACKVACWCVQDSEATRPSMGMVVQVLEGLVDVNAPPMPRSFKVLGDPSNYVKFFSALPSIS

SEQ ID NO: 64273 - protein, 159 aa, Bifidobacterium longum DJO10A
MQIDIIAPGRVKERYLRDAIDEYSKRLSRYCKLNIIEVADEKTPDHASEGVDRQIKAREGERIAKHLKDGAFVIALAINGKQLSSEELAAKINDLGLRGTSHIQLVIGGSIGLDDAILRRADFLLSFSKMTFPHQLMRVILLEQIYRAYKINAGEPYHK

SEQ ID NO: 64274 - protein, 304 aa, Oceanicola granulosus HTCC2516
MILACGEALIDMLPRTTESGEDTYLPAPGGAVFNTAVALGRLGAPASFFSGLSSDFFGDMLRASLAESGVDTTLAPVSDRPTTLAFVKLVNGQASYLFYDENTAGRMLEEDDLPETDARALFFGGISLMVEPCGSAYEALMRRAAPDCVTMIDPNIRPQFIRNESAYRARIGRMIAAADIVKVSDDDLRWLEGDGEIACLARRMLEQGPKLVLVTRGGDGVTGYTRAHTIDQPAVPTQVVDTVGAGDTFNAGILASLHARGALTKYRMETLDEETLAAALALGARAAAVTVSRAGANPPWASEL

SEQ ID NO: 64275 - protein, 636 aa, Neisseria meningitidis
MNILSVENASFAIGHVALLDKTSFQLDSGEKVGLIGRNGAGKSSFLKILAGVQKLDDGQIIIQNNLKIVYVPQESFFDKDATVFDTVAEGLGEIRDLLRRYHRVGHELENGSGEALLKELNELQLEIEAKDGWKLDAAVKQTLGELGLPENEKIGNLSGGQKKRVALAQAWVQKPDVLLLDEPTNHLDIDAIIWLENLLKAFEGSLVVITHDRRFLDNIATRIVELDRGILRSYPGSFSKYSEKKVQELAVEAEHNRLFDKFHAQEEAWIRKGIEARRTRNEGRVRRLEELRRQRAERRNVQGQVNFKLDSGEKSGKIIAELEHASFAYGDKVIMDKFSAILQRGDKIGLIGPNGIGKTTFLKLILGELNPTYGRIRIGSKQEVAYFDQFRSTLNENDTVFYTLGQGNDYVEVGGKKKHVMSYLEDFLFHPARAQSPVSSLSGGERNRLLLAKLFTRPANILILDEPTNDLDIDTQELLEDLLRDYQGTVFLVSHDRMFLDNVITQSIIFEGNGRLKEYIGGYQDYIDAKSREAKIQTESAPKTADAEPVKEKPKANRTVKLSYKEQRELDALPDEIAALEAEQAEINAQLSDPEIFKDYEKAGALQSRAEEIEMLLLEKLERWELLETKQNGNAV

SEQ ID NO: 64276 - protein, 152 aa, Triticum aestivum
  misc_feature (48)..(48): Xaa can be any naturally occurring amino acid
  misc_feature (98)..(98): Xaa can be any naturally occurring amino acid
MAEQTFIMIKPDGVQRGLIGEVISRFEKKGFYLKGLKLQNVEKSFAEXQHYSDLSSKPFFAGLVEYIVSGPVVAMVWEGKSVVATGRKIIGATNPLGXLSPGTIRGDFAVDIGRNVIHGSDSVESARKEIALWFPEGIAEWRSSQHNWIYEA

SEQ ID NO: 64277 - protein, 393 aa, Neisseria gonorrhoeae
MIIDVKVPMLSESVSEGTLLEWKKKVGDAVARDEILIDIETDKVVLEVPSPQAGVLVEIVAQDGETVVAGQVLARIDTAATVAAEAPAAAPAEAAPAAVPAAAQNNAAMPAAAKLAAETGVDVNVLQGSGRDGRVLKEDVQNAAAKPAAAVAPAVALPAGARPEERVPMSRLRARVAERLLASQQENAILTTFNEVNMKPIMDLRAKYKEKFEKEHGVKLGFMSFFVKAAVAALKKYPVVNASVDGKDIVYHGYFDIGIAIGSPRGLVVPILRDADQMSIADIEQAIVDYAKKAKDGKIAIEDLTGGTFSITNGGTFGSMMSTPIINPPQSAILGMHATKERAVVENGQVVVRPMMYLALSYDHRIIDGREAVLTLVAIKDALEDPVRLLLDL

SEQ ID NO: 64278 - protein, 459 aa, Neisseria gonorrhoeae
MSQYDVVVIGAGPGGYVAAIRAAQLGFKTACVDAGVNKAGNAPALGGTCLNVGCIPSKALLQSSEHFHAAQHDFAEHGITVGDVKFDVAKMIERKDAIVTKLTGGVKFLFQKNKVTSLFGTASFAGKNGDAYQIEVDNKGEKTVIEAKHVIVATGSVPRPLPQVAIDNVNVLDNEGALNLTEVPAKLGVIGSGVIGLEMGSVWNRVGAEVTILEAAPTFLRAADQQIAKEAFKYFTKEQGLSIELGVKIGDIKSEGKGVSVAYETAAGEAKTEVFDKLIVAIGRIPNTKGLNAEAVGLEKDERGFIKVDGECRTNLPNVWAIGDVVRGPMLAHKASDEGVAVAERIAGQKPHIDFNNVPFVIYTDPEIAWVGKTEEQLKAEGVEYKKGTSGFGANGRALAMGKAKGTVKVLADAKTDRILGVHMIGPVVSELVTEGVTALELTKTGTALPRPGPKGTIP

SEQ ID NO: 64279 - protein, 101 aa, Mycoplasma genitalium
LDVGSKTIALFESYLKTAKTIFWNGPLGVFEFTNFAKGTSKIGEIIAKNKTAFSVIGGGDSAAAVKQMQLSDQFSFISTGGGASLALIGGEELVGISDIQK

SEQ ID NO: 64280 - protein, 201 aa, Xylella fastidiosa Dixon
MKCSSNNIHSTPCTVHRRIYPQKRDLIQNIKNRIDIFHRILSSDLTMNVTFDLTPPSPSQREALIATLNAEERRILLQHGTEAPFCNRLLENNQPGTYTCRLCGLPLFHSNAKFKSGTGWPSFFEPYTHTHIRKQHDTSHGMIRTEILCARCNSHLGHLFPDGPPPTYERYCLNSVSLTFIPTGTLLPDQLHRGDNTTYRT

SEQ ID NO: 64281 - protein, 438 aa, Glycine max
MATKALSFALSLNDLTNNHFSSNTPHTAAKVSVFTVKCSSSGGGERPWKNSDARLVLEDGSIWKAKSFGASGTQVGEVVFNTSLTGYQEILTDPSYAGQFVLMTNPHIGNTGINFDDEESIQCFLAGLVIRSLSISTSNWRCKKDLGDYLAERNIMGIYDVDTRAITRRLRQDGSLIGVLSTDNSKKDEELLHMSKSWDIVGKDLISGVSCKTPHEWVDKTKQQWEFSKVPGETFHVVAYDFGIKHNILRRLASYGCKITVVPCTWPASETLKMKPNGVIFSNGPGDPSAVPYAIETVKNIIGKVPVFGICMGHQLLGQALGGKTFKMKFGHHGGNHPVRNLRSGHVEISAQNHNYAVDPATLPEGVEVTHINLNDGSCAGLAFPAQQLMSLQYHPEASPGPHDSDYIFREFIELMKQGKNRTKGRLHQLSTAHALDA

SEQ ID NO: 64282 - protein, 427 aa, Mannheimia glucosida
QNLILNMNDNGFKVVAYNRTTSKVDEFLEGAAKGTNIIGAYSLEDLAAKLEKPRKVMLMVRAGEVVDQFIDALLPHLEEGDIIIDGGNSNYPDTNRRVKALAEKGIRFIGSGVSGGEEGARHGPSIMPGGDESAWQYVKPIFQAISAKTDKGEPCCDWVGRDGAGHFVKMVHNGIEYGDMQLICEAYQFLKDGLGLSYDEMHEIFKEWKNTELDSYLVDITTDILAYKDEDGEPLVEKILDTAGQKGTGKWTGINALDFGIPLTLITESVFARCVSAFKDQRVAASRLFNKEIGKVEGDKKVWVEAVRRALLASKIISYAQGFMLIREASEQFGWDINYGNTALLWREGCIIRSRFLGNIRDAYEANPYLVFLGSDPYFKDILENCLADWRKVVAKSVEIGLPVPCMASAITFLDGYTSARLPANLL

SEQ ID NO: 64283 - protein, 427 aa, Bibersteinia trehalosi
QNLILNMNDNGFKVVAYNRTTSKVDEFLAGAAKGTNIIGAYSLEDLAAKLEKPRKVMLMVRAGEVVDQFIDALLPHLEEGDIIIDGGNSNYPDSNRRVKDLAAKGIRFIGTGVSGGEEGARHGPSIMPGGNIEAWEHVKPILQAISAKTDKGEPCCDWVGKEGAGHFVKMVHNGIEYGDMQLICEAYQFLKDGLGLSYDEMQAIFQEWKKTELDSYLIDITTDILGYKDEDGTPLVEKILDTAGQKGTGKWTGINALDFGIPLTLITESVFARCVSSFKDQRVAASKLFNKTISPVEGDKKVWIEAVRRALLASKIISYAQGFMLIREASENFGWDINYGATALLWREGCIIRSRFLGNIRDAYETNPDLVFLGSDDYFKGILENAMADWRKVVAKSIEVGIPMPCMASAITFLDGYTSERVPANLL

SEQ ID NO: 64284 - protein, 289 aa, Mycoplasma penetrans HF-2
MKTSNVKLITLNNGNKIPSIGFGVFQIPKEETADCVKKAISIGYRLIDTAQAYHNEKETGLGIKLSGVKREEIFLTTKVWVSNYERCYESVIESLKRLDTSYLDLILLHQPFGNYYKAYQDLERLYKENKVRNIGVSNFWDNRIIDLCFFNQIKPMVNQIEINPFHQRIEDRFYNDKYKVVSQAWAPFAEGKNGLFTNPTLVEIGKKYNKTPAQVILRWLVQSNVVALCKTVNESRMKENFDIFDFELSKQDLDKIVALNKQHSEFRYHHSAEGAEFYGEISNQIKIGD

SEQ ID NO: 64285 - protein, 114 aa, Medicago truncatula
MSQEKPRRPEQEPIKYGDIFNVSGDLSSQPIAPRDAATMQSAEDRTLDHARKDGPASLMTSAAQKNEDAGFIDNNTATNIARNEGVAVSEINNGGKRVITETLGGQANIYFFDR

SEQ ID NO: 64286 - protein, 718 aa, Photobacterium profundum SS9
MSRTIMLIPVGAGVGLTSVSLGVLRAMERKGVRVSFFKPIAQPRSGGEQPDLTTTIIRANSDMEIAEPFTMARAEELLRNDQSDVLLEDIVARFKASTAQSEVALIEGLVPTRKHPFANQINYEIAKTLGAEIVFVIAHGTDNPAQLKERIEVACSNFGGIKNKQISGVIVNKLNAPVDAEGRTRPDLSEIFDDIDGTTIPLNVEVMQVYNSSPIRVLGCAPWSPELIATRSTDIAAHLNAQIINEGDIATRRIKSVTFCARSIPNMVEHFRPGSLLVTSADRPDVIVAACLAAMNGVEIGALLLTGGYELPKPVMDLCERAFATGLPVMTALGNTWQTSLNLQSFSLEVPADDKERVEFVNEYMASHIDGQWIESLTEGSAKERRLSPPAFRYELTELARKAAKRVVLPEGDEPRTVKAAAICAERGIAECVLLGNPEEIKRVAEQQGVTLGAGVTIIDSESVRENYVKRLVELRGAKGMTDVVAREKLKDSVFLGTMMLEAGEVDGLVSGAVHTTANTIVPPFQIIKTAPDASIVSSIFFMLLPDQVLVYGDCAINPDPNAEQLAEIAIQSADSAKAFGIEPRVAMISYSTGTSGKGADVDKVREATRIAQEKRPDLIIDGPLQYDAAIMENVAASKAPNSPVAGKATVFVFPDLNTGNTTYKAVQRSADLVSIGPMLQGMRKPVNDLSRGALVDDIVYTVALTAIQAKQTENATK

SEQ ID NO: 64287 - protein, 143 aa, Medicago truncatula
MSRTFTPNKENSQNQKINIKSLIFKSSFGNNNIIMSQEQPRRHEQEPIKYGDVFNVSGELSSQPIAPRDAATMQSAEYRTFGQTRKDGPASLMTSAAQKNEDAGFIKHNTATNIARNEGVAVSETYDGGKRVITETLGGQAIF

SEQ ID NO: 64288 - protein, 133 aa, Mycobacterium avium 104
MADRIELRGLRVRGQHGVFDHERVDGQDFVIDVTVWIDLVGAAASDELADTYDYAALAQLAADVVAGPARNLIETVGAQIADQVMDDERVHAVEVMVHKPQAPIPQQFADVAVVVRRSRRGGRGSVVPAGGAL

SEQ ID NO: 64289 - protein, 451 aa, Mannheimia haemolytica
KLIPALYNLYKIGRLGEHFSVLGVSRSELTDESFRQKMRDALVKFEKASGEELDKFCEHLYYQAVNTSDAVDYAKLLPRLDELHDKYQTAGNTLYYLSTPPSLYGVIPECLAAHGLTTEEFGWKRIIVEKPFGYDIETAKKLDVQIHKCFEEHQIYRIDHYLGKETVQNLLVLRFSNGLFEPLWNRNFIDYVEITGAESIGVEDRGGYYDGSGAMRDMFQNHLLQVLAMVAMEPPAIINANSMRDEVAKVLYCLHPLTEEDVKHNVVLGQYARGTVDGKEVPAYLEEKGVPADSNTETFMAVKCKIDNWRWAGVPFYVRTGKRLPTRVTEIVIHFKTTPHPVFSQNAPENKLIIRVQPDEGISMRFGLKKPGAGFEAKEVSMDFRYSDLSSSSSLLTAYERLLLDALKGDATLFARTDAVHACWKFVQPILAYKANRGRVYEYESGTWGPT

SEQ ID NO: 64290 - protein, 166 aa, Propionibacterium acnes KPA171202
MSSRTTLGLSAPDLSGLDGSGLKVAVVAAQWHGTVMTGLLDGALRGLVDSGVHDPAVIRVPGSFELPVACASLADHFDALVALGVIIRGGTPHFDYVCDAATRGITDVAVRTKTPIGFGILTCDDEAQALDRAGLEGSHEDKGYEAAQAAIATLTALSTALASGPS

SEQ ID NO: 64291 - protein, 381 aa, Alkalilimnicola ehrlichei MLHE-1
MWWQAEFPQDDGIAYLNHAGVSPWPACTRDAVAEFAAENVRQGAAAYPRWLEAEHRLKNRLAELINAPSSDTIALVKNTSEGLSMIAWGLDWAPGDEVVINRHEFPSNRIVWESLARLGVRVRDVSWTVGDPDPESRLIEAMGPKTRLLAVSTVQYASGERMDIARLVTACRERGVLCCVDGIQSLGALPLDVAALAPDFVVADGHKWLLGPEGLGFMYVRPELIGQLQLYQYGWHMVEHAGDYDRSDWAPAASARRFECGSPNMLGVHALVASVSLLLEVGPDTIAENVLDNTRHLMDWVDQRPELELITPREGGRHAGIVTFRAPGADARALWKRLSSAGVVAAHRMGGVRFSPHFYTEPTRLEYATEQLLAALPHCRA

SEQ ID NO: 64292 - protein, 307 aa, Nostoc sp. PCC 7120
MSIIVFGSINIDLVATAPKLPGAGETLLGEDFFKVPGGKGANQAVALARLGVPTQMVGRVGAQSFGAELMQNLQDAGVQTDNIFVDETASSGVAMITVAHNGENQIVVIPGANGRVNQVDVERLSRILPTATALLLQLEIPVPAVIAAAQAARSNNITVILDPAPAPSDLPTELYSFVDIITPNEVEAGQLVGFPVDGEDAARKAAGVLLQKGVKSAIVKLGAKGVVCATNKETFFVPAFSVDTLDTVAAGDAFNGGLATALYSGLSLHQAVIWGAAAGALAATKLGAQTSLPDKLTFEAFLKERVL

SEQ ID NO: 64293 - protein, 172 aa, Magnetospirillum magnetotacticum MS-1
MSGTILAFQGVSPTIAPDVFVAPTAVVIGDTVIGAGTSVWFNCVIRGDVHEIRIGERTNIQDGTIIHVTGGKLGTYIGSDITIGHGAILHACTLEDGCFVGMGAVVLDGAVVETGGMVAAGAVVTPGKRVKKGELWGGNPARMLRSLSDEEMAFFPVSAEKYAELAAKYFKA

SEQ ID NO: 64294 - protein, 753 aa, Methanosarcina barkeri str. Fusaro
MASVETTERLGCSLGFFSTFAIGTGTMIGAGIFVLPGIALADAGSGAIISFLLGGLISIATAISMSELATGMPLAGGSYYYISRTMGAALGAIIGLGSWLALIFKGTFALIGLAEYAQIFYPLPLYFVAAATGVILLVINYRGAKSSGSLQNFIVIFLLVILALFIARVSFMVNPANLSPATSYGGTSIITTAGVIFISYLGLAEAAAVSEEVKNPSKTLPLAFIASAVVVTLFYVSTMAVVVGFSDPQVTGKSITPLADIAGLLAGESGRIAISLSALLATLSTANGAILSSSRFPFAMSRDALMPEWFVLIHQKFETPHNAILVTGIVMVLLLFLFDIEELARLGGAFNILIFILLNMAVIILRKRNLPGYEPTFRDPFFPYTQIFGIVGSIVLLPLLGGLPLLFTIMMIFAGIGWYSFYGRGKAVPEYNLFDLLENTVEKKEIEPVPLVKVLVPISNQKHERDLLKLADFMGSEIICLHVIEVPDQTNLKLAQEAYHEKKIEMDCRFKEEFENYPAILGHKREYIAAFDHNISNSILEQAEIEHADMIIMGWHEPKRFEYSHGVTNQVLLSSKSPIALLKGHLPDSINKILVGYNGKENSIYGLSLAEKLAVNTGAGIEIISIISPDEAQENRQKITDELESLVKKISSIPVSFRVLEKYSIEDALLEASNNNDLTIIGDSSERFKISLLGTLSQRIAKHSKKPIVVVKKSKPISKESFNYLVKKHARKIYARLRGKEVKLNSDKSAVLA

SEQ ID NO: 64295 - protein, 274 aa, Glycine max
  misc_feature (231)..(231): Xaa can be any naturally occurring amino acid
  misc_feature (247)..(247): Xaa can be any naturally occurring amino acid
ETDSGCRLPFGFTRKKHNCYNCGLLFCRACSSKKITNAPLAPSKSKAFRVCDQCFDKRQGGAHSVMASKSRNYNTQQVLKHQHKISDVTEDRGETTVTQGPMLSLGQSCYRKSMPSGRKDWKNHQEIQQDVEDSSSMLGGMPQWGQVPCPAMFQINCTENPVVHVSSSKNKLATVSPFNVESTAYNFSSNVETDTTKSDKVLLEEVHRLRAEAKRLEEQCELKNRKIQECXRQKIEESWFVAREEAXKCKAAKEVIKALALRVHTISGKDNVGQ

SEQ ID NO: 64296 - protein, 553 aa, Frankia sp. EAN1pec
MLVDANIDRPVPGGRAEPAEPLRTLVDAKGDPARHNAAAFADLVEELRGRLASTALGGSEAARRRHVERGKLLPRDRLDTLLDRGSPFLELSPLAADGMYDSEAPGAGIITGVGRVSGRECVVVVNDATVKGGTYYPTTVKKHLRAQEVALHNQLPCVYLVDSGGAFLPRQDEVFPDREHFGRIFFNQATMSARGIAQIAAVLGSCTAGGAYVPAMSDEAVIVRNQGTIFLGGPPLVKAATGEVVSAEDLGGGLLHSRKSGVTDHLAADDTDALTIVRRIVAGLGPRAPRPWDVTPTEEPLYPTSELYSVVPADPRTPYDVREVIARLVDGSRFAEFKKEYGSTLVTGVARLHGHPVGIIANNGVLFGESALKGAHFIELCDRRSIPLLFLQNITGFMVGRDYEAGGIAKHGAKMVTAVACARVPKFTVVIGGSFGAGNYSMCGRAYSPRFLWTWPNARISVMGGDQAAAVLSTVRRDAVEARGGEWSAEEQAAFEAPIREQYEQQGNPYYATARLWDDGVIDPADTRTVLGLALSAAANAPLEPVGYGVFRM

SEQ ID NO: 64297 - protein, 309 aa, uncultured marine proteobacterium ANT8C10
MLGLPMTGKITKNIKKNKSMNKIGFIGLGVMGYPMAGHLSKEFSNICIFNRSQEKVTKWLNQYSGTAFDTPEELSSQCNVIALCVGRDEDVREMMSGEKGILNSVNPGTIIIDHTTTSATLSKEMNELALQKDVIFLDAPISGGQAGAESGQLSVMVGGDKASYESVKPILDNYSKFTKYMGPSGSGQLTKMVNQICIAGLVQALSEGVNFSEKVGLNTSDVMEVITKGAAQSWQMENRWETMLKDEYDHGFAVDWMRKDLDIVSEQAGQVGANIEITEMVNKFYKDIQDLDGGRWDTSSLLKRIKDST

SEQ ID NO: 64298 - protein, 483 aa, Synechocystis sp. PCC 6803
MPALINPVKFMRPLSHRTKIVATIGPASSSVEVIRQMVDAGMNVARLNFSHGSYEDHATMVRLLRSVEQEMDTPITLLQDLQGPKIRIGQLPGGEKQLREGEKVSLVPVEIGDRHPGAVGIDYPHLATEAKVGERILLDDGLLEMKVVSIQDPEVICEVVTGGILKSRKGVNLPGLVLTLPSMTTKDKQDLEFGLSQGIDWVSLSFVRKGEDIHTLKQFLAERGHPDLPVIAKIEKPQAIDNLEEIVAVSNGIMVARGDLGVEVNPEKVPRLQKEIIRRCNVRAIPVITATQMLDSMIQNSRPTRAEASDVANAILDGTDAVMLSGESAVGQYPVKSVQMLRKIAEETEVGLHLVNNPPIENTETHALSEALVVIDGILDLKYIVTFTTSGFTSLLASNQRPSVPVIAFTPSEKVYHSLNLVWGIIPFLINEEFDTFEDLIQQAEVLLRDRKMVEKGDQLLIMAGIPTKIPRGTNFLKIHRIS

SEQ ID NO: 64299 - protein, 416 aa, Haloarcula marismortui ATCC 43049
MIAARTVSTNIAVSRVFTVASSQSLCRSYLKIGSDTRESVGTPNRDRDGTDAVAVPFLSSYALPRMSGMSQNHTDRSSSEDIEWCYDAVHRVSRTFSLTISELNEPMARDICLGYLLCRVADTIEDAGHLPPAVQTELLQTYSRSLEPSSGTTVSSFHDAVEEWIPTTTNADWEVVENAGRIVDVFHTLDDHSTQTIRGPVRELVDGMAMFVDRYADAGGLRIKTLDELEEYCWYAAGTVGTLVTGLVSHEATDEQIAQMEENARSFALLLQLVNVAKDAATDMEEENNVYLPLELLHEQGLDHSDVSDTGNVDSLVPVIEQVTERAEGYLDDAQAWLEAMPETRGNTLSAWAIPFLLAVGTIRELRERPADVIEQGNVKISREEVHSVTQQFGGDNDPSIGELRAKIRQQPLHQY

SEQ ID NO: 64300 - protein, 156 aa, Zea mays
ATSITTTQSPGLHYLLPSQASSVSGRPADAHGGTGSIGRSTSLVYPSLFSPLTSSQTKMVHTNSAVPTAPPQHPRIAQQPQSAPLLQPFPLPTASSPPYGTPLLQPFPPPNPSPSLASAPVLSPALTRDKVRDALLRLVENDEFVDLVYREIMNRQ

SEQ ID NO: 64301 - protein, 479 aa, Physcomitrella patens subsp. patens
MTTIDAPQIVSELRATLRTARTRPAQWRLDQIRAVLKLVNENEDDIYAALHSDLHKSNYESFLTEVNVLVSACKSTMKNLHKWMAPEKKPIPLAVWPANASVISEPLGVALVISPWNFPLLLALDPVVGAIAAGCTVCLKTSEIAPATSALLARLLPEYVDTEAIKVVEGSIPEVTALLEQKWDKIFYTGNAKVGRIIMGAAAKHLTPVTLELGGKCPLFIDDSVDLKVASKRIMVGKYGSNAGQACISPDYVLVEEHFAPTLIKQLQKTLLEFYGPDPSASVDLARIINKNHFQRLSSMLDDPSIADKIVHGGERDEKSLYIAPTLIDNPPLDSPVMVEEIFGPMLPIITVRNVDHALNIINDKPKPLEVYVFSNNKDLFNRFRDETSSGGIVMNDCVLQFIIPELPFGGVGESGTGAYHGKATFDAFSHRKAVLVKNMGGDVFARYPPFTVRKQSLIKALLTGTIIDIILAALGWRK

SEQ ID NO: 64302 - protein, 312 aa, Xanthomonas campestris pv. campestris str. 8004
MTKKIPLLIDTDPGVDDALALLMAFNDTRHDVVGLTIAAGNVGLEHTVRNALKVCEVAGRADVPVYAGCPQPLLHPSVDAAHVHGIDGFGDVGLPPAARAADAEHAALAILRLSHVHAGELLLVALGPLTNLALALTLDPTLPQRVARLVVMGGALTGHGNITAAAEFNIGFDPEAAHIVFRGFPQFDVADWEATVAHGLLHRDVEQWLAADSPRARFYEEISRKTRLWSEDSRGEYWYAADALAMAFALQPDGAQRLEQRPVHIELSGTHTRGMTLVDWNRQGGAADNATLLLDYDRQRFYGLVGQALAAG

SEQ ID NO: 64303 - protein, 299 aa, Triticum aestivum
MAVSELEVDGVVFPPLARPPGSEHAHFLAGAGVRGMEIGGNFIKFTAIGVYLQADAAVSALAAKWAGKPAADLASDAAFFRDVVTGEFEKFTRVTMILPLTGAQYSDKVTENCVAYWKATGVYTDAEAAAVDKFKEAFGPHSFAPGASILFTHSPAGLLTVAFSKDSSVPESGGVAIDNARLCEAVLESIIGEHGVSPAGQAQPGPPGSPSWLEGGRPPPAASRPPRPCRFRCERTGGHAPRVRHWCGGLCGWWCPWWDVLFPPFPHRLLGFSPATCNHAWITMSPWGFTWINRETLYF

SEQ ID NO: 64304 - protein, 451 aa, Mannheimia haemolytica
KLIPALYNLYKIGRLGEHFSVLGVSRSELTDESFRQKMRDALVKFEKASGEELDKFCEHLYYQAVNTSDAVDYAKLLPRLDELHDKYQTAGNTLYYLSTPPSLYGVIPECLAAHGLTTEEFGWKRIIVEKPFGYDIETAKKLDVQIHKCFEEHQIYRIDHYLGKETVQNLLVLRFSNGLFEPLWNRNFIDYVEITGAESIGVEDRGGYYDGSGAMRDMFQNHLLQVLAMVAMEPPAIINANSMRDEVAKVLYCLHPLTEEDVKHNVVLGQYARGTVDGKEVPAYLEEKGVPADSNTETFMAVKCEIDNWRWAGVPFYVRTGKRLPTRVTEIVIHFKTTPHPVFSQNAPENKLIIRVQPDEGISMRFGLKKPGAGFEAKEVSMDFRYSDLSSSSSLLTAYERLLLDALKGDATLFARTDAVHACWKFVQPILDYKANRGRVYEYESGTWGPT

SEQ ID NO: 64305 - protein, 319 aa, Xylella fastidiosa Dixon
MTIYNTILDTIGHTPVVKLNRIAPAHVDLYIKVESFNPSGSVKDRLALAIILDAEQQGLLKPGDTIVEATSGNTGVALAMIAAARGYTFVATMVETFSIERRKLMRAYGAKVILTPATERGSGMVRKAKELAEQHGWFLASQFSNPANPAYHRNTTAAEILRDFAGRRLDHFVSGWGTGGTLTGVGEVLKIARPDIKITASEPANAALLQGKEWQPHKIQGWTPDFVPEVLNRSVPHHILSVTDDDAITVARRLAAEEGVFSGISGGASVATALQIAQQAEPGAVILAMLPDTGERYFSTPLFADINEHSDDAWLASLG

SEQ ID NO: 64306 - protein, 511 aa, Aspergillus nidulans FGSC A4
MADLFVDLVAPNGTHYSQPTGLFINNAFVASSGQTITSLDPATDKPIATVHAASAEDVDRAVIAARAALVHPSWKKLPGTERGQLMARLADLMEKNKELFATIDAWDNVLSLTEKSGKPYHIALSEDLVEAIGTIRYYSGWADKTFGQTISTTPAKFAYTIRQPVGVVGQIIPWNYPLSMACWKLGPALACGNTVVLKPAEQTPLSVLVLGSLIKEAGFPPGVVNIVNGYGREAGAALAGHPLIDKIAFTGSTVTAREIMKLAAGTLKNITLETGGKSPLLVFPDADLEQAVKWSHFGIMSNQGQICTATSRIYVHQDIFQLFLSKFKAAVETTSKIGDQWDESTFQGPQITRAQYDRILSYIETAKKGGMAVVTGGSAHAPSSEKNKDGYFIQPTVFTGTDDSHAIVREEVFGPVVVILPFASEEEAIRRANDTTYGLGAAVFTCDLERAHRVAAEIEAGMVWVNSSQDCDPRVPFGGVKQSGIGRELGEAGLEAYTQVKAVHVNMGNKL

SEQ ID NO: 64307 - protein, 451 aa, Mannheimia haemolytica
KLIPALYNLYKIGRLGEHFSVLGVSRSELTDESFRQKMRDALVKFEKASGEELDKFCEHLYYQAVNTSDAVDYAKLLPRLDELHDKYQTAGNTLYYLSTPPSLYGVIPECLAAHGLTTEEFGWKRIIVEKPFGYDIETAKKLDVQIHKCFEEHQIYRIDHYLGKETVQNLLVLRFSNGLFEPLWNRNFIDYVEITGAESIGVEDRGGYYDGSGAMRDMFQNHLLQVLAMVAMEPPAIINANSMRDEVAKVLYCLHPLTEEDVKHNVVLGQYARGTVDGKEVPAYLEEKGVPADSNTETFMAVKCEIDNWRWAGVPFYVRTGKRLPTRVTEIVIHFKTTPHPVFSQNAPENKLIIRVQPDEGISMRFGLKKPGAGFEAKEVSMDFRYSDLSSSSSLLTAYERLLLDALKGDATLFARTDAVHACWKFVQPILGYKANRGRVYEYESGTWGPT

SEQ ID NO: 64308 - protein, 438 aa, Propionibacterium acnes KPA171202
MLNTIEEVLAELRAGRPVLVTDDADRENEGDAILAAELADPRWVGWMVRHTSGYLCAPMTEERADQLDLPLMWPASQDPLRTRYTVAVDAAHGITTGIDAVQRARTARVLADPSSTPSDLVRPGHVLPLRARAGGVLERRGHTEAAVDLARLAGLEPVGLIGELVGDDGMCLRADAIADLARTEGLALTTIDQLAQWRQAHDPGPAVPTQRVTALASAHLPTRHGQFAITGYRDNCTGVEHVLLVGEKGIDADDGGPAWVRVHSECLTGDALGSLRCDCGDQLAAAQQHVCRHGGAIILLRDHEGRATGLLNKIAAYKAQDGGLDTVDAQTHLGLPVDAREYGAAVAILANIGITSVRLLTNNPAKAEALRDGGLEVTMSPLETSTRPEDERYLRTKRDRMGHALTLGVSPSEMSTQPLASSHTTSTTPALTIKGDRP

SEQ ID NO: 64309 - protein, 288 aa, Corynebacterium efficiens YS-314
MCCAVACMPQGRSNPSVIYPERIPMGFRSKKRVIAAKTPGELDAMQAAGEIVGRALQAVKAEARVGMTTHDLDQIAETVIREAGAIPTFLGYQGFPASICTSVNEVIVHGIPSKDVVLEDGDLVSVDCGATFEGWVGDSAWSFGIGELDDDVIALNNATEWVLMEGLQAMVPGNRLTDVSNALERATRRAEQKFGVHLGIVDGYGGHGIGRTMHEDPYLANEGKPNRGPMIQEGSVLAIEPMLTLGTTDSAVLEDDWTVVTLDGSYAAHWEHTVAATAAGPRILTPRR

SEQ ID NO: 64310 - protein, 322 aa, Prochlorococcus marinus str. MIT 9215
MEIANDITSLVGNTPLVKLNRIRNYFNCYPEIIAKLESFNPSASVKDRIAYSMLCKAEEEGLINPDKTTLIEATSGNTGIALAMVAAAKGYKLILTMPDTMSIERRAMLRAYGAELQLTPGKDGMKGALDLANELSSTIVNSYQFNQFENFANPDIHERTTAQEIWSQSNNNLDGLVTGVGTGGTITGCARFLKKVNPNCKIYAVEPKKSAVISGEKAGSHSIQGIGAGFIPKVLNTKLIDEIIKIDDDEAFYYGRLLARLEGLLSGISSGAALAATIKIGKRKELMNKRLIVILPSFGERYLSTAMFESNTSIQARKDGYL

SEQ ID NO: 64311 - protein, 182 aa, Wolinella succinogenes DSM 1740
MSVLDENQKQFLLDSIRNIPDFPKPGIQFKDITTLLNDPKAFGFLIDFLTDRYARFELDYVAGIESRGFIFGAALAAKLEVGFVPIRKKGKLPSTTIAEKYSLEYGFDEVEIHIDAFREKEGSRVLLIDDLIATGGTAEAAVKLIQSAKGHCVEACFLLNLEELGGAKKVSNLAPLYTLLDI

SEQ ID NO: 64312 - protein, 391 aa, Propionibacterium acnes KPA171202
MDLYEYQARDLFEKHGVPVLRGIVAETPEQASEAAAKLGTPVVAVKAQVKVGGRGKAGGVKIAKSAAEAAERAEAILGMDIKGHTVHKVMVAEGADIAEEYYFSILLDRGERRYLAMCSREGGMDIETLAKERPEALAKVPVDPIDGVDDAKAREILSEAGFPDSEQDAIVPAVLKLWETYRDEDATLVEVNPMIKTGDGRILAIDGKMTVDNNASFRQPDHAGLVDRATTDPLELRAGELGLNYVKLDGNVGVIGNGAGLVMSTLDCVAYAGENFPGSPAPANFLDIGGGASAEIMANGLDLIMSDEQVRSVFVNVFGGITACDQVALGIKGALEKLGDKAVKPLVVRLDGNAVAEGRKILEEFNYPLVTMVSTMDEAASKAAELASKEA

SEQ ID NO: 64313 - protein, 494 aa, Bacillus subtilis
MTITFQDFNLSSDLMKAINRMGFEEATPIQAQTIPLGLSNKDVIGQAQTGTGKTAAFGIPLVEKINPESPNIQAIVIAPTRELAIQVSEELYKIGQDKRAKVLPIYGGQDIGRQIRALKKNPNIIVGTPGRLLDHINRRTIRLNNVNTVVMDEADEMLNMGFIDDIESILSNVPSEHQTLLFSATMPAPIKRIAERFMTEPEHVKVKAKEMTVSNIQQFYLEVQERKKFDTLTRLLDIQSPELAIVFGRTKRRVDELAEALNLRGYAAEGIHGDLTQAKRMVALRKFKEGAIEVLVATDVAARGLDISGVTHVYNFDVPQDPESYVHRIGRTGRAGKTGMAMTFITPREKSMLRAIEQTTKRKMDRMKEPTLDEALEGQQQVTVERLRTTISENNLNFYMTAAAELLEDHDAVTVVAAAIKMATKEPDDTPVRLTDEAPMVSKRYKNQRSSKRRDGQGGGYRGGKGKSNNRSSYDKKRSNDRRSSGDRRQKKSY

SEQ ID NO: 64314 - protein, 79 aa, Alkalilimnicola ehrlichei MLHE-1
MSSIEERVKKIVVEQLGVKEEEVSGEASFVDDLGADSLDTVELVMALEEEFECEIPDEEAEKITTVQQAVDYINKHLGS

SEQ ID NO: 64315 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDAAFCWMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64316 - protein, 251 aa, Alkalilimnicola ehrlichei MLHE-1
MFSNQALENQVALVTGATRGIGRAIALQLGAMGATVVGTATSEKGAERIGETLSAQGIAGGGRVLDVTDPDQVAEVVKAIGADFGAPTVLVNNAGITRDNLMMRMKEEDWSRILDTNLSSAFRMVKACMRGMMKARQGRIINIGSVVASAGNAGQANYCAAKAGLEGLTRSLARELGSRGITVNTVAPGFIETDMTREMPEAQREALVGQIALERLGQPEDIAATVGFLATPAAGYITGSTLHVNGGMYMG

SEQ ID NO: 64317 - protein, 91 aa, Zea mays
  misc_feature (10)..(10): Xaa can be any naturally occurring amino acid
  misc_feature (12)..(12): Xaa can be any naturally occurring amino acid
  misc_feature (21)..(22): Xaa can be any naturally occurring amino acid
  misc_feature (36)..(38): Xaa can be any naturally occurring amino acid
  misc_feature (43)..(43): Xaa can be any naturally occurring amino acid
  misc_feature (69)..(69): Xaa can be any naturally occurring amino acid
  misc_feature (72)..(72): Xaa can be any naturally occurring amino acid
FPVDHTSYYXMXTYLTKFIDXXQCIVTKKLGVANNXXXLINNXLNNISYYKVDYTNFFPFFSNINPNPXIPXNQLLFPLKASLLHILKESK

SEQ ID NO: 64318 - protein, 533 aa, Gibberella zeae PH-1
MGVVEALLEQVTLKTTLVILFVSYCIYSIICRIDEHRRIRRLGHYGPHMKTYAPWGLGIVARFVVSTVKHQNLATWRDDMFGAENSWTVETRLLGVRTIFTADPANLKAILATQFVDYGKGKPFHAEWKDFLGDSIFTTDGAPWHASRQLIRPQFTRDRVSDLHCFEAHMQTLFKAIANRGPLHGEDQPVPTEGLDGKVLDISDLFFRYTLDVATEFLLGWDVKSLTTPRQEFAEAFNDVQRIQNIVARTGKLRHIIPRYKFWKGLKTVNHFINFYIERALRLSPEELNSKTKDDHSYTFLHALAGFTRDRKVLRDQIIAVLLAGRDTTAATLSWTLYELGRYPNAVKRLRSEILSTLGSERTPTYDDLKSMSYLKAVLNETLRLYPAVPFNVRLALKDTTLPRGGGPDGSEPLPVLKDSPVGYSTLVMQRRSDLYPPISDTFADPQIFSPERWAHWHPKPHDYIPFNAGPRICIGQQFALTEMSYVLCRLFQKYERVESRMKDIDGGEPLLKADIVLSPGQGVNVAFWEAKK

SEQ ID NO: 64319 - protein, 624 aa, Synechococcus sp.
MSPTAAPQKLSKVEDLKARSQYLLEPILSQLQEESTHFNEDGIQILKFHGSYQQDNRDNRVKGQEKDFQFMLRLRSPGGYIPPQLYLTLDQLADDYGNGTLRATTRQAFQLHGILKRDLKTVIRRIVENLGSTISACGDVNRNVMAPPAPFRDRPEYEWARTYANNIADLLTPESGAYYELWLDGEKVLSGEPDPAVLAARRNPKGRVADSVEPLYSDRYLPRKFKIAVTVPGDNSIDLFTQDIGLVVIGNDRGELEGFNVYVGGGMGRTHNKEETFARLADPLGFVPAADIYAAVQAIVATQRDYGDRSNRRHARMKYLIHDWGIAKFKEAVESVFGKAIAPVRELPPFRYRDYLGWHEQGDGKWFLGLPITSGRIKDDGNWQLRSALREIVSRWQLPLLLTGSQDVLIYDVQPGDRAAIDKLLRDRGVHTVEAIDSLQRYAMACPALPTCGLAITESERALPGLLVRIRRLLEEQGLPDEHFVVRMTGCPNGCARPYMAELAFVGSAPNTYQLWLGGSPDQTRLARPFIDRLADGDVETQLRPLFVFFKQSRQAGESFGDFCDRVGFDALRQFSESYQHEAAKPGYRVGLRADVHGRLKAEADKRGVSLTDLACEAIAAYLR

SEQ ID NO: 64320 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFGIMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64321 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDCAFNLMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64322 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRELLVALRQELDLYICLRPVRYYQGTPSPVKHPELTDMVIFRENSEDIYAGIEWKADSADAEKVIKFLREEMGVKKIRFPDHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 64323 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLLVALRQELDLYICLRPVRYYQGTPSPVKHPELTDMVIFRENSEDIYAGIEWKADSADAEKVIKFLREEMGVKKIRFPDHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 64324 - protein, 324 aa, Haloarcula marismortui ATCC 43049
MKATAKAHPIQGLVKYHGMRDEELRLPYHDSISVCTAPSHSKTTAAFDPNREVDVYVIDGETVTGRGAERIDAVVDHVRDLAGIDHGVRFESANNFPTNIGFGSSSSGFAAAAMALVEAAGLDMTRPEISTVARRGSSSAARAVTGAFSHLRTGMNDRDCRSERIETDLEDDLRIVAGMVPSYKETEEAHKEAAESHMFESRMAHIHSQISDMRDALYDGDFDAVFDLAEKDSLSLAAATMTGPAGWVYWQPRTIEIFNAVRELRNTEDVPVYFSVDTGASVYINTTEEYVGRVEETVADCGVDTRVWDVGGPAQILDEDKALF

SEQ ID NO: 64325 - protein, 520 aa, Citrus sinensis
MASMASIGSLKVPSSPSTATTSSNSNNHSRRSVVKRLAFSSSQLSGDKIFSKAVTGDRRSERRPIVVSPQAVSDSKNSQTCLDPEASRSVLGIILGGGAGTRLYPLTKKRAKPAVPLGANYRLIDIPVSNCLNSNISKIYVLTQFNSASLNRHLSRAYASNMGGYKNEGFVEVLAAQQSPENPNWFQGTADAVRQYLWLFEEHNVLEFLVLAGDHLYRMDYERFIQAHRETDADITVAALPMDEKRATAFGLMKIDEEGRIIEFSEKPKGEQLKAMKVDTTILGLDDERAKEMPYIASMGIYVISKDVMLNLLRDKFPGANDFGSEVIPGATSIGMRVQAYLYDGYWEDIGTIEAFYNANLGITKKPIPDFSFYDRSAPIYTQPRYLPPSKMLDADVTDSVIGEGCVIKNCKIHHSVVGLRSCISEGAIIEDTLLMGADYYETDADRRFLAAKGSVPIGIGKNSHIKRAIIDKDARIGDNVKIVNSDSVQEAARETDGYFIKSGIVTIIKDALIPSGTII

SEQ ID NO: 64326 - protein, 366 aa, Wolinella succinogenes DSM 1740
MALSIGIVGLPNVGKSTTFNALTKAQNAEAANYPFCTIEPNKAIVPVPDSRLEALAKIVNPQKIQYSVVEFVDIAGLVKGASKGEGLGNQFLANIKETEAILHIVRCFEDGNITHVEGSVDPLRDIEIIETELLLADMQTLEKRIERLERTAKTDKDAKDALEIAQALMAHIESGNAVRIFPQKEHESFKELNKELRFLTNKEIIYGANVDEEGLGEDNAFVLIVKDYAQKNGCEVIKLCAKIEEEMVSLEPNEKQEFLESLGASESGLDQIIKKGFEKLGLISYFTAGVKEVRAWTIRKGSTAPQAAAVIHKDFERGFIRAETIAYEDFIKHGGEQKAKEAGALRVEGKEYIVQDGDVMHFRFNV

SEQ ID NO: 64327 - protein, 289 aa, Sphingomonas paucimobilis
MTIKPLRKAVFPVAGLGTRFLPATKAMPKEMLPVVDRPLIQYAVDEAVEAGIEQMIFVTGRGKSALEDHFDIAYELEATMAARGKSLDVLDGTRLKPGNIAYVRQQEPMGLGHAVWCARDIVGDEPFAVLLPDDFMFGQPGCLKQMVDAYNKVGGNLICAEEVPDDQTHRYGIITPGTQDGVLTEVKGLVEKPAPGTAPSNLSVIGRYILQPEVMRILENQGKGAGGEIQLTDAMQRMIGDQPFHGVTFQGTRYDCGDKAGFIQANLAVALSRPDLEPAVRAFAVKALG

SEQ ID NO: 64328 - protein, 410 aa, Medicago truncatula
MGNCLDSSAKVDAAQSSRSTSGTSKTTPSSLTIPSYSDKSNSSSLLPTPRSEGEILSSPNLKAFSFNELKNATRNFRPDSLLGEGGFGHVYKGWIDEHTFTAAKPGSGMVVAVKRLKPEGYQGHKEWLTEVNYLGQLHHPNLVKLIGYCLEGENRLLVYEFMPKGSLENHLFRRGPQPLSWSIRMKVAIGAARGLSFLHNAKSQVIYRDFKASNILLDAEFNSKLSDFGLAKAGPTGDRTHVSTQVVGTQGYAAPEYVATGRLTAKSDVYSFGVVMLELLSGRRAVDKTIAGVDQNLVDWAKPYLGDKRRLFRIMDSKLEGQYPQKGAFMAATLALQCLNREAKARPSMTEVLATLEQIEAPKHASRNSLSEHHRVHAPVRRSPARNRTPSYVTPTASPLPSVRQSPRAH

SEQ ID NO: 64329 - protein, 324 aa, Lactobacillus sakei subsp. sakei 23K
MGQSATARAHTNIALIKYWGKKDANLIIPQNSSLSLTLDHFYTDTTVTFSETLTRDQIIFNGQEADEQTQTKMSQFLDLIRQQAGRSTFASVETTNHVPNAAGLASSASGYAALAAAGSRAAGLDLNRRDLSRLARRGSGSATRSIYGGFVEWQRGRNDQDSYAIPVQEEIDWDIQMIAIVLNDRKKRVASRAGMASVVATSPYYPSWVETAQADLPKMKDAIIKKDINLVGQLAEKSAMQMHATTLSAVPPFTYFEPETLQAIEVVERLRQQGVSCYYTMDAGPNVKVICTSRETPQILAALAPYFTAEQLLVAKPGPGVTSL

SEQ ID NO: 64330 - protein, 357 aa, Xanthomonas oryzae pv. oryzae KACC10331
MSKQILILPGDGIGPEIMAEAVKVLQRIDTQHGLGFELVYDELGGAAYDKYGSPLADETLERARAADAVLLGAVGGPQWDTIDPSLRPERGLLKIRSQLGLFANLRPALLYPQLADASTLKPEVVAGLDLLILRELTGGIYFGQPRGNRTLDNGERQAYDTLPYSESEICRIAKAGFEMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFAQADAADAIERAVGKVLDQGLRTADIWSEGTTKVGTVAMGDAVVAAL

SEQ ID NO: 64331 - protein, 530 aa, Propionibacterium acnes KPA171202
MAPGGVVGHRLAFMEQLHDVVLVVDFGAQYAQLIARRVREANVYSEIVPHNMPVRDMLAKEPAAIILSGGPASVYVEGAPSVDPALFNAGVPVLGICYGFQAMAQALGGQVAHTGASEYGRTSLCITSAGQLLSRIPHTISVWMSHGDSVSRAPEGFSTLARTAGAPVAAFEDVERRLVGVQWHPEVHHTESGQTVLEHFLFDIAGCRPDWNASSIVGDQIAQIRGQVGDRRVICGLSGGVDSAVAAALVQRAVGDQLTCVFVDHGLLRQGEAEQVKNDFVAATGADLVVADESQRFLDALAGVTDPETKRKIIGREFIRTFEDVAKRLNADQPIDFLVQGTLYPDVVESGGGEGAANIKSHHNVGGLPDDFQFSLVEPLRTLFKDEVRAVGLELGLPEDIVWRQPFPGPGLAIRIIGEVTAERLEVLRTADAITREEMGAAGLDRKVWQCPVVLLSDVHSVGVQGDGRTYGSPIVLRPVTSEDAMTADWARIPYDVLEKISTRITNACPQINRVVLDITSKPPATIEWE

SEQ ID NO: 64332 - protein, 324 aa, Mycoplasma penetrans HF-2
MKIIQNIKKDVSSLGYKPTIVYAEGWNKTIQEAATQVKNENLVDVVVIFRTQEELNGFNNTANVKTIVIENSDLSQYANLLFDLRKEKGLSYEDAVKLSKEPNYLACLMVKSNENWGAICGIEYTTKDTLRAALQVIKAKKGSIVNSIMILEREDKSIFASDIGLVINPSAEELSKIVYNCVDFIVNTLKIVNNNVAMLSYSTNGSGAGESVDKVKQAFELYKTLPQNPHANVYGEIQFDAAVDSKIRSKKSPDCTWSGDANVFVFPNLDAGNISYKILQRYAGFEPTGPIIIGLDKPVNDLSRGAGLFEVVSLSYVTALQTKN

SEQ ID NO: 64333 - protein, 190 aa, Propionibacterium acnes KPA171202
MSTETTALLRTLKRCKERAMEDLDAAMREDPAATSKLMVAIAYQGVHAIWAHRLAHAMWVKKPALRPLARLLSQLSRHITGIEIHPGATIGRRFFIDHGMGVVIGETAVVGDDVLMYHQVTLGGRARGQFKRHPTIGNRVLIGAGAKIIGNITVGDDCKIGANALVVKDVAPGTVVVGIPSKVHQGDVIA

SEQ ID NO: 64334 - protein, 167 aa, Glycine max
MVLTLYMCLISILKLFSPVSVVQFILKNLHYFLNFLFSTFQYARIIQKLGFPAKFKDFKIQNIVGSCDVKFPIRLEGLAYSHGAFSSYEPELFPGLIYRMKQPKIVLLIFVSGKIVLTGAKVRDETYTAFENIYPVLTEFRKNQQWYEVVFAYLTVVWQRSSWNCKY

SEQ ID NO: 64335 - protein, 396 aa, Escherichia coli
MFENMTAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64336 - protein, 478 aa, Rhodobacter blasticus
MTMATTVSKGKVTQVIGAVVDVQFEGVLPAILNALETTNNGKKLILEVAQHLGENTVRCIAMDATEGLVRGAPVSDSGTPISVPVGNATLGRILNVVGEPIDERGPIAATEKRAIHQKAPDFQSQSTESQILVTGIKVIDLLAPYSKGGKIGLFGGAGVGKTVLIQELINNIAKVHSGYSVFAGVGERTREGNDLYHEFIESGVINIDDLEKSKVALVYGQMNEPPGARARVALTGLTLAEQFRDQSGTDVLFFVDNIFRFTQAGSEVSALLGRIPSAVGYQPTLATDMGQLQERITSTKAGSITSVQAIYVPADDLTDPAPATSFAHLDATTTLSRAISELGIYPAVDPLDSTSRLMDPQILGEEHYNTARAVQGILQRYKSLQDIIAILGMDELSEEDKLTVARARKIQRFLSQPFDVAQVFTGSPGVQVPLDKTIASFKAVVAGEYDHLPEAAFYMVGDIEEAKAKAAKLAAAAA

SEQ ID NO: 64337 - protein, 705 aa, Vibrio vulnificus YJ016
MSEQKAFNLKIDEQNIAWLGIDVPNEKMNTLQAAFADEMKAIFAQLKDSSGLKGLIVHSLKPDNFVAGADVRMLEACKTAPEAEALARQGQELFQQLSDLPYPVVAAIHGPCLGGGLELALACDFRVCSDDDATRLGLPEVQLGLLPGSGGTQRLPRLIGLLPSLDLILTGKQLRAKKAKKLGVVDACVPQTILLDVAKQFVEKGKKRAKQKVTTKEKLLSGSGLGRKFVFEQAAKKTHEKTRGNYPATVAILQVIQHGLEKGMKQGLELEAKRFGELVMSNESKALRSIFFATTEMKKETGSEAKPSKVGMVGVLGGGLMGAGISHVSVAKAKVPVRIKDVSNDGVLNALKYNYKLFDKQRKRRILSKAQLQSKMLQLSGGTDFTSFNRTDVVIEAVFEDLSLKQQMVADIEANAKPETIFATNTSSLPIHKIAEKAQRPENIVGLHYFSPVEKMPLVEVIPHESTSEETIATVVALAKKQGKTPIVVKDQAGFYVNRILAPYMNESAHILLANEPIDKIDTALLDFGFPVGPITLLDEVGVDIGAKIMPILVAELGARFKGPDVFDVLLNDGRKGRKSGKGFYTYKGKKKEVDKSVYKLLKLTPESKLSDNDIALRCVLPMLNEAVRCLDDGIIRSPRDGDIGAIFGIGFPPFLGGPFRYMDQFGLKELVEKMNQFAEKYGDRFAPCDGLLTRAGEGRRFYDN

SEQ ID NO: 64338 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFKRMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64339 - protein, 756 aa, Zea mays
LMTKILLLLLLLALPLPAALALTAEGLALLTFKAAATDDPHSALSRWSESDQDPCRWPGVICANASSSAPSAAPRVVGLAVAGKNISGYIPSELGSLLFLRRLNLHGNRLSGVIPAALSNASSLHSLYLYGNRLTGGLPVALCDLPHLQNLDVSGNALSGELPLDLRGCRSLQRLVLARNAFTGELPAGVWPEMPNLQQLDLSSNAFNGSIPPDLGELPRLAGTLNLSHNHFSGVVPPELGRLAATVTLDLRFNNLSGAIPQTGSLASQGPTAFLNNPGLCGYPLQVPCRAVPPPTESPTPPATTTPLPSTASSDQHQPIRTGLIALISVADAAGVALVGVILVYMYWKVKDRKGRRDGGGDDSSKSGLCRCMLWQHGGSDSSDASSGDGDGEGKYSGGEGELVAMDRGFRVELDELLRSSAYVLGKGGKGIVYKVVVANGTTPVAVRRLGGGGGGGADRCKEFAAEARAVGRVRHPNVVRLRAYYWSADEKLVVTDFVGNGNLTTALRGRPGQTVLSWSARLKIAKGAARGLAYLHESSPRRFVHGEVKPSNILLDADFTAHVADFGLARLLAVAGCAPDGPPSTGGAGLLGGAIPYVKPPATGTGPDRFGAGGGYRAPEARAPGAKPTQKWDVFSFGVVLLELLTGRGPAADHASPSTSASFSAPVSGSTATDRSGSGEHGGGAVPEVVRWVRRGFEEDVRPLAEMVDPALLRGPALPKKEVVAAFHVALQCTESDPELRPRMKAVADSLEKIG

SEQ ID NO: 64340 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDRAFSQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64341 - protein, 107 aa, Bartonella henselae str. Houston-1
MSCIKVDKSNFESEVLTSSTPVVVDFWAEWCGPCKMIAPILDEISMEMQNQVKIAKVNIDENPELATQYGVRSIPTLLMFKDGNIASNMVGAASKGRVSEWIKEGLR

SEQ ID NO: 64342 - protein, 473 aa, Gibberella zeae PH-1
MPTVRATRTRNENDENSGTTRLTRAQAAALKVDELSMPAKAALQTKKSTANGTAAANTRKRAALGDVSNVGKADGVAGKKAKGLVSKAAQPTGIEKKTARPTRPALASQTANSKPAQSGSGTINNKRKVLTDTKPKAPVKKTEPTSKEPELTEENERSETPEEAEVEKPEVSVEKPEVQDAPFKYPPGVNNLDEEDLEDPLMVAEYANEIFEYLRDLECKSIPNPQYMSHQDDLEWKTRGILVDWLIEVHTRFHLLPETLFLAINVIDRFLSEKVVQLDRFQLVGITAMFIASKYEEVLSPHVENFKRIADDGFSEAEILSAERFVLSTLNYDLSYPNPMNFLRRVSKADNYDIQSRTIGKYLMEISLLDHRFMAYRPSHVAAGAMYLARLMLDRGEWDATLSYYAGYTEDEVEPVVHLMVDYLARPVVHEAFDKKYAAKKFLRASLLARQWAKKNAVLFGITDIELGLDQIS

SEQ ID NO: 64343 - protein, 603 aa, Solanum lycopersicum
MEERNSTRLSSSTNDTVWECVIPYIQESRDRDAVSLVCKRWWQIDAITRKHITMALCYTAKPEQLSRRFPHLESVKLKGKPRAAMFNLIPEDWGGYVTPWVMEITKSFSKLKALHFRRMIVRDSDLELLANRRGRVLQVLKLDKCSGFSTDGLLHISRSCKNLRTLLMEESYIIEKDGEWAHELALNNTVLENLNFYMTDLLQVRAEDLELIARNCKSLVSMKISECEITNLLGFFRAAAALEEFGGGAFNDQPELVVENGYNEHSGKYAALVFPPRLCQLGLTYLGRNEMSILFPIASRLRKLDLLYALLDTAAHCFLLQRCPNLEILETRNVVGDRGLEVLGQYCKRLKRLRIERGADDQEMEDEEGAVTHRGLIDLAKGCLELEYMAVYVSDITNEALEVIGTYLKNLSDFRLVLLDREERITDLPLDNGVRALLRGCHNLRRFALYVRPGGLTDVGLSYVGQYSPNVRWMLLGYVGESDHGLLEFSKGCPSLQKLEVRGCCFSERALALATLQLKSLRYLWVQGYRASSAGRDLLAMARPFWNIELIPARRVIANDGNNAETVVSEHPAHILAYYSLAGQRTDFPDTVKPLDPTYLLAE

SEQ ID NO: 64344 - protein, 253 aa, Glycine max
MAANFWTSSHYKHLLDQEDVDVVNTLDKEKGITLEDFKLIKMHMANYILKLAQQVKVRQRVVATAVTYMRRVYTRKSMAEYDPRLVAPTCLYLASKAEESTVQARLLVFYIKKLYSDDKYRYEIKDILEMEMKILEALNYYLVVYHPYRSLVPLLQDAGLNDLNMTQLTWGLVNDTYKMDLILVHPPHLIALACIYIASVLREKDTTAWFEELRVDMNVVKNISMEILDFYESNRMFTDERINAALQKLSLRP

SEQ ID NO: 64345 - protein, 178 aa, Physcomitrella patens subsp. patens
MASTIDFRHLDEGLGGAKRKRKRAEEEEAVELAAAEAMDVGEETKHASKRAAVAGDGQNKPVYGRPTYDGVLAGKVSGRKWKAHKTTRTSAMKVVGRKSTLEEKNREKEVKRAYKERMMELKEQIRASKVEKRKKNEERLRIKKENELRGQAVQKVTNPKTIKKMSKKQRKLLRPAPN

SEQ ID NO: 64346 - protein, 358 aa, Oryza sativa
  misc_feature (163)..(163): Xaa can be any naturally occurring amino acid
  misc_feature (225)..(225): Xaa can be any naturally occurring amino acid
  misc_feature (351)..(351): Xaa can be any naturally occurring amino acid
MAEVRTIGSLPVPNVQALAGTCNGSDEQIPERYIRTEATCEEVISNYHGDMAIPIIDLNKLLSPQSSEEECVKLRSACQYWGFFQLINHGVPEEVIENFRSNIIEFFSLPLDAKKEYSQLPNSLEGYGQTFVFSEDQKLDWGDMLYLQVHPTDSRDLRFWPVXPASFRQSLDQYSSETKSLSLCLFEFLAKAVGAEPESLLGIFEEQPRGMRMNYYPPCRQSDKXVIGLSPHTDVVGLTLLLQVNDVQGLQIKRDGKWFSVDALSGAFIVNIGDTLEILSNGKFKSVEHRAMIHPNKERISTALFHYPRDDLLLSPLPEFVKDGKVNYRSISYNDFMMQFFNQKRDGRNRXERLKLEQ

SEQ ID NO: 64347 - protein, 166 aa, Streptomyces aureofaciens
MQGADDTIHHRIDELTGIKESARSGDEGATGRQHAKGKLTAHERIALLLDKGSFTEVEPLRRHRASGFGLEAKKPYGDGVVTGWGTVDGRTVFVYAHDFRIFGGALGEAHATKIHKIMDMAEAAGAPLVSLNDGAGARIQEGVSALAGYGGIFRRNTRASGVIPQI

SEQ ID NO: 64348 - protein, 211 aa, Oryza sativa Japonica Group
MEGSLRLGFLLVLCILAFLRPAAAIRFVIDREECFSHNVDYEGDTVHVSFVVIKAETPWHYTEDGVDLVVRDPNGNQIHDSRDKISDKFEFIVHRRGVHRFCFTNKSPYHETVDFDVLVSHFSYYDQHAKDEHFSALFEQIAKLDEALYNIQFEQHWLEAQTDRQAILNENMSRRAVHKAFFESAALIAASVVQVYLLHRLFERKLGTSRV

SEQ ID NO: 64349 - protein, 478 aa, Mycoplasma penetrans HF-2
MYIFKFADIGEGIHEGKVSDILVKEGDSVKDGTDLFSVETDKITTEVSSPVNGVISKILIKVGDTIHVGDPIFEIDDSNGSSSSAAPAQAPEVKSEPVVVKEEKTEQVQEGGASVVGEVKVSNNVLPLFGSNTLNVSASVEPTKTRNDDVLASPVARVLAKNNNVDIALISGTGPEGRVTKEDVEKYLSSSNQTTTTQTISTASESVTVAPTVTVTKTVVQSSPATAVTNAIVANKVESTAIATIVEGDKILEMTSMRKAIANAMKRSWSNAAYTNLSVEIDVTDVWEQRNKIKDYILETENVKLNLLPFIIKAIAKTLKQFPIFNAINDDANGTLILRNEVNIGIAVDTKDGLIVPNIKNADKLSIIEIAKSIADIAARARTKKITMADLQKGTFSVSNYGSLGIEFGVPVINYPEVAIAGLGTASNKIKKVGIQMVERKVMVLTIAADHRWVDGGDIARFANQVKQYLENIAFLFV

SEQ ID NO: 64350 - protein, 463 aa, Mycoplasma penetrans HF-2
MKKYDLVIIGSGPGGYVAAEHAAKHGLKTLCVEAKDFGGVCLNKGCIPTKALLNTSKIKQYVLKAEEFGVTGINIDNITLDWPKVIERKNSVVKKLQMGVQGLLKTAKADMLKGEAKIVDQNTISVNEELINFDNLIIATGSSPRKFNLPGFAQGYEEGKILTSDEVLNLPRIPDKFTVIGGGVIGIEFAILFAELGSKVTILQGVDRILEILDKDISAEVTKLLLSKGVTIHTDVQIQKYENGQVYYTKDGTEQSEDFDYCLVSVGRTPSTEIARNLPIEFAPNGSIITNDKMQTSIKHIYAIGDCTSKVMLAHSAYKNAVVAVDTILNKPSKMDLLKIPSCIYTHPQVATVGYTEEQLKEKNIPYYAAKYPFMHLGKALADGKTVGFIKILVSQDCGEILGCHIVGEQASNYISEIALAMENESTIYTLSQTIHPHPTYAEIIWEVARKIIIENFSDKDWG

SEQ ID NO: 64351 - protein, 178 aa, Xanthomonas oryzae pv. oryzae KACC10331
MGLELVTSGKNLPEEINVVIEIPKDSEPVKYEVDKASGAIFVDRILSTPMRYPCNYGYVPNTLCGDGDPADVLVVLPLPLVPGSVVRCRPVGVLRMSDEAGSDEKILAVPIEKIFSGYAHIEDINQVSSHWMERIGHFFEHYKDLEKGKWVKLNGWGGAAEAKRILVESVERYNSDAP

SEQ ID NO: 64352 - protein, 473 aa, Bacillus sp. PS3
MTRGRVIQVMGPVVDVKFENGHLPAIYNALKIQHKARNENEVDIDLTLEVALHLGDDTVRTIAMASTDGLIRGMEVIDTGAPISVPVGQVTLGRVFNVLGEPIDLEGDIPADARRDPIHRPAPKFEELATEVEILETGIKVVDLLAPYIKGGKIGLFGGAGVGKTVLIQELIHNIAQEHGGISVFAGVGERTREGNDLYHEMKDSGVISKTAMVFGQMNEPPGARMRVALTGLTMAEYFRDEQGQDGLLFIDNIFRFTQAGSEVSALLGRMPSAIGYQPTLATEMGQLQERITSTAKGSITSIQAIYVPADDYTDPAPATTFSHLDATTNLERKLAEMGIYPAVDPLVSTSRALAPEIVGEEHYQVARKVQQTLERYKELQDIIAILGMDELSDEDKLVVHRARRIQFFLSQNFHVAEQFTGQPGSYVPVKETVRGFKEILEGKYDHLPEDRFRLVGRIEEVVEKAKAMGVEV

SEQ ID NO: 64353 - protein, 251 aa, Neisseria meningitidis serogroup B
MWDQKWVIGNWKMNGRLQNNNALMHRFRIHPTAERVLIGLAAPTVYLLQLHNAMQIVLNNRILTCAQDVSRFPNNGAYTGEVSAEMLADTGTDIVLIGHSERSLYFGEKNEIQRRKMENVLNVGLIPLLCVGESLEEREAGKEHEVIAHQLSILQGLDTKNIAVAYEPVWAIGTGKVATVEQIADMHAFIYKEILSLCGSDVKIRVLYGGSVKADNAADIFAVPYVDGALVGGASLSYDSFTAIISAAQNA

SEQ ID NO: 64354 - protein, 530 aa, Rhodopseudomonas palustris CGA009
MTDQFSHLQQIRKPAITAKGGIVAAQSRRAAEIGADVLAEGGDCIDAVIATTFALGVLEPWMSGIGGGGAMVLYRAKEDRAEVIDYGMRAPQSLRVEDYPLTGAGAASDLFPWPRVKDDRNIHGPAAVAVPGVVAGMEEAHRRYAKLPWRDLVAPSIALASDGLAVDWWTTLMIGSVAADLRRYQASAASYLIDGLPPHAPWGIKSNVTLPQDRLQATLAQLGEQGPRDFYEGDLARSLAADIQAAGGTLSVEDLAGFRAHLRAPLTIPYRGGAVFATPELTAGPTLAHTLRVLGEHLTPAGSEPDAAAYQAYALALQSAYAERLRDMGDADGRRALGAEHLAPACTTHFSVVDRDGNMAAVTQTLLSTFGSKFETPHTGIMMNNGIMWFDPEPGRPNSLAPGKRCLTNYTPVLAHAPDGRRLALGASGGRRILPAVAQILSFVIDYGMDLDAAIHQPRIDASEGEVVIGDVRLPNATREALRQKFDYEEARVQTFPMKFACPSVVLRHGTTNSGATEIAQPWGDAVAES

SEQ ID NO: 64355 - protein, 396 aa, Escherichia coli
MFENITAAPADPILGLADLFRADERPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPTHKSVFNSAGLEVREYAYYDAENHTLDFDALINSLNEAQAGDVVLFHGCCHNPTGIDPTLEQWQTLAQLSVEKGWLPLFDFAYQGFARGLEEDAEGLRAFAAMHKELIVASSYSKNFGLYNERVGACTLVAADSETVDCAFGQMKAAIRANYSNPPAHGASVVATILSNDALRAIWEQELTDMRQRIQRMRQLFVNTLQEKGANRDFSFIIKQNGMFSFSGLTKEQVLRLREEFGVYAVASGRVNVAGMTPDNMAPLCEAIVAVL

SEQ ID NO: 64356 - protein, 365 aa, Alkalilimnicola ehrlichei MLHE-1
MIPPLTPWAQRPRLPAEWERQAAVQLTWPHDRDGLWGDQLPAVEGCFVAMASAIAAHQPVLVVCHDERLRERVDVLLARAGMAAEARRLAVAPSNDIWARDHGPITVLNGDGRPLIQDFAFNGWGQRYRADRDDVITQHLVQQGVFGESRFRRVEWVLEGGAIDADGAGTLLTTTRCLLNDNRNPGATRAQVEQQLIARLGASRVLWLERGGLTGDDTDGHVDMLARFVDPETIVYQACDDPDDADYPELQAMLSALRGFTTLRGGGYRLVPLPWPAIKRDEQGMRLPASYANFLIINGAVLVPQYQDPADDRARAVLGELFPDREIIGIPAVPLIQQHGSVHCATMQLPAGVTVVAPDPAGHAA

SEQ ID NO: 64357 - protein, 282 aa, Oryza sativa
  misc_feature (179)..(179): Xaa can be any naturally occurring amino acid
MAEHLASIFGTEKDKVNCPFYFKIGACRHGDRCSCLHNRPTISPTVVFANMYQRPDMITPGVDAQGQPIDPRQMQEHFEDFYEDIFEELSKFGEIENLNVCDNLADHMIGNVYVQFREEDQAAAAHTALQGRFYSGRPIIVDFSPVTDFREATCRQYEENSCNRGGYCNFTHVKQIGTXRDLRKKLFGHYRKPQRGRSRSPSPSPRHRRERHDRDDYRGRDDYSGGGGRRGGSSRHERHDDGGRRRHGGSPPRRARSPVRESSEERRAKIEQWNRERDEKQG

SEQ ID NO: 64358 - protein, 260 aa, Bartonella henselae str. Houston-1
MTAETERIGVKGGMEYSFGFTKIDEAQKQSMVDGVFHSVAENYDKMNDILSLGLHRMWKNSMVAWLSPPAVFHWKVLDVAGGTGDIAFRILNASRQKAHATVLDINGSMLSVGKKRAEKNGLAPLIDFVEANAEHLPFEDQSFDAYTIAFGIRNVPHIDQALREAFRVLKPGGRFLCLEFSNVEMPLLDKIYDLWSFHAIPKLGQLIANDGDAYRYLVESIRKFPKQDDFAHMINHVGFSRVSYRNLTGAIAALHSAWKI

SEQ ID NO: 64359 - protein, 196 aa, uncultured bacterium
MDIQMRTNVPHIFAIGDIVGQPMLAHKAVHEAHVAAEVIAGELQGNKELASAAFNARVIPSVAYTDPEVAWVGLTEDQAKAQGIKVKKGLFPWAASGRAIANGRDEGFTKLLFDDSPEAGSGDGHAGRGHGKILGGGMVGTHAGDMIGEIALAIEMGADAVDIGKTIHPHPTLGESIGMAAEVAHGSCTDVPPARK

SEQ ID NO: 64360 - protein, 521 aa, Ganoderma lucidum
  misc_feature (12)..(12): Xaa can be any naturally occurring amino acid
MARLQSFVPDLXLLFAASAYAAIGPVANLTISDADIAPDGFTRAAVVVNGVSPGPLITGNKGDNFQINVINQMTNHTMNKTTSIHWHGLFQEGTNWADGPAFVTQCPIVSGNSFLYNFHVPDQAGTFWYHSHLSTQYCDGLRGPLVVYDPHDPLAHMYDVDDDSTVITLTEWYWTASHLGTRFPAGLANSRDNGLGRTTATSNAELAVVNVTQGKRYRFRLVSMACDPSFNFSIDGHDLTVIEADGVETQPVTVNSINIFAAQRYSFVLTANQTIDNYWIRANPSLGVMGFDAGINSAILRYDGAAPVEPVTSPQSTQILLNETDRPPSLRPEEDAWKPEKGGVDLPLNMAFGFDGTDFFINNATFVPPTVPVLLQILSGTQAAQDLLPAGSVYTLPKNASIEITFPANANAAGSPHPFHLHGHTFAVIRSAGSTAYNYDNPVWRDTVSTGFATNNDNVTIRFQTDNAGPWFLHCHIDFHLNAGFAVVLAEDVPDIARANPVPQAWKNLCPTYDALSPNDQ

SEQ ID NO: 64361 - protein, 849 aa, Debaryomyces hansenii CBS767
MLRQVVGRSVVKRLSSVANKEIVGSVSLSNRLRSTKTTTRFYSTRSTVVQLLNNIGSKREVEQYLKYFTSVSQQQFAVIKVGGAIITQQLPELASCLAFLYHVGLYPIVLHGTGPQINELLENEGVEPEYLDGIRITNPKTMEVVRKCFLEQNLRLVTALEKMGVHARPITAGVFGADYLDKDKYQLVGKVNSVNKSPVESAIEAGYLPILTSLAETPSGQLLNVNADVAAGELAREFEPLKIVYLNEKGGIINGNTGEKVSMINLDEEYDDLMKESWVKYGTKLKIKEIHDLLQHLPRSSSVAIIDVDDLQKELFTDSGAGTLIRRGYKLISRNSLKEFGNPDLLRAALLRDPEIKSGKLSVASYLKHLESIEFKSYGDEPLEVLAIVTKNGSRFPKLDKFLSSRTGWLNNVTDNIFNSIKKDYKSLYWIVSENDSNLSWYFSKSDGSFSKNGEILFWYGLNTEEVSQLINQFDSSSIGSALSSSSESGIFSSPTQKKGLHTMARRSYSSNPNPPIREGKNTQKAKVALIGARGYTGQNLINMIDSHPFLELSHVSSRELKGQKLKGYNKDNIVYSNLQVEDIKELEKNNEVDVWVMALPNGVCKPFVEAIESIPNNKSKIIDLSADYRFDTTGEWVYGLPELNDRNAIASAKKISNPGCYATAAQCAIAPLVSYINGTPSIFGVSGYSGAGTKPSPKNDVKFLANNIIPYSLTDHIHEKEISSQLGLDVAFTPHVAQWFQGISHTISIPIKPKSLSSREIRNIYQDRYQGEQLITISGEAPLVKDISGKHGVVVGGFAVNSKQDRVVIVATIDNLLKGASTQCLQNINLTMGYGEFEGIPDDLVIRG

SEQ ID NO: 64362 - protein, 529 aa, Pleurotus ostreatus
MFPGARILATLTLALHLLHGTHAAIGPTGDMYIVNEDVSPDGFTRSAVVARSDPTTNGTSETLTGVLVQGNKGDNFQLNVLNQLSDTTMLKTTSIHWHGFFQSGSTWADGPAFVNQCPIASGNSFLYDFNVPDQAGTFWYHSHLSTQYCDGLRGPFIVYDPSDPHLSLYDVDNADTIITLEDWYHVVAPQNAVLPTADSTLINGKGRFAGGPTSALAVINVESNKRYRFRLISMSCDPNFTFSIDGHSLQVIEADAVNIVPIVVDSIQIFAGQRYSFVLNANQTVDNYWIRADPNLGSTGFDGDINSAILRYAGATEDDPTTTSSTSTPLEETNLVPPENPGAPGPAVPGGADININLAMAFDVTNFELTINGSPFKAPTAPVLLQILSGATTAASLLPSGSIYSLEASKVVEISIPALAVGGPHPFHLHGHTFDVIRSAGSTTYNFDTPARRDVVNTGTDANDNVTIRFVTDNPGPWFLHCHIDWHLEIGLAVVFAEDVTSITAPPAAWDDLCPIYDALSDSDKGGIA

SEQ ID NO: 64363 - protein, 180 aa, Solibacter usitatus Ellin6076
MLGVGQKFPAFSVQATVSLEKGKAFQTITDQNFKDKWKIYFFWPKDFTFVCPTEIAAFGKLNRDFQDRDAQVLGGSTDSEFVHHAWRTHHADLKDLPFPMLADVKRDLCEALGILDPQEGVAQRATFIVDPHDIIRFVSVNDLSVGRNPQEVLRVLDALQTDELCPCNWQKGEEALTVAV

SEQ ID NO: 64364 - protein, 346 aa, Lactobacillus sakei subsp. sakei 23K
MKAATFIEPGKMVITEAPKPTIEKKTDAVIRIIRACVCGSDLWWYRGLSKRESGSLVGHEAIGVVESVGEAVTDIKAGDFVIVPFTHGCGHCAACLAGFDGDCTNQEGGGNGGYQGEFLRYTNANWGLVKIPGQPADYSDEMLNNLLTLSDVMATGYHAAVSAEVKPGDTVVVMGDGAVGLCGVIGAKLLGAEQIIAMSRHEDRQKLALEFGATDIVAERGDEAVAKVMALTDNAGANAVLECVGTEQSVATAVAVAGAGAVIGRVGIPQKAEMNTNVLFRKNIGLRGGIAAVTTHDKARLLDAVLKGEINPGKVFTQRFNLDDIQAAYEAMDQRQAIKSLLVISD

SEQ ID NO: 64365 - protein, 157 aa, Mycoplasma penetrans HF-2
MKIKIICFGKIKDKNITALINEYLSKINHFTNLTIVELSEEKINNENSIGEIEEALKKESKKLIPYLENSFNVLLDIKGVQMDSIKFANSINQNLIISKDINFYIGSSHGISESIKNKFNLKLSFSELTFNHQIFRLILLEQIYRAFSILNNTKYHK

SEQ ID NO: 64366 - protein, 437 aa, Physcomitrella patens subsp. patens
MGQRVYQVWKGSNRFFLCGRLIFGPDVRSLAVTIFLIVAPSVCFCNFVGRHLLHHFNNNGGVAIVAVTAIYTAYVLVLLLLTSGRDPGIIPRNLHPPEPEEDFVSNNSPGEWGAQTPRSRLPRTKDVIVNGVAVKTKYCDTCMLYRPPRCSHCSICNNCVLRFDHHCPWVGQCIGQRNYRFFFMFVSSTLLLCVYVFAMCAMYIKILVDEGDRTVWKALSKSPASIVLMVYTFICVWFVGGLTVFHLYLIGTNQTTYENFRYRYDNKVNPYNRGCVSNFNEIFCSTIPASKNQFRSRVQEVIPRQMGRVQQTRDMGEAHGSSAAKESDLEQGYKATWPNAEDMVGEGGELEMAGGRVSTGSELGMEMKDTFDPRPIEQGRPAVANRRTSRGRQSGSWEITPDILAMSSSEGGGGHNNHGRGRLQSRFTGESTAISNQ

SEQ ID NO: 64367 - protein, 255 aa, Gibberella zeae PH-1
MTAFELHLYRGLEPTEPNFIMGHEFTGTVVELGSAVKSVEIGDKIVSPFTASCGLCYYCENGGSARCVNSQPLGSPNLDGAQAEYVRVPFADGTVAKASADIHDQALILMADIFPTGYFGVKSGVEMMPNLDVHDSTIVVIGCGPVGLCAVVAAAALKPKHLFAVDSVSSRLDQAAKLGAEPLNFMSDKTGMHDRIKAATNGRGADIVVEVVGLSPALRTAFDLVRPFGAISSIGVHNAEIPWSGNDAYKWGDAQ

SEQ ID NO: 64368 - protein, 420 aa, Photobacterium profundum SS9
MTLLALGINHNTASVDLREKVAFSPDKLKEALQQLESHPEVTSSIIVSTCNRTEVYCDVTHSGPGVMIDWLAKFHRLSAEEILPSLYFHEEQAAARHLMRVACGLDSLVLGEPQILGQVKQSYYSSQEYDAIHGTLEKLFHKTFTVAKRVRTETDIGGNAVSVAYAACTLAKQIFESLSDTTVLLVGAGETIELVSRHLVEQGCNKLIVANRTKERAANLAEEFGAEVIGLPEIPEHLHRADIVISSTASPLPIVGKGMVEKAIKARRHQPMLFVDIAVPRDVEAEVGDLNDVYLYTVDDLHSIIEKNREQRKVAAIQAEAIISEESAAFMSWLRSLEAVDSIRQYRCFADDIKNDMLSRSLQAIANGVAPEKVLVELSNKLTNKLIHAPTRAMQQAAHNGEPEKLSVIRETLGLDSIKD

SEQ ID NO: 64369 - protein, 459 aa, Rhodopseudomonas palustris CGA009
MSIQVADSSLVARLSPPKPSALAHVPGDEGWPIIGRTLAVLADPKGEVEKMARTYGPVYRSRVLGETSITLLGPEANELVLFDNTKLFSSTHGWGPILGRLFPRGLMMLDFDEHRLHRRTLSVAFKAGPMQSYLAELNAGIAHRVAEWRARPGEMLCYPAMKQLTLDLAATSFLGTAIGAETEEVNRAFIDMVAASVAPIRKPWPGTAMARGVKGRQRIVAYFAEQIPIRRAKGGDDLFSQLCRATHDDGALLSNQAIIDHMSFLMMAAHDTLTSSLTSFVAALAAHPEWQQKLREEIAGLGLKPGEPISFEQLDALPLTEMAFKEAMRLRPPVPSLPRRATRAFSFKGYTIPAGTMVAVNPLFTHHMPEIWPNPDQFDPLRFTDEASRGRHRFAWIPYGGGAHMCLGLNFAYMQAKCFAVHLLQHLDLSLPPNYQASWQMWPIPKPKDGLRVNVAPLN

SEQ ID NO: 64370 - protein, 547 aa, Chlamydomonas reinhardtii
MNRLWTSLLKAALVVCAWSSACSAIELGAEAVGSPLAPSHTRAFALPVRHHKLPDGVRRRRHLLRSSTRPVYGNVPELGYYYTYLTIGTPGQTVSGILDTGSTLPAFPCSGCTRCGPSKTGMFKPELSSTSSTFGCSDARCFCGANSCSCNNEQCGYSIRYLEGSSTSGFLAEDMLAVGDGGPAANFVFGCAQSESGLLYSQIADGVFGMGRTPASLYGQLVQQGVIDDAFSMCFGAPREGVLLLGNVALPADAPAPVVTPVVGNTNKFNIQIEGLNFNDQQLVSGQRHNLQLLHTQCVQRAGGGHPETRRGQPRPCVRAGCLRECWLPYTHKDCIRRRRALCACDARARPRACPLHCCADCCLWFCACVMSLAQSDDICWKGAPADDASKLGAYFPDMELLLAGGGRLTRSPLHYLYPYGAAWCLGFFDNAYSSTVLGANLMLDTVVTYDGRLNQMRFTTYECDKLSEALGVNGQGSNNSTSPGSAPSPPLPQPPPPPPPSPPPAAPPPAALKPKRPRRTSPPPPRPPPRSPSPRARTKKSPPPRS

SEQ ID NO: 64371 - protein, 315 aa, Photobacterium profundum SS9
MPDMKLFAGNATPELAQRIADRLYISLGDATVDRFSDGEVCVQINENVRGSDVFIIQSTCAPTNDNLMELVVMIDALRRASAGRITAVIPYFGYARQDRRVRSARVPITAKVVADFLSNVGVDRVLTVDLHAEQIQGFFDVPVDNVFGSPVLLEDILARNLEDPVVVSPDIGGVVRARAIAKLLDDTDIAIIDKRRPRANVSQVMHLIGDVEGRDCIIVDDMIDTGGTLCKAAKALKERGAKRVFAYATHPVFSGSAVKNICESVIDEIIVTDSIPLSKEIIATGRVSVLTLSGMLAEAIRRISNEESISAMFEH

SEQ ID NO: 64372 - protein, 594 aa, Gibberella zeae PH-1
MSTDADDLLNDFGGSGDEAEEENNDGLIKDQEATGDRDRDAMELDGDAEAKNDDDSDADLNDRDDSEAAKIKVEKMQLGGVKDVRSVASLMQTLEPVLEKIAHFRSQAATQNTNIGNIEDHPEYHLLTQSNSLSTQIDGEVALVHKFIRDHYSTRFPELERLVTTPLEYAKVVAIIGNGPLDSESIKALQTSTDNPLGITLKSVLDGPSLMIVTVEATTSKGHEMTPEELQRVYKACEMTISLNNAKQTLTEYVQSRMNIFAPNLTALVGSLTAAQLLNHAGGLTGLSKTPACNIASWGSKKKHSGMATNIGVRQQGYLYNSEIIRAIPSDLRKQALRVVSAKLVLAARVDRIHSSPDGSTGEELKSACLERLEKLTEPPPNKGQRALPVPDDKPARKRGGRRARKAKEALAMTDLRKQQNRLAFGKEEKEVGYGLGEGTVGMGMIGQSNDGRIRGTQIDQRTRAKVSAKNKGWSGNSTVGGAASSIGGFGQASNIDLRGRGLRATGVGSTVGSGAGISSSLAFTPVQGLELVDPKTQAALSKKRKAEEDRWFKGGAFTQVGGSSSGNGFKVPELPTAKRVDTGSTKTGPSASK

SEQ ID NO: 64373 - protein, 395 aa, Rhodopseudomonas palustris CGA009
MAVSAGREFLAIPGPTTTPDEVLQAMHRPALDIYSNEMVALSEGLHTDLSRLFATKGKSYIYIANGHGAWEAVISNVLSRGDKVLVLESGRFAVGWGNAARAMGCDVEVLQGDWRRAVRVDEVEARLRRDTEHSIKAIVVVQVDTASSARNDLEAIGRAIRTAGHPALFMVDAVASLGCMPFEMDAWGIDVAMSASQKGLMSPPGLSFVAVGDRARAAHQRAGLRTPYWDWTERDGPEHYQKYAGTAPVHLLFALRKALDILFAEGLDNTFRRHHLLAGAVRRAVDVWSEGNMLGFNIEHPDERADTVTTVRAAEGHDIAALHRYCKDKCGVVLGVGIGELQNKAFRIAHMGHVNAPMVLGTLGVIEMALSALGIPHSRGGVDAAVAYLAENVPA

SEQ ID NO: 64374 - protein, 595 aa, Auricularia auricula-judae
MAPAQRSKHAHTIVILLVAGVALLALVLGLGLGLGLRNRNKDASAASGATSNLSSQLTAQNGSHAFFIRGAAAMAKDPPQTREYNFTISNVRGAPAGVEKDMVVVNNIWPGPTIEVNQHDRVVIRVMNRAQNATAIHWHGLYQRGTPFYDGTHGITQCGIPPGQDLVYNFTLGDFSGTTWWHSHYMTQYTDGVTGAFIVHPTNATVSAPTYDTDSLIQVGDMYHTISDKLLAAFTSPSGIDGTPGDEPVPDTGTINGMGQYGVNGSQVGTCYKLTLAPNATHRLRIINSGSFADVRFSVDGHPLTVVETDGVEVAPYVVEAVQVSVAQRYSVLLTTNNTAGVYWMRAVVQEDMFTYDQPGFNGNALGVLQYTGVDNSTMPDPGLVDNNPGTGKNLTLMDTALLRPASKQHPPKATLTYKITVSFQVTADNGFFAFINSTSWTPLSGSPTLFSHLGADTVGANTFDNSQLILTSPNSEVIDLIIDNLDDGDHPFHLHGYKFWIMGTGDGRYQGQDVDDVVNPLLRDTHLIPSFTWTVLRFVANNPGAWAFHCHISWHMAIGLLVQFYTMPTEAAGLLLPQDMVDQCSTEGASARVR

SEQ ID NO: 64375 - protein, 175 aa, Triticum aestivum
MAPPVMASSATSVAPFRGVKSTAGLPVSRRSNGASLGSVSNVGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 64376 - protein, 612 aa, Aspergillus oryzae
MAFSSTNSETSDAPHLGPTQHALGIPRPPSVGGISSRVTEDIASEDGDQSQSNTGVSSHAQHRSRPSVSSRPGPPPVRSSIISQATNRPGSSNSRLSRSHIPSLTAQGFFRPLSSQRLQAHRGRPMTKGTESSEDWVDHASQNRRSLISNSTLAQSSIPQEQEVPPSRGTEFTDPIIPDRNTSNASPIGNTTARSIGESAKLLRDKERHNQPSQPHLNLGVSASSQNGHDISQRSPLSFLSPPNRNGGQEHRDSRNHERLSSAGSSPGSIEKQSRTVSKSRLGKNYEYFLGNTIFCGGGRFQNSRDKPVNVATGVLVVVPSALFFGFSAPWLWHNISPAIPILFAYLFYLCFSSFLHASVVDPGIIPRNLHSMPPPDPSDDPLAIGPPTNDWVMVKLATSEVAAMDVPVKFCKTCNIWRPPRCYHCRVCDNCIETLDHHCVWLNNCVGRRNYRYFFTFVGSSTLLALFLIGASLAHILVYRSREGISFNDAIDQWRVPWAMVLYGAVAAPYPASLWAYHLFLVGRGETTREYLNSHKFAKADRHRPFTQGNILKNWISVFGRPRPPTYMQFKKPYHEGDQRLSMVKRKYLPRDVEAQAGIEMQHVPSDQPQD

SEQ ID NO: 64377 - protein, 302 aa, Bradyrhizobium japonicum USDA 110
MGRVYVAGSINMDVVATADRHPKVGETVAGKQVLYFPGGKGANQAVAASRLGARTTLIGRLGKDSFGTELRAFLAGQGIDLGYVQETAEAHTGTAIITVAAADNTIVVIPGSNALVGADDVSVVPLVKGDVAISQFEIPLPTIAAFFLRARAAEATTLLNPAPAQKFGHELLELVDILVLNETELGFLAGTELSDNDEAARIIQVARQLQAREDQTICVTLGKRGVLALAGDQEFAVPGRVVKAVDTTGAGDCFVGALAAQLADEVPLRTALAFANAAASISVQRMGAGPSMPTAAEVAAVL

SEQ ID NO: 64378 - protein, 717 aa, Oryza sativa
MASHANASGGGGDEEMVEASTLRHRHGAGKDANGVGTERQLAAAAAEGEEEGPSSVERAFVDRAVPSWREQLTVRAFVVSFFLSIMFSIIVMKLNLTTGIIPSLNVSAGLLGFFFVRLWTAAIERVGLLRQPFTRQENTVIQTCVVAAYGIAFSGGFGTYLFGMSETIAKQATEANNAQNVKNPHIGWMIGFLFLVSFIGLLALVPLRKIMIVDYKLTYPSGTATAYLINGFHTPEGAKLAKKQVKELGKFFLFSFVWGFFQWFYTAGDGCGFQSFPTLGLQAYKNRFYFDFSPTYVGVGMICPHIVNVSVLLGGILSWGIMWPLIRNKKGSWYAASLSETSLHGLQGYRVFISIALILGDGLYNFVKVLIRTTAGFVVMMKKNSTLPVSNNGSPMVATEAISFDDERRTELFLKDQIPKTVAFGGYVAVAAVSIGTLPQIFPQLKWYYILVAYVFAPVLAFCNAYGAGLTDWSLASTYGKLAIFIFGAWAGASNGGVLVGLAACGVMMSIVSTASDLMQDFKTGYLTLASPRSMFVSQVIGTAMGCVIAPCVFWLFYKAFADIGVSGTEYPAPYAIVYRNMAILGVDGFSSLPKHCLTLCYIFFAAAIAINLARDLAPSKVARFIPLPMAMAIPFYIGSYFAIDMFIGTVILFVWEMVNKAKAEAFAPAVASGLICGDGIWTLPQSILALAKVKPPICMKFLSRSVNAQVDGFLGN

SEQ ID NO: 64379 - protein, 325 aa, Glycine soja
MAVERSGIAKDVTELIGKTPLVYLNKLADGCVARVAAKLELMEPCSSVKDRIGYSMIADAEEKGLITPGKSVLIEPTSGNTGIGLAFMAAARGYKLIITMPASMSLERRIILLAFGAELVLTDPAKGMKGAVQKAEEILAKTPNAYILQQFENPANPKVHYETTGPEIWKGSDGKTDAFVSGIGTGGTITGAGKYLKEQNPNIKLIGVEPVESPVLSGGKPGPHKIQGIGAGFIPGVLGVNLLDEVIQISSDEAIETAKLLALKEGLFVGISSGAAAAATFQIAKRPENAGKLIVAVFPSFGERYLSSVLFESVRREAESMTFEP

SEQ ID NO: 64380 - protein, 818 aa, Synechocystis sp. PCC 6803
MVSSVVEKTSVAHKETALILWFEEVGTHDVGLVGGKNSSLGEMIQQLTNKGVNVPSGFATTAYAYRYFIQEAGLEQKLRDLFTDLDVNDMANLQERGHLARQLILDTPFPQNLQTAIAEAYGAMCERYGQKMGRTGVDVAVRSSATAEDLPEASFAGQQETYLNVHSLSCVLESCHKCFASLFTDRAISYRHHNGFDHFAVALSVGVQKMVRSDLATSGVMFSIDTETGFKNAALITAAYGLGENVVQGAVNPDEYFVFKPTLKEGFKPILEKRLGSKAIKMVYDVGGSKLTKNVEVAEPEREKYCINDEEILQLARWACIIEDHYSGVRGVYTPMDIEWAKDGQTGELFIVQARPETVQSQKSANVIKTYELKDHSQVLATGRSVGAAIGQGKAQVIRNVSQINQFRPGEVLITNRTDPDWEPIMKQASAIVTNQGGKTCHAAIIAREMGIPAIVGCGDATDTIKTGEDVTICCSEGDEGSVYSGILNYEVHETELSNLPRTKTQILMNVGNPEQAFGFASYPADGVGLARLEFIIANHIKAHPLALMKFDELEDPLAKAEIAELTKLYAGDRPRFFVDKLAHGIAMIAAAFYPKPVVVRMSDFKSNEYANLLGGRQFEPKEENPMIGWRGASRYYDPNYREAYALECQALKRVRDEMGLTNVIPMIPFCRTPDEGRKVIAEMAKHGLKQGKNGLEIYVMCELPSNVILADEFSEVFDGFSIGSNDLTQLTLGLDRDSSLVAHLFDERNLGVKRMVKMAIETAKANGRKIGICGQAPSDYPEFAEFLVELGIDSISLNPDSVLKTVLRIAEVEKALG

SEQ ID NO: 64381 - protein, 192 aa, Oryza sativa
  misc_feature (133)..(133): Xaa can be any naturally occurring amino acid
  misc_feature (158)..(158): Xaa can be any naturally occurring amino acid
MSEEDTNAAAGQPRRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQGEKDDKIIAVCADDPEYRHYNDXSELSPHRLQEIKRFFEDYKKNENKXEVAVDAFLPANTARDAIQYSMDLYAQYILQSLRQ

SEQ ID NO: 64382 - protein, 499 aa, Arabidopsis thaliana
MSIFLCFLLLLPLSLILFKKLLPSKGKLPPGPIGLPIIGNLHQLGKLLYKSFHKISQEYGPVVLLRLGVVPVIVVSSKEGAEEVLKTHDLETCTRPKTAATGLFTYNFKDIGFAPFGDDWREMRKITTLELFSVKKLKSFRYIREEESELLVKKISKSVDETQNSSVDLRKVLFSFTASIICRLAFGQNFHQCDFVDASLEELVLESEANLGTFAFADFFPGGWLIDRISGQHSRVNKAFYKLTNFYKHVIDDHLKTGQPQDHSDIVSVMLDMINKPTKADSFKVTYDHLKGVMSDIFLAGVNGGANTMIWTLTELSRHPRVMKKLQEEIRAMLGPNKERITEEDLEKVEYLKLVMVETFRLHPPAPLLLPRLTMSDIKIQGYNIPKNTMIQINTYAIGRDPKYWKQPGEFIPERFLDSPIDYKGQHFELLPFGAGRRICPGMATGITMVELGLLNLLYFFDWSLPNGMTIEDIDMEEDEGFAIAKKVPLVLIQTSHRW

SEQ ID NO: 64383 - protein, 426 aa, Medicago truncatula
MQKDTSPTSTSSSGGGRIRHRKRSNEVIPEVSKANGSGQLLVNDKSKYKSMLIRAYSSVWMIGSFVLIIYMGHLYITAMIVVIQIFMARELFNLLRRAHEDKQLPGFRLLNWHFFFTAMLFVYGRILSQRLVNTVNSDKVLYRLVSSLIKYHMVVCYSLYITGFIWFILTLKKKMYKYQFGQYAWTHMILIVVFGQSSFTVPSIFEGIFWFLLPATLIVINDIAAYIFGFFFGKTPLIKLSPKKTWEGFIGASVTTIISAFMLANIMGRSQWLTCPRKDLSTGWLDCDPGFLFKPESYSLLGWTPHWFPWKEISILPVQWHALCLGLFASIIAPFGGFFASGFKRAFKIKDFGDSIPGHGGLTDRMDCQMVMAVFAYIYHQSFVVPQSLSVEMILDQILMSLSFEEQEALYRRLGEVLQQGIQRMY

SEQ ID NO: 64384 - protein, 342 aa, Oryza sativa
MVKKKGKYSPGASGSGSGSGGGNAGGGPRPGGRETVVWSEKMNEYLIDALLHQQAIGNRGEGRFHSAAFDSIISGVAERFGVAIDRSNIKNRLKSIKENFHECENLFQNQSGFKWSAMNKKFYADPTVWREYIERKPEARKWINKPIDHYDRLLELFGKDRERCLASGSPKSPPAKKARRDPPKEKPQRTPTNGLVSPIVKSLKDMESQRTPTNVLVSPIIIKSSKEMVNENEVPSEAVTEINIAEEQDLSEKFTSENGAMPVEDQWSWKVGNRASATGHWLDRYLTPPSRFRDATGKKTSFTSRLKVEEFIKTEFPDMDPNTFFSMFIWKIPAKGHCIQRG

SEQ ID NO: 64385 - protein, 321 aa, Oryza rufipogon
YVISVGLGTPAKTQIVEIDTGSSTSWVFCECDGCHTNPRTFLQSRSTTCAKVSCGTSMCLLGGSDPHCQDSENYPDCPFRVSYQDGSASYGILYQDTLTFSDVQKIPSFTFGCNLDSFGANEFGNVDGLLGMGAGPMSVLKQSSPRFDGFSYCLPLQKSERGFFSKTTGYFSLGKVATRTDVRYTKMVARRKNTELFFVDLAAISVDGERLGLSPSIFSRKGVVFDSGSELSYIPDRALSVLSQRIRELLLRRGAAEEESERNCYDMRSVDEGDMPAISLHFDDGARFDLGSHGVFVERSVQEQDVWCLAFAPTESVSIIG

SEQ ID NO: 64386 - protein, 465 aa, Mycobacterium avium 104
MTSHYDVVVLGAGPGGYVAAIRAAQLGLSTAIVEPKYWGGVCLNVGCIPSKALLRNAELAHIFTKEAKTFGINGEATFDYGAAFDRSRKVAEGRVAGVHFLMKKNKITEIHGYGRFTDPHTLAVELNDGGTETVTFDNAIIATGSSTRLVPGTSLSANVVTYEEQILSRELPESIIIAGAGAIGMEFGYVLHNYGVEVTIVEFLPRALPNEDADVSKEIEKQFKKLGVKILTGTKVESISDDGSQVTVVVSKDGNSQELKAAKVLQAIGFAPNVEGYGLEAAGVALTDRKAIGITDYMRTNIEHIYAIGDVTGKLQLAHVAEAQGVVAAETIAGAETLALGDYRMMPRATFCQPNVASFGLTEQQARDEGHDVVVAKFPFTANGKAHGVGDPSGFVKLIADAKYGELLGGHLVGHDVSELLPELTLAQKWDLTATELARNVHTHPTMSEALQECFHGLTGHMINF

SEQ ID NO: 64387 - protein, 133 aa, Triticum aestivum
  misc_feature (39)..(39): Xaa can be any naturally occurring amino acid
  misc_feature (83)..(83): Xaa can be any naturally occurring amino acid
MSYCVQGAKPPPSDGRFMFFCGVGDPAWDPGELLSQLVXLVELSGAKYTSSMVPTVCLLESPSGLPLGRHLAEKKTNGTKAGXGEKCDGECLVKSSLLEGTFVGIVLLIILISGLMCMMGIDTPSRFEAPQES

SEQ ID NO: 64388 - protein, 207 aa, Zea mays
MESLEALVAHIQGLSGSPEELAHLHSLLKQADGEPLRAHAAALVPFLAHLSPETHSLGYIYLLDACAASASNLSDFGGGDFLVTIAGFLTACSADQIRLAPDKFLHVCKVLKDQVMQLNMPIRGIAPLRAAVRKIQSSPEQLTPVHADYLLLCLLAKQYKAGLSVLEDDIFEVDQPKDLFLYCYYGSGSNVPLWFTYGFGVLVAHAY

SEQ ID NO: 64389 - protein, 164 aa, Xanthomonas oryzae pv. oryzae KACC10331
MSLIATFDTSRGPIVVALYPEKAPLTVANFVNLAKRGFYNGLSFHRVIADFMIQGGCPEGSGRGGPGYRFEDETNNGVGHERGVLSMANAGPNTNGSQFFITHTATPWLDGKHTVFGKVIQGLDVVDSVAQGDTINTLTIEGDTDAVLAAKADRVAEWNKILAA

SEQ ID NO: 64390 - protein, 450 aa, Thermotoga maritima
  misc_feature (2)..(2): Xaa can be any naturally occurring amino acid
  misc_feature (24)..(24): Xaa can be any naturally occurring amino acid
  misc_feature (27)..(27): Xaa can be any naturally occurring amino acid
  misc_feature (35)..(35): Xaa can be any naturally occurring amino acid
  misc_feature (60)..(60): Xaa can be any naturally occurring amino acid
  misc_feature (62)..(62): Xaa can be any naturally occurring amino acid
  misc_feature (185)..(185): Xaa can be any naturally occurring amino acid
  misc_feature (212)..(212): Xaa can be any naturally occurring amino acid
  misc_feature (238)..(238): Xaa can be any naturally occurring amino acid
  misc_feature (303)..(303): Xaa can be any naturally occurring amino acid
  misc_feature (417)..(417): Xaa can be any naturally occurring amino acid
  misc_feature (424)..(424): Xaa can be any naturally occurring amino acid
  misc_feature (447)..(447): Xaa can be any naturally occurring amino acid
KXERKNVWHHRKKEEIEAFSKEYXEFXSKAKTERXTVKEIKRILDESGFVPLEDFAGDPXNXTVYAVNRGKAIAAFRVVDDLKRGLNLVVAHIDSPRLDFKPNPLIEDEQIALFKTHYYGGIKKYHWLSIPLEIHGVLFKNDGTEIEIHIGDKPEDPVFTIPDLLPHLDKEDAKISEKFKGENLXLIAGTIPLSGEEKEAVKTNVLKILNEXYGITEEDFVSGEIEVVPAFSPREVGXDRSLIGAYGQDDRICAYTALRALLSANPEKSIGVIFFDKEEIGSDGNTGAKARFYLKALRQILKXQGAKDSEFVLDEVLENTSVISGDVCAAVNPPYKDVHDLHNAPKLGYGVALVKYTGARGKYSTNDAHAEFVARVRKVLNEQGVIWQVATLGKVDQGGGGTIAKFFAERGSDVIDXGPALLGXHSPFEISSKADLFETYVAYRSLXEKL

SEQ ID NO: 64391 - protein, 252 aa, Rhodopseudomonas palustris CGA009
MDRRNILKAFAGLALCPLCATAGAAAEGAHHWGYEGEGGPAKWGEIDPANQICSIGVQQSPVDIRSTVSANLFPLQVQWADTADTIINNGHTIQLNVAEGSTLKLGGATFKLVQFHFHRPSEHQIDGKSFPMEVHFVHRMDSGTLGVVGVLMQEGAANAAFAKIVATMPQSEGPAVKADAGINPNALLPAKLGYYRYEGSLTTPPCSEVVDWMVLTDPITVAAEDVAAFAKLYPMNARPVQKDNRRFVLQSN

SEQ ID NO: 64392 - protein, 257 aa, Oryza sativa
  misc_feature (125)..(125): Xaa can be any naturally occurring amino acid
MLSQFSSSFLEGISTHVDPKLPFISLSKGLELNTLRTMSQIIPQALGNPRQPFIVLSGPSFAIELMNKLPTAMVVASKDKKLAAAVQQLLASPNLRISTSNDVTGVEIAGALKNVLAIAAGIRHXVEGMHLGNNCMAALLLKAVGEIRWLATKMGAKPTTLSGLSGSGDIMLTCFVNLSRNRNVGLRLGSGEKLDEIMNSMNQVAEGVSTAGAVIALAQKYHVKMPVLTAVARIIDNELTPKKAVMELMNLPQVEEV

SEQ ID NO: 64393 - protein, 75 aa, Triticum aestivum
GKAFKQLRIGWVIMLPAAAAAVMSSSVMDLVDERLSTEGTGLPYGVSNSLDGWLLSWVFGIIWSLCLSALAPVRG

SEQ ID NO: 64394 - protein, 259 aa, Oceanobacter sp. RED65
MSYQDRFSGIARLYGVNAVSVFKQSRIAVIGIGGVGSWVAEALARSGFEHIKLIDLDDICVTNTNRQIHTLTSTVGQLKVDAMAERLRGINPDIHVEAVMSFLTQNNHNELLSGVDFVVDAIDSVKVKASLIAYCKRNKMPIVTTGAAGGQLDPTQISVADINKTYNDPLAKKVRSLLRREYGFSRNQKRTYGIPCVYSTEQLKYPQPDGSVCQQKSFDDGAVRLDCSGGFGASTMVTATFGFVAAAEVAKRLAKKAEA

SEQ ID NO: 64395 - protein, 461 aa, Burkholderia pseudomallei K96243
MATDQDNDGLKRGLKNRHIQLIALGGAIGTGLFLGIAQTIRMAGPSVLLGYALAGVVAFFIMRQLGEMVVDEPVAGSFSYFASKYCGHFTGFLSGWNYWVLYVLVSMAELSAVGIYVQYWWPGVPTWISALVFFVVINAVNLASVKSYGETEFWFSIVKVAAIIGMIGFGGYLLLSGHAGPDAGVANLWRHGGFFPNGIGGLAMAMAVIMFSFGGLELVGITAAEADDPSHSIPRATNQVIYRILIFYIGALGVLLSLYPWQKVVTGGSPFVLIFHALSSDIAASVLNVVVLTAALSVYNSCVYCNSRMLYGLAQQGNAPQALARVNRRGIPIAALGVSAFATALCVVINYFMPGKAFELLMGLVVSAIIINWAMISVIHLRFRQAKRAAGETTRFRSLGYPLTNYFCLAFMAAILVVMFRTPELRLSVYLIPVWLVVLALGYRFRQRGAGYALGGGVSAR

SEQ ID NO: 64396 - protein, 128 aa, Methanosarcina acetivorans C2A
MDYSAKVLDHFSNPRNMGSIANCDGVGEVGNAKCGDIMKIFLKVEGDRIVDVKFQTFGCGAAIASSSMATELIKGKILKEAWELSNKAVAEALDGLPPIKMHCSMLAEEAIHEAINDYLQKKGLEPWD

SEQ ID NO: 64397 - protein, 155 aa, Oceanobacter sp. RED65
MKTISGNFAPMEAKFAIVQTTWNEFVVDKLVDGAVRGLTRHGISEDNITLVHCPGAFEVPLVVKKLAQSGEYDAVIALGAVIRGSTPHFDYVAGEAAKGLGQITLNTEVPVSFGILTVDTIEQAIERAGTKAGNKGEEAAMSAFEMVSLLRQLEA

SEQ ID NO: 64398 - protein, 371 aa, Oceanobacter sp. RED65
MSLNSIEEIIQDISDGKMVILMDDEDRENEGDIIVAAEKVTPEIINFMASKARGLICLTLTPERCDFLGLPSMVSGNGSKFSTPFTVSIEAAEGVTTGISAADRAVTVRAAVNPMGKPDDIVQPGHIFPLRAQAAGVLSRAGHTEAGCDLARLAGLQPSSCIVEIMNEDGTMARRPELEEFAKEHDIKIGTIADLIQYRMANEQTIEKISSDTLQTVYGDFLLHVYRDTINQDTHLAITKGDVEACEAPLIRVQAAETLRDLLGAVMPNSHSWSMANSLQAIGDSDAGALVMLNAGEKEDVATAIETFYGRQKPQRTTDVDSSGAYVTIGTGSQILRDLGVSKMRLLSSPMKFAGISGFNLEVVEYIPCEK

SEQ ID NO: 64399 - protein, 308 aa, Methanosarcina acetivorans C2A
MGQIYSDITWTIGNTPLVRLNHITKGLHTDVLVKVESFNPMGSVKDRIGLAMLEEAEREGKIKEGTTIVEATSGNTGIALAGVCAARGYKLILVMPETMSIERRKLLKALGAELVLTPGPEGMKGAVNKAEQMASADPTLYYMPQQFQNPANPEAHRRTTAEEIWRDTDGKADVLVAGVGTGGTITGIAGVLKKRKTGFRAIAVEPTESPVLSGGSPGPHRIQGIGAGFIPDVLQLGLVDEIIKVSADEAISTGRRLAREEGILAGISSGAATCAALQVASRKEMSGKTIVVILPDTGERYLSTDLFS

SEQ ID NO: 64400 - protein, 320 aa, Methanosarcina acetivorans C2A
MGIREDIKTVFEKDPAARSTLEVLCCYPGLHAIWMHRVAHSLWNKDLLFLARLTSHISRALTGIEIHPGAKLGKRVFIDHGSGVVIGETAEVGDDVLIYMGVVLGGTALEKKKRHPTVENNAVLGSGAIVLGPITIGRGAKVGAGSVVVRSVPPEATVVGVPARIAGTPQPSAPSEQLDHNKLPDPVLTVISQVLDRMSRLEERFQAHEKASTTPVPVSFVSSENPSVKKDEQIYSLLKDVIDPAVGIDIVNLGFVKEVTVNGTNVDVNLVLTTSACPMIEYFRNQVKRKVMGIKGIENVTVNILDEPWKWDGAGRQAFH

SEQ ID NO: 64401 - protein, 573 aa, Bradyrhizobium japonicum USDA 110
MKHWIDWLPAIETLRRYEAAWLPRDIFAGLVLATMLVPVGIAYATASGLPGIAGLYATIVPLLVYALFGPSRILVLGPDSALAAVILGVVVPLSGGDPLRAATLAAMMAIVSGTVCILAGIARLGFVTELLSKPIRYGYMNGIALTVLISQLPKLFGFSIESEGPLRSLWAIADAILEGKTNWIAFGIGLGTLTVILLLRNSKRLPGILIAVVGATAIVGVLDLGTRYGVAVLGPLPQGLPGFAIPWITYGDIVPVLVGGCAIALVSFADTSVLSRAYAARLGTHVDPNQEMVGLGAANLATGFFQGFPISSSASRTPVAEAAGARTQLTSVVGALAIAILLLVAPNLLQHLPTAALAAVVIAAAIGLFEVTDLKRIYRIQQWEFWLSMVCFVGVAVLGVIPGIGLAIAIAIAEFLWDGWRPHSAVLGRAHGVKGYHDITRYPDARQIPGLVLFRWDAPLFFANAEFFKERVLDAVAKSPTPVRWLVVAAEPVTSVDVSAGDTIAELDEALHAQGIEFCFAELKDPVKDKLKRFGLFSQLGEQYFFPTIGAAVSSYLEINGVEWEDWEDQAKR

SEQ ID NO: 64402 - protein, 341 aa, Moritella sp. PE36
MKALAKLKPEQGIWMTDVEKPTLGHNDLLIKIRKTAICGTDIHIYNWDEWSQKTIPVPMVVGHEYVGEVVGIGQEVRGFTLGDRVSGEGHITCGHCRNCRAGRTHLCRNTIGVGVNREGAFAEYLVIPAFNAFKLPDDISDDMAAIFDPFGNAVHTALSFDVVGEDVLITGAGPIGIMAAAVCKHVGARNVVITDVNEFRLDLARKMGVTRAVNVTTESLTDVMDELKMTEGFDVGLEMSGVPSAFRDMLDKMNHGGKIAMLGIPPNDMSIEWGNVIFKGLVIKGIYGREMFETWYKMAALIQSGLDLTPIITHHFPIDQFQEGFDIMRSGMSGKVILDWE

SEQ ID NO: 64403 - protein, 184 aa, Candida albicans SC5314
MFSFTRAVPKSQLRFTVRNALRTYVSIGDKVPATPVFEGSPGNDINLAEETASGKTILIGVPGAFSPACSASHVPGYIKNIRAFNDKGYQRFFVVAVNDPFVTKAWGEQLLESVAGQQIRFFADSTGAFTKELDLLFDARKAFGNERSKRYALIIEDGKVVKSFVEPDNTSVDVSAAQKVLEEA

SEQ ID NO: 64404 - protein, 518 aa, Oryza sativa Indica Group
MAFIPPRDLVVVLPFLALLLPLYIYLRYSRSAKANPSLPTEWPLVGMLPSLVANIHNLFDYATALLAASGNSFEARGPPMSGLRFFVTCDPDNVRHIFINNFANYPKGEEFASFFDVMGDSFFNADGESWRRQRARVQHVMSNPRLLASMAACCRGKVEKGLLPILDRMASAGAPFDLQRLLTRFAFDVTAMAVFGVDTCRLSIDMPPLDVANAMDAVMEVGFFRHTVPVSCWKLMRSLRIGPERKLTAAQRLLRRFVAEMIEKRRVAGGACKATDDEQGGVPPPADIVSSYINDPEYVDEDGNPREFMYATFINYMVAGRDTVGTALSWLFFNLTEHPRVVARIREELEPIASSKAGGGGMVVFDPEETKPLVYLQAALFESMRLYPPGPIERKATLADDVLPSGHTVRAGDNILIPVYSMGRMASVWGKDSGEYRPERWVTEDGKLRHVPAHRFMPFNAGPRLCLGKDISVLQMKSVAAAVAWNFDLEVVAGHAVEPKVSIVMQIKNGLMVKVKKR

SEQ ID NO: 64405 - protein, 357 aa, Glycine max
CFEVVEKTGNDLHCKCIDAGLFLPGAKLSFWRDGKLVRGNNKLPTLSTKDWADIDFGIAEGVDFFALSFVNHADSVKDLKNYLSSKSTKSIKVLAKIESSESLHKLEEIVRASDGIMVARGDLGVEIPLEQIPTVQEDIIYVCRQLNKPVIVASQLLESMVEYPTPTRAEVADVSEAVRQYADALMLSGESAIGSYAQKALAVLDMASSRMESWSREENRQNLVNYHQLGASLPECITEQICNCAVEMANNLGVDAIFVYTKYGHMASLLSRNRPNPPIFAFTNDDSTRMALTLQWGVVPLLVDLSDDAESNISKSVQLMKSRGLISQGDVVLVVSDVAPTRATPMAFQSIQVKTII

SEQ ID NO: 64406 - protein, 525 aa, Spinacia oleracea
MAGRNIKNGENNKIAGSSLHLEKNPTTPPEAEATLKKLGLVASVAAGVQFGWALQLSLLTPYVQLLGIPHTWAAYIWLCGPISGMIVQPLVGYYSDRCTSRFGRRRPFIAAGAALVAVAVGLIGFAADIGAASGDPTGNVAKPRAIAVFVVGFWILDVANNTLQGPCRALLADMAAGSQTKTRYANAFFSFFMALGNIGGYAAGSYSRLYTVFPFTKTAACDVYCANLKSCFFISITLLIVLTILALSVVKERQITIDEIQEEEDLKNRNNSSGCARLPFFGQLIGALKDLPKPMLILLLVTALNWIAWFPFLLFDTDWMGKEVYGGTVGEGKLYDQGVHAGALGLMINSVVLGVMSLSIEGLARMVGGAKRLWGIVNIILAVCLAMTVLVTKSAEHFRDSHHIMGSAVPPPPPAGVKGGALAIFAVLGIPLAITFSIPFALASIFSASSGSGQGLSLGVLNLAIVVPQMFVSVTSGPWDAMFGGGNLPAFVVGAVAATASAVLSFTLLPSPPPEAKIGGSMGGH

SEQ ID NO: 64407 - protein, 461 aa, Clostridium acetobutylicum
  misc_feature (436)..(436): Xaa can be any naturally occurring amino acid
LLKEYKNAWDKYDDKQLKEVFALGDRFKNFISNCKTERECVTELIKTAEKSGYRNIEDILAKGETLKEGDKVYANNRGKGLIMFLIGKEPLYTGFKILGAHIDSPRLDLKQNPLYEDTDLAMLETHYYGGIKKYQWVTLPLAIHGVIVKKDGTIVNVCVGEDDNDPVFGVSDILVHLASEQLEKKASKVIEGEDLNILIGSIPLKDGEEKQKVKHNIMKILNEKYDISEEDFVSAELEIVPAGKARDYGFDRSMVMGYGQDDRICAYTSFEAMLEMKNAKKTCITILVDKEEVGSIGATGMQSKFFENTVADIMSLCGDYDELKLRKALYNSEMLSSDVSAAFDPNYPNVMEKRNSAYLGKGIVFNKYTGSRGKSGCNDANPEYIAELRRILSKESVNWQTAELGKVDQGGGGTIAYILAEYGMQVIDCGVALLNXHAPWEISSKADIYETKNGYSAFLNN

SEQ ID NO: 64408 - protein, 196 aa, Chlamydomonas reinhardtii
MSASPSKRREMDVMKLMMSDWKVELVEDNISEFNVDFAGPKDSPYEGGLWRIHVELPEAYPYKSPSIGFVNRCYHPNIDEASGSVCLDVINQTWSPMFDLVNIFEVFLPQLLLYPNPTDPLNSEAAALLMREPQLYANKVKDYVQRYARPEQLLGHNPVSVNNKSSDDEEGDGDQKMGGDGEESEGAFLSDSDDEA

SEQ ID NO: 64409 - protein, 142 aa, Zea mays
MGGLPHFGGAAALEPGDPAGCGNSHGPVHMEITNGKKLERDQIGKRKMGEGKESVPQEHDVNAKWDACIDLTTRRFVYSSLGGAFAGLLFFRSPVTRWASIAFGAGLGIGSAYTDCSRAFDAPPSFTETSSVSQTVSQSADE

SEQ ID NO: 64410 - protein, 579 aa, Mycoplasma penetrans HF-2
MMKDKKYKGIGASDGIATAKAFLLDKPIFKIDDSKISNVDQEISKVNAAIEASIKNIEHVKTIAIDKIGAEKAMVFDAHAQIANDPELKNEIISIIKDQKVNGAYAIDVVFKKTHDLFANMEDDYFKQRASDVEDVRTKILSFFLNIELPDLLAIKSEVIIVADDLTPSETALLDKKYVKGFATNIGGRTSHAAIMARTMEIPAVLGLKDITNAVDKNSMIALDGSTGDLVIEPSDLSVWNKKKEIFLKEKEELKKYINVKAKTLDGVEVDVVANIGKPEDADNLDSYGAEGIGLVRSEFLYMENSKWPTEEEQFNAYKYILEKQKNKLVIIRTLDIGGDKKLNYYQFPHEMNPFLGYRAIRFCLNNPEIFKTQIRALLRASAFGRMGIMFPMIATVDEFLKAKNIVEETKKELTKEKIAFDSKVLVGMMVEIPSSAFLTDKFAKYADFFSIGTNDLVQYTFAVDRMSENVSYLYQPNNPALLRAIKATIEGAAVHKKFVGMCGEMAGDIRSIPILLGLGGKGLDEFSMSASSILRSKKVIASLKHSECVELANKAIDCDTAEEVNNLVENFLQKKNLI

SEQ ID NO: 64411 - protein, 381 aa, Bartonella henselae str. Houston-1
MKVDYYEILGVTRECDDKKLKSAFRKLAMQYHPDRNAGDKEAERKFKEIGEAYEVLKDPQKRAAYDRFGHAAFENNNNGGGSPFSGFSAGGFADIFEDFFGEIMGGGHRKRSDGRERGADLSYNMEVTLEEAFSGKTAQINIPSSVVCDACEGSGAKKGSKPQTCGTCHGAGRVRAAQGFFSIERTCPVCHGRGETIKDPCPKCQGTRRVEKNRSLSVNIPAGIEDSTRIRLSGEGDAGIRGGPSGDLYIFLSVKPHEFFQREGADLHCRVPISMVTAALGGEFEVSDLDGIKARVKIPEGTQNGRQFRLKGKGMPMLRRQQVRGDLYIHITIETPQKLTQEQRELLQKFEKLSNHENSPQSHGFFSRMKEFFENISGKNE

SEQ ID NO: 64412 - protein, 441 aa, Vibrio vulnificus YJ016
MMIALAERLKSYRVQGLGSRPVASGKLVRVVGLTLEATGCRAPIGSLCLVETMTGQMEAEVVGFSGDNLFLMPSEQIGGILPGAKVTPLTSESGLPVGMELLGRVIDGVGNPLDGLGPIYTEHRASFNAEPINPLARKPITEPLDVGLKAINGLLTVGKGQRIGLFAGSGVGKSVTLGMMTRGTTAQVVVVGLIGERGREVKEFIEEILGEDGRKRSVVVAAPADASPLMRLKGCQTALTIAEYFRDQGLDVLLLMDSLTRFAQAQREIALSVGEPPATKGYPPSVFAKLPALVERAGNGGPQQGSITAFFTVLTEGDDLQDPIADASRAILDGHIVLSREMADAGHYPAIDVEKSVSRVMPQITTEEHVLMSKAVRQVLSICRKNQDLVSIGAYKPGTDPSIDSAFTLKPKLDEYLQQRMKETVPYAMCVNMLKNVLGVQ

SEQ ID NO: 64413 - protein, 301 aa, Bartonella henselae str. Houston-1
MDDVENGVADVFEKQAAFLSSALPYMQKYENETVVVKYGGHAMGDPALGRAFARDIALLKQSGINPVVVHGGGPQIAEILMKMGIESRFENGLRVTDERIVEVVEMVLAGSINKEIVALINAEGEWAIGLCGKDGNMVFAEKAYKTVIDPDSHIERVLDLGFVGEPVEVDRTLLDLLACSEMIPVLAPVAPGRDGKTYNINADIFAGAIAGALEAKRLLFLTDVPGVLDKKGKLLKELTISEAENLIKNETISGGMIPKVETCMKALQNGVEAVVILNGRTPHSVLLELFTEQGAGTLIVS

SEQ ID NO: 64414 - protein, 666 aa, Oryza sativa
MRLLCLAAMAHLPLLLLSFLVLIGVHASVSHGSPPLPSTYDPSICSKSSECGGVNISYPFYLSNATDYYTRFSCGYTDLKISCSRDRDGRNETPTILLGGDNYTVLDIIYDSHTIVLADTDALRGGSCPRVRHNITFAQADEWLQYTGPRDNLTFFFGCKLNLPPPIDPGLVSLADKHQINCKDFSNWPDSGDSFVFTSAELEAPVESELARRCRQVIVVPVNGDILNSSNQSALPSGGYGQVLNKGFDLAWNSRKDEQCYQCEQSQGHCSYSQNRVFLDCLCSDGKVGNQDCRNSGASNSSTLRYSSLKGRMKLYIIAGISSVLLLCLLSFPCLFSLKKYRHRRISKGTPRIESFLQRNGTLHPKRYTYTEVKRMTKSFAEKLGHGGFGAVYRGNLSDGRQVAVKMLKDSKGDGEEFINEVASISRTSHVNVVTLLGFCLHRSKRALIYEYMPNGSLERYAFRNNSKGELSLTWEKLFDVAVGIARGLEYLHRGCSTRIVHFDIKPHNILLDQEFCPKISDFGMAKLCANKESIVSIAGARGTIGYIAPEVYSKQFGAISSKSDVYSYGMMILEMVGARERNIEANSESSSHYFPQWIYEHLDEYCISSSEIDGETTELVRKMVVVALWCIQVVPTNRPTMTRVVEMLEGSTSGLELPPKVLLSW

SEQ ID NO: 64415 - protein, 387 aa, Glycine max
MVYSGAVDRIIGRPPPKTGDVVLVADGTEKPIGWGMYNSVSMFCVRLMQLEDEATSDSSCALNMEKLIETRIDAAVEMRRRLGLPSVHTNAYRLINSEGDRLSGLIIDVFGGVAVVASSAAWVEKYKSEIEACIKKINYINHVNWRPSVDILKEDGVNESDLNKMHSSTCPERTKIVENEIVYTISLKGQKTGFYADQRENRQFISRISDGQKVLDICCYSGGFALNAVRGGALNVTGIDTSPLALELAKENVVLNNIDPGRISFLREDATEFMKGALLRNESWDIVIIDPPKLAPTKKVLHSASGMYRNLNSLAMQLTKRGGLLMTCSCSGAVTQSGIFMRILQGAASMAGRRITVLRQAGAACDHPIDPSYPEGAYLTNILLRVS

SEQ ID NO: 64416 - protein, 404 aa, Bradyrhizobium japonicum USDA 110
MSSSVIDYLATETRLGAHNYEPIGVVLSRGEGVWVWDTDGNRYLDCLSAYSAVSQGHCHPKILAAMVEQAHRLTLTSRAFHNDQLAPFYEEIAALTGSHKVLPMNSGAEAVESAIKSVRKWGYEVKGVPDDQAEIIVCADNFHGRTLGIVGFSTDPETRGHFGPFAPGFRIIPFGDAAALEQAITPNTVAFLVEPIQGEAGVIIPPAGYFTKVRELCTANNVMLVLDEIQTGLGRTGKLLAEQHEGIEADVTLLGKALAGGFYPVSAVLSNNEVLGTLRPGQHGSTFGGNPLACAVARAAMRVLVEEGMIENAARQGARLLEGLKDIRANTVREVRGRGLMLAVELHPEAGRARRYCEALQGKGILAKDTHGHTIRIAPPLVITSDEVDWALEQFATTLTQDFS

SEQ ID NO: 64417 - protein, 552 aa, Oryza sativa Indica Group
MPEANAGGRAAPAAEQRSKNTTEMDFFSEYGDSSRYKIQEIVGKGSYGVVCSAIDQHTGDKVAIKKIHNIFEHLSDAARILREIKLLRLLRHPDIVEIKHIMLPPSRRDFKDIYVVFELMDTDLHQVIKANDDLTKEHHQFFLYQMLRALKYIHTANVYHRDLKPKNILANANCKLKICDFGLARVAFNDTPTTVFWTDYVATRWYRAPELCGSFFSKYSPAIDTWSIGCIFAEILTGKPLFPGKNVVHQLDLMTDLLGTPSMDAISRALADPYFKGLAKVEREPSCQPISKMEFEFERRKVTKDDIKELIFREILEYHPQLLKDYMNGSENTSFLYPSAVDNFRRQFAILEENGGKSGALDRKHVSLPRATTVHSTSIPPNEGLDATSQVTQRIPTARPGRTVGPVLPFENPGAADPHSARRVVRNPMVPPAAANKSGYSYNLKSDYSDRQHQEELEKDRVQYRPAQHLMDAKVAPDTAPDIRSSQYYFTRSAPRTDLTDRAALQGSMLYGIAPFNGIAAVAGGYSKAKVEERRRETPIPSQAAIVHLKWQ

SEQ ID NO: 64418 - protein, 132 aa, Brassica napus
MALEIEARDVIKIVLQFCKENSLNQTFQTLQSECQVSLNTVDSVETFVSDINSGRWDSVLPQVSQLKLPRNKLEDLYEQIVLEMIELRELDTARAILRQTQVMGVMKQEEPERYLRMEHLLVRSYFDPHEAY

SEQ ID NO: 64419 - protein, 618 aa, Oryza sativa Indica Group
MAVSVAPVEAPRNRRATGDQGLVSRRVVEFPLPELKMELVYLERRNGFDEDSTSPEFSGRSAIDHQQLSIATPEVESDLGQTIYKQPLPSDEKKSRSCQSCHKPPCSCRSEVFHSDLYPTLPAKMMILEFLIRSLRHPRRTHNVSDLDDMISNGASTGSVVLGPSEKMMLDSLHSLVDAKTRPKSPSFFHSGTKMRKARSKSHIITQSEILKLISPETWEISSPGVSPLKKSTAELSMHEKMVSSDTPSMSSNQPVLSSCPSSLSAGLLQCIWKDGLPHFELSLDNPMAVYTANPTKAHDNDKPLDYVYLFHSGEQGRKDGLGNSSSVSRLVGKMKVSSSLVLNPDKSTSMETEFVLYGSPDDYLRQMQSSYGVTKGKGLAKRVADIMKPSNLNSSPKHVWKFGKSSSQQIDEMTEIPEGEQCSAKESVLKNLVADDLPTNQEIAAIVVQKQRRERRKSPVLGGWGLKFLEKAGATHPGSTEDGDVQNKKNNAGSVSAIFPRGYHGGAASKNGSPASLIGRWRSGGRCDCGGWDIGCPIRVLQNDGCGTSPQAESQSQDRKSVELSVKGAKKGPMFRLVNITDDLHIIYFDSSLSPLQCFSAGIAIIHSQAPHLYPKL

SEQ ID NO: 64420 - protein, 277 aa, Physcomitrella patens subsp. patens
VVLLGWLGAQQKHLKKYAQWYNARGIHAVTFVIPMTDILSLKVGENAEEHVDSLARHLAQWLSAQDEHADLEGEKQLMFHTFSNTGWLTYGAILEKMHAEDGDILGRIKGCVIDSAPVPNPDPQVVWASGFSAALLKKRSSATKPALLKAEVMEGVTVEAASQGSVANLEVEGTDGLETAVLTVLERFFSVFLKLPSINQRLAEIVTVLQKKQPPCPQLYIYSTADKVIPVKAVEAFIDDQRKAGRVVRACNLQSSPHVDHFRSHPQLYSEQLSSFL

SEQ ID NO: 64421 - protein, 513 aa, Oryza sativa Indica Group
MAFSSILQLTLCFLCFSVFYYYHIKSKRKNPAIPVCWPLVGMLPDLLVNRHQLHDWITSFLTASQLNFRFIGPTMSSNMRFFFTCDPANVRHIFTSNFANYPKGPDFAEIFDDTLGDGIFNVDGDSWRRQRAKTQLLMYNHRFQSFVSRCSSDKVENALLPLLSHFAGTGERCNLQDVFMRLTFDMSTMLASGEDPGCLAISLPMPKVPFVRAVDYTTRVLLVRHIIPLSLWKLARRLGVGFERKMAEALRTINQFIYETIVKRRAKKATEGIEDSEDLLSSYLKDDDENADTFLRDTTMTLIAAGRDTIGSALSWFFYLLTKNPHVASKILEELDSVERATTTPDGMVTFDPDELKSLVYLHAAVCESLRLYPPVPLDHKGVVAADVMPSGHKVRPGDKIVVSIYAMGRTESVWGSDCMEFRPERWISDHGKLRYVPSYKFTPFITGPRTCLGKDMALVQLKVVAATVVKNFEAEAVPGHIVEPKLSMVLHMKNGLMVRVKRSLLGPSSVHV

SEQ ID NO: 64422 - protein, 186 aa, Xylella fastidiosa Ann-1
MSVLNTEILSFKATAYKNGQFVEVSEAVLKGKWAVFVFYPADFTFVCPTELEDLADHYEEFQKYGVEIYSVSTDTHFSHKAWHDISPAIGKIKYAMIGDPTHEISRNFNVLRPSGLADRGTFIIDPQGVIQSVEITAEGIGRDAKELLRKVKAAIYVANHPGEVCPAKWEEGGKTLAPSLDLVGKI

SEQ ID NO: 64423 - protein, 507 aa, Oryza sativa Indica Group
MAFASILQLALCFLCFSIFSYNHIKSKRKNTAIPVCWPLIGMLPDLLANRHRIHDWITSLLTASQLNFRFTGPPSSNMRLFITCDPANVRHVFTSNFSNYPKGPDFTEIFDIFGDGIFNVDGDSWRRQRAKAQLLTCRPRFRAFVSRCSRAKVEKALLPLLAHFAATGESCNLQDVFMRLTFDTTTMVVSGADTGCLAISLPEVAFARAMDDATRVLLVRHIVPLSWWKLVRRLGIGYERTMAEALRACDHFVNETIEKRRAEKAKGEADGSADLLSSYINDDDEEENASSSFLRDTTMNLISAGRDASAMALSWFFYLLTKNPCVVSKILEELDSVNGITTPDGMVTFDPDELRPLVYLHAALSETLRLYPPVPLEHKGVLAADALPSGHDVRPGDKIVVSLFAMARMEAVWGSDCREFRPERWISKDGKLRYVPSYKFMTFSSGPRTCLGKDMAFVQLKAVAAAVVKNFEIEAMPGHVVEPALSIVLHMKNGLMVRVKRRHVLNN

SEQ ID NO: 64424 - protein, 394 aa, Arabidopsis thaliana
MPTFSAAALGRSLNSGTSLSSKFPSTLQSKPSILNDESKQPKEKTFTRPQMSPSLYATTKEIPHPNSPSSYPPSPYIINHKARGPVLFNRDSEVDGPSHPITSGEEKISGNVDVEATASLSKSTSLSFPITEAIAVDHTNGVHTQGIHERPVWDCSPPLGTFLNEKSGRDISNGGIGSNNATSNLEWQSYLLEPVRIKADKELEPENFYNPGELVSFTSNTEVEDFERAESSHSLATHVGEFYDACDELSTDSGMQSSANNIESEVREMRLGLLMEIERRRQAEATLEQMQVHWRRLRDQLADVGMFLPLDPTRSQYSMNLADELRCQLEVTRFVSDTLGSDLAKTEVEMEMEAELEAKNFEITRLSDRLHYYETVNQEMSQRNQEAIGRRNSS

SEQ ID NO: 64425 - protein, 274 aa, Triticum aestivum
MADRVHPAPLLPLSTPPAPPPDNSDAAAENTPLRSATPAAAAAPGASYIVHVPKDQVLRVPPPDRARRYRKLAARPARRRMLRRACCGACCALLLLLVLAAAFVGAVYLVFRPRAPSFTVTSLSVAGLLDASPARLDAAVRADNGANRKVGVDYRAGGEVRVSYSGVLLATGRWPAFYQPPRNVTLISMPLTGRDGLALTDDQRARLAEQAAAGAVPLTVEARVPVRVRLGKVLRTWTVDVWARCQVTVDRIDGETTAANQGCTVKAKPLWWWW

SEQ ID NO: 64426 - protein, 358 aa, Lactobacillus sakei subsp. sakei 23K
MKRYLILEDGTVFSGFGFGAPTISTGEIVFNTGMSGYQETITDQSYNGQIIAFTYPLIGNYGVNRDDFESIKPTCKGVVVHEVPRLANNWRMNMSLDDFLKQKKIPGIWGIDTRALTRRLRDKGTMKASIVDAADDHAFDQLKALVLPKNQVQQVSTAKPYPSPATGRNIVVIDFGLKHSILRELSKRNCNLTVLPYNATAEEILSLDPDGVMLTNGPGDPEDVPEAIEMIRGIQGKLPIFGICLGHQLFALANGAKTYKMKFGHRGFNHPVREIATNRIDFTSQNHGFAVDADSIDPQQLLVTHVEINDHTVEGLRHRQYPAFSVQFHPDAAPGPHDAVHLFDEFIDMIDDFNRRQK

SEQ ID NO: 64427 - protein, 508 aa, Oryza sativa Indica Group
MAVSSFSFLELLLSFLCFGFFYYYHVKSKQKNPVIPLQWPLVGMLPALLANCNHLHEWITSVLTVTPLNFRFIGPPSSDMRLFITSDPANIRHVFNTNFSNYPKGREFQEIFDILGDGIFSADGESWRRQRTKAQMLMSSPRFRAFVARYSRDKVEKALLPLLAHVAGTGDACNLQDVFLRLTFDTTTTLVFGVDPGSVAIDLPEVPFARAMDDAMTVLLLRHIVPLSWWRLARRLGIGYERKMPVAWRTMDRFVADTIAKRRAEKARTGIDDSADLLSSYINDDEEDAGTVDAFLRDTTINLMLAGRDTTGSALSWFFYLLTKNPRVLHKLLQELDSVKSTTTADGMVIFDPDETGRLVYLHAALCESLRLYPPVPMEHKGPAAADVLPSGHEVRPGDKIVVSLYAMGRMESVWGSDCMEFRPERWISDDGKLRYVPSYKFMSFNSGPRTCLGKDMAFVQLKTAAAAVMKNFEIEAVAGHVVEPKLSIILHMKNGFMVTVKRRLAVC

SEQ ID NO: 64428 - protein, 532 aa, Oryza sativa Indica Group
MDMLLCFVEIFSILCCCIIYYYHLQTKKASASEPTEWPVLGHLFGMFANIHRFHDWATDILAGGWHNFEARAGLTGIRFFITCDPSNVRHIFTSNFANYPKGDEYAEIFDVLGNGIFNADGESWRSQRAKAQMLMAGARFRAFAARSSRDKAEKSLLPLLAHAADTGARCDLHDLFLRLTFDVTCTLVFGVDTGCLSAGLPVIPFARAMDDVLETLFLRHIIPMSCWKLMYRLEVGTERKMAVARRTIDRFVAETIAKRRADMIRQGTSNSDDLLSSFISHDDDDTSNGNDVVDETDEFLRDTTVNLLLAGRDTTGAALSWFFYILSKNPRVEQKLLEELAPIAAQKGGDGGGMVIFDASELKNLVYLQAALSECLRLYPSVPFEHKAVAADDVLPSGHEMKAGDKVLVFSYSMGRMEGVWGKDCTEFLPERWITSEGKLRYEPSYKFFSFNAGPRTCLGKELAFVQLKTVAAAVMWNFAVEVVPGHAVEPKLSIILHMKNGLAVTVKRRATMASCQLVHESLAISHGWFRS

SEQ ID NO: 64429 - protein, 361 aa, Solibacter usitatus Ellin6076
MAQNTSYKLLAAATLLATGLVLTNLPGEQAAAGRAARLSTNRSPVAPADAQIQAAINEAYARYRSDTSGKNADYIPYLAQVDSKLFGIAAVTTDGRVFTAGDVDFSFSMQSISKVFTLALAMEELGADKVFERIGAEPTGRPFNSVTAVEDMPGHTANPFVNAGAIATTSLVSGSDPNAKWDKILAFYNKVAGEKLKLIDDVYKSEAATNMHNKAIATLLASYERMYSDPLEATDIYTRQCSVGVTAKELAVMGATLADQGRNPITGIQVIKPENVPHILAVMSMAGLYDGSGGWAWKVGLPAKSGVGGGILAIVPGKGAIVGFAPRLDKAGNSVKAQKSIAYVADKLDINLYSPGSVGLK

SEQ ID NO: 64430 - protein, 253 aa, Propionibacterium acnes KPA171202
MTGLLAGRTALVTGGTAGIGRGIAEVLALHGARVAVTGVTEERCAQAREDGLDVYQLDVRDKKACIRVVNDVAAECGGLSVLVANAGVYPQVRLADLDDDQIDFIFDVNVKGMMHVVQAATPALRESGRGRIVVTSSITGNITGYPGWSHYGATKAAQMGFIRSAAMELAGDKITINAVMPGNIMTPGLKALGDDYLAEMAKSVPLGMLGEAKDIGEAVAYLASDGARYVTGQSIVVDGGQVLPEGPEALAEM

SEQ ID NO: 64431 - protein, 510 aa, Desulfococcus oleovorans Hxd3
MSHNGYLDRESLDAHDKRWLSRVRPEGWTNPNPALMYNLVVIGAGTAGLVTAAGAAGLGARVALVEQNLMGGDCLNTGCVPSKSLIRSARLAHEMRHVAGLGLSGGANVSQADFATVMERLRRIRANISVNDAATRFRDDLGVDLFFGQGVFAGHNAVSVSGDILRFKKAVIATGAGPFVPPLPGLARSGYLTSDTVFSLTRRPMHLVVIGGGPIGCELAQAFARLGTYVTLVEGGGTLLPNEDKDTARLIQDKFTQEGMTIFLNAMVTRVDDRMGEKVVTLNVGSVEQKVTADAVLVAVGRAPNVEGMGLSTAGVDYTPHGIIVNERLQTTNPCVYAAGDCCMTYKFTHVADATARIVIGNALFGGRARATDLNVPWCTYTDPEVAHIGLYERDAQRQGIRVDTLSVPMSEVDRAVTEGHTDGFVRIHLKKGTDRILGATIVGSRAGEMIGQVAVAMAGNVGLKKIAGTIFPYPTYGEAVRKAADAYNRGRLTPFVKRLLNAWMKWRLK

SEQ ID NO: 64432 - protein, 835 aa, Xylella fastidiosa Ann-1
MSSSAVRLSTVETPVYVPRTVVHKFGGTSVADADCYRHVARLLLAREETVQVTIVSAMKGVTDTLIALAEQAANHSPDWQALWQQTRTRHCDAAQALLGEHAATLQDWLNTHFNELHEMLVALSVIGMLPSEVLDRLQGLGEVYSAQLLGEYLQFQGEDCVVLDARQVLVVSPGEFGAEVDWATSAQHLAHWRMQHPQRRVVVTGFVASDRTGRAITLGRNGSDYSGAIFAALFEADELHIWTDVDGVMSADPRVVPDAVQLDALSYDEACELAYFGAKVVHPQTMSPVMKRGVPIIIRNTFQPRHPGTRITADSVVSGSVKGLTLSPGLAVLNLEGTGLIGVPGTAERVFAALRNARLSVVMISQGSSEHSICCLVHQTEAERARDALLYAFAHELAIGHVQRVQLTNNISVLAAVGDGMAGHLGVAARLFESLRRAHVNILAIAQGSSERNISVAIDSQQATKALRAAHAAFWLSPQTFSIGVIGPGHVGEALLDQLCAAQQQLLSKANLDLRLRAIVSQRRMLLDERGLGSDWRHAFAAVPEAVDLDAFTAHLQAAHLPHAVIIDCSGSAEVADRYADWLAAGIHVVTPNKQAGSGPLHRYHAIRAAADASGARFRYEATVGAGLPVITTLRDLMDTGDSVTSIEGIFSGTLAWLFNKYDGSVPFSQLIAQARAMGYTEPDPRDDLSGVDVARKLVILARDAGRDISLEDVAVESLVPETLCQLSVADFMERLNEIDATFAERLAAAKQRGCVLRYVAQLSPGHVPSVSLIELPSDHAFVNLRLTDNVVQFTTRRYSENPLVVQGPGAGPEVTAAGVFADLLRVAAGEGARL

SEQ ID NO: 64433 - protein, 494 aa, Arabidopsis thaliana
MQSDNGKLFIGGISWDTNEERLKEYFSSFGEVIEAVILKDRTTGRARGFGFVVFADPAVAEIVITEKHNIDGRLVEAKKAVPRDDQNMVNRSNSSSIQGSPGGPGRTRKIFVGGLPSSVTESDFKTYFEQFGTTTDVVVMYDHNTQRPRGFGFITYDSEEAVEKVLLKTFHELNGKMVEVKRAVPKELSPGPSRSPLGAGYSYGVNRVNNLLNGYAQGFNPAAVGGYGLRMDGRFSPVGAGRSGFANYSSGYGMNVNFDQGLPTGFTGGTNYNGNVDYGRGMSPYYIGNTNRFGPAVGYEGGNGGGNSSFFSSVTRNLWGNNGGLNYNNNNTNSNSNTYMGGSSSGNNTLSGPFGNSGVNWGAPGGGNNAVSNENVKFGYGGNGESGFGLGTGGYAARNPGANKAAPSSSFSSASATNNTGYDTAGLAEFYGNGAVYSDPTWRSPTPETEGPAPFSYGIGGGVPSSDVSARSSSPGYVGSYSVNKRQPNRGIAT

SEQ ID NO: 64434 - protein, 430 aa, Xylella fastidiosa Ann-1
MNFHSTRTTAPATTLSQAIAAGLAPDGGLYVPECLPPLGDLEHSADFINTATALLTPFFAGDPLEVHVPSICAEALDLPAPLLPLATPEDYALELFHGPTAAFKDFGARFLAACLTRLRRDAERPLTILVATSGDTGAAVAAAFHRQPGLRVVVLYPDGRVSPRQAHQLGCFGDNIHTLRVAGVFDDCQAMVKQALNDTSLQTAVPLSSANSISLGRLLPQMSYYAHAALTHRASTGRPLNLIVPTGNLGNALAAILARALGVPLGQIVLATNANRVLPDYFSGAHYRPQPSVATLANAMDVGAPSNFERLRWLYRGDDAALRAAFTAYSVDDIAIRQTITARHRRYDEIFCPHTATAVFVLEHLRAQGVAGDWAVVATAHPAKFEQVVEPLIGTTVPVPAALDSLLQRPVRDEPLAPEYPALRHMLLAT

SEQ ID NO: 64435 - protein, 519 aa, Solanum tuberosum
MAASCMLRSSFISPGLPQLHHQSTSKPNNGIHFFTPIKATATNDAISQQKHRRPADENIREEARRHCSSHNFSARYVPFNAGPNSDEWYSLDEIVYRSRSGGLLDVQHDMDALKKFDGQYWRSLFDSRVGKTTWPYGSGVWSKKEWVLPEIDSDDIVSAFEGNSNLFWAERFGKQFLGMTDLWVKHCGISHTGSFKDLGMTVLVSQVNRLRKMHKPVVGVGCASTGDTSAALSAYCASAGIPSIVFLPANKISMAQLVQPIANGAFVLSIDTDFDGCMQLIREVTAELPIYLANSLNSLRLEGQKTAAIEILQQFDWEVPEWVIVPGGNLGNIYAFYKGFQMCKELGLVDRIPRLVCAQAANANPLYLHYKSGWKDFKPVKANTTFASAIQIGDPVSIDRAVFALQQCNGIVEEATEEELMDAMAQADSTGMFICPHTGVALTALFKLRNSGVIAPTDRTVVVSTAHGLKFTQSKIDYHSKEIKDMECRFANPPVEVKADFGSVMDVLKSYLLSQNSKL

SEQ ID NO: 64436 - protein, 457 aa, Propionibacterium acnes KPA171202
MAANIPLTNTASLTPDTQLASAPISPESRRFLRHVTAATAFGGGLDGFDLGVISVVILHINHDLELTPAMEGLVGAASLLGIFIGAPLFGFLTDKFGRRRMFLVDIIAFIVIGVGQAFAMGGVSLGILRFLLGMAIGAEYSIGAPMLSEFVPARERGSKLAFLELCWRIGFLIAVLLGYALLWSGVSWKVILATSVIPALIVLGLRIGLPESPRWLLRHGREAEAREIVEKHMGPKYFAAEQLSEESVDGEGYRKLFRKGQRRRTIFVCIFWTCIVTPYFAIFTYAPKVLESLNVKSQAGGTILSNTIGVVGAIVGLLAIDRIGRRRMLIGPFWGQTAVLLIVGLWTDAPPWVLVVGLALFALVNSYSDILTAVYPSEIVDTDIRSSGVGFGSAVSRIGAFLGTYLLPIGIGTIGAKWCMVIAAGLCVVGAVTGQTLAPETMNRPLTKTATGELSHA

SEQ ID NO: 64437 - protein, 103 aa, Erwinia amylovora
  misc_feature (83)..(83): Xaa can be any naturally occurring amino acid
MKKTKIVCTIGPKTESEEMLTNLLDAGMNVMRLNFSHGDYQEHGKRISNLRNVMNKSGHQAAILLDTKGPEIRTMKLEGGQDXSLKAGQTFTFTTDQSVIGNA

SEQ ID NO: 64438 - protein, 738 aa, Rhodopseudomonas palustris CGA009
MAFKNFKVETDADGIALVTWDLPGKSMNVLDAATIEELGAIAEATTKDAAVKGVVITSAKDAFCAGADLSMLESMNQQFAQIRKDKGEEAAQKMLFDESRKLSQILRGIETCGKPWVAAINGLALGGGFEVTLACHYRVAADNPKTRLGLPEIKVGLFPGGGGTQRIPRIVDPQNAMTILLKGDQIKLDKAKALKLVDAVVPAADLIKTAKDWIKNGGKAVAPWDEKGFKLPGGQVFSKQGMMMFPAGNAIYRRETYDNYPAARAIMSCVYEGLLVPIDVALRIESRYFAHVLQTKEAAAMIRSLFLSMQELNKGARRPQGVPPTKVKKLAIIGAGFMGASVGYVSAKAGIEVVLIDRDQESADKGKAHCQSVIDGLIKKGRAKEADRDALMSRITATPDFNAISDCDLVIEAVFEDRKVKAETYAKAQPLLKEGAIFASNTSTLPINSLAEEFKDQSKFIGIHFFSPVEKMMLVEVILGNNTSDVTLATALDYTRQIGKTPIVVNDSRGFFANRCVLRFTAEGLEMLMEGVPAPMIETAAKMAGMPVGPLSLADEVALDLILKIMKATEADLGEQAVDQQQKKLMVELVEKQGRFGRKNGKGFYVYPEKGKGQKSLWDGIAALQPKHLDPDTIDVEELKQRFLAVQAVEAARTVEDNVIVDPREADVGSILGFGFAPFTGGTLSYIDFMGTKEFVALCHKLEGKFGSRFTPPKLLEDMAKTGDTFYHRFAPKKQAAA

SEQ ID NO: 64439 - protein, 375 aa, Vitis vinifera
MAEARRLRGHKATATCCIASRDRPGLVATSGEDGCICWFDMRCKDVVLTMDLGVNPISSLCFKPGNEDIIYVSSGSEVKCFDVHLADAWKPLESYNYNKEEINQIACNSKSSFLASADDDGDVKIIDIRQKCLFKTLRSGHTSICSSVKFLPWRPWEVITGGLDSKLVMWDFSKGRPYKIVDFGMPDMENSSSAGQCLNPAFVHAIAVPEVDMLEKSGKICVVARGDGVVDVINIESELAAAQSKTSSKPQRGSKSRSKSKGSVSTVAETLNQNGRRRLHLDYSLGGHTASVSCVAFALFGERGKSIISGGNDKTVKVWDCSRYLDAGQPSSSNDVLHLNINLSKKVNWLCTTPADSENLVVCDTTKVVKVHTVS

SEQ ID NO: 64440 - protein, 509 aa, Saccharomyces cerevisiae
MATIAPTAPITPPMESTGDRLVTLELKDGTVLQGYSFGAEKSVAGELVFQTGMVGYPESVTDPSYEGQILVITYPLVGNYGVPDMDLRDELVEELPRYFESNRIHIAGLVISHYTDEYSHYLAKSSLGKWLQNEGIPAVYGVDTRSLTKHLRDAGSMLGRLSLEKSGSDRTISRSSSWRSAFDVPEWVDPNVQNLVSKVSINEPKLYVPPADNKHIELQTGPDGKVLRILAIDVGMKYNQIRCFIKRGVRIESCSMDYDFTKEDYDGLFYSNGPGDPSVLDDLSQRLSNVLEAKKTPVFGICLGHQLIARAAVQSTLKLKFGNRGHNIPCTSTISGRCYITSQNHGFAVDVDTLTSGWKPLFVNANDDSNERFYHSELPYFSVQFHPESTPGPEIQNSCLTFIQAVKEFKYTQVLKPIAFPGGLLEDNVQGTPRIEAKKVLVLGSGGLSIGQAGEFDYSGSQAIKALKEEGIYTILINPNTATNQTSKGLGDKVYFVPVNAAKQRDVDR

SEQ ID NO: 64441 - protein, 490 aa, Vibrio sp. Ex25
MKQNWRETMKGDIGVIGLAVMGQNLILNMNDHGFKVVAHNRTAAKVDEFLEGPAKGTNIIGAYSLEELVEKLETPRKVMLMVRAGDVVDKFIDALVPLLDKGDIIIDGGNTNYPDTNRRVAALREKGIHFIGTGVSGGEEGARFGPSIMPGGAPEAWEAVKPIFQGISAKTDAGEPCCDWVGNDGAGHFVKMVHNGIEYGDMQLITEAYQFMKDGLGMSADEMQAVFAEWNNTELNSYLVEITADILGYKDEDGEPLVEKILDTAGQKGTGKWTGINALDLGIPLTLISESVFSRCLSALKDQRVEAEKLFGKTITPVEGDKQEWVDALRQALLASKIISYAQGFMLMREASNENGWDLNYGNVALMWRGGCIIRSAFLGNIRDAYEANPELAFLGSDDYFKGILQNSLVAWRKVAAKSLEAGIPMPCTTSALTFLDGYTTARLPANLLQAQRDYFGAHTYERIDRERGEFFHTNWTGTGGDTASTTYDV

SEQ ID NO: 64442 - protein, 148 aa, Brassica napus
  misc_feature (106)..(106): Xaa can be any naturally occurring amino acid
MASSMLSSAAVVTSPAQATMVAPFTGLKSSAAFPVTRKANNDITSIASNGGRVSCMKVWPPVGKKKFETLSYLPDLTEVELGKEVDYLLRNKWIPCVEFELEHGVXYREHGKHPPGYYRWPVTGTMGKLPLVRDAPDSAPGVERNPQP

SEQ ID NO: 64443 - protein, 202 aa, Glycine max
MASLSSSTKQSNNNQEVDEKPIPHDQNVLQKHVAFFDRNHDGIIYPWETFQGFRAIGCGYLLSSVAAIFINGGLSQKTRPGKFPSILLPIEVQNIHRSKHGSDSGVYDSEGRFVLSKFEEIFSKHARTHPNSLTSDELMGMLVANRVPKDYAGWLASYTEWKILYVLGKDKDGLLHKETIRAVYDGSLFEKMEKEHSDKKAK

SEQ ID NO: 64444 - protein, 522 aa, Vibrio sp. Ex25
MRYDTVVNERETKGRVMIYAQPGSENAIVNFKSHYDNFIGGEWVKPTGGEYFDNISPINGQAYCKVARSGEADINLALDAAHNIRTKWAKTSVTERSNILLKIADRIEQHLEELAVAETWENGKPVRETLAADLPLVVDHFRYFAGCIRAQEGSAAELDEHTASYHFPEPIGVVGQIIPWNFPMLMAAWKLAPALAAGCCVVLKPAEQTPTSILVLMEKIGDLLPPGVINVVNGFGSEAGQALATSNRIAKLAFTGSTQVGNHILKCAADNLIPSTVELGGKSPNIYFSDVFDYEDEYLDKCIEGTLLGFFNQGEVCTCPSRVLVHEAIYDKFVEKLTERAQLIKQGNPLDTDTQVGAQASQEQFDKILSYLEIGREEGAKVVFGGGVSEQPESINQGYYIQPTMLEGHNKMRIFQEEIFGPVIAITKFKDEAEALEIANDTEYGLGAGVWTRDANVAYRMGRNIEAGRIWINCYHAYPAHAAFGGYKKSGIGRETHKMMLDHYQNTKNLLISYSVDPLGFF

SEQ ID NO: 64445 - protein, 255 aa, Medicago truncatula
MAMTRESWAFVFGIIGNIISFAVFLSPLPTFYVIFKKKSAEGFQALPYVVALFSAMLWIYYAFVKRESALLLITINTFGIVVESAYIIMFLIYAPKKQRLSTIKLLLLLNVFGFGAMLLSTLYLSKGAKRLAIIGWICLVFNISVFAAPLFVISKVIRSRSVEYMPFFLSFFLTINAVMWFFYGLLLRDYYVALPNTLGFVFGIIQMVVYLIYRNATPVVEAPMKGQELSGGHIIDVVKIGTDSNRAGGGAGSKV

SEQ ID NO: 64446 - protein, 274 aa, Synechocystis sp. PCC 6803
MNHQNLLSITRNLVHPPISSGLVLLSARELDKMRRVGQLAANLLNHLESMVQPGVSTQALNDEATRWMEDHGAISATLGYAPPGYPPFTGAICTSINEVVCHGIPNPKQILKDGDIINIDVTLRLAGYHGDTSRTFLVGSVSATARKLVEATQESMMRGIAEIKPGARIGDIGAAIQAYAEASGFSVVRDMVGHGIGRQMHTELQIPHYGKRGSGLKLRPGMVFTVEPMLNEGTYELTFLADGWTVITKDKKLSAQFEHTVVVTEEGVEILTLA

SEQ ID NO: 64447 - protein, 511 aa, Oryza sativa Indica Group
MAAIGNMNLFDLFFVLQLLLSGVCVLVICYRYQRLKSMKKCSLGVVQWPIVGVLPAIVANMHRLLDGVTFLLATSQLNFQCRFWLAGFRFFVTCDPDNVRHIFTSNFDNYPKGDAQMLMTTPRFRAFVARSSLDKVEKGLLPFLAHVADARKTCDLQDVFTRWSLDATCHLVFGVDPGCLDIGLPEVPFARAMDDVLRTIFLRHTMPVSFWKTMRWLGIGHEKRNAAARRTVESFVASAIAKHRADDESKSRQGGGGGGDKQSVADLLSSFLCDDEIAGSADADVYIRDMAMNLLVAGRDTTSSALSWFFYLLSTNPRVEQKLLQELAPIASRKPQLQQGRLFPGNGGMVTFDASEVRNLLYLHAALCEAMRLYPPVPLEHKAAVADDVLPSGHEVMAGDKVLVFYYSMGRMKRVWGKDCREFRPERWITEDGKLRYVPSNKFVAFNSGPRTCLGKEMALVQMKVTAAAMAWNFAVEVVPGHVVEPRLSVILHMKNGLLVRVKRREPVMNT

SEQ ID NO: 64448 - protein, 152 aa, Kluyveromyces lactis NRRL Y-1140
MSNTERTFIAIKPDGVQRGLISKILARFEDRGYKLVGIKLVTPTEALLKEHYADLVSKPFFPSLLSYMTSGPVLATVWEGKDVVKQGRAILGATNPLQSAPGTIRGDFAIEVGRNVCHGSDSVESAEKEIGLWFKKEELIDYKLNQLSWIYE

SEQ ID NO: 64449 - protein, 732 aa, Desulfitobacterium hafniense DCB-2
MRKRMKLMVMLILLTLLSGGCADQQVQQQKIVQIACGNDFSLFLYDTGKVRAIGKNSSGQLGVGDTEDRYELTEVLLPEAVSEIGVSDDSAFALTQDGTLYTWGDNRCRQAENSAEPAVPTPIRYQIKEQEKVTQFALGWYASYGLTESDVLYGWGSKLGLVTLEDLNYEPIYQAVPLPQSRAFPIVDGKENKRYIPPKISKIDISNYTIMGIGDDGTFFGPVGENIFGAIPYTPGEIVKIAAGRLFCVLLTAEGSLYLWGDNFRGELASGDYQLRKVPLFRSFAEDPLRDVAVGPSHILALTRSGKVLAWGDNARNQLGLADRKEVLSPENIAFPEKITLIATGFHHSDALGESGKLYAFDANDYGQLMTGDQTSRDTPTVADLQSVVANPDPVIIPEFSQEVAIAATMEAFLTESGRVFTKGPGDMGTLGTATANSHEEPTYVPMSEAITQIEAGLFTFTVLTAKGEVYNWGLSQLNSLGHDHKENKWYLTPTQVPLPEKITKIRSDMYSTGALAESGNWYMWGDNTYGSLATGTKDYAAGPVKLETPVPFAELFPSRSYWLALTAEGEVYQWGTWQNKFAEEMYMPDVQTQDLKYQKIALPEKVIKAKSTAYDNFVLSATGNLYAWGFRFKQEPQIFLENVQDFVVSPRESDFLALTHDGKVYYWGYNLMEPYIPVEIHYPEIIRTVFPGEGIFYAAGEEAMYMVYDTWIQEGMKTNEFLVKVDYRYKK

SEQ ID NO: 64450 - protein, 173 aa, Desulfococcus oleovorans Hxd3
MPLYELNKIKPSIGAGTWIAPSAQVIGNVTIGRDCFIGFGAVIRGDFGPIIIGNESLVEDNAVIHTATRTEIGNRVIIGHMAMIHDAIIRDGSLIGMKSMICEGAEIGEGAIVAEQSLVKKGQKIASGKIYAGNPAEFKKEATDHHRKMLDMGIQAYIELTRLYHSTLKPVDP

SEQ ID NO: 64451 - protein, 303 aa, Hordeum vulgare subsp. vulgare
EVDVTISCIRIPAQLSPTFYDTSCPRALATIKSGVMAAVSSDPRMGASLLRLHFHDCFVQGCDASVLLSGMEQNAAPNNGSLRGFEVIDSIKAHVEGICKQTVSCADILTVASRDSVVALGGPSWTVPLGRRDSIDANEAAANLDLPGFTSSRSELEIAFKNKGLDTVDMVALSGAHTIGQAQCGTFKDRIYNEANIDTTFATTLRANCPRSGGDGSLANLDTTTANTFDNAYYTNLMSRKGLLHSDQVLFNNDTTDNTVRNFASNPAAFSSAFTTAMIKMGNIAPKTGTQGQIRISCSRVNS

SEQ ID NO: 64452 - protein, 381 aa, Triticum aestivum
  misc_feature (69)..(69): Xaa can be any naturally occurring amino acid
  misc_feature (84)..(84): Xaa can be any naturally occurring amino acid
  misc_feature (205)..(205): Xaa can be any naturally occurring amino acid
MERMVMRLMRNKNQSLRQLQGAAAGVLASSSSASSAAGAAASPFSTLQQQEDHPGVLNIRDTAAHLIGXRTPLVYLNKVTEGCXGARVAAKLEFLQPSFSVKDRPAISMIEDAEKKGLITPGKTTLIEPTSGNMGIGLAFMAALKGYELVLTMPSYTSLERRVVMKAFGAQLVLTDPAKGMGGTVRKATQLYENHPSAFMLQQFXENPANVQVHYETTGPEIWEDTLGQVDIFVMGIGSGGTVTGVGKYLKEKNPNAKIYGVEPAEANVLNGGKPGPHLITGNGVGFKPDILDMDIMEKVLEVKSEDAVTMAQQLALQEGLLVGISSGANTVAAIELAKRPENKGKLIVTVHPSAGERYLSSALFEGLRKEAEAMQPVPVD

SEQ ID NO: 64453 - protein, 276 aa, Bacillus megaterium
MNIGFIGTGNMGKILIDAFIESKAVRPSKITIMNRTKKRAKEIQQQHKKINVADTAEEVVHASKVIFICVKPLDIHPLLIKLEPLLTKDHCIVSITSPISVEQIERLIPSQAARIIPSITNRALAGVSLFTFGERCTPFYQNYLHELFSSMSKPVAIDQTITRVSSDIVSCGPAFFSFLLQRFIDAAVQETNISEEEATVMASDMIIGMGKLLEKEIFTLPTLQDKVCVKGGVTGEGIKVLEAELGEMFVHVFQKTHEKFDEDIELVHNQFDSLIP

SEQ ID NO: 64454 - protein, 406 aa, Gibberella zeae PH-1
MSSSSFSIENVRSQFPALEKRQIFGDNAGGSQVLGTVAKRQLSPITEYLIETNVQLGASYKTSTQSTAIFDNAYKAAAKYINAGIDEIVIGASTTQVFRNLAAALKLQPGDELILTNVDHESNIDPWLHYAALNNATIKWWTPSDLNNPKLDPEQLRSLLTNKTRLVACTHCSNILGTINNIKAIADVVHEIPGALLAVDGVAYAPHRAIDVKELGADFYAFSWYKVYGPHISLLYGSKAAQAQLSSLGHFFNPDGSLMDKLELAAASYELTQAIIPLTAYFGENPKQTWDAIAEHEQKLQTRLIEYLVSKPQITVYGETSTDKAVRVPTVSFTVEGMSSQSVVEAVEAVSHAGIRWGHFFSKRLVGSILGLSDDGVVRVSLVHYNTDRVAVEEVDQIIVALEMVL

SEQ ID NO: 64455 - protein, 493 aa, Moritella sp. PE36
MVKPENNSIVIFGASGDLTKRKLLPALYHLYVNELLPEDFSILGASKTAFTDDSFREKVTNDLIKSEGVSQQQAEEFCQHLYYISMDMTDADSYVAFKERLEILSEKHNTVGNAIYYMATPPSLYAAISTNLAKHKLNKDRNGWKRLIVEKPFGYDLASANELDEHLHTCFRERQVYRIDHYLGKETVQNLLVFRFSNGFFEPLWNRSFIDYVEITAAESLGVEERGGYYDHSGAVRDMLQNHLLQVLALVAMEPPAVINADAMRNEVVKVIQSLRPLEEQDLKENLVLGQYTKSVVNGEELPGYRSEKDVDEDSRTPTYVGMKMMIDNWRWNGVPFYVRTGKRMPERLTEIVVHFKKTPHPVFGQNAPENKLILRIQPNESIQMDFGLKKPGAGFTAQQVSMSFNYNSLEENNLLTAYERLLLDCMKGDATLFARSDAVKACWEYVQPILDYKKEVKSLFGYKCGTWGPNRADEMLEKDGREWRFSSEEVIN

SEQ ID NO: 64456 - protein, 288 aa, Coccidioides immitis RS
MASPRPTATPAAGLSAAPTQPLTPPAERPSSSSNPASGNPSNAALTSATANPPQVPGTSLQDNGKSRRPRDARLIHMLLASSGVNAYQERVPLQLLDFAYRYTSSVLQDAVYLATEGYAGEVPGPKGTDGGKTQQSSLEVSSVSLQALRLSIASRLHYQFQPGLPKEFLMDIAAERNRIMLPGLSRGAEGGASNVAAPGVVMGGMRLPPERFCQTGVGWGLREEWESEGEEEMEIDAAAQQGAPPAAGAGEEEGGAEDDDIDGKMEDIFGEDPMDEDNPDGDKTMTGV

SEQ ID NO: 64457 - protein, 442 aa, Chlamydophila pneumoniae CWL029
MDQLTTDFDTLMSQLGDVNLTTVVGRITEVVGMLIKAVVPNVRVGEVCLVKRNGMEPLVTEVVGFTQSFAFLSPLGELSGVSPSSEVIPTGLPLHIRAGNGLLGRVLNGLGEPIDVETKGPLQNVDQTFPIFRAPPDPLHRAKLRQILSTGVRCIDGMLTVARGQRIGIFAGAGVGKSSLLGMIARNAEEADVNVIALIGERGREVREFIEGDLGEEGMKRSVIVVSTSDQSSQLRLNAAYVGTAIAEYFRDQGKTVVLMMDSVTRFARALREVGLAAGEPPARAGYTPSVFSTLPRLLERSGASDKGTITAFYTVLVAGDDMNEPVADEVKSILDGHIVLSNALAQAYHYPAIDVLASISRLLTAIVPEEQRRIIGKAREVLAKYKANEMLIRIGEYRRGSDREIDFAIDHIDKLNRFLKQDIHEKTNYEEAAQQLRAIFR

SEQ ID NO: 64458 - protein, 330 aa, Nostoc punctiforme PCC 73102
MTAAGSPEVLQVQEVPNPAVPVGNTELLVRLVAAGINPIDTKLRSRGTFYPDRTPTILGCDGAGVVEAAGAGVQRFRPGDEVYFCYGGLGAHQGNYAEYSVVDERFVARKPASISFTEAAAAPLVLITAWEALYERGRLLPGERVFIHAGAGGVGHVAIQLAKLKGATVATTVSSEEKANFVKELGADHVIFYKQTDFVQAVLDWTGGEGVDLAFDTVGGETFHKTFPAVRVYGDIVTILEPDANTVWKTARLRNLRIGLELMLTPALLGLEDILQHHAEILEQCATWIDEGKLKIHVSHEFPLKEAAKAHQLIESGSVTGKIVLLISDK

SEQ ID NO: 64459 - protein, 279 aa, Propionibacterium acnes KPA171202
MLGRNRFQIKTPDQIRTMRRAGLVVAEGLEAMRAVAVPGATTADIDRAGRDVLEQHGARSNFLNYGGDWGLPPYPGVACVSPNETIVHGIPGERELKDGDIVSIDYGAIVDEWHGDAARTVLVGDVSEEARTLSEVTRESMWAGIAKVAPGARIGDISAAVQASLESHDGDYGIIREYTGHGIGTEMHMDPDVPNWGRAGRGPKIVEGMVLCIEPMATLGTEVTATLDDEWTVVTVDGSWASHWENTVAVTSKGLWVLSEPDGGQAELEKRGVPFGPLD

SEQ ID NO: 64460 - protein, 515 aa, Oryza sativa Japonica Group
MASSGFSWTLPDHPKLPKGKTVALVVLDGWGEANADKYNCIHVAQTPVMDSLKNGAPERWRLVKAHGTAVGLPSEDDMGNSEVGHNALGAGRIFAQGAKLVDLALASGKIYDGEGFNYIKECFDKGTLHLIGLLSDGGVHSRLDQVQLLLKGASERGAKRIRVHILTDGRDVLDGSSVGFVETLESDLSQLRDKGIDARIASGGGRILSLKNAQNDWDVVKRGWDAQVLGEAPYKFQNAVEAVKTLRAETKASDQYLPPFVIVDESGKSVGPVVDGDAVVTFNFRADRMVMLAKALEYADFDKFDRVRVPKIRETVKFGHVTFFWNGNRSGYFDETKEEYVEIPSDIGITFNVKPNMKALEIAEKARDAILSGKFDQVRVNLPNGDMVGHTGDIEATVVACKAADEAVKIILDAIEQVGGIYLVTADHGNAEDMVKRNKSGQPLLDKNGGIQILTSHTLQPVPVAIGGPGLHPGVKFRSDIQTPGLANVAATVMNFHGFEAPADYEPTLIEVVDN

SEQ ID NO: 64461 - protein, 251 aa, Staphylococcus epidermidis RP62A
MIVKTDEELQALKEIGYICAKVRDTMKEATKPGVTTRELDHIAKDLFEEHGAISAPIHDENFPGQTCISVNEEVAHGIPGKRVIHEGDLVNIDVSALKNGYYADTGISFVVGKSDQPLKQKVCDVATMAFENAMKKVKPGTKLSNIGKAVHATARQNDLTVIKNLTGHGVGQSLHEAPNHVMNYFDPKDKTLLKEGQVIAVEPFISTHATFVTEGKNEWAFETKDKSYVAQIEHTVIVTKDGPLLTTKIDD

SEQ ID NO: 64462 - protein, 174 aa, Glycine max
  misc_feature (140)..(140): Xaa can be any naturally occurring amino acid
  misc_feature (154)..(154): Xaa can be any naturally occurring amino acid
MICSLAVTTANRAGAGMVAPFTGLNSMAGLPTTKTNTDITFIACIGGIEQCMQVWPPLGKKKLETLSYLPYLDDAQLAKEVKYLLRKGWIPCLEFNLDHSSVYREHNTSPRYYDRRYCTMSNLTMLGCTDASHVLNELHXAKTAYPNGSVRIIXFDNATQVQCITFIVYNTPAY

SEQ ID NO: 64463 - protein, 748 aa, Salmonella typhimurium LT2
MLTRLREIVEKVASAPRLNEALNILVTDICLAMDTEVCSVYLADHDRRCYYLMATRGLKKPRGRTVALAFDEGIVGLVGRLAEPINLADAQKHPSFKYIPSVKEERFRAFLGVPIIQRRQLLGVLVVQQRELRQYDESEESFLVTLATQMAAILSQSQVTALFGQYRQTRIRALPAAPGVAIATGWQDATMPLMEQVYEASTLDTSLERERLTGALEEAANEFRRYSKRFAAGAQKETAAIFDLYSHLLSDARLRRELFAEVDKGAVAEWAVKKIIEKFAEQFAALTDNYLKERAGDLRTLGQRLLFHLDDSVQGPNAWPERFILVADELSATTLAELPQDRLAGVVVRDGAANSHAAIMVRALGIPTVMGADIQPSVLHRRTLVVDGYRGELLVDPEPVLIQEYQRLISEEIELSRLAEDDVNLPAQLKSGERVKVMLNAGLSPEHEEKLGSRIDGIGLYRTEIPFMLQSGFPSEEEQVAQYQGMLQMFNDKPVTLRTLDVGADKQLPYMPISEENPCLGWRGIRITLDQPEIFLIQVRAMLRANAATGNLSILLPMVTSIDEVDEARRLIERAGREVEEMIGYAIPKPRIGIMLEVPSMVFMLPHLANRIDFISVGTNDLTQYILAVDRNNTRVASIYDSLHPAMLRALSMIAQEAEKHGLDLRLCGEMAGDPMCVAILIGLGYRHLSMNGRSVARVKYLLRHIDFEDAQTLARRSLEAQMATEVRHQVAAFMERRGMGGLIRGGL

SEQ ID NO: 64464 - protein, 601 aa, Bradyrhizobium japonicum USDA 110
MASNVNPDPFTTRPEIEGTFGVVATTHWIATAVGMAILEKGGNAFDAGVATAFTLQVVEPHLNGPGGDVPVIVHDVKRGRTEVICGQGPAPARATIAHYRSEGLDMVPGTGLLAACVPGTFESWMMLLRDYGTMRVRDVLEPAISYARDGYPLVERACATIQTVEQLFRKHWPTSAAVYLPNGEVPKPGTLFTNKTLAATYARILSEAESGDGGRDAEIERARRAWSHGFVAEAIDKFCRTQEVMDVSGSPHRGVLSADDMARWQPTIEAPLTYDYGRYTVCKAGVWSQGPVTLQQLALLKGFALDGLDPTGPEFIHLQIECAKLAFADREKFYGDPKFSEIPIATLLSDAYNDERRKLVTDKASLDFRPGSVEGFGGVVKLRRAEGQREAVGALGAGEPTVGRFGEVRGDTVHFDIIDKAGNMVSSTPSGGWLQSSPIIPELGFCLGSRAQMFWLEEDHPAALAPGKRPRTTLSPTMALRDGEPYLAWGSPGGDQQDQWITQFFLRHVHCNLNLQESIDAPAWHSEHFPISFWPRTARPGVLVVENRVPKAAIENLRERGHIVEIGPDWSEGRLTAASRVGVRRRAAANPRGMQGYAAGR

SEQ ID NO: 64465 - protein, 1012 aa, Chlamydomonas reinhardtii
MAPKQRCLYEVLEVAREAEDGEIKKAYRKMALMWHPDKNAHRAEEAAERFKEIQNAYEILSDKHERAWYDDHRDQIMRSGERHQAGGGSGGYEAGGERPAEDEEIFSFFSTSCFSGFGDGPKGFYGVYAEVFANLAKREQEAWEAREREQIRRRMEEENRRKRRKARRDWMDTIRELVAFVKKRDKRVAKAQAEEAARRAQREAEDAERRKREREERLARAAAYEEADWVRNTPSHHHHGEEDGEGSEEDEAEEEVFECVVCDKVFRSDKQIKNHERSKKHAEAVAALRAVLEEEEAAILDLDLDLDGSGAGAASVAGGGGGGGGGGGKGGRGGSGMDGAATGGGGGSKKKKKAKRRAQKAAGGSAMQSRDAGGEDEEAEEAEGEEEAEEEARAAPAPAPASAAAGKGKGKAQQAKGKAAAPPPPPPPPKSESEEEEEEEEEEQDEDDDAMLARMMAAHARVGGGKQQRQSKGGRGGKQQQQEDEKGEEEEEDEEEEEAEAPAARKAEAAADIEDDEEEEDDEDEDAMLARMMRSKQAAAASGPAARKGGGGGGKKAAPAPAVESDEEDDEQDEEEEEEAPPAASSSGRQQQQQPAAPKQAQAGGGKVAKGGAAAAAKPAASKPAPASKRGGGGGGGAATVGVPAGSGFVASDDDSDEEDGSQATTKKEKRKAKAAARKAAATAPGPGQTACLVCVPVTFEQCFGAGNILRPPVPLHHVHPGDAGDEVLFLRSGRQLRREQISRLAEENCRIEHSCGADTPAAIIAHGVRHSVVRANMNISGFTSISQELAEHLGLAYQVLGGGGKEPLRGRPEPISALVDPIQIQLLNTDGGPLATFTAYLVFVTTDSHVDLQIAGDVVGGRSCIGDGQWSIGLPGSGALVPLPRLLPRRWRAGEPRTMPTTTTFSVAPDTYAEALARVAARAGDRARLAAAAAADTAAAEAAGAAFPVLGAGSEDPVAAGLPPLPPALRSAHWAEVAATDLPAGDTECVVCAWSLTGAADGRRRLEQQQQ

SEQ ID NO: 64466 - protein, 449 aa, Clostridium symbiosum
SKYVDRVIAEVEKKYADEPEFVQTVEEVLSSLGPVVDAHPEYEEVALLERMVIPERVIEFRVPWEDDNGKVHVNTGYRVQFNGAIGPYKGGLRFAPSVNLSIMKFLGFEQAFKDSLTTLPMGGAKGGSDFDPNGKSDREVMRFCQAFMTELYRHIGPDIDVPAGDLGVGAREIGYMYGQYRKIVGGFYNGVLTGKARSFGGSLVRPEATGYGSVYYVEAVMKHENDTLVGKTVALAGFGNVAWGAAKKLAELGAKAVTLSGPDGYIYDPEGITTEEKINYMLEMRASGRNKVQDYADKFGVQFFPGEKPWGQKVDIIMPCATQNDVDLEQAKKIVANNVKYYIEVANMPTTNEALRFLMQQPNMVVAPSKAVNAGGVLVSGFEMSQNSERLSWTAEEVDSKLHQVMTDIHDGSAAAAERYGLGYNLVAGANIVGFQKIADAMMAQGIAW

SEQ ID NO: 64467 - protein, 337 aa, Candida glabrata CBS 138
MTATEIPIWLDCDPGHDDAVAILLACCLPAFKLVGLSTCFGNAPPENTDYNARSLLTALGKTDVPVYLGAQRPWIRKPHYAPDIHGETGLDGTSLLPVPVVEVNKEVNFIDAIEKAILESDGELSFVSTGATTTIATVLREKPYLLEKIKYISIMGGGLGVGNVNKGLSAEFNVWIDPHAAKFLLTDPGIKRKCILIPLNLTHKALATDEVMKRVLGDGKSNIRRLFYDLFLFFKKTYEHAQGFESGPPIHDPLTLLPLLELYGWETKEVINFSYRRLDIDVDIDIHSDHAGKLIILNEYEQEEVQKGVIVGYELNFDYFWDKLYFCLEEAEKTSTI

SEQ ID NO: 64468 - protein, 155 aa, Glycine max
  misc_feature (84)..(84): Xaa can be any naturally occurring amino acid
MHPKPVPQKEPLSAALSALTLVVQFNGVSSLGPPPYYKLPLRPETHKTYYEYTGLWHIYGLLAMNSWFWSAIYHSCDTIWTEKXLYFSSDAAFLGLIILELVLTIEASGGIAPIVSVLQLWMSVDKRCIREKHFKVNLSKLEMLDFVFWLLMGGE

SEQ ID NO: 64469 - protein, 610 aa, Pasteurella multocida subsp. multocida str. Pm70
MTETTMTFNDLGLPEFLLNAVSDLGFETPSPIQQSCIPNLLNGHDVLGMAQTGSGKTAAFSLPLLAQIDLDKKYPQMLVMAPTRELAIQVADACEHFCKYAKNTNIVTLYGGQRYDIQLRALRQGAQVVVGTPGRILDHIRRGTLDLSNLRFMVLDEADEMLRMGFIDDVETVMAELPEQHQTALFSATMPDPIRRITKRFMKDPKEIKIKSTQTTNPDITQSCWYVHGFRKNDALLRFLEVEKFDAAIIFTRTKTGTLDVTELLEKHGFRAAALNGDMTQQLREQTLDRLRNGSLDILVATDVAARGLDVERISLVVNYDIPLDAESYVHRIGRTGRAGRTGRALLFVEPRERRLLRNIEQLTKKPITEVEVPNHEVLQACRREKFKAKITVQLEHHDLGLYRSLLEDMFTADQDQEDIAAAMLMLLQGKQKLILPADPIIDRKTSRGDRGERRERGGRENPRSAERRGYGTPQAMDLYRIEVGRLDGAEVRHIVGAIANEGDINSRYIGHIKLYDDYTTIELPQGMPKELLGVFAKTRVMNKQMQMSFVGASNAGSSRDRDDFADRRGGKRKGRGDEPRFGREDRKFKEKSQRTFNDRPRRERRERQK

SEQ ID NO: 64470 - protein, 545 aa, Mycobacterium sp. MCS
MPGAASDLTRLPDLAHGTPRAGPVRLRYPVYVDLLPPCNDACPAGENIQAWLSHVRAGRHEQAWRRLVSDNPFAAIHGRVCYHPCETHCNRGQLDSPVAIHAVERFLGDLATQNRWEFAPPAARSGKRVLVVGAGPSGLSAAYLLALRGHDVEIRDAGPEPGGMMRYGIPSYRLPREVVDAEVDRIAALGVRLTCGHQVEDLAAERDSGDFDAVFVAVGAHLAKRVDIPGRDAGALLDAVTFLRSVAAGQPPELGRHVAVYGGGDTAMDVARVARRLGAEDSVIIYRRTREQMSAHAEETEEAEREGVRINWLRTITAFDRPDLQVEVMDLDEHGQPRPTGRFEKLAADTVIMALGQKTESEFMRTLPGVRFDDDGTVQVSPTLMTGCPGVFAGGDMVPGERTVTVGVGHGKRAARHIDAWLAGRSGERPPSHPPVAFDDLHLWYFGDAPQRPQPHLDAERSVAGFDEVVGGLTEQAAVYEAARCLSCGNCFECDGCYGACPEDAIIKVAEGHHGYEFVYDRCTGCGACFEQCPVHAIEMLPETS

SEQ ID NO: 64471 - protein, 124 aa, Desulfitobacterium hafniense DCB-2
MYTEKVMDHFMNPRNVGEIEDANGVGEVGNAKCGDIMRIYLDVEGDIIKDVKFKTFGCGAAVATSSMVTEMVKGKTIEEALKITNAAVAEALDGLPPAKMHCSNLAADALHEAIKNYHEKTLKV

SEQ ID NO: 64472 - protein, 845 aa, Chlamydophila pneumoniae CWL029
MAVRLIVDEGPLSGVIFVLEDGISWSIGRDSSANDIPIEDPKLGASQAIINKTDGSYYITNLDDTIPIVVNGVAIQETTQLKNEDTILLGSNQYSFLSDEFDPQDLVYDFDIPEENFSNDSGDLSDSNEQGKDLEPRQTSETNHSPKPKEKLTKDQGSSDPITSGDQELADAFLASAKAEKNQPRAKVAKKGLKESSNESLNPKEQNAKDSPKGEERTNKPQNAIMEDNGASPRQDPQPKSAEPSLKNTARDETPLKENKPVEEKANKKATPDSPEKKDQPEEGSKKEGSKIEATPLDSQKESEDKEAEEAFVQEEEENLTEDNKEDSDSAADANDDTASDHTAEDNKETPKKVENEKSAVLSPFHVQDLFRFDQTIFPAEIDDIAKKNISVDLTQPSRFLLKVLAGANIGAEFHLDSGKTYILGTDPTTCDIVFNDLSVSHQHAKITVGNDGGILIEDLDSKNGVIVEGRKIDKTSTLSSNQVVALGTTLFLLIDHHAPADTIVASLSPDDYSLFGRQQDAEALERQEAQEEEEKQKRATLPAGSFILTLFVGGLAILFGIGTASLFHTKEVVPLENIDYQEDLAQVINQFPTVRYTFNKTNSQLFLIGHVKNSTDKSELLYKVDALSFVKSVDDNVIDDEAVWQEMNILLSKRPEFKGISMHSPEPGKFIITGYVKTEEQAACLVDYLNIHFNYLSLLENKVVVETQMLKAIAGHLLQGGFANIHVAFVNGEVILTGYVNNDDAEKFRAVVQELSGIPGVRLVKNFAVLLPAEEGIIDLNLRYPNRYRVTGYSRYGEISINVVVNGRILTRGDVIDGMTVTSIQPNAIFLEKEGLKYKIDYNK

SEQ ID NO: 64473 - protein, 2761 aa, Ustilago maydis 521
MHPRQPSGPGSTDAMEIYDHLHTPKHEIDVADAFAAAMPSAIDPNQPSLRSVPEDAQLDTQQLSSLNASPLASSLQPSSQVAQQESPTSRRSDKLATSSYGLVQPGGRPDLASRRSSDVLKSLPGLPLALTNAEQTFLPATLNGGTSSAIPHPSAAIGSLVDHRAPPADTLPPQHIPRPLPGSATPSASASPSAMQTPPKKTPYDAIAAGVQTLAMPNSISVGPLSPPESDPHRSMMDSNRKSIDDIRRNHAARAAQRQSNNSSPIETRPGNGLVPDSAYTPTRAHAQYQSEFASSPDPTQRQRRAMASEPPRPASVLDTRAAQMQAVQRRQHDSRLGQGSSDTFDATDTLGSSRDTQLDRASQQHLQLRAAREQELERERLQHQQLQEQQREKEQQRQREKLKEREREKEREREREKERGERDRDRDRERRSRRLLGDYALGKTLGAGSMGKVKLGVKMGNGEKVAIKIIPRHTSMAAAQSPRAAVDENGKPQPPPPPPTASFLAKAAAKDQSKEIRTIREGSLQILLHHPYVCGMREMIIHTNHYYMVFEYVNGGQMLDYIISHGRLRERSARKFARQIGSALEYCHRNSIVHRDLKIENILISKTGNIKIIDFGLSNLFSPHSHLSTFCGSLYFAAPELLNAKVYTGPEVDVWSFGIVLYVLVCGKVPFDDQSMPALHAKIKRGQVEYPAWLSGECKHLLSRMLVTNPANRATLAEVLAHPWMVKGYEGVPDPHLPDRTPLRPHNIDQEVIKGMTGFEFGSPEAITAKLIEVLNSEAYQTSLYHWELKNLPASLTGLSTVSNSGSSIDSPGLNRPSTRGSFTATSGSDTVKSKAGSRRFSGIDFYKKKLTTNPLAAAFGSKDDSAVGSANGSSNGLGSGTGLLPFGKEPLDPTRGFHPLISIYFLVKEKMERERLYGHSFFASSNLSLNGPPVPSTGAVAGAGTGARAAAAGAMPTAADIPQEALRVPEVPHVSHRAYDPSRQQEAALASPAPPRPAAAMIPVPASPTPVFESREKSRPSGLMAGPPRARANADEMEAALREKCLPSPKDAGFAPGIGGMAPVPAASTPGMRQSFSVVPPGPEVAIGHNHRHSMMAPDISMAITNNHKRSVSLTARRPPGAAAAGRTPVGAMVEPSTPDAFSMDTRRMSTMSPARLPARASYIATPSKSEAGSAEPSSSPAATAHNTSSTLGYGATLARRFSSFMGRSPSQPLDTEARERKKQSRMSMPLGGLPQQQQQQHQQRRGSAHMPLSEVDEADTGTDVDAYDYDEVEEHLVTHDEDMPLGSGTTVRRSGTMGDMPASHANTRVSEASMGALSVGRAAGLSMSPKSTAAAKSGRRPSTGISPSTSMPLNVLDAGGAARQKEDALQQVSPSNARTGWMGPSTPGQAEVLPALVTRRRFGGGSNATGGQQNGSSASEGGSKPIFLKGLFSVQTTSTKPRTVIHASLVKVLDRIGIQYRELRGGYECVHLPSLDFSGSDSLGRGNARIPLETMAAAAAADAEASERSPTSEENNRQPKRKPSRLSFVSGRSKDKDRANRKEGSVAESIGALTGAGGTVRSRTPSLTSNAAFANADSTTLPPLPPKTPSKPSLLIRSPRQRADSMGAASMLGPSGSRDSNLMLDTTVAAGSGGDACALSPASAAGTVTARTMNAAQATELAVRFEIFVVKVPLLLGVNGLQFRRVGGNPWQYQMLAKRILQELKLPVLWNDRGSWIRMVAFHVWKHSRFTIHDSRFGVSKEAGEIHREWSRSRVGRIVCETRHAAVEPVLGTTFYHTFILTIKNAADDHKQVWQRYISPARIRNETCSISKMHKDYTTLHSVAPDKARIDNLCCDIERCCFTDTIHTQGSFHSSSSAHKTLLSDIPSISPRSLVKYLDSYVVGQTRAKKVLAVGVWNHYLRVASNQRMKHEAEARLEAQQQQQQQQQQQQQLSEEETETQLQRNCTIPDHGVSEAASRSLRLGKYKARSEEAAGPISNPTAMQEKDEAMASLQDSWRSQHQIEQERNAERARDPHGEATRSLMFGRSEREWLVNAGGPSAIIEDDSKVAIQNGSGYAGRIAPKFGDDLKPPEKPEKPEKPMKRVSAQTPAEEASWKLEQRKWSSTTAAQENALAEAASRMHNAVLSDYTRDFHQKDHVVEGTSRIGVFGADEPLYFSSNTMRGSQHAGVRGPGSQSQMSRTDETENKWESSQERAAYAAGIAQERTKRALRLARERLSTSRNSDHPSERASTVDVCHVSDCTPRTHDAGKETASTSNPGIAFLSTQPGSLPFFEKSNILLLGPSGSGKTLLLRTLAQALDVPFVHVDATPLTMAGYVGEDVESIIQRLLVEAGWDVDRAQRGIVCIDEIDKLRKTGLGGGGGGAGGAGGGGGKDVGGEGVQQALLRILEGTTIQIANKAGANAGASAAGTATAASKVPKSYPRQAATGDVNGVETAGGLGPWYNHRRAQADSADAKWNSNSLSSSQTQAASLSVDTSSILFVLSGAFVGIDHVIRNRLDRLSGDPTTLNVSSEDQNEKPHAATLSQCDLLSRLEPSDLEQYGMIPEFIGRVPVSVVLNPLSHQDLIRVMTEPRNSLVDQYTSLFKLNGIELHISRGAIEEVVHRAMGTCSAANSKALVRNSADRGGGGGGARSLRRIMEDVLLDAFYESYGSSSVKYILVDRQSVRDTSEVKLFSRGQKLDFEARVKTEAQDWCTRQQQQKQTRHQGANPAKAIRKDGGALGDMDAARTAMARHKARALIRSRLRRTNRLVDPVIYV

SEQ ID NO: 64474 - protein, 95 aa, Triticum aestivum
  misc_feature (54)..(54): Xaa can be any naturally occurring amino acid
REVPAYLKPRLTWSNVKKSTDQAVDRYIEKYIETSSVDPLFHVCFGGMAFSYLXVGLPQERRHLEHLREARALNSDPRARLIYLFMAPVFSPTDG

SEQ ID NO: 64475 - protein, 277 aa, Oryza sativa Japonica Group
MAAASRARRWSLAGKTALVTGGTKGIGRAIVEELAGFGVRVHTCSRHDADLQDCLRRWNAAGEGGGAAALVTGSVCDVSVRGDREALVAAARAALGGRLDMLVNNAGQVVVGPAAETAPEEYARLMATNLESCFHLAQLAHHLLRDAAAGGGAAASVVNISSTAAFYAAPHLAVYSATKGGMNQLTRCLAAEWARDGVRVNAVAPGATRTDICDTSGVALGEKTRRRLADAGAMDRVPIRRIGEPEEVAAAVVFLCMPAASYITGQVICVDGGRTLL

SEQ ID NO: 64476 - protein, 478 aa, Xylella fastidiosa Ann-1
MFKQLWATKLSQPSQDSAEGLSLQRVLGVWGLTALGIGAVIGGGIFVITGQAAANHAGPAIMLSFALAAICCTFCALAYAEFAAMVPVSGSAYTYTYATFGELAAWFIGWMLVLEYGVSAAAVAVSWSGYFLSLLQHLGIHLPAALVNAPLDGTLHATGAIANLPAATIVLLLTWLCYFGIRKSSKINIAMVALKSGLILLIIGVGWKYVNPDYWQPFIPTNQGPGKYGWNGVLHGASMVFFAYIGFEAVSVAAQESHRPQRDLPISMMSALAICTVLYIMMAAVMTGLVPYTQLGTDEPVVTAVAAHPQLGWLRVVVEIGALVGLSSVVLVMLIGQPRIFMIMAGDGLLPPIFSTIHSKHRTPHINTVITGLGIALLAALLAAVFPLDVLGELTSMGTLIAFTAVCAGVLILRCTRPDLPRPFRMPAAWLFCSAGVLSCITLLSAMTRHNWMLMSVWTVLGFSLYFSYGYHHSKLHQ

SEQ ID NO: 64477 - protein, 496 aa, Xylella fastidiosa Ann-1
MTHATIYQGEERRMLKKHLFIVKPIEPTNHTGTGKGGTQLKRSLTAGQLVMLGIGAVIGAGIFVLSGHAAAEYAGPAVVLSYILAGIACALAGLCYAEFAAMLPVSGSAYSYAYATLGEFTAWFIGWNLILEYMFSASTVAVGWSGYLNSFLSSFGYGLPASLSSAPLDVVDGRLIYSGGLINLPAVAIVAAISGLCYVGITQSAFVNSITVAIKVSVIVLFIAFAARYVNPDNWVPFVPDNVAPGKYGIEGVIRGAAVVFFSYIGFDAVSTTAGEAKNPQRDMPIGILGSLAICTVIYIAFSGVLTGLMHYSQLDTPKPVATALETYPTLSWLKHVVEIGAIAGLSSTMLMMLMAQPRIFYAMSQDGLLPKLLSKVHPKFQTPHVGTLIVGACACALAGLFPISLLGDLVSMGTLLAFATVCIGIVVLRRTRPDLPRPFRVPMYWVIAPTGAAACLYLFWQPFTEHWPLMVGWTVLGLVMYGLYGYHHSKLRHGG

SEQ ID NO: 64478 - protein, 487 aa, Populus tomentosa
MTTKATRDEPLPDYDSSSSSTTVPDSSRSWMSNLSFGSRRSSISISSSVADSASICSTARVKPHKANQAAWQAIKRLQRATGRVGLDHFRLLRRLGSGDIGNVYLCQIRNPVVGLPQCFYAMKVVDKEALAIRNKLQRAEMEKEILGMLDHPFLPTLYAEFEASHYSCLVTEYCPGGDLYAARQRQPWKRFSISSAKFYAAETLLALEYLHMMGIVYRDLKPENVLVREDGHIMLSDFDLSFKCDVVPKLLRSKPSLEAIVRHKNETTSFAPFCATPIHPVLSCFSSSNKKRKPRITTTIRERVDDQGYDEDVVDTELVAEPISARSKSFVGTHEYLAPEVISGQGHGSAVDWWTLGVFLYEMLYGRTPFKGENNEKTLINILKQPLTFPRIGVNSSKEFEEMVKLQDLVGKLLVKNPKRRIGSLKGSVEIKRHEFFKGVNWALIRSIKPPESPSDLCRFRSRAHIPMLSKKERQEPYQIPSHFEYF

SEQ ID NO: 64479 - protein, 442 aa, Vitis vinifera
MADRQSKENTSKRKNGENQSLLLGRYEIGKLLGHGTFAKVYHARNVGSNESVAIKVIDKEKILKGGLIAHIKREISILRRVRHPNIVQLFEVMATKAKIYFVMEYVRGGELFNKVAKGRLKEEVARKYFQQLISAVGFCHARGVYHRDLKPENLLLDEAGDLKVSDFGLSAVSDQMRQDGLFHTFCGTPAYVAPEVLARKGYDASKVDIWSCGVILFVLMAGYLPFHDQNIMAMYKKIYKGEFRCPRWFSPELARLLTRLLDTNPETRITIPEIMENRWFKKGFKHIKFYIEDDTLRLCNAEEAEDDVDLNAFDIISFSPGFDLSGLFEEGGGDARFVSGAPVSKIISKLEEIAKVVSFTVRKKDCRVSLEGSREGVKGPLTIAAEIFELTPSLVVVEVKKKGGDKGEYEEFCNRELKPVLQNLNLVVDDSASTPHLPSDTE

SEQ ID NO: 64480 - protein, 458 aa, Nostoc punctiforme PCC 73102
METADVIVIGSGQGGIPLAADFASSGRNVVLFERDALGGSCINYGCTPSKAFLASAHAAGRARQATKLGIHAQVEVDFSAVMERVRSIRSQFNQGVKRRLDSAGVRVVCAEAAFTGERTVSGGGVTVQAPLIVINTGTSSTIPDFSGLVGTPYLTNRNFFDLQQIPPRLLVVGGGYIALELGQGMARLGSQTELIVRGERLLAQEESDVSAVLADAFEQDGIGLHFNVTVQQVAYTNRVFTLTLNNGEVLDGEALLIATGRKPNTQALNSAVTGVELDAQGFIKIDEQFQTTCAGIYAIGDAAKQPAFTHVSWEDYRRLKAILCGEHRTRNDRVLGYAVYTEPQVGRVGMTLEQAHKQGITASEVTLPMAHIARSIEWGHDLGFYRMVIDTQTNLILGATLVGYETAELVHVFLSLMEAKATWQVLEQSVHIHPTYGEALPSLARLLVGDDMPTCPNM

SEQ ID NO: 64481 - protein, 375 aa, Oryza rufipogon
WSKMCMQPDVKPNKRKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVMSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMSIETDSARMWETVARKGQHRSFVANLWSTMA

SEQ ID NO: 64482 - protein, 461 aa, Burkholderia pseudomallei K96243
MTSRDERLHRGLEERHINLMALGATIGVGLFLGSATAIRAAGPAILLTYILGGVAIFLIMRALGEMAIDNPVAGAFSRYARDYIGPLAGYLTGWTYWFMWIVTCMAEITAVGVYMHMWFPDVPNWIWTFAALIVMGAVNFIAVKLYGEFEFWFALIKIVTIVLMIAGGALMIVAGVGNGGVPTGVSNLWAHGGFLPNGWPGVVDALPIVMFAYLGVEMLGLTAGEARNPEKSLAKAVNSVFWRVVIFYVGALFVIMSVYPWNQIGTQGSPFVMTFSRLGIPAAAGIINFVVLTAALSSCNSGIFSTARMLFNLAEQGQAPERLASVNRRGVPVHGVLISVALLFVGVVLNYFAPQKVFVWLTSVSTFGAIWTWCVILIAQLRFRRRVSAERLARLPLRVPCYPLSSFVALAFLAFVVVLMAFSPDTRVALVIGPLWIAALTVYYYASQAGRRSPLGAPTDG

SEQ ID NO: 64483 - protein, 549 aa, Zea mays
MARRAASSLVSRCLLARAPAGAPPAAPSAPRRTVPADGMHRLLPGVLQRFSTAAAVEEPITPSVHVNYTKLLINGNFVDSASGKTFPTLDPRTGEVIAHVAEGDAEDINRAVAAARKAFDEGPWPKMTAYERSRILLRFADLIEKHNDELAALETWDNGKPYEQAAQIEVPMVARLMRYYAGWADKIHGLIVPADGPHHVQILHEPIGVAGQIIPWNFPLLMYAWKVGPALACGNTLVLKTAEQTPLSALYISKLLHEAGLPEGVVNVVSGFGPTAGAALASHMDVDKIAFTGSTDTGKIILELAAKSNLKTVTLELGGKSPFIIMDDADVDHAVELAHFALFFNQGQCCCAGSRTFVHERVYDEFVEKAKARALKRVVGDPFRKGVEQGPQIDDEQFNKILRYIRYGVDGGATLVTGGDRLGDKGFYIQPTIFSDVQDGMKIAQEEIFGPVQSILKFKDLNEVIKRANASQYGLAAGVFTNSLDTANTLTRALRAGTVWVNCFDVFDAAIPFGGYKMSGIGREKGVDSLKNYLQVKAVVTPIKNAAWL

SEQ ID NO: 64484 - protein, 291 aa, Oryza sativa
  misc_feature (85)..(85): Xaa can be any naturally occurring amino acid
MGKDEVMESGGAAGEFAAKDYTDPPPAPLIDAAELGSWSLYRAVIAEFIATLLFLYITVATVIGYKHQTDASASGADAACGGVGXVLGISWAFGGMIFILVYCTAGISGGHINPAVTFGLFLARKVSLVRAILYIVAQCLGAICGVGLVNAFPNAYFNRYGGGANTLAAGYSKGTGLAAEIIGTFVLVYTVFSATDPKRNARDSHVPVLAPLPIGFAVFMVHLATIPITGTGINPARSIGAAVIFNNEKAWHNHWIFWVGPFVGAAIAAFYHQYILRAGAIKALGSFRSNA

SEQ ID NO: 64485 - protein, 150 aa, Glycine max
REDDRRAWILDEYSEFHGHSPAVVTGKPVELGGSLGRDAATGRGVLFATEALLKEHGMSVSGQRFIIQGFGNVGSWAAQLISEKGGKVVAVSDITGAIKNTNGLDIPSLLKHSREHRGVKGFHGGDAIDPNSILVEDCDVLVPAALWGVI

SEQ ID NO: 64486 - protein, 375 aa, Oryza rufipogon
WSKMCMQPDVKPNKRKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPAEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVMSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPKMSIETDSARMWETVARKGQHRSFVANLWSTIA

SEQ ID NO: 64487 - protein, 501 aa, Arabidopsis thaliana
MDIISGQPMFLLFCFILSCFLFFTAARSRRSPTQVLSKSPPGPPRLPIIGNIHLVGKNPHHSFTDLSKTYGPVMSLKLGYLNSVVITSRDAAREVLKAHDQILSGRYITQATKSNNHHEFSVGWIHPSSPLEEMTFTQLFSPQRIEATKALRMKKVQELVNFLSESSERGEAVDISRASFVTALNIISNILFSVNLGSYDSKNSSAFQEMVIGYMESIGNPDVSNFFPFMRLLDLQGNSKKMKEYSGKLLQVFREFYDARILENSSRIDEKDVSSRDFLDALIDLQQGDESEINIDEIEHLLLDMFLAGTDTNSSTVEWAMTELLGNPKTMTKVQDEINRVIRQNGDVQESHISKLPYLQAVIKETFRLHPAAPFLLPRKAERDVDILGFHVPKDSHVLVNVWAIGRDPNVWENPTQFEPERFLGKDIDVKGTNYELTPFGAGRRICPGLPLALKTVHLMLASLLYTFEWKLPNGVGSEDLDMGETFGLTVHKTNPLLACL

SEQ ID NO: 64488 - protein, 647 aa, uncultured proteobacterium eBACred25D05
MSFPFELPILDKVSGPEDLRKLSDADLDQVAKELRNEVIEVVSQTGGHLGSSLGVVELTVALHAIFKTPLDKLIWDVGHQCYPHKIITGRRKRMMGLRQKDGVSGFTKRSESEYDPFGAAHSSTSISAALGFTMGRELGQTVGDCIAVIGDGSISAGMAYEAMNNAGAENKRLFVILNDNEMSIAPPVGAMSSYLSGLYGNSAFHKLKTLAEEVEVHLPWAMRDGARRARQIVTGMHGQATLFEELGFDYLGPIDGHNMPQLLSVLRAAKARATGPVLIHVCTKKGCGYAPAENSSDKYHGVSKFDIATGLQSKTPANAPSYTSIFGQALTIEAEADPRIVAVTAAMPSGTGVNAMAKVFPKRVFDVGIAEQHGVTFAAGMAASGLKPFCAIYSTFLQRGYDQIVHDVALQNLPVRFAIDRAGLVGADGATHAGAFDVAYLSNLPNFVVMAAADEAELMHMVRTAAEYDAGPISFRYPRGNGLGVELPKRGEVLEIGKGRIIQDGSDIAILSFGAHLSVVQEAAVALKNKGISVTIADARFAKPLDTDLIDELVNNHSAILTVEQGSVGGFSSLVLHYLMQSGQLRHGINIDSMVLPDRFIDQASPAEMYSDAGMSEGHVIDRCTKLLHKGSSIPSNHLDAVNLQSS

SEQ ID NO: 64489 - protein, 323 aa, Burkholderia pseudomallei K96243
MSLHKILYDTDPGVDDSMALVFQALHPDIELLGVTSVFGNATIDTTTRNALYLAGRFAPGVPVARGAAAPLRRPAPEPLGGIHGDDGLGNTGLSVSVDVAAAPNLDARPAHRFIIDTVRAHPHEITLLAVGPLTNLAHALAEDPQVAMLVKQVVIMGGAFGTAGVLGNVSPAAEANIAGDPDAADIVMSAPWPLAVVGLDVTQATIMTTEYLAALRDDAGEAGRFVWDVSRHYEAFHRASAGLAGIYVHDSSAVAYVVAPQLYRTRTGPVRVLTSGIAVGETIQKPAAMTVPAPDWDGRPPRDVCVGVDANALLALYRKTLVG

SEQ ID NO: 64490 - protein, 249 aa, Aspergillus oryzae
MATPDPHPDLKALYDKENELNAQWEHDIHEARKIHYEHNKSFYQRRAELATGWTGDTQTHHPPIRDFWLTALRNEHETRKLVTKLDLGPLKSLIDIRVEWLEGFDYVLAFYFAPNEYFTNRMMRKEFYYDKTGEPTPNPSPLEMRGDRIHWKKNHILQAECHARIGTKSFFAFVSRSLAYGDAQTSEEESMEDARITEDFEMGESIRDSVQPYAMELNSKAFGLEEDGVGEEAEEAEEEDDEDIDYDME

SEQ ID NO: 64491 - protein, 257 aa, Pasteurella multocida subsp. multocida str. Pm70
MKPLVIKLGGVLLDTPAAMENLFTALANYQQNFDRPLVIVHGGGCIVDELMQRLHLPVQKKNGLRVTPSDHIEIITGALAGIANKTLVAQAAKFHLNPVGLCLADGNLTYATQLDPELGHVATVVPKNPALLNNLLGEAFLPIISSIAVDKQGLLMNVNADQAATAIAALIQADLVMLSDVDGVLDANKQRLPELNGAQIEQLIKDNVITDGMVVKVNAALDAAKMLNQGVDIANWKYPEKLTALFAGEIIGTRIKP

SEQ ID NO: 64492 - protein, 877 aa, Ajellomyces capsulatus
MQMADEAALRHLIFDHPIIDNHAHNILKADSASNYDRYPFETITSEAKGESLGSHAANSLALIRAVNQLAELFGCAPELSSIKSAREKEIENDYDGLVKKCLTGTHMLLIDDGLPEGDMELYSWHDQFTNAASKRIVRIEAVAANIIDKLLETRNISRKSLLSAELKSAKDFWNAFRDSFSAAIKNSLDDPAVVGFKSVVCYRTGLKIWKGSAEALFASFETYFRHFVETGESRIQNKPLNDYLVISVLEHISQQSKESRKPIQFHTGLGDSDINLLRSNPAHLQNLIEEYPNVDFVLLHSSYPYTREAGYLASIYANAYLDVGEVFPMTSRDAQLSILRQSLELVPSTKLLWSTDGHYHPETFWLANKQFRQALYTIFTEYVYHGDYTYGQAMEAVRDILFFNSNRLYNLKQSPDSPDFDLNYLQTRGLSPVVFQTATTPTPEDILKKFLHKKSVDFIWMQWVDYTATVRVRMFPIRQFKKIVSSKHKVGICLAVMIMLQNDHLASPEPLSTGEFILTPDVTTLCRNIGLSSRSATVMTFWKNQDGGELEGCPRTILQNTVNKCQSEYGIKTLVGFEIEVVFMKISKEGSSTSYSPWFTNHSWSNITTENVQALPMIEKIVDKLADIDIHLQQFHTESGPSQFEFILPPSTPLAACDTLIQARQTITDVAAQYGVRATLHPRPIPNAAGTASHTHLSITPTTFKDNFLAGLLQNLPSVSPFTLPQDASYERIAEGIWSGGVWVAWGYQNRETPIREVSSGHWEFKPMDGLANPYLAVAAIIGSGYLGIKNRMPLTIKGCNVNTAALSPSQRAALSITTRIPSSLEESLKALESNVELQTLLGPGFVRRYVCVRRGEQKMLNAMDKEQRRNWLIERY

SEQ ID NO: 64493 - protein, 484 aa, Ajellomyces capsulatus
MEAVRDILFFNSNRLYNLKQSPDSPDFDLNYLQTRGLSPVVFQTATTPTPEDILKKFLHKKSVDFIWMQWVDYTATVRVRMFPIRQFKKIVSSKHKVGICLAVMIMLQNDHLASPEPLSTGEFILTPDVTTLCRNIGLSSRSATVMTFWKNQDGGELEGCPRTILQNTVNKCQSEYGIKTLVGFEIEVVFMKISKEGSSTSYSPWFTNHSWSNITTENVQALPMIEKIVDKLADIDIHLQQFHTESGPSQFEFILPPSTPLAACDTLIQARQTITDVAAQYGVRATLHPRPIPNAAGTASHTHLSITPTTFKDNFLAGLLQNLPSVSPFTLPQDASYERIAEGIWSGGVWVAWGYQNRETPIREVSSGHWEFKPMDGLANPYLAVAAIIGSGYLGIKNRMPLTIKGCNVNTAALSPSQRAALSITTRIPSSLEESLKALESNVELQTLLGPGFVRRYVCVRRGEQKMLNAMDKEQRRNWLIERY

SEQ ID NO: 64494 - protein, 93 aa, Zea mays
MPGSHGRPLAIDGLGRPPPVDPFQGLKCTASLPDSARSFISLGNVSNGGRILCMQVWPDYGTKKFQTLSYLPQLTTEDLLKQMDSLLCNRWIP

SEQ ID NO: 64495 - protein, 434 aa, Oryza sativa Japonica Group
MERYKVIREIGDGTCGNVFRAYNTETNEIVAVKKMKRKFFQWEECISLREVKALQKLNHPNIVKLKEVTMENHELFFIFENMECNLYDVIRERQAAFSEEEIRNFMVQILQGLAYMHNNGYFHRDLKPENLLVTDGTVKIADFGLAREVSSSPPYTDYVSTRWYRAPEVLLQSSAYTPAIDMWAVGAILAELFTLSPLFPGGSETDQLYKICAVLGTPDHTVWPEGMNLPRSSSFNFFQIPPRNLWELIPNATLEAIDLIQQLCSWDPRRRPTAEQSLQHPFFNVGNWVPRPLHASHTKTIETRPNPRLELNLWDFGTEPEDNYLDLTLSLKPSFPGTDFSNNVPEHTKEEILLYPGFENPPVQSAGFWPLVASDRPMGDVPAMSSWPQAYVVDGQATLPAVGFSGSPFGLSPLQPNLFENRSFATPIRQVNFF

SEQ ID NO: 64496 - protein, 102 aa, Zea mays
GRVGDNNAVGYFVKQGFTKEITLDKERWQGYIKDYDGGILMECKIDPKLPYVDVATMIRRQRQAIDEKIRELSNCHIVYSGIDFQKVRFFPHGLYYIGVCFS

SEQ ID NO: 64497 - protein, 285 aa, Methanothermobacter thermautotrophicus str. Delta H
MIIGCSASQKLAASVADLLDEPLCPVETRKFPDGERYIRVKEEVEGEVTVVQSTGYPQDENLMELLFMIENLKDLGADYVRAAIPYFGYGRQERRFKSGEAVSAKIVAHLLEAAGADEIVTVNLHENCLSEFFRVPVRELSAMPLIAEHISFLDDPVIIAPDKGALGHAREVSDILGCECDYMEKVRISPEVVETRVSDLDVEGKDAVVVDDIISTGGTIVNAAGILGKCGASSITVCCVHPVLVEDALLKIFSAGVERVIATDTLKSDVSEISVAPLIADVMKD

SEQ ID NO: 64498 - protein, 485 aa, Synechococcus sp. RS9917
MTTPLIPVILCGGTGTRLWPLSRASYPKQYWPLGGSGDETLLQQTQQRLEGLSGLAAPLLICNDDHRFIVAEQMRQIGVEPGAILLEPMGRNTAPAVAVAALQATARGDDPLLLVLAADHVIRDAALFRAAIEAGRADAEAGRLVSFGIVPTAPETGYGYIEAAAPLQAGSLQPVPIARFVEKPDRATAEQFLASGRFTWNSGMFLFRASAMLAELERLAPEVVSCCRAALEQDVADLDFLRLEREAFAKCPNVAIDVAVMEKTALGSVLPLAAGWSDVGSWSALWDTADRDDDGNVLRGRVISEGSRNCYLRSEHRLVVGLGVENLVVVETDDAVLIADRSQAQNVKTIVKQLEADGSPEGKAHRRIYRPWGSYTGVVEDHRWQVKRISVKPGASLSLQMHHHRAEHWIVVKGTALVERDGEQQLIGENQSTYIPLGCKHRLSNPGRIPVEMIEVQSGAYLGEDDIVRFDDLYGRSDATAALKA

SEQ ID NO: 64499 - protein, 1187 aa, Alkaliphilus metalliredigens QYMF
MDIRMNINGREIVAQNDMTILEAAIQNNIDIPTLCHDKKLETYGSCGLCVVEIVGSPKLLRACATKIQSGMLVRTKTERVKKSRKLALELLLSDHSGDCRPPCITACPGNTDCQGYVGLIANGKHEEALKLIKEQLPLPASIGRVCPHPCETACRRGLLDEPVSIAWLKRFVADIDLKNNDVFMPAIQPSTGKRVAVIGGGPGGLTAAYYLAQKGHNVVIYEAMPQMGGMLRYGIPQYRLPKEVLNEEINVIKKMGVKMLTGIKVGKDVAFDHIQADFDAVYISIGAWISPGMNCPGEDLEGVIGGINFLAKFSMNEPIRTGDRIAVIGGGNTAMDACRTSIRLGAKEVTALYRRTKEEMPAERIEISEAEEEGIAFKFLVSPIEILEKNGRVAGVRLQKMQLGEPDSSGRRQPIPIEGEEEILEVDSVIISIGQGVDTTGLNEIALTKRGMIEIDPNSYQTNIPGVFAGGDAVTTSDRVAIKSVGDAKKATGVIHAYLQGEGIPYKKPIYVEQEKTKEDFIQQDRIKRPPMPHLSPTHRSDSFEEVVIGYSVEAARADAERCLECGCHDYFECKLVTYANEYEASPKSFTGEIHHRQSDDGHPFIIRDADKCILCGLCVRTCQEVIGVGALGLVDRGFDTIIMPGLDLPLKETDCISCGQCVTVCPTGALQERLMIHKSVPLRPKKTETVCSYCSVGCKTNLNTVDSLLVKSLPVNTNSSEDGLLCVKGRFGFNISQSPERLTSPLIKEDGAFKEVSWEEALLYTAKKAQSLALLYGSKSLALCLSDRYTNEEIFLATQFGEKVLKTNNISSFNSKSGGIMNVLGYDASSNTFDELLSTETIVVVGTDFMKDHTIIGLKIKEAAKAGAKIILINPFPSLLDQWADLTVDSKDDIHFLKEIQKSLIDLGCHPNNTHGFDEVKQELEAITPGETAMEVASIYKNSKKAIIVFGQNSITEDAARCIANISVISGHIGRPHSGIIQLKPQNNSQGLRDIGIKTEIDTIKAQIENKSIKGLLLFGEDVKDTDLSGLDFFMVQDVFLTETAQMADVVFPGAAPLESRGTYTNSERKIQQCHQVIQPDHAYENWQLIIELANALSTNMFYDNPVAILNEITATHPEYFKRNTDGASKFWPVTGSPVLYEYGFGFPDKKAFLRKVGNGPIFTEQQTTNDLAHRFMEKLTIHGLV

SEQ ID NO: 64500 - protein, 366 aa, Triticum aestivum
PMEEFKTYVLKEPIGVVGLITPWNYPLLMATWKVAPALAAGCTAVLKPSELASLTCLELGAICEEVGLPSGVLNIITGLGPDAGAPIASHPHVDKIAFTGSTATGKTIMTAAAQMVKPVSLELGGKSPLVIFDDVADIDKAVEWAMFGCFFNSGQVCSATSRLLLHEKIAERFLDRLVEWAKNIKISDPLEEGCRLGSVISKGQYEKIKKFISTARSEGATILHGGDRPKHLGKGFFIEPTIITDVSTSMQIWREEVFGPVICVKVFKTESEAVELANDTHYGLAGGVISDDLERCERIAKVIHSGIVWINCSQPTLVQAPWGGNKRSGFGRELGEWGLENYLSVKQVTRYCKDELYGWYQRPSKL

SEQ ID NO: 64501 - protein, 430 aa, Wolinella succinogenes DSM 1740
MANFEGYNPRFLPLPTEGEAITLTPEGILQVPDHPIIPYIEGDGIGMDITPAMKSVVDAAVNKAYGGKRKIAWYEVYTGEKCYEKFKNEKSLSPMDQWLLPDTIDAINYFKVSIKGPLTTPVGEGFRSLNVALRQMMDLYVCLRPVRWYGSPSPVKEPHKVDMVIYRENSEDIYAGIEFAAESKEANKVIQFLQNEMEVKKIRFPKTSAIGIKPVSKEGSERLIRKAIQYAIDNDRASLTFVHKGNIMKFTEGGFMKWGYELLKREFGATEIDGGPWCSMKNPKTGKEIIIKDVIADAFLQQILLRPAEYDVIATMNLNGDYISDALAAMVGGIGIAPGANLNDSVAMFEATHGTAPKYAGLDKVNPGSLILSAEMMLRHMGWIEAADLVVSSMKKAIESKNVTYDFARLMEGAKEVKCSEFAQVMIERM

SEQ ID NO: 64502 - protein, 568 aa, Xanthomonas axonopodis pv. citri str. 306
MSHSVEDIKSESRRLRGSLEQSLADAVTGALREDDQTLIKYHGSYQQDDRDIRDERRRQKLEPAYQFMIRTRTPGGVITPTQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGSEDEPIYGERYLPRKFKIGFAAPPLNDVDVFANDLGFIAILRDGQLLGYNVSIGGGMGASHGDAETWPRVANVIGFVTREQLLDIATAVVTTQRDFGNRAVRKRARFKYTIDDHGLDTIVAEIARRAGFALQPAQPFAFDHNGDRYGWVEGEDGLWHLTLSLPAGRIADTDTAAHLSGLRAIAQLNVGEFRMTPNQNLVIAGVLASERARVDALVAHYGLDAGNQSATALARGAMACVALPTCGLAMAEAERYLPDFGAALQPLLQQHGLAETPIVLRLSGCPNGCSRPYLAEIALVGKAPGRYNLMLGGDRRGQRLNTLYRENITEPEILAALEPLLARYAAERDHANDEGFGDFLHRAGVIALPPYPTHRRLDLELLA

SEQ ID NO: 64503 - protein, 80 aa, Synechococcus sp. RS9917
MSQEAILEKVRSIVAEQLSVDAGDVKPESNFQNDLGADSLDTVELVMALEEAFDIEIPDEAAEGIATVGDAVKYIEDKQA

SEQ ID NO: 64504 - protein, 310 aa, Burkholderia pseudomallei K96243
METIAVIGSNMVDLVTYVTRMPADGETLEAPNFELGCGGKGANQAVAASKLGARVAMISKLGDDLFAENTLRNFERFGVDTEHVRRVSGVSSGVAPIFVSPDSRNRILIVKGANRHLRPADIDAAAAKIEASRLVVLQLEIDIDTVYYAIDFAAARGIPVLLNPAPGVPDLDFARLAKLEFLVPNETELALVSGMPTDTPDAVERAAGSLVERGVKHVIVTLGEKGSLLVSRAGAVRVPPVAVDARDTTGAGDAYIGCFARHYVATADIPAAMRLASAYAAHSVTGLGTQKSYADAATFERFLQTIGFGA

SEQ ID NO: 64505 - protein, 481 aa, Staphylococcus epidermidis RP62A
MKKFNIKHSFMLTGFAFMVTTSLFSHQAHAEGNHPIDINFSKDQIDRNTAKSNIINRVNDTSRTGISMNSDNDLDTDIVSNSDSENDTYLDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSDSGTSSGKGSHTGKKPGNPKGNTNRPSQRHTNQPQRPKYNQTNQNNINNINHNINHTRTSGDGAPFKRQQNIINSNSGHRNQNNINQFIWNKNGFFKSQNNTEHRMNSSDNTNSLISRFRQLATGAYKYNPFLINQVKNLNQLDGKVTDSDIYSLFRKQSFRGNEYLNSLQKGTSYFRFQYFNPLNSSKYYENLDDQVLALITGEIGSMPELKKPTDKEDKNHSAFKNHSADEITTNNDGHSKDYDKKKKIHRSLLSLSIAIIGIFLGVTGLYIFRRKK

SEQ ID NO: 64506 - protein, 273 aa, Oryza sativa Japonica Group
MAASLVHAAAASASPAPAARVGAFHPLASSSPFLRLACATASSPSTRRRRCLDAPLRALSAGSRLAAGWGAPRTRRVIATFAGEESVGSESGDDKEKGKGEMKPEEAQEVWKEMLKQFKDEAQRMHGLTLQAYGVYSQRAREVLLEASEKLKIHADKAQKDLSVIATEVGEEGQEYLKLAAQNSPDSIKDIIETFNSLGKLKISEYEDYHVGIPFGNFLTVGGFLNFMLTGRTSAIRFGIILGFALLAMGISSLRSQRAGGRRPRLLLKGQAG

SEQ ID NO: 64507 - protein, 230 aa, Saccharomyces cerevisiae
MFKSVAKLGKSPIFYLNSQRLIHIKTLTTPNENALKFLSTDGEMLQTRGSKSIVIKNTDENLINHSKLAQQIFLQCPGVESLMIGDDFLTINKDRMVHWNSIKPEIIDLLTKQLAYGEDVISKEFHAVQEEEGEGGYKINMPKFELTEEDEEVSELIEELIDTRIRPAILEDGGDIDYRGWDPKTGTVYLRLQGACTSCSSSEVTLKYGIESMLKHYVDEVKEVIQIMDP

SEQ ID NO: 64508 - protein, 308 aa, uncultured proteobacterium eBACred25D05
MSSIIYTYVNNNCHYRSIAVLDKRIEAAVRRGVGVFGKKLPVPQKLDDAIQYSVFPGGARIRPTILLSVAVACGDDNPSLANASAAALEMIHCASLVHDDLPCFDNAETRRGKPSVHNKYGEPTAVLVGDSLIANAFGVIARAADKDAVRAAKLIALLSKYTGFPKGICAGQAWEAEISVDLSAYHQTKTGALFIAATQMGAASAGHDPEPWFELGARIGEAFQVADDLLDVLCSEDETGKPSGQDVTNQRPNAVSEYGISGAKQKLRDILGGAISSIPSCPGEAKLAEIVKLQSNRLLPKEHMKPVA

SEQ ID NO: 64509 - protein, 479 aa, Pseudomonas syringae pv. phaseolicola 1448A
MRSGWRVIHYATFLFCRSTVVTNTAFNSLPLSAAMLANLESLGYAEMTPIQAQSLPVILKGMDLIAQAKTGSGKTAAFGIGLLNPINPRFFGCQALVMCPTRELADQVAKEIRRLARSEDNIKVLTLCGGVSFGPQIGSLEHGAHIIVGTPGRIQQHLRKGSLVLDGLNTLILDEADRMLDMGFYDAIADIIEQTPQRRQTLLFSATYPVGIKQLSSKFMRDPQTVKVEALHADSQIDQIFYEISPEQRLEAVVKVLGHFRPASCVAFCFTKQQVQEVVDHLTAKGMSAVGLHGDLEQRDRDQVLAMFANRSTSVLVATDVAARGLDIDALDMVINVELARDSEIHIHRVGRTGRAGEKGIAVSLVAPSESQRARAIEELQKAPLNWQQYDQLSIKEGGKLLPTMTTLCIGSGRKDKLRPGDILGALTGEAGIAGTQVGKIAIFDFQAYVAVERSMAKQALERLNNGKIKGKSLRVRIL

SEQ ID NO: 64510 - protein, 305 aa, Aspergillus oryzae
MTASKDLPPDTTPYYYLKIFLKSQLCTKAQLPPKNTTLIDKVAIVTGANTGLGLESSRQLLSYNLSLLIIAVRSVAKGEIAAATLRKEYPIATIEVWNLDMSSYDSIRAFVRRTETQLSRLDIVILNAGLQNMQFGVVPSTGHEETIQVNYLSTVLLSILLLPVLKNKSTVGTPGRLSIVSSGTALFARFPHRKFSLLLPSYDDPKNFDLIEQYSASKLLGHMFMWKLADYVSADDVVVNLVDPGFTKGTQLQRDVSGVVSLAMSLAKVITARTVRDGASTYVDATVVKGKESHGCFVMDWQIRP

SEQ ID NO: 64511 - protein, 175 aa, Triticum aestivum
MPPPVRASSPTSVGLFGGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVKFIPFHPPGCEESGKA

SEQ ID NO: 64512 - protein, 791 aa, Pseudomonas syringae pv. phaseolicola 1448A
MVEYVVSLDKLGVHDVEHVGGKNSSLGEMISNLAGAGVSVPGGFATTAQAYRDFLELSGLNDQIHAALDALDVDDVNALARTGAQIRQWIMEAEFPETLNAQIRTAFAELSAGNPNLAVAVRSSATAEDLPDASFAGQQETFLNIRGVENVIRAAKEVFASLFNDRAISYRVHQGFDHKLVALSAGVQRMVRSETGTAGVMFTLDTESGFRDVVFITGAYGLGETVVQGAVNPDEFYVHKDTLAAGRPAILRRNLGSKAIKMIYGEEAKAGRSVKVIDVEPADRARFCLTDAEVSELAKQAMIIEKHYKCPMDIEWAKDGDDGKLYIVQARPETVKSRASANVMERYLLKETGKVLVEGRAIGQRIGAGKVRIIKDVSEMDKVQPGDVLVSDMTDPDWEPVMKRASAIVTNRGGRTCHAAIIARELGIPAVVGCGNATQTLQDGQGVTVSCAEGDTGYIFEGELGFDIKTNSVDAMPELPFKIMMNVGNPDRAFDFAQLPNAGVGLARLEFIINRMIGVHPKALLNYSLLPPEIKESVDKRIAGYHDPVGFYVDKLVEGISTLAAAFTPKKVIVRLSDFKSNEYANLIGGKLYEPEEENPMLGFRGASRYISENFRDCFELECRALKRVREEMGLTNVEIMVPFVRTLGEASQVIDLLAANGLKRGENGLRIIMMCELPSNAILAEEFLEYFDGFSIGSNDLTQLTLGLDRDSGVIAHLFDERNPAVKKLLSNAIQACNKAGKYIGICGQGPSDHPDLARWLMDQGIESVSLNPDSVLETWFFLAEAHAPV

SEQ ID NO: 64513 - protein, 297 aa, delta proteobacterium MLMS-1
MIVAIGEVVWDIFPQRRVLGGAPVNVAYHLVALGEPVRVITRIGYDELAAATGERLSQLGLPLEGVQRDLRLPTGQVRVSFGDDNEPLYDIVAPAAWDNIEPAAALAAAGEGDFDLVFGTLAQRAATSRRAIRQLASRARRRFYDVNLRPPFTTAELVLESLELAELVKVNEQELRQIAGWLGLGGGQREADLHELAALIHQRCQLEALVVTAGPAGAWVATAAGIASAAGEPVTVADTVGAGDAFFATLIAACRRQLASGLAPAALPWPEILSRANRRGAYVASQPGATPAMPAGL

SEQ ID NO: 64514 - protein, 641 aa, Bordetella parapertussis 12822
MIRASGLTLRRGTKVLLDGADFVVHPGERVGIVGKNGAGKSSLFALLTGALDPDAGNLDLPAGWRIASVQQEIAADAQAAREFVIDGDTHLRALQAQRAALTDDQGTQIAETEAALIEAGAWSAASRAEQLLAGLGFKPSEWMQPVRSFSGGWRMRLALARALMAPSELLLLDEPTNHLDLDAMLWLEKWLTAYPGTVLLISHDTEFLDAVARAILHFDQAKLQRYRGGYQDFLLQRAERLRQANIAYERQTREAARLQGFIDRFKAKASKAKQAQSRVKALARMEALAPIHAESGIDIRIPSPDHMPDPLLAMEHMDAGYGGAEPILRDVTLMVRAGSRIGVLGANGAGKSTLIKTLADELAPHAGTRRASRGLAIGYFHQHQLDMLDLDSTPLAHLARLAPEVREQELRNYLGGFGFSGDTVLSKVGPMSGGEKARLALSLIVWQKPNLLLLDEPSNHLDVETREALATALAEFSGSMLLVSHDRHLLRTTVDSFWIVADGGVREFDGDLEDYRDWLAARNAGERAAAREAAAGEPGVAIDRKAQRRLEAEQRQRLATLRKPLAAKLAKVEADMERARARLQELDAVIADADLYSDARRTERQQVMTEHGESGKRLNDLEEQWLEIQQALEEIEQDNAA

SEQ ID NO: 64515 - protein, 443 aa, Methanothermobacter thermautotrophicus str. Delta H
MALAVYLVPLPGLRASGHAALALLVFAVTMWATEAVPLAVTSLIILFAQPLIGVESFENAVIGFANPILFLMIGGFIMAEAIRKSGLAQRFTYYLLGRLGTSPERGLFVSIFSTGLLSAWIENVVAFAMLLPIIKEIVDIMGCSEPEKGKSNYAKAMILGASFGSLAGGFGTEIGTAPNLMAAAYTSIPFLNWMIFGLPLSIAMLLVTWFLLMRIFPSEVRALENGDALIGERIRMMGSMSRDEKLSAGILLFAILLWVTAGFTGINSYSVSLIAAVMFIFAGVITWKDAQKNIDWGLVVFFGGALSLGSALLKTGAAAWIIDKLVGMLGSDPSTVIVMLVLMAVAVIITQVMSNIALSAILVPLSVTLASAQHQPIGVYAVPVAIACSLSFMLPMADPTVAMAYGSGYVKLRDIPRAGIPIIAVGIILTVLVITTLAAPFIS

SEQ ID NO: 64516 - protein, 238 aa, Arabidopsis thaliana
MSLASIRRLAAGAAVIAAASGGAVYLSPSVASSDKGGGPILDSLRRRLGDGGVRYLEKAVFNLDYGQLKLVFHALEERKQLIENAPHLCHALPCMTPCFDWFEVIYFWMGLKMYDLVAGPRLLHLSRYYSAKESIELFPTLARKGKDKNLRGTVVYYDGQMNDSRLNVGLACTAALAGAAVLNHAEVVSLITDDATKRIIGARIRNNLTGQEFNSYAKVVVNAAGPFLLNTIKLELEG

SEQ ID NO: 64517 - protein, 222 aa, Chlamydophila pneumoniae CWL029
MLMMLMMIIGITGGSGAGKTTLTQNIKEIFGEDVSVICQDNYYKDRSHYTPEERANLIWDHPDAFDNDLLISDIKRLKNNEIVQAPVFDFVLGNRSKTEIETIYPSKVILVEGILVFENQELRDLMDIRIFVDTDADERILRRMVRDVQEQGDSVDCIMSRYLSMVKPMHEKFIEPTRKYADIIVHGNYRQNVVTNILSQKIKNHLENALESDETYYMVNSK

SEQ ID NO: 64518 - protein, 426 aa, Zea mays
  misc_feature (220)..(220): Xaa can be any naturally occurring amino acid
  misc_feature (248)..(248): Xaa can be any naturally occurring amino acid
  misc_feature (283)..(283): Xaa can be any naturally occurring amino acid
  misc_feature (300)..(300): Xaa can be any naturally occurring amino acid
MQWLMESGGVGLRFRACWMVQRTLGLLRSYAHVRSYNSQLSALVSATSECSNLPRRCYYLPNPSPYQVWSRSFASDNGDKFEAVVPFMGESVTDGTLANFLKKPGLSLASTPSPCDNISFFLTDRGDRVEADEPIAQIETDKVTIDVASPEAGVIEKLIASEGDTVTPGTKVAIISKSAQPAETHVAPSEEATSKESSPPKVEDKPKAGRKAPEVDHPRXMRTPKPTAPSKTSPSEPQLPPKERERRXRIANRLKDSQNTFAMLSTFNEVDMPRKAKTRNSLXFGDGVNLLCLSLTETSXGLVVPVIRDADTMNFADIEKGINNLAKKANEGALSIDDMAGGTFTISNGGVYGSLLSTPIINPPQSSILGMHSIVQRPVVVNGDILARPMMFLALTYDHRLIDGREAVFFLRRIKDVVEDPRRLLA

SEQ ID NO: 64519 - protein, 394 aa, Heliobacillus mobilis
MNKKTIKDIDVKAKRVLVRVDFNVPVNDAGVITDDTRIRAALPTIQYLIQAGAKVILASHFGRPKGKVNDKYRLTPIAGHLSELLNRSVKKLDDCIGPDVEAAVKEAQPGDVILLENVRFYPEEEKNDPEFSRKLASLADVYVNDAFGTAHRAHASTAGVAAYLPAVAGFLMDKEISIMGKALAQPERPFVAVMGGAKVADKIAVIENLLNKVDTLIIGGGMANTFFYAMNLEVGKSLCEKDKADTARELLQKAEKAGVKMMLPVDVVIADTLAANVPTEVVPVNAIPADKSALDIGPESVKQFAQALSASKMVLWNGPMGAFEVEPFDRGTMGVAQAMVNVQGTTIIGGGDSVAAVEKAGLAEKMTHVSTGGGASLEFLEGRELPGVAALLDA

SEQ ID NO: 64520 - protein, 335 aa, Heliobacillus mobilis
MAVRIGINGFGRIGRLATRVALANPEVEIVAINDLTDAKTNAHLFKYDSVHGTYPGQVTVGEDNIEIDGRPIKVFAQKDPAAIPWGDVGVDIVIESTGLFVDGQKAAAHFQGGAKKVIISAPAKNEDITIVMGVNEKEYDGSKHKIISNASCTTNCLAPVAKVLNDEFGIIKGLMTTVHSYTNDQKILDQTHKDLRRARAAAMSIVPTSTGAAKAIGKVIPALDGKLNGFSMRVPTPNVSVVDLVVDVKKKTTIKEVNDALKAAAEGPLQGILGYNELPLVSRDYNGTHLSSVVDGLSTMVLDGDMVKIIAWYDNEYGYSVRLIDLALYVASKGL

SEQ ID NO: 64521 - protein, 319 aa, Xanthomonas axonopodis pv. citri str. 306
MALYDNILDTIGRTPVVKLQRLAPDNVTLYVKVESFNPGGSVKDRLALAIILDAEQRGLLKPGDTIVEATSGNTGVALAMVAAARGYKFVATMVETFSIERRKLMRAYGAKVILTPAAERGSGMVRKAKELAEQHGWFLASQFANPANPAYHRNTTAAEILRDFAGHRLDHFVTGWGTGGTLTGVGEVLSVARPEVRITASEPAGAALLQGQDWKPHKIQGWTPDFIPEVLNREVAHEVLSVEDTDAITVARRLAAEEGIFTGISGGATVATALRVAEGAVPGAVILAMLPDTGERYFSTPLFADINEGSDDDWLAGLP

SEQ ID NO: 64522 - protein, 312 aa, Heliobacillus mobilis
MTKIATRDAYGRALAQLGGENQDIVVLDADLAKSTKTIDFAKVYPERFFDMGIAEQNLIGVSAGLAAAGKIPFASTFAMFATGRAFEQIRNSVAYPKLNVKIAATHAGISVGEDGASHQTVEDIALMRAIPNMTVVVPADGIETEAVIRWAASYSGPVYIRLGRLAVPVLYDENYRFEWGKAVTLRSGKDVTFIATGLMVAMAMEAAELLSAEGIEAEVLNIHTMKPIDAEAIGASVQRTGAVVTAEEHSIIGGLGSAVAEVLAEHCPAPLERVGLKDTFGESGKPNELFEKYGLTKEALVAAAKKAVSRKK

SEQ ID NO: 64523 - protein, 375 aa, Oryza rufipogon
WSKMCMQPDVKPNKRKSRGSRKERSRTQAPLLPGLPDDLAIACLIRVPRVEHPNLRIVCKRWNRLLSGNYYYSLRKRNGMAEEWVYVFKRDREGKISWHAFDPLHQLWKSLPPVPVEYSEALGFGCAVLSGCYLYLFGGKDPLRGSMRRVVFYNARTNKWHRAPDMLRKRHFFGSCVINNCLYVAGGECEGIQRTLPSAEVYDPNRNRWACVAEMNNGMVPFIGVVYDGKWFLKGLDSHRQVTSEVYLPSSNLWSTIDDEMVTGWRNPSITFNGKLYSSDCRDGCKLRVYDPNTGTWAKFMDSKHHLGSSRAFEAAALVTLNGKLCIVRNNMSITLVDISDPTMSIETDSARMWETVARKGQHRSFVANLWSTIA

SEQ ID NO: 64524 - protein, 334 aa, Xanthomonas axonopodis pv. citri str. 306
MSIEQLAETAQAMVAPGKGIIAIDESTSTIAKRFASVGIENIEENRRAYRELLLTTPKLSDYISGAILFDETIRQKTKDGVPFAEYMTAHGIIPGIKVDKGAQPLAGMPGELVTEGLDGLRARLEEYYTLGARFAKWRAVINIGEDIPSGTCIEANSHALARYAALCQEQGLVPMVEPEVIMDGSHDIETCYEVTEATLRSLFGALYEQNVVLEGTILKASMVISGKSCEEQASIEEVAESTVMCLKSTVPAILPGIVFLSGGQTDEQSTAHLNEMHQLGNLPWPLSFSYGRAMQQAALKLWAKDMTGNFAKAQQVIYERAKENGLAALGKWKG

SEQ ID NO: 64525 - protein, 285 aa, Gracilaria tenuistipitata var. liui
MLNNFERVQILSDALPFVQRFHGRTLVVKYGGSAMKNVYLKSKIIEDILFLSYIGIKVVIVHGGGPMINHWLKQVNIQPKFFNGIRVTDKDTMELVEMVLVGKVNKDLVTLLNRSSNLAVGLSGKDANLVVASSFFPDQKDNYTGKVQQVNIEIVNLLLSSGYIPVVASVASDLNGQAYNINADSVAGAIAECLNAEKLILLTDTPGIMSDINDPSSLIKYLNISQLEELKSQKIILGGMIPKVDCCIKALQGNVSSAHIIDGSVEHALLLEILTSAGIGSMLVL

SEQ ID NO: 64526 - protein, 533 aa, Ustilago maydis
MSIANASSSTASHDLDAADADPCPSACTSVSALCNMSTLPSPRPFGYRPTYVPAMVASGVSAVTVTTNSHRPPSKSHSISSVDSLASVSSNAPSTPTHDADDVRFEMAVIPKLVRASADAYLDRVGKPLPPSPAPQIVATSATTKTNAQAARSVAAAAAAAAAAAAVPPSHSALRNENHKNAISFRVGSKYKVCEIIGEGAYGVVCSAIHRATGQKVAIKKIQPFEHQMFALRTLRELKLLRFFQECDVSENIISILDIIKPSTYEAFTEVYLVQELMETDLHRVIRTQELSDDHCQYFTYQTLRALKPMHCADVIHRDLKPSNVLLNANCDLKVCDFGLARSVLTADQDTGFMTEYVATRWYRAPEIMLTFKQYTKAIDAWAVGCILAEMLTGRPLFPGRDYHQQLSLILDVLGTPTLEEFQNINSRRSRDYIRSMPFRKRREFRTLFPKASPEAIDFLQKTLTFDPRNRLTVEECLQHPYLSAYHDPDDEPGAPRLDPDFFYFDMQKESITKEDLRKELWYQVQEFQPLLR

SEQ ID NO: 64527 - protein, 499 aa, Rickettsia conorii str. Malish 7
MLSTSSRSFKNKFRAAFWPVHNYELGKFIPMSTLMFCILFNQNVLRILKDSILISEISAEIAGFAKVYCVTPAAALFVIIYAKMINYLTFEKIFYYLSAFFISFFVLFTFVIYPNIHIFHVHPNNLADWMERYPHFKWYISLVGNWGYIVYYSLAELWPNIFYVLLFWQFANELTTTEEAKRFYTLFSLFGNSSLILVGFLMMNLSSEDTIIKKFMSISDSKITLVQVSTTIVAIVAIICCLLVRFISKNVFTNPLFYAKAKSGRSTSERMGLIKSFKYIAKSKYLWLLLICSAAFGFAINLVEAVWKAKIKELYPTVNTYAEFNSLYILWTGVAIMVMTIIGNNIMRMHNWFVAAVISPVIIMVTGILFFVLIVFDQQILSLFDGAILMSPLALAVSIGGIQNILAKGTKYSIWDTSREMLYIPLDEELKTKGKAAVDVISAKVGKSSSGLVQSIIFTLVPTATFTLISPILMVVFTFVCLAWIYAVRKIYCEYQKIA

SEQ ID NO: 64528 - protein, 539 aa, Coprinopsis cinerea
MFKNLLSFALLAISVANAQIVNSVDTMTLTNANVSPDGFTRAGILVNGVHGPLIRGGKNDNFELNVVNDLDNPTMLRPTSIHWHGLFQRGTNWADGADGVNQCPISPGHAFLYKFTPAGHAGTFWYHSHFGTQYCDGLRGPMVVYDDNDPHAALYDEDDENTIITLADWYHIPAPSIQGAAQPDATLINGKGRYVGGPAAELSIVNVEQGKKYRMRLISLSCDPNWQFSIDGHELTIIEVDGRLTEPHTVDRLQIFTGQRYSFVLDANQPVDNYWIRAQPNKGRNGLAGTFANGVNSAILRYAGAANADPTTSANPNPVQLNEADLHALIDPAAPGIPTPGAADVNLRFQLGFSGGRFTINGTAYESPSVPTLLQIMSGAQSVNDLLPAGSVYELPRNQVVELVVPAGVLGGPHPFHLHGHAFSVVRSAGSSTYNFVNPVKRDVVSLGVTGDEVTIRFVTDNPGPWFFHCHIEFHLMNGLAIVFAEDMANTVDANNPPVEWAQLCEIYDDLPPEATSIQTVVRRAEPTGFSAKFRREGL

SEQ ID NO: 64529 - protein, 500 aa, Burkholderia pseudomallei K96243
MTQTDLVAVADTVRAFTEREFGVFIDGAMRAAHSPRRLDVFDPATGARLSRVPDADAHDVDAAVASAQRAFDARAWSGLRPAERERILLKLADVLEAHAEELAQLETLNQGKSILVSRGVEVGATIEYVRYMAGWATKITGQTLDVSIPFPPGARYTAYTRKEPVGVVAAIVPWNFPLMIAVWKLVPALAAGCTVVLKPSPETPLTALRLAELALEAGVPAGVFNVVTGARACGAALASHPAVRKISFTGSTATGKLVGAAAVQNMTRFSLELGGKNPIVMLEDVDVDAALGGVAAGAFFNQGQVCAAASRIYVHRSRFRRLAEGLAGVASAMRLGPGLDPAAQINPLVSAHHRDTVARHIDAARREGLTFLAGGTRADDLPGYFVRPAVIADAAHDSAIVRDEVFGPVVVVLPFDDPAEAVRLANASPYGLAASLWSNDLKAVMDLVPQIEAGTVWVNCHIPLDPSMPFGGYKQSGIGREFGQYAIEGFTETKSVCIAH

SEQ ID NO: 64530 - protein, 449 aa, Burkholderia pseudomallei K96243
MSYNDSRFWHPMLHPNDMKRREPIRIVRGDGCHVYDERGRQLVDGVAGLWNVNVGHNRAEVKEAIVRQLDELEYFQLFDGITHPRAEELSSKLIDMMEPEGMRRVLYSSGGSDSVETALKIARQYWKVRGQADRTKFISLKQGYHGTHFGGASVNGNTVFRRNYEPNLPGCFHVETPWLYRNPFTQDPEALGRICAELLEREILFQSPDTVAAFIAEPIQGAGGVIVPPANYWPLVREVCDRYGVLLIADEVVTGFGRSGSLFGSRGWGVKPDIMCLAKGISSGYVPLGATAVNARIEDAFAANADFGGAIMHGYTYSGHPVACAAALASLDIVLREDLPANAAKQGAHLIEALRPFVERFDALGEVRGKGLMVALDLVADKATRAPIDPMSGYANAVAEVARENGVLVRPVGTKIILSPPLVIQREQIDRIVAGLEAGFAATPFPGGR

SEQ ID NO: 64531 - protein, 579 aa, Yarrowia lipolytica CLIB122
MATEHVEHAENAKQSPQPSFSGSESGRIGRYQIIKTLGEGSFGKVKLAYHLATHEKVALKIINRKTLAKSDMQGRVEREISYLRLLRHPHIIKLYDVIKSKDEIIMVIEFAGKELFDYIVQRGKMPEDEARRFFQQIISAVEYCHRHKIVHRDLKPENLLLDENLNVKIADFGLSNIMTDGNFLKTSCGSPNYAAPEVISGKLYAGPEVDVWSCGVILYVMLCGRLPFDDEFIPNLFKKISNGVYTIPPYLSAGAKHLLQQMLVVNPLNRITVQGIMEDPWFKQGIAEYLVPRDLKPDQVEIDDKVVGALSDTMGYDRDQVYEALKAPKSDGTEIRDAYDLMKENRQQLEKDSTVFDKVDESGKPKHQFSRKNPPALTFDSHHMPTIVDHSDLRTPNTTIAVLPSSLPAYHRANMMAHGPATLRKLNPISSRKSKTRWHFGIRSKSYPLDVMGELYRALKNLGAEWAKPSENDLWTIRVRWRYTPEKDESDSTTKPDSGLLKMQIQLYLLEQNSYLVDFKFDGWECETESGEIKTRDVAQVSNSKSANETFTFSAYPFLHLATRLIMELAVSSQKESEK

SEQ ID NO: 64532 - protein, 396 aa, Mesorhizobium loti MAFF303099
MLAHRTNLFGTSGTAAARAAAKAAADAGKEIIDLTAGEIWSELAPTIRDGAIDAINKGVNRYTDTVGMVELREALARKISLDTGQIWKAEEVAVTSGAKQALFNAAMVLLNPGDEVIIPAPYWTTFPAQVLIAGGTPVFVDTRSNGYVPRPEHIKEAVTERTRAIVVNTPSNPAGAVYDVETLMAIAQLAVSHNLWIIFDECYGDFVHEDHTHHPIVSVAPEIRARALIVSSFSKSLALTGWRIGYLAGPKEVINAVNALQSHTTSNPNVIAQHAVLAHLQRGGSDYEGKLRSRLTSARRIGLDVLAWLTRVPVPRAQGGFYFYLDLSHLLRSASEDGASTTADDIVTALLAETGVAAVSGAAFGDPAGLRLSYGIPSEKLATGLARLVEFLNSWK

SEQ ID NO: 64533 - protein, 404 aa, Bordetella parapertussis 12822
MLKSCPMNPRLDALHPYPFEKLRALLADAGKPTHDLPPINLSIGEPKHAAPACVGQAIAANLAGLSVYPSTKGEPALRQAISQWLSRRYSIPAPDPESEVLPVLGSREALFAFAQTVIDPSAGALVVCPNPFYQIYEGAALLAGATPYYVNADPARDFGCDWARVPDEVWRRTQLVFVCSPGNPAGNVMSLEEWRTLFELSDRHGFVIAADECYSEIYLDEDNPPLGSLQAARRLGRDRYTNLVAFSSLSKRSNVPGMRSGFVAGDAALLARFLLYRTYHGSAMSPVVSAASIAAWSDETHVQENRRQYRAKFEAVLPILQNVLDVRAPQASFYLWAGTPGSDTAFARELYGRTGVTVLPGSLLAREAHNANPGQGRIRIALVAPLDQCVQAAERIAHFARTSI

SEQ ID NO: 64534 - protein, 441 aa, Desulfitobacterium hafniense DCB-2
MKICVVGAGYVGLVSAAILADWQHNVVCVDHNEQKIEDLLAGKLPIFEPGLQELVELNRRRQYLRFTAEMAEALRGCEMIIVAVGTPPAENGHPNLEDFWAVVKSFRENVGNNVIVMIKSTVPVGTGEAVSLYLNEKVSHTFSVVSAPEFLRQGTAVHDFLHPDRLVVGCMSPEIREQMKELFQPLDCPKVFTDWHSAEMIKYASNSFLALKISYINTIANLCEAVGGNIQDVAAAVGLDHRIGQAYLKPGVGFGGSCLAKDTQGLIAQGEVHGVNVWMFKDVLEVNYEQRVHIVQRLTEVLGNLKGRKIAILGLAFKANTDDLRDAPSVTIIAQIIKLGGLVKVYDPVVDSSSLPNIISVSTADNPYAACQGVDAVIVLTEWEEFLDLDLKRLQKSMNAPVFIDGRYLFERKRLLEAGFFLPERPSSSEWPVVQSMISAR

SEQ ID NO: 64535 - protein, 184 aa, Arabidopsis thaliana
MGGLKRRISIEKIQKKESRAVCFSKRRTGLYSKAAELLCLLSSDSQVAILTTPCSSNSHVSFYSFGHSSVDSVVSAFLKDQGLVRKENLGDHQEDVKINNDIKIKNLVSHETLNLQLSSATFGVPDDDRLKEETEMVVFDDQILAIFESNDKPTGNLEDQEIDLDQFLDFDQLIDFEGLIDGDY

SEQ ID NO: 64536 - protein, 1078 aa, Gibberella zeae PH-1
MEIIAKERVCPMKHKMNALEQMWDQVPATIQHAVELIQRVGEEYIWVDRLCIVQDDYETKQEQISQMAFIYGNAYFTIVATAAHSAEEGLKGIKDVSPSMYHNVWPERANMDHYGLVAWSPWNERGWTLQELVFSQRSLFFHKNELTWECHCAIWHERMQLADIGETSCLGTHNPNARGFRYSPWPDLQEFHQLATSYSRRQLSFSSDILPAFAGITTALAHSFPGGFLFGLPEVAFDVTLLWRSAGPASRNSKLGEASVPSWSWMVCLDQKISVDLSPWASGFAYLAGSSSEQSDEGGRRTYTPLHVAYQQEWNSRWSRKRPPAGVLDGLVTESICSWYVKEEAGERLISNDLDEFKDCSHHQSNELPMGWKRDGDLFYHLVDPQRRFKYPIPLVTNEDDIFIEKYLSFLIKTRTERAFFYNTPEPYGQAVSMLEGEAVVNICNNEQVWVGCLRVQTRTILWRLLTKKVECELVAISKGYIDSSAGGWSRLDEHEALKSRELERYEFYNVLFIEWKDGVAYRQGIGRVDKTAWEDPVSKPTSTTMMSRASVAVIGAGPTGITMLKQLLQDGFNATLFERRSQVGGLWAYDAKHGWTSALDSTTANISKYTCGFTDYPIPDRYPVHLTPADFQEFMQGYAEHFGLLKHITFDTSVKVVNRNKEDNGWDVQVENVESGQTDTRHFDKVAFCHGYQTLKKMPIFPGQDHYKGDLMHAQQYRSPESFKDKTVVILGLATTTDDIAPQVVSVAKKVFVSHRSGQIVVRRFRKGTPSDLLVSWRRRVISQWIAKNLPNTYRFLANTLAKLLSSQMAGMKLDPAWRLKDFKDLTLSLPGIIENVLPLLKDGSVTSLHGIKRFTGGKSIEFEDGTIIDDVDSVIFTTGYQCDFSPAPFVEKSIPKLPNYGGPSIHRLYMNVFPPKYADSCVMLCFSAYGKNNGFSFSDVMNMAISNIWRGVSNLPSHQEMEQWVDHHHEWLASNWAREPTVDLSMVKQYEFQPWMHKQAGTGMENLGWGWAGWKFWWKDRKMYNLMNHGVETAHMFRFFETGMRSTWDGARDEIIRQNRIVKEAFGGKKNKTRSD

SEQ ID NO: 64537 - protein, 170 aa, Desulfitobacterium hafniense DCB-2
MDFDKYIRVIDDFPKPGISFKDITTLLKDGEAYRAAVDAIVERVRESQPDLIVGPEARGFLLGAPVAYALGIGFVPVRKPGKLPGKTVSETYELEYGSDTLEVHADAIQPGQRIAIVDDLLATGGTTSATARLIEKTGAQVAGMSFLIELGFLEGRKRLEGYEVFSLIKY

SEQ ID NO: 64538 - protein, 169 aa, Triticum aestivum
MSHFAAMKSPVPVAAAAATDAKSPLFCPKPRRPVAPLRCHQSSHSDAGAGMDLLDLLLSKGDESNLSAASPQPPLFCGSPPRRASNPVVHDSRFGMDCPSSPLPWWPVMSPVTPAPVVVRPTPRPAGPPMSPRSSAGCARVFQPAVRVEGFDCLDGGRSGRGHGIAAMV

SEQ ID NO: 64539 - protein, 395 aa, Chlamydophila pneumoniae CWL029
MSFFNHIPTFSPDAILGLQNVFFADKRPEKVNLVIGVYEHPQKRYGGLSCIRKAQTVILEEEQNKSYLPISGLQIFLDEMRELVFGAVDPSAIVGFQSLGGTGALHLGARLLSVAKGSGKVYVPEQTWSNHIRIFSQEGLEVIRYPYYSKEQKQLLFEPLIAFLKEVEKNSVILLHGCCHNPTGVDFTEDMWKELAILMKERELIPFFDTAYQGFAHGIELDRKPIEIFISEGNTVLVAASSSKNFALYGERVGYFAVHSTFTDELVKIHSFLEEKIRGEYSSPQRWGVEIVSTILSNPYLKEEWQSELNFIRESLGKMRTRFVQALRKVAGHTFDFLLSQHGFFAYPGFSDKQVLFLREQHAVYTTAGGRMNLNGITEKNIDHVVQSFIQAYEL

SEQ ID NO: 64540 - protein, 121 aa, Triticum aestivum
  misc_feature (115)..(115): Xaa can be any naturally occurring amino acid
MSSTATVTRAHLENKLALARRCSREATLAGAKAAAIATVASAVPTLASVRMLPWAKANLNPTGQALIVCTVAGMAYFVAADKTILSLARRHSYESAPDHLKDTSFAGAAAATVPXPAFFRP

SEQ ID NO: 64541 - protein, 406 aa, Methanothermobacter thermautotrophicus str. Delta H
MELIVAKFGGTSIGNGRRIKKAARSVVKEYMKGRKVVVVVSAINKTTDELLQIVDEAMEDAVTEKQLAEIVSMGEMTSVRIFSSAIEALGVKSEYIDPFMDEWPIITDSNLLNAKVDFEATEEKSRELLKLLDQGIIPVVCGFLGRDPNGYITTLGRGGSDITAFLLGHCLKADEVIIVTDVGGVMSTDPNKLQGAKKLDKISVEEMRDLATHGAQVLHPHALKYKDPDIKAKIIGFEHGDLSAPGTEIIGPSKNKMVKTTTLNPDPISVVAVVGEKILNKPGILARLTSRLAENSINIIGISTGQNSVTIFVDKKDADEAHRLLHDVVIADDDLSSLSLGRDIAMITISSPDFIDTPGIISEITKPLRDNDLNIVEISSSQTSVVIFVDWNDGKKAYELVRGVLE

SEQ ID NO: 64542 - protein, 303 aa, Fremyella diplosiphon Fd33
MVGLAKGTQRHHYYLQITSMAALNGRDLLSLADLSSTELQELLQLATQLKSKQLKLHSNKVLGLLFSKASTRTRVSFTVAMYQLGGQVIDLNPNVTQVSRGEPVQDTARVLDRYLDVLAIRTFAQQELETFANYAKIPVINALTDAEHPCQVLADLMTIQECFGTLKGLTLTYVGDGNNVANSLMLGCALAGMNVRIATPQGYEPDNKIVEQARAIANNQTEVLLTNDPEIAAKGAAVLYTDVWASMGQESEADDRFPIFQDYQISEQLLSLADREAIVLHCLPAHRGEEITEAVIEGSQSRV

SEQ ID NO: 64543 - protein, 634 aa, Heliobacillus mobilis
MMGRLFGNRYEIVELLGSGGMAQVYKAWDKLLERAVTIKLLRETLTSDEEFVRRFRREAQAVAGLSHPNIVNVYDVGREGDIDYIVMEFIDGPTLKEVIRSRAPLPPEEAVELGKQISDALEHAHERGIIHRDIKPHNILLNRNGRVKVTDFGIARSVAQNTMTMDRTIVGSVHYLSPEQARGLPVDEKSDIYSLGVVMYELLSGRVPFQGETPIAVALQQIQQTPPPLTTVNQRIPQSLENVIFRAMEKEPSRRYANAQAFRKDLENVFSGKIVGRLPVKDDDSPTMRFDNVIDTSIPVLVNEEAEPVEDGKEKLKAKAKPLQKRQIGLWIGSLIALAIVLFGLTYAWQQYMSVPEATVPKVTGMRHIDAIKALQAAGLEYQINEVNHPDVAKEIVISQDPPENTKVKKTRVVVLTVSKGQKVVKVPSVVGMSQRDAVVALQQANFNVEVIEQSDDKIPPGTVISQTPGANAEQPVETVVRLAVSKGQGQDAKGTMPSLVGTKLADARAKLEPLSVDLKLKTQENSGLEAGTILAQDPAPNSPVKPGDPVLLTVSGTAAPAQTAKTTSVSFLIPNDGKDHMVKIVVQDSRGNREVYNRQHHAGETVNQEVSYTGKGTIQAYSDAVMVLNRQVE

SEQ ID NO: 64544 - protein, 501 aa, Xanthomonas axonopodis pv. citri str. 306
MCVKFRGFYREAIMKERQRRTKILATLGPATDAPGVLDTLFKAGVNVVRLNFSHGDPSGQAKRAAEVRAAAARVGAEVGILADLPGPKIRIERFAEGKIKLTMGDRFDLVADANAPAGDQTQVGVSYLGLPQDVTAGDVLLLDDGLMQLQVTDVQGARIVTKVLNDGVLSDRKGLNKQGGGLSLGALTERDKELIGIVAKIGVDFIAVSFCRNAQDMHDARQIAQQHGCDAQLVSKIERTEAIENLVEIVEASDVVMVARGDLGVEIGDAELPGLQKKIIRESLAQNKVVITATQMLQSMVESPIPTRAEVLDVANAVIDGTDAVMLSAETAAGAYPVRAVEAMARICLGAEHQFEFDTDFEAAQRNLQRADQAIAMATMFLSEHIGLGGVVALTESGGTPRFLSRFRSNMPIYAFTRHDGARRQMAMMRGVFPISFDSRGLTPREAARAAIRLLVENERMGPGDRVVFTSGEHMETHGATNTLRLLEVGEDGRATGLGEL

SEQ ID NO: 64545 - protein, 451 aa, Desulfococcus oleovorans Hxd3
MSVIKSVIDKVKHMDPDQKEFHQAVIEVMETLEPTAERHPEFVKNGIYERIVEPERAVQFRVPWVDDKGQVQVNRGFRVQFNNAIGPFKGGIRFHPSVNLGIIKFLGFEQIFKNSLTTLAMGGGKGGSDFDPKGKSDGEIMRFCQAFMRELFRHIGPETDVPAGDIGVGGREIGYMYGYYKKIRNEHTGVLTGKGLEYGGSLIRPEATGYGTVYFASEMLATRGLDFKGKRVAVSGAGNVAQYAIEKVNEMGGTVISVCDSGATIIDEAGIDNDKCCYLMELKNVRRGRVNEYADQYKTVCVESKNVWDVIREQGIKVDVALPCATQNEIDGANAEALVKNGCICVAEGANMPSSPEAVRIFQANNVLYGPGKAANAGGVATSGLEMSQNSSKLSWTREEVDSRLLLIMKGIHKSCLDAAEAYGKKGDYVTGANIAGFVKVAKAMLAYGIV

SEQ ID NO: 64546 - protein, 289 aa, Chlamydophila pneumoniae CWL029
MLHALDTYRPSIESAIEKALEGFGPIGHPIRSPVEYALQGGGKRLRPGLVCMMAQGLGLNHDVMDSALAVEFVHTSTLIADDLPCMDNDDERRGRPTVHKAFDEATALLASYALIPAAYSHLRLNAKKLKEQGCDPREIDIAYNIIGDITDKNIGCSGVLGGQYDDMFFSNRGQEHVQSIMIKKTGSLFEIACISGWLFGGGDPQFAPIITSFSNNFGLLFQIKDDFSDLQKDSQQIGLNYALLFGEKAALELLARSQNNCLELLDRLSAGGLKNSSEFETIISSLGSF

SEQ ID NO: 64547 - protein, 313 aa, Crocosphaera watsonii WH 8501
MSNTKKKLTIIGAGLWGQALAKLAQYNDQNNVKIWSRTSSESLASVVQEADVILSAVSMKGVRLTVEKLTALTIPEETIFISATKGLETKTLLTPSQIWQKSFPSHPVVVLSGPNLSKEIQQRLPAATVVASEDVVAAAKVQEIFSSDIFRVYSNQDPIGTELGGTLKNVMAIASGVCDGLQLGTNAKSALLTRALPEMIRIGTELGASRETFFGLSGLGDLIATCYSPLSRNYRVGYGLSEGKTLEQILIELGSTAEGINTANVLIELAQKHRIAIPISRQVYQLINGETTPQEAVKELMARDLKAEFDVLS

SEQ ID NO: 64548 - protein, 391 aa, Xanthomonas axonopodis pv. citri str. 306
MSIVRMTDLDLSGKRVLIRQDLNVPIDNGQITSEQRITASVPTIKLALEKGAAVMVTSHLGRPKEGSWTEEDSLAPVATRLAALLGVDVPLVRDWVDGVEVAPGQVVLLENCRMNVGEGKDDETLARKYAALCDVFVMDAFGTAHRAQASTHGVIRFAPVAAGGPLLMAELDALAKALDNPAKPLLAIVAGSKVSTKLELLSNLVNKVDQLIVGGGIANTFIAAAGHAVGKSLNEPDLIPTANRIVADAKARGAEIPLPTDVVVAKQFLPDAQASVKSLDAVDADDLILDIGPQTAQRYAELIASAGTVVWNGPVGVFEFESFSHGTETLARAIASSKAFSIAGGGDTLAAVDKYDIAQDVTYISTGGGAFLEFLEGKTLPAVAALQARGQ

SEQ ID NO: 64549 - protein, 256 aa, Synechococcus sp. RS9917
MPEAGPSSTPKATILVVDDEPAVRRVLVMRLQLAGYQVICAEDGEKALELFHRDSPDLVVLDVMLPKLDGFAVCRRLRAESCVPIIFLSALEAISERVAGLDLGADDYLPKPFSPKELEARIASILRRIGRGSATAEPREVPVGQGVLRLGDLMVDTNRRQVTRGSERIALTYTEFSLLELLFREPGRVVPRAEILEQLWGYPPRRAADLRVVDVYVARLRGKLEPDPRNPELILTVRGIGYASQRMGDLPQVATG

SEQ ID NO: 64550 - protein, 178 aa, Xylella fastidiosa Ann-1
MGLELVNAGNNLPEEINVIIEIPKDSEPVKYEVDKASGAIFVDRILSTPMRYPCNYGYVPNTLCGDGDPVDVMVVLPLPLVPGSVVRCRPVGVLQMKDEAGNDEKLLAVPVSKIFSGYSHIEDINQVSAHWLERIGHFFEHYKDLEKGKWVEIDGWGNSTTAKQILTNAVQRYKDTLP

SEQ ID NO: 64551 - protein, 333 aa, Xanthomonas axonopodis pv. citri str. 306
MAIKVGINGFGRIGRNVLRSAVQNFANDIEIVAINDLLEPDYLAYMLQYDSVHGRFKADVSVDGNTLIVNGKKIRLTQERDPANLKWDAVGADVVIESTGLFLTKETAQKHIDAGAKKVILSAPSKDDTPMFVYGVNDKTYKGEAIISNASCTTNCLAPLAKVINDKWGIKRGLMTTVHAATATQKTVDGPSNKDWRGGRGILENIIPSSTGAAKAVGVVIPELNKKLTGMSFRVPTSDVSVVDLTVELEKPATYAEICAEVKAQSEGALKGVLGYTEDKVVATDFRGETCTSVFDADAGIALDSTFVKLVSWYDNEWGYSNKCLEMVRVVAK

SEQ ID NO: 64552 - protein, 1360 aa, Oryza sativa Japonica Group
MAGNPAAAAPSSSGSSSVFLPPPSPSDGELLRPLHRLARDLSAVDTPAPFLRAAFASISRRSKLLAAAFDDLLLCGAAGELPRSASLCLREVLLVLQRFKAIVADCSARSRMRLLLESDEMEAELRELNHDLATLLDLLPVVELGLADDVLDVLALASRQCRRCSPAPESEEALKASVLSLIQEIEREIVPERERLEEILVEVGINDPASCSEEIESLEQEIGDRASEKWTASMIALVGLLRYAKCVLFSATPRPSDSNSKADVEAEDGEPPVPPSDFRCPISLDLMRDPVVVASGQTYDRESIDRWFSSGKSTCPKTGQVLANLELVSNKALKNLISKWCRENGVAMEACEASKSEQAQAVAANKAALEAARMTASFLVKKLSVSFSPDAANRVVHEIRLLSKSGSENRAFVGEAGAVPLLVPLLYSEDAGLQLNAVTALLNLSILEANKKRIMHADGAVEAVAHIMSSGATWRAKENAAAAVLSLASVHSYRRRLGRNQSVVEKLVHLVRTGPTSTKKDALAALLTLAGERENVGKLVDAGVAEVALSAISKEETAAAVLAALAKRGGAEAIVNIDGAVARLVAEMRRGTDWARENATAALVLLCRRLGAPAVTQVMAVPGVEWAIWELMSIGTERARRKAASLGRICRRWFIAAIVTALISTDIYLSRRVKRREESGRRNYVKLVSIYWDHLASITINRCSDDNHSSTRGCDDWSRTVPRCGNPVQKPVDIAAAKRLAEWMGGYACLDGGRFAAWQRPPKAGCVHRNGEARFKRRLIAFRGKNLELEIKHETLGLTPYTSCHRNIKCISKAFIYGDLRLPGYTSHEDFDLYIYESCPSFRRRHPIDSKSRKYEYESKQLRISFSVGCGDDGVALVGPQRRQRLQKRRIEAREFNGGYWSFLGWSLKVHCRPVVRSLAMESATEKVRRTPSSCLLLRISDICKVRSVGVAPTVREKPKADGSATGESSEDGGAHLKVHPHHVSDHESVSECSSARCEEAFVERLLDAISGLKLSYVNLQQALVPYDPEEITIADERFTSELQETAGLKDLYVNMNKWRNPMYQCYVGSRIQEQQKLAVELQAGMCKRDSEIVCLRAELDELERKNMELEEKIGQSALQKEGSFAIGMGVSTDMFMELFELSTKSIHDFAKLVVRWMKLSRWNLGNLTSPIDNSVVYDKRSHKNYAVEAYFACMMLMGHKEEYLSLDVFDYVMSFSDPFDALMKAPDSCFGRFCREKYLAILPPSMEDSFFGNLDHRSFVENGGHPRTPFYQAFVTMSRYVWASLTVARSLNPRAEMFYVKGGTEFRSKHMECVPSKITKEGDKMQGVSVHGQRKKLLNTSYSYRISRSGLLSHCFVRE

SEQ ID NO: 64553 - protein, 400 aa, Marchantia polymorpha
MSVASVSASVAKASQVSGKDFSGLKSTSVATFGKRSDDLLTRVAAQSAVAVSGAQKRAVVEAKVKVAINGFGRIGRNFIRCWHGRKDSPLEVVVINDTGGVKQASHLLKYDSMLGIFDAYVKAVGDDAISVDGKIIKIVSDRNPLNLPWGEMGVDLVIEGTGVFVDKEGAGKHLQAGAKKVLITAPGKGPIPTYVIGVNEELYDPSEQIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFREAANGDMKGILAVCDEPLVSVDFRCTDVSSTVDSSLTMVMGDDMVKVVAWYDNEWGYSQRVVDLANLVAEKWTGA

SEQ ID NO: 64554 - protein, 98 aa, Gracilaria tenuistipitata var. liui
MSDYNVTLLLEDDKTATIKCPDTTYILDQAEESGYELPYSCRAGACSTCAGKLVSGTIDQDDQSFLDDDQIQEGFVLTCIAYPTSDCTILTHQESSLY

SEQ ID NO: 64555 - protein, 318 aa, Spirogyra sp.
KVGINGFGRIGRNFIRCWHGRDDSPLEVIAINDTGGVKQAAHLLKYDSMLGIFNADVKIADDNSISVDGKIIKVVSDRNPLNLPWGEMGIDLVIEGTGVFIDGPGAGKHIEAGAKKVLITAPGKGPIPTYVVGVNADKYVHSEPIISNASCTTNCLAPFVKILEEKFGIIKGTMTTTHSYTGDQRLLDASHRDLRRARAAALNIVPTSTGAAKAVSLVLPSLKGKLNGIALRVPTPNVSVVDLVIQTEKKTFAEEVNAAFREAAAGPMKGVLAVCDEPLVSIDFRCSDVSCTIDSSLTMVMGDDMVKVVAWYDNELGY

SEQ ID NO: 64556 - protein, 318 aa, Sphagnum cuspidatum
  misc_feature (313)..(313): Xaa can be any naturally occurring amino acid
KVGINGFGRIGRNFIRCWHGRKDSPLEIVVINDTGGLKQASHLLKYDSMLGTFAADVKVDGNDSISVDGKTIKVVSDRNPLNLPWGELGIDLVIEGTGVFVDKEGAGKHLKAGAKKVLITAPGKGAIPTYVVGVNADEYNHGDEIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRDASAGPLKGILAVCDEPLVSVDFRCSDVSSTIDSSLTMVMGDDMVKVVAWYXNEWGY

SEQ ID NO: 64557 - protein, 283 aa, Sphagnum cuspidatum
  misc_feature (279)..(279): Xaa can be any naturally occurring amino acid
GVKQASHLLKYDSMLGTFNADVKVDGNDGISVDGKIIKVVSDRNPLNLPWGELGIDLVIEGTGVFVDKEGAGKHLQAGAKKVLITAPGKGAIPTYVVGVNEEQYSHRDEIISNASCTTNCLAPFVKVLDEKFGIIKGTMTTTHSYTGDQRLLDASHRDLRRARAAALNIVPTSTGAAKAVALVLPNLKGKLNGIALRVPTPNVSVVDLVVQVEKKTFAEEVNAAFRDASAGALKGILAVCDEPLVSVDFRCSDVSSTVDSSLTMVMGDDMVKVVAWYDXEWGY

SEQ ID NO: 64558 - protein, 229 aa, Brassica napus
  misc_feature (208)..(208): Xaa can be any naturally occurring amino acid
  misc_feature (225)..(225): Xaa can be any naturally occurring amino acid
MTMAANLARRLIGNRSAQILGTANSTSTAATSAARTFCSSTTPITATLFPGDGIGPEIAESVKKVFTTAGVPINWEEHYVSTEIDPRTQSFLTWESLESVRRNKVGLKGPMATPIGKGHRSLNLTLRKELNLYANVRPCYSLPGYKTRYDDVNLITIRENTEGEYSGLEHQVVRGVVESLKIITRQASLRVAEYAFHYAKTHGRERVXAIHKANIMQKTDGLFLXCCRE

SEQ ID NO: 64559 - protein, 166 aa, Pseudomonas aeruginosa PAO1
MANNEQKRDEGYIEKLVQVNRVAKTVKGGRIFAFTALTVVGDGKGRVGFGRGKAREVPAAIQKAMEAARRNMIQVDLNGTTLQYPTKSAHGASKVYMQPASEGTGIIAGGAMRAVLEVAGVQNVLAKCYGSTNPVNVVYATFKGLKNMQAPEAVAAKRGKSVEEIL

SEQ ID NO: 64560 - protein, 429 aa, Pseudomonas putida KT2440
MRDALNTGLIEFLKASPTPFHATASLVQRLEAAGYKRLDERDSWDTETGGRYYVTRNDSSIIAIKLGKQSPLLNGIRMVGAHTDSPCLRVKPQPELQRQGFLQLGVEVYGGALLAPWFDRDLSLAGRVTYRRDGKVESQLIDFKLPVAIIPNLAIHLNRTANEGWAINPQNELPPILAQVAGDERIDFRALLTEQLAREHELIADVVLDYELSFYDTQDAALIGLNGDFIAGARLDNLLSCYAGLQALLAADSDETCVLVCNDHEEVGSCSACGADGPMLEQTLQRLLPDGDTYVRTVQRSLMVSADNAHGVHPNYADKHDGNHGPKLNAGPVIKVNNNQRYATNSETAGFFRHLCMAEEVPVQSFVVRSDMGCGSTIGPITASHLGVRTVDIGLPTFAMHSIRELCGSHDLAHLVKVLTAFYRSRELP

SEQ ID NO: 64561 - protein, 338 aa, Lactobacillus plantarum WCFS1
MMKKIAVLGAGSWGSILANLLDENGHSVRLWSYSPAQVTELNEKHTNERYVPDFKYSETLTAYSNLTQAIDGADVILFVVPTKAIREVAQQVTAVLAKTHQRPIIVHASKGLEQETHKRLSQVLAEEIPTELRQAIVVLSGPSHAEEVARHDITLITAASADESAAELVQQLFMNDYFRIYTNTDVVGVELGAALKNIIALGAGALHGLGYGDDAKAALMTRGLAEISRLGVALGAEPLTFIGLSGVGDLIVTATSVHSRNWRAGNELGAGQDLKTVIDTMGMVIEGIPSTKAAYELAQQQNIEMPITEAIYDVLYKSADIKEVIPQLMRREGKPEIQ

SEQ ID NO: 64562 - protein, 396 aa, Moorella thermoacetica ATCC 39073
MQLAQRAAGISPSPTLAIDAQAKAMKAKGVKVINFSAGEPDFGTPEHIKQAAIDALAAGFTRYTPVAGIPELRQAICASLAARGVTYEPADIVVSCGAKHSLYNAMQVLLNAGDEVILSAPYWVSYYEQVKLAGGVPVVVTTGPDTGFKLTPGLLEAAITPRTRLLILNSPCNPTGAVYSREELAALAEVIVARDLIVISDEIYAALLYDGLTHTSIASLAPEVKERTILIDGVSKTYAMTGWRIGYAAAPRPVAKAMTDLQSHSTSNPTSIAQKAAVAALTGSQEAVEMMRREFEQRRNRILAGLRELPGIECNQPGGAFYVFPYIGKLFGRKFRGRVLGNSTDVATALLNEFQVAVVPGVAFGAEPYLRLSYATSMDQIEAGLERLRAFVTELE

SEQ ID NO: 64563 - protein, 306 aa, Lactobacillus plantarum WCFS1
MSKVRKAVIPAAGLGTRFLPATKAMPKEMLPIVDKPTIQFIVDEARKSGIEDIVIVTGKSKRSIEDYYDSNPELEDNLRAKHKEEMLKLVQETTDINLYFIRQSHPRGLGDAVLTAKAFVGDEPFVVMLGDDLMEDKVPLTKQLMNSYDKTHASTLAVMKVPHEEVSKYGVINPESEKEPGLYNVNNFVEKPSPEDAPSDLAIIGRYLLTPEIFDVLENQKPGKGDEIQLTDAIDTLNKTQRVFAHEFKGTRHDVGYKFGYLKTTIEYGLTHPDVKADLRTYIKDLGAKLSKEDSAAPKTTKKPTK

SEQ ID NO: 64564 - protein, 876 aa, Arabidopsis thaliana
MVAPPLLSSHEFRPLSWHPRPLQQELICLGRIITMSAFVSKYEDELIKTAKYIATPGRGILAADESTETIGKRFAGINVENTESNRQAYRELLFTSPGSYPCLSGVILFEETLYQKTSDGKPFVDLLMENGVIPGIKVDKGLVDLAGTNGETTTQGLDSLGARCQQYYEAGARFAKWRAFFKIGATEPSVLSIQEDARVLARYAIICQENGLVPIVEPEVLTGGSHDIKKCAAVTETVLAAVFKALNYHHVLLEGTLLKPNMVTPGSDSPKVAPELIAEYTVTALRRTVPPAIPGIVFLSGIQREEQATLNLNAMNKLDVLKPWTLTFSFGGALQQSAIKAWAGKPENVAKAQAKFLTRCKANKDATLGKYTGWASGDSAAFENLVVIGYSWIEIFSSLLKSGLKVFMWSAKKFPKIKIVTSEIDNGLDEEFRVIPWYGRVWGQIFWHRRGLGHCGPAALGVPSISNHPFALSEVDKFPRVLLLTRMTNSNSIFLVDITYIFSIVAAKLVSLALQKATMSAFVGKYADELIKTAKYIATPGKGILAADESTGTIGKRFASINVENIESNRQALRELLFTSPGTFPCLSGVILFEETLYQKTTDGKPFVELLMENGVIPGIKVDKGVVDLAGTNGETTTQGLDSLGARCQEYYKAGARFAKWRAVLKIGATEPSELSIQENAKGLARYAIICQENGLVPIVEPEVLTDGSHDIKKCAAVTETVLAAVYKALNDHHVLLEGTLLKPNMVTPGSDSPKVAPEVIAEYTVTALRRTVPPAVPGIVFLSGGQSEEEATLNLNAMNKLDVLKPWTLTFSFGRALQQSTLKAWAGKTENVAKAQATFLTRCKGNSDATLGKYTGGASGDSAASESLYEEGYKY

SEQ ID NO: 64565 - protein, 516 aa, Glycine max
MAEDDGYTKDGTVDYCGNPANKKETGTWKACPYILGNECCERLAYYGMSTNLVLYFKNRLNQHSATASKNVSNWSGTCYITPLIGAYLADSYLGRYWTIAVFSIIYAIGMTLLTLSASVPGIKPTCHGHGDENCRATTLESAVCFLALYLIALGTGGIKPCVSSYGADQFDDTDSAEKERKSSFFNWFYFSINIGALIASSLLVWIQDNVGWGWGFGIPAVAMAIAVVSFFSGTRLYRNQKPGGSAITRICQVVVASIRKYNVEVPADESLLYETAETESAIKGSRKLDHTDELRFFDKATVLARSDKVKESTNPWRLCTVTQVEELKSILRLLPVWATGIIFSTVYGQMSTLFVLQGQTMDTRVGNSTFKIPPASLSIFDTLSVIFWVPVYDRIIVPIARKFTGYKNGLTQLQRMGIGLFISIFSMIDNAGLEWGFGIPAVAMAIAVVSFFSGTRLYRNQKPGGSAITRICQVVMASIRKYNVEVPADESLLYETAETESAIKGSRKLDHTNELR

SEQ ID NO: 64566 - protein, 348 aa, Synechococcus sp. RS9917
MADPSPQVLCLGEALVDRLGPPGGDPLSAAPEQCDDRLGGAPANVACALARLGTAAGFIGRLGDDAIGASFREVLVDRGVDLRGLQWDAARPTRVVLVRRHLDGERVFQGFAGDRGQGFADQALEPEALALAWPPLAAAVRWLLVGTIPLASEASAAALGSALALAKRDQVRIALDVNWRPTFWRADADPAAGPDAAALAAIAPLLEQAALLKLAREEAEWLFDTDDPVAVSARLPQRPDVVVTNGGDPVRWCIAGHNGAMPVLAPPRVVDTTGAGDAFTAGLLHQLVRLTPAVGHPLELSEAVVEQVVRFAAACGALVCAGAGGIDPQPSAAAVESFLAQAPVQASS

SEQ ID NO: 64567 - protein, 304 aa, Magnetospirillum magnetotacticum MS-1
MTIDTSHHDKILIVDFGSQVTQLIARRVREEGVYCEIVPFTKAEAAFDEHRPKGVILSGGPESVTTDLSPRAPQKIFESGVPVFGICYGQQTMAAQLGGQVEGGHHAEFGRAEVEILSDSPLFKGVWHVGEKYPVWMSHGDRVTKLPDGFTTIALSRNAPFAAVADEARHYYAVQFHPEVHHTPHGALLIRNFVRDIAGCSGDWTMGTYREEAIAKIREQVGSEKVICGLSGGVDSSVAAVLIHEAIGDQLTCVFVDHGLMRLGEGDEVVRLFRDHYNIPLVHVEAQDLFIGALEGVDDRRSSA

SEQ ID NO: 64568 - protein, 570 aa, Synechococcus sp. RS9917
MNESLPLADDPTMAAPSVAQYTLSRLAQLGIDQIFGVPGDYAFSIDDAAEEVPGLSWVACANELNAAYAADGYARIRGAALLTTTYGVGELSAINGVMGSKAHRLPVFHLVGMPSERIQKQGLITHHNLGDAVYDRFQVLSAEAACVSAVLTPDNCIDELERVIREALRQSRPAYLVISEVNGGQPVLGTPVQGQPLVAIKRQHSVPQELEAAVGTILARLAAAQKPVAVLTHLVSRYGVRDQALELIRKTNLPTALTPNDKGTIDESMPQYAGLYAGDWSSSDAVRDLVGNADLVLDIGGIITTELNTGLWTGNYDPAKVVSIQDNFVRAGSKVFVNVAIDDVLNALCERVSTRCNDHGLKLEPMPLVGAAGDATCSATFYPRLQRRLRAGDTLVIETGTCMTHLNKVLLPEGVSAEGQGLWGSIGWGTPACLGVAMAKTSGHTWMVTGDGSHQLTLNELAVMGRYGVKPRIFVLNNGLFGIEDVISERGHGYDDLAPVNYHLLPEAFGCRNWLSARVSTVAELDAVLDQIDAHDGAAYIEVMIPNEESQPLPQSTIDSGYKLSTPPIG

SEQ ID NO: 64569 - protein, 265 aa, Mycobacterium sp. KMS
MSTGSSSVADDLALALRLADHADAVTVDRFRALDLHVETKPDLTPVTDADRSVENDLRRALAGERGDDSVLGEEFGGTAVFSGRQWVIDPIDGTKNFVRGVPIWATLISLLNDGVPVVGVVSAPALHRRWWAADGLGAFVTVSGESPRRLSVSKVAELDSASLSFSSLSGWAKRGLRDRFIDLTDAVWRVRGFGDFFSYCLLAEGAVDIAAEPEVSLWDLAAIDILVREAGGTFTNLDGAAGPHGGSVVASNGLLHDAALGHLSR

SEQ ID NO: 64570 - protein, 183 aa, Klebsiella pneumoniae subsp. pneumoniae MGH 78578
MTATAQQLEYLKNSIQSIEDYPKPGILFRDVTSLLEDPKAYALSIELLTERYKDAGITKVVGTEARGFLFGAPVALALGVGFVPVRKPRKLPRETIAETYELEYGTDQLEIHVDAIKPGDKVLVVDDLLATGGTIDATVKLIRRLGGEVHDAAFIINLFDLGGEQRLEKLGIHCYSLVPFPGH

SEQ ID NO: 64571 - protein, 635 aa, Klebsiella pneumoniae subsp. pneumoniae MGH 78578
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPAHVKFLLATTDPQKLPVTILSRCLQFHLKALDVEQIRHQLEHILGEEQIAFEPRALQLLSRAADGSLRDALSLTDQAIASGEGQLTAASVSTMLGTLDDDQALSLIEALVAADGERVMAGVNDAAARGVEWEALLVEMQSLLHRIAMVQLSPSALGADMAAVEVRMRELARTVPPGDVQLYYQTLLIGRKELPYAPDRRMGVEMTLLRALAFHPRKPLPEPEVQPAQAAAPAPRQPVAPAAPPPQSPQSLPPTTSQVLAARSHLQRSQGATTPKKSEPAAASRARPVNNAALERLSSITERVQARPAAAALEQAPAKKEAYRWKATTVVEETKVEVATPKALKKALEHEKTPELAAKLAEEAVERDSWAAEVSQLAVPKLVEQVALNAWKEQEGSRVCLHLRPSQRHLNSASAQQKLAEALGVLYGTPVELTIVEDDNPAMRTPLEWRQAIYEEKLAQAREAIIADNNIQTLRRFFDADLDEESIRPI

SEQ ID NO: 64572 - protein, 424 aa, Synechococcus sp. RS9917
MAWHPHLWHPTTQVALHPEPLRVRAARGCLLSLEDGRELIDAISSWWVTLHGHGEPSIAAAIARQAEQLEQVIFANFSHAPAEQLATRLAAHTGLQRMFFSDNGSTAVEVALKIAWQWWRNQGSERRQLIAFEGAYHGDTFGAMALGDRSVFTDPYDSLLFDVRRLPWPHTHWGDSSVEAREREALAALDQALETPTAALILEPLIQGASGMRLVRPAFLQAVQARVQDRGALLIADEVMTGFGRTGALFASALAGLEPDLIALSKGLTGGFLPMGATMASERLYQGFISREPSHTFFHGHSFTANPLGCAAALASLDQLEANPEAYSGFESRHRRHLERLQTLNGVARVRCLGTMAAFELAIGATDYLNPIGRQLQHQALQRGVYLRPLGNVVYLLPPLCISDSQLERCYAAIASGLAALGCA

SEQ ID NO: 64573 - protein, 165 aa, Triticum aestivum
MAQRDHKQEEPTELRAPEITLCANSCGFPGNPATQNLCQNCFLAGPASTSPSSSSSSSSSLPGVSAPTPVIDRPRPAPLEAELARPAVDLAPATEAKPARTSVNRCSSCRKRVGLTGFRCRCGDMFCGEHRYSDRHGCSYDYKAAARDAIARDNPVVRAAKIVRF

SEQ ID NO: 64574 - protein, 287 aa, Fusobacterium nucleatum subsp. vincentii ATCC 49256
MKIFVCDAFSSKIFKGNQAGVVILDEKENYPDKILMKNIAAELKHSETAFLKKIDDKKFKIRYFTPTEEVELCGHATISVFSTLRELKLITIGKYIAETLAGNLEIIIDKDFIWMDMSSPKIEYIFNSEEIKEIYSAFNLDISQAPKNLIPKIVNTGLSDIIIPIENKEVLDNFIINKEKVIELSKKYKVVGTHLFTLDKNKKVTAFCRNIAPLVGIDEECATGTSNGALTHYLKDYNIILTQDINTFIQGETMGRASTILSKYKEDEKTIQIGGNAIISFECKIYK

SEQ ID NO: 64575 - protein, 306 aa, Thermoanaerobacter tengcongensis MB4
MVANNILDLIGKTPVVKLNKVPDKNSAEVYLKLEFFNPAGSVKDRIALAMIEKAEKEGILKKGSVIVEPTSGNTGIGLAMVGAAKGYKVIIVMPDTMSMERRMLLAAYGAEVILTPGKLGMEGAIRKAEELVKQNKNYFMPQQFENLANPLIHEETTAKEIIEDFKEGLDAFVAGIGTGGTITGVGRVLKKVFPDIKIVGVEPYSAAVLSGREPGPHKIQGIGAGFIPKVLDREVLNEVIPVKDEDAFEMTRILAKKEGILAGISTGASLWAALNVAKKLGKGKKVLAIAPDSGERYLSTQIFREH

SEQ ID NO: 64576 - protein, 531 aa, Lentinus sajor-caju
MFPGARILATLTLALHLLHGAHAAIGPVGDMYIINEDVSPDGFTRSAVVARSAPSTESTSETGSTPGVLVQGNKGDNFQLNVLNQLSDTTMLKTTSIHWHGIFQTNSTWADGPAFVNQCPIASGNSFLYDFNVADQAGTFWYHSHLSTQYCDGLRGPLVIYDPSDPHLSLYDIDNADTVITLEDWYHVVAPQNAVLPTADSTLINGKGRFAGGDTTALAVINVESNKRYRFRLVSMSCDPNFTFSIDGHSLQVIEADAVNIVPIVVDSIQIFAGQRYSFVLNANQTVDNYWIRANPNLGSTGFDGGINSAILRYAGATEDDPTTTSATSTPLEETNLVPLENPGAPGPAVPGGADININLAMAFDFTNFELTINGSPFQAPTAPVLLQILSGATDAASLLPSGSIYAPEANKVVEISIPALAVGGPHPLHLHGHTFDVIRSAGSTTYNFDTPARRDVVNTGTDANDNVTIRFTTDNPGPWFLHCHIDWHLEIGLAVVFAEDVTSIAAPPAAWDDLCPIYDALSDTDKGGIA

SEQ ID NO: 64577 - protein, 449 aa, Pseudomonas syringae pv. phaseolicola 1448A
MNAALSQWKDAHAARLRDYSAVRVSGRVSAVRGILLECKIPAAKVGDLCEVSKADGSFLLAEIVGFTQECTLLSALGAPDGIQVGAPIRPLGIAHRIGVDDSLLGCVLDGFGRPLLGDCLGAFAGPDDRRETLPVIADALPPTQRPRITNALPTGVRAIDSAILLGEGQRVGLFAGAGCGKTTLMAELARNMGCDVIVFGLIGERGRELREFLDHELDETLRARSVLVCATSDRSSMERARAAFTATAIAEAFRARGQKVLLLLDSLTRFARAQREIGIASGEPLGRGGLPPSVYTLLPRLVERAGMSENGSITALYTVLIEQDSMNDPVADEVRSLLDGHIVLSRKLAERGHYPAIDVSASISRILSNVTGREHQRANNRLRQLLAAYKQVEMLLRLGEYQAGADPVTDCAVQLNDDINEFLRQDLREPVPLQETLDGLLRLTSRLPE

SEQ ID NO: 64578 - protein, 172 aa, Gracilaria tenuistipitata var. liui
MKKKSIKDKEQENNWEEKVVQVKRVTKVVKGGKKLSFRAILIVGNEKGEIGVGIGKASDVIGAVKKGVTDAKKHIINVPLTKSYSIPHPIEGISGAAKVILRPSAIGSGVIAGGSTRTVLELAGVKNILAKQLRSSNTLNNARAVLNALSQLRTFQNTAQNRDINIERLFNM

SEQ ID NO: 64579 - protein, 187 aa, Vitis vinifera
MLDGNSAVIAETGDSWFNCQKLRLPENCGYEFQMQYGSIGWSVGATLGYAQGAKDKRVIACIGDGSFQVTAQDVSTMIRCGQRTIIFLINNGGYTIEVEIHDGPYNVIKNWDYTALINAIHNGEGKCWTAKVRTEDELTEAIATATGAHKDSLCFIEVFVHKDDTSKELLEWGSRVSAANGRPPNPQ

SEQ ID NO: 64580 - protein, 491 aa, Candida albicans SC5314
MAPKLNNPNLFQNKPFINGQWYDSKSTSTFKVYDPATQELIIELPDQTPEEIDEAIAITHKAFQTYQRTPVYERAKWLRRMYELMIENLQDLATLITWENGKCLADALGEIKYAASYFEWFSEECKRNYGHTIQPSNQNNKVITYKQPVGPVGLLCPFNFPSAMGARKAAPALAAGCTCILKPDGQTPLSSLALAYLAQQAGFPDGCFNVVLTSVTNTPMCGLKFCQSPKLKKISFTGSTNVGKLLMQQSSSTLKKLSMELGGNAPIIVFNDCNLDLAVDQSITSKFRSLGQTCVCANRIYVEKGVYDEFCNKFVEKVNQFKIGNGFEPGVTHGCLINTKAIEKVEDHVQDAVEKGAKLIVEGGRLPQLGENFYSPSVVKDVTQDMKVVKEETFGPLAAIIPFDSKEQVLQWCNDTPYGLASYIFSENLNTVWYMSEFLENGMVSVNTGLFTDAALPFGGVKESGFGREGSLYGMDDYTVIKSITLGNVYN

SEQ ID NO: 64581 - protein, 532 aa, Lentinus sajor-caju
MRALSHFIASLTLVLWFRPGANAVETIGPVGSMRIVNKVVSPDGFSRSAVVAGKTAAGATNPGVLVHGWKGNNFKLNVINELTDTTMLKTTSIHWHGFFQAGTSWADGPAFVTQCPIAAGNSFLYDFEVPDQAGTFWYHSHLSTQYCDGLRGAFVVYDLFDPPRLRYDIDNADTVITLEDWYHVVAPQNGPIPTPDSTLINGLGRYAGGPTSPLAVVRVLWGLRYRFRLVSLSCDPNWTFSIDGHKLLVIEADAVNVEPVEVDSIQIFAGQRYSFVLRANQQIANYWIRAEPNLGTVGFAGGINSAILRYILAPNADPTTTAPASPVQLAETDLVPLSNPGAPGPPVPGGADVNINLAMNFDFTNFELIINGQAFHPPTAPVLLQILSGATTAASLLPAGSIYELPPNKVIELSIPALAIGGPHPFHLHGHTFDVIRSAGMTTYNFDTPARRDVVNTGVGAEDNVTIRFVTDNPGPWFLHCHIDWHLEIGLAIVFAEDAPIVNTENPPSSWDDLCPIYDALTEEEKGGLLPT

SEQ ID NO: 64582 - protein, 521 aa, Lentinus sajor-caju
MVLSTKLVALVASLPFVFAVTKKLDFHIRNDVVSPDGFERRAITVNGIFPGTPVILQKNDKVQIKTINELTDPGMRRSTSIHWHGLFQHKTSGMDGPSFVNQCPIPPNTTFLYDFDTAGQTGNYWYHSHLSTQYCDGLRGSFIVYDPNDPLKHLYDVDDESTIITLADWYHDLAPHAQNQFFQTGSVPIPDTGLINGVGRFKGGPLVPYAVINVEQGKRYRFRLIQISCRPFFTFSIDNHTFDAIEFDGIEHDPTPAQNIDIYAAQRASIIVNANQTIDNYWIRAPLTGGNPAGNPNLDVSLIRAILRYKGAPAVEPTSVATTEGHKLNDADMHPIAQEGPGNLGTGPPDMAITLNIAQPNPPFFDINGISYLSPSVPVLLQMLSGARKPQDFLPSEQVIILPANKLIEVSIPGAGAHPFHLHGHTFDIVRVSNSDVVNLVNPPRRDVLPINGGNTTFRFFSGNSGAWFLHCHIDWHLEAGLAVVFAERPAEVNEGEQAQIVTQDWRTLCPAYDGLAPEFQ

SEQ ID NO: 64583 - protein, 532 aa, Lentinus sajor-caju
MFPGARILATLALALHLLHGALAAIGPVGDMYIVNEDVSPDGFSRSAVVARSVPITGPTPATASIPGVLVQGNKGDNFQLNVVNQLSDTTMLKTTSIHWHGFFQAGSSWADGPAFVTQCPVAPGDSFLYNFNVPDQAGTFWYHSHLSTQYCDGLRGPFVVYDPTDPHLSLYDIDNADTVITLEDWYHIVAPQNAAIPTPDSTLINGKGRYAGGPTSPLAVINVESTKRYRFRLVSMSCDPNFTFSIDGHSLLVIEADAVNIVPITVDSIQIFAGQRYSFVLTADQTPDNYWIRANPNLGSTGFAGGINSAILRYVGAADADPTTTSSTSTPLLETNLVPLENPGAPGPAVPGGADININLAMAFDFTTFELTINGVPFHPPTAPVLLQILSGASSAASLLPSGSIYELAPNKVVEISMPALAVGGPHPFHLHGHTFDVIRSAGSTTYNFDTPARRDVVNTGTGANDNVTIRFVTDNPGPWFLHCHIDWHLEIGLAVVFAEDVTSISAPPAAWDALCPIYDALSDADKGGIIP

SEQ ID NO: 64584 - protein, 401 aa, Rickettsia conorii str. Malish 7
MALIIQKFGGTSVANIDRIKKIVPIIKTEIAKNNQVIVVVSAMAGVTNQLVTLCNELSSLNNISQFAEYDVALSSGEIVTASLLALALQEEDIKARSFLAWQLPMLTDNNHSKALVESITTDLLEKYLQLNTIPIIAGFQGINKSNRLTTLGRGGSDTTAALIAAAMKADRCDIYTDVEGIFTADPRIIPNAKKIKEIDFLEMLELASSGAQVLHPRAGELVMRYKIDMRVLSTFSPDTEGTLITSKDKNMENGIINSITSNKNLLKISVKSMSLSFLQVANMITQNNNHIEFMQEIKNNEEYSFITNLTDKNNLQALLTNLKDDKQIQYFTFDTEIATISLIGYGIKNDCKLLETILSKLTNDNINVHMIQLSEVKITLFINDQDTEKTIFNLYNLFKIS

SEQ ID NO: 64585 - protein, 525 aa, Lentinus sajor-caju
MAPLVRALACLAILAVTNVYGATVGNNADIYIANKVIAPDGFERSGVLAGTAAGVEVIGPLVRGWKGNRFRLNVINQLSDSSMLKTTSIHWHGFFQEGSSWADGPAFVTQCPIASGDSFLYDFRVPDQAGTFWYHAHLSTQYCDGLRGAFVVYDLLDPHRLRYLVDNEDTVITLADWYHTVAPQAGLVPVPDSTLINGRGRYAGGPTVPLSLIRVLWGVKYRFRLVSLSCDPNYTFSIDGHKMTIIEVDGVNTKPLEVDSIQIFAGQRYSFVLHANQRIANYWIRANPNLGTRGFEGGLNSAILRYYGAPNRDPTTTQETSVNPLVETNLVPLRDAGAPGVPGVGNADVNINLAMAFDFPSLQFTINGAPWVSPTSPVLLQIISGASSASELLPPGSIYTLPRNKVVELSIPALAIGGPHPIHLHGHAFDVVRSAGSSTYNYNNPVRRDVVSTGTGSDNVTIRFKTDNPGPWFLHCHIDWHLEIGLAVVFAEDTASTSKQRPPKSWSDLCPIYDSLTEEQKGGIV

SEQ ID NO: 64586 - protein, 573 aa, Azoarcus sp. BH72
MRAAILFAVWLWLAATAAAQPPAPEAATGFSPRPAVCASNAMVVTAHPLATDAALAVLGEGGSAADAAIAAALVLNVVEPQSSGIGGGGFLLHYDAAAQRLAAWDGRESAPAAVEADWFLDEAGRPLHFFDAVVGGRAVGVPGLPRLLEAAHRRHGVLPLARLFAPAIALAREGFAVSPRLHAHIARDRFLRADPAARLLFFDGGGAPLAVGATLRNPALAATLELLARDGAEVFYRGEVARDLVAAVARAPAPGALTLDDLRTYEVVERPALCGPYRAWRVCGMPPPSAGGASVLALLGVLQRFDLPAIAPDSAFAAHLFAEAGRLAYADREAWYGDPAEMTLAPAQLLAPRYLAHRAALIALDGSMGTAPAGVPDPAVAAVAASSPELPATTHISVVDAGGNAVSLTASIENAFGSRRMVRGFLLNNQLTDFSFVPGGEHGAHPNRAGPRKRPLSSMAPTLVFAPDGRLHAVLGSPGGSAIINYVAAALVGVLDWGLAPDAALARPHAGSRNGPTEVEDNAAGRALAGRLALFGHRPQLRDLTSGTSLIVREAGGWAGAADPRREGSAAGY

SEQ ID NO: 64587 - protein, 506 aa, Oryza sativa
  misc_feature (13)..(13): Xaa can be any naturally occurring amino acid
  misc_feature (351)..(351): Xaa can be any naturally occurring amino acid
MPRRPSGGGGGAXPAAAAVRKVPLRKLLRAASVACGVQFGWALQLSLLTPYVQELGIPHAFASLVWLCGPLSGLLVQPLVGHLSDRIAPAASPLGRRRPFIAAGAASIAAAVLTVGFSADLGRIFGDSITPGSTRLGAIIVYLVGFWLLDVGNNATQGPCRAFLADLTENDPRRTRIANAYFSLFMALGNILGYATGAYSGWYKIFPFTVTPSCSISCANLKSAFLLDIIILVVTTCITVASVQEPQSFGSDEADHPSTEQEAFLWELFGSFRYFTLPVWMVLIVTALTWIGWFPFILFDTDWMGREIYRGSPDDPSITQSYHDGVRMGSFGLMLNSVLLGFTSIVPALAXLEKLCRKWGAGLVWGVSNILMALCFVAMLVITYVAKNMDYPPSGVPPTGIVIASLVVFTILGAPLAITYSIPYAMAASRVENLGLGQGLAMGILNLAIVIPQVIVSLGSGPWDQLFGGGNAPAFAVAAAASFIGGLVAILGLPRARIASRRRGHR

SEQ ID NO: 64588 - protein, 710 aa, Ustilago maydis 521
MRLSLVSLALLGLAANHALAFPASLGDVKRNTDHAPYFDTDKSALDPDLTLGPDMLGSDDVDEFVRRIDQVLQSYEPDLSSFGLGPVPGFWPGHRHGDAHNHGPPHAHEDGHKDQGHQVPGSRPINGKPPKDTCKPKPPSGVSHKCEKRDFTPQTREFDWTITYGHSAPDGFLKKRILVNGQSPGPLIEANEGDTIVVKVRNLLDQGTSIHWHGMFQNSTPFMDGIAGFSQCPIPPRGHLTYRFKIEGQYGSYWWHSHSKMQYTDGLYGGLIVHSKRDPYQKCRDYDDERVFLFADNYHDFADYIVQQLLSANGYNGTAAAPSPQSGLINGAGQFNCAALAHAKGKQPGMPTRCTQLPTPTMDVEPNKKYRFRFINTGSHAQHIISIDNHELEVIAADGTPVKPHKVHRVPIHNGQRHDVFVDTNQGSDGDSFLLRSAMMTACFSFVDPLLDPVANLTLQYRLPGSKIAPKRPVPHDWKDAMGSQCQDLKDSELVPAIDTSVPPNHNLGSLGIFNSQFGNLQLANGTTLGRFFVDNVTQTNYVNKPYLEVTHAGGQINSSTVASLLIPDDVWVADIVINNEDSFLDHPFHLHATDMHIVARGSGSMTQAQWIALNQNAQPQNGNASALNLKNPLRRDTITVPRSSFVVVRIIPDLPGVWAMHCHIAMHVAEGLMAAIAIHPHKIRELKFSQEVLDLCLVSRAALNEVEPA

SEQ ID NO: 64589 - protein, 626 aa, Desulfococcus oleovorans Hxd3
MGLLETIDSPADLKKLPVSDLPALAEEIRELIVRVVSETGGHLASSLGAVELAIAIHYVFDVPNDRVIWDVGHQSYAHKILTGRREQFSTLRQHGGLSGFTKRSESPFDSFSTGHSGTSISASLGFLCAKHQRNDPSKVVAVIGDGSMTAGLAYEGLNQAGDRHKDKNLIVILNENDMSISQNVGALSSFLSRTLSATYLQDWRKELGELLRSLPGIGDDVYQFAKRSEESFKTFVTPGMLFEAFNLEYFGPINGHKIKQLVNILQNIREIREPVLLHVTTTKGKGYEPAERDPAYFHGVGAFEITTGSKRPDAAPCPSTYTQVFGRTMVELAEKDPAIVAVTAAMPEGTGLAEFAQRFPDRFYDVGIAEQHGVTFAAGMAADGLRPVVAIYSTFLQRSYDQIIHDVCLESLPVTFAIDRAGIVGEDGPTHHGLFDLSYLRSMPNMTIMAPADENELRRMLVTAISHNGPAAVRYPRGKGTGAALADPLLPVSIGKAKILTKGGDILILAIGRTVCEAMAARQQLETEGISATVVNCRFVKPLDEELICDLARAIPRILTVEDSMLAGGFSSAVLECLNDHRVTGVTVKRLGIGDTFVEHGSQEILRAKYAIDARAIVVAAKELMA

SEQ ID NO: 64590 - protein, 295 aa, Desulfococcus oleovorans Hxd3
MKNLETYLARRQKAVNEALDRILADCVPGGRLFSAMRHSLKAGGKRLRPILCMAAAEAVGGTWEDALFPGCAIELIHTYSLVHDDLPAIDNDPLRRGQPACHAAFDEATAIFAGDALHTLAFEVLSSDRYIFFQGKRRLALIHLISRATGNHGMIEGQMRDILAQGGNLGLDQLKELHRLKTGALITASVHAGALTGKATVRQTGKLIEYAENIGLAFQVADDLLNVEGDPLLTGKSIGTDHVLGKATFPNLMGIDASRKFAAQLVEKSLQAIESLGIKANPLRAVAKYVIERKL

SEQ ID NO: 64591 - protein, 168 aa, Desulfococcus oleovorans Hxd3
MRIGTGYDLHRLVKGRRLVLGGVALPFEKGLDGHSDADVLVHAVCDALLGAAGLGDIGDHFPDTDARFKGVSSLLLLTETGRMLKEKGFFVVNIDATVLAQAPKLGAHKAAMAANMATALGIDAACVNVKATTTEGLDAVGRGEAMAAMSVALIIEEEARDSRGQGAG

SEQ ID NO: 64592 - protein, 335 aa, Chlamydophila pneumoniae CWL029
MAAPIFIKNILLRSSIVYAPLAGFSDYPYRCMSALYQPGLMFCEMVKVEGILYAPERTSKLLDYNENMRPIGAQLCGSNPETSGEAAKILEGLGFDLIDLNCGCPTDKITKDGSGSGLLKTPELIGRILDKIINSVSIPVTVKIRSGWDMEHINVEDTVRIIRDAGASAVFVHGRTRAQGYHGPSKQEYISRAKAAAGKEFPVFGNGDIFSPEAAQAMLTTGCDGVLVARGTLGAPWIGKQIQDYLTTGSYEKIPFIKRKAAFLEHMRLVEDYYQSETKFLSETRKLCGHYLISAAKVRFLRSSLAKATSYQEVYQLVNDYEEADDSSLETFVKC

SEQ ID NO: 64593 - protein, 162 aa, Oryza sativa Indica Group
MPVAAAMLSTAIRKMFDKYPSIDHGGVIELPHQISSGIFPKVKEYCTKHAKVDDKGNPTVSTNTGAAAAASSSSTDDEEEDLKNWDKEFVNMEVKPLHDLLLVAHLLDIKGLFDITCRKVADMLKGKTSEEMRQILNIRNDFTEEEDKAIKEQNPWVFPDPE

SEQ ID NO: 64594 - protein, 192 aa, Oryza sativa Indica Group
MISVECSDGKTFDMPLAAAMLSTVIRNSCKIVDDESDSDKPSGDGEITMVKLPHQVPSTIFPEVKKYCMKHAKVDEKGNSTATVFTNTGAAAASSSSTSVPDDDPTATEEEVLKNWDKEFVNVDQWPLYNLLIAAHFLDIQGLFDIASQKVADMLKGKNSQEMRDTLNIANDFTADEQQAIRALNPWAFPNP

SEQ ID NO: 64595 - protein, 182 aa, Chlorella vulgaris
EASGDAVVGIVTERDYLTKVVVKDQSSKDLAVSQIMTDKSKLMTATPQQSVVDVMKLMTENNFRHVPVVHEGKYLGMVSIRDVVHVVVEEHKEEVGPPARVHPGILLSRHAATRGCPKGEWQYASQINPFIGVPCMSCKSPCWGWCHCAILPGKQTGQVQMMNRLSQESLTCASSDESRLGA

SEQ ID NO: 64596 - protein, 490 aa, Avena strigosa
MDMTICVVWLVLAIISIAAVVSKSSKRSNASDSVVTRPPPPVVTGIDLLKFLHALCRKDPEAAMMYLYNKLGSIFTLSFLWKRVTILIGHEASIPFFHGLESDVSQGNFNEFTVPMFGKENGYAVEYATRIEQSRFFYDSLKASQLRSHVDLIRQEVEEYFAKWGDEGEVDLKQEFTKLLMLIAGRCLLGSEVRDTIFGEFYTLFADIEEGVNLFSYMFPYMPVPVNNRRDRAQMKLTSIVSEIVRSRKRCNRVEDDMLQRLIDSRYKDGRPTTEGEVSGMIIGLIFAGKHTSTITASWTGACLLTHPKFLGAAVEEQKQMMSKYKDNIDYNILSEMEILHSCIKEAGRMYPAAPVLLRKTLKEISVQTREGGEYGIPKGTTLAHLVMLTGKVPHTYKDPEVYDPDRFRVGREEDKIGGKLSYTIFGAGRHACAGESFAFMQIKIIWSHLLRNFDLKLTSPFPKQDWSKFIIEPKGKVMVSYKRCRMPAN

SEQ ID NO: 64597 - protein, 174 aa, Vitis vinifera
MELADASGYPIAVMPSGKGLVPEQHPHFIGTYWGAVSTTFCGEIVESADAYVFAGPIFNDYSSVGYSLLIKKEKAVIVEPNRVTVGNGPSFGWVFMADFLSALAKKLKKNETAVENYRRIYVPPGVPLRREEHEALRVNVLFKHIQASQTRHILLFSFSTSMISILSRSISFVK

SEQ ID NO: 64598 - protein, 540 aa, Oryza sativa Indica Group
MGLCSSSSARRDAGTPGGGNGAGNKDNAGRKGIVACGKRTDFGYDKDFEARYALGKLLGHGQFGYTFAAVDRRSSERVAVKRIDKNKMVLPVAVEDMIIMCILLWSKSWKNSQMFMKSVEVYLSITIKCLSELFMALAKLKEGTVQANEDLTLLHVFDRLCEGGELLDRILAKKDSRYSEKDAAVVVRQMLKVAAECHLHGLVHRDMKPENFLFKSTKEDSSLKATDFGLSDFIRPGKHFRDIVGSAYYVAPEVLKRKSGPESDVWSIGVITYILLCGRRPFWDKTEDGIFKEVLKNKPDFRRKPWPNITPCAKDFVQKLLVKDPRARLTAAQALSHEWVREGGQASDIPLDISVLHNMRQFVKYSRFKQFALRALASTLNAEELSDLRDQFNAIDVDKNGTISLEELKQALAKDVPWRLKGPRVLEIVEAIDSNTDGLVDFEEFVAATLHVHQLVEHDTEKWKSLSQAAFDKFDVDGDGYITSDELRMQTGLKGSIDPLLEEADIDRDGKISLDEFRRLLKTASMSSRNVQTPRSVHRS

SEQ ID NO: 64599 - protein, 477 aa, Alkaliphilus metalliredigens QYMF
MAERISGKKRQEQLTKMSYNAWEQLADGELERVFEFGEIYKKFMDQGKTERECVDEIIAQARERGFVSLDEVMGRGIVKPGDRIYAENKGKAVALFVIGNEGLEKGMRIIGSHLDAPRLDLKAVPLYEEGGLALLKTHYYGGVKKYHWVATPLALHGVLIKKNGEKLSIVIGEDDQDPVFYISDLLPHLAKDQMAKKMGEGITGEELNVIIGNIPYQGDDIDEKVKLNILDLLNEKYGIDEEDFTVAEIEIVPAGKSRDVGLDRSMIAAHGHDDRVCSFAACQAVLEISNPKDTIVGLFVDKEEVGSMGNTGMESMFFENVVAELLNLEGTTSYLGLRRSMSNSKVLSGDVTAGFDPNFPDVLDKRNASFIGKGVTLTKYTGVKGKSGSNDANAEFLSEVRSIFNSSDVTWQVGELGKVDQGGGGTIAYILANYGAEVVDCGTPMLSMHAPIELISKVDLYMTYKAYKAFYQGITRI

SEQ ID NO: 64600 - protein, 215 aa, Vitis vinifera
MEEADWSAVTGSCSGTLGGHLARRLVQIGVRDVFSVPGDFNLTLLDHLIAEPGLNLVGCCNELNAGYAADGYARARGVGACVVTFTVGGLSVLNAIAGAYSENLPVICIVGGPNSNDYGTNRILHHTIGLPDFTQELRSFQTVTCTQAVVNHLEDAHEQIDTAISTALKESKPVYLSISCNLPGIPHPTFSREPVPFFLAPKVSNQIGLEAALIF

SEQ ID NO: 64601 - protein, 134 aa, Triticum aestivum
SISLTLDPSKLWSRELIQQELDNVVEELEKIAVVHLLQHRSIISLIGNVQRSSLILEKAFNVLRRNGVNVQMISQGASKVNISLVVNDSEAKQCVQALHSAFFENGFLSEVKEADLAQNRVPVLVSSNGAINGN

SEQ ID NO: 64602 - protein, 541 aa, Oryza sativa Indica Group
MSAAHLLRHSRKLRSLHNALDCERSGLVRYFSTASGSFPTKGNGAEKRIGGARFPQRKQPGKELETSKLSLGLNGSYTCRRSPNNFIPNTITGLNGSLSCGQIASARSFSSSADLPPHQEIGMPSLSPTMTEGNIARWLKKEGDKVSPGEVLCEVETDKATVEMECMEEGYLAKIIHGDGSKEIKVGEIIAVTVEEEGDIKKFKDYKPSTLAAPVAPSELKAQSELTEPKVEEREPSKASEPKAPRTEEPSRSGDRIFSSPLARKLAEDNNVPLSNVKGTGPDGRILKADIEDYLAKGCRKEALAAPGLSYTDVPNAQIRKVTANRLLSSKQTIPHYYLTVDTRVDNLIKLRGELNPLQESSGGKKISINDLVIKAAALALRKVPQCNSSWMNDFIRQYHNVNINVAVQTEHGLFVPVIRDADKKGLGMIAEEVKQLAQRARDNSLKPDDYEGGTFTISNLGGPFGIKQFCAIINPPQSAILAIGSAERRVIPGSANGQYEFGSFMSATMSCDHRVIDGAIGAEFLKAFKGYIENPTSMLL

SEQ ID NO: 64603 - protein, 392 aa, Ehrlichia chaffeensis str. Arkansas
MNSSPILPVYAPSKVTFSHGKGVYLYDYNNKKYVDFHAGIATSSLGHAHPALVNALKTQGEKLWHISNVHTIPEAIKLAQKLVDISFADKVFFNNSGAESVECCLKIARSYQCGKGNTQRYRFITMKQSYHGRTCAACSANDPSKFSPFLKPYVEWFDCVNPDITSIKNAINETIGAILLEPIQGEGGINVLDDSFLKELRTICDQNDILLIFDCVQCGSGRTGKFFAHEHTGVTPDICCLAKGLGGGFPISATLATNNASQFMGVGMHGSTFGGNPLATTIGMTVVEEILKDGFLDNVTKNGHYLYKRLEDLAKKFPVIEEVKGKGLMIGLKINTNINNRELMHDLISCGLLTNTASNNTLRIVPPLIITQQEIDEGLAILESYLQSKYHQ

SEQ ID NO: 64604 - protein, 272 aa, Ehrlichia chaffeensis str. Arkansas
MHLFCFGYGYTARFLAQKLLPLKWKISGTLFNKVAHTDNKDVHLLDYNFPLPESVFSDVTHVLISIPPDGDNILQKYYNFLKEIKWLGYLSATNVYGDHNGNWVDETSSTNPSTPNGINRLKQEKMWHNSNLPSHIFRLSGIYGPTRNVLRNLIQGNVKYTISDTIFSRIHVDDIANILFTSIHNPNPGSIYNCTDDLPSPYSNVVKYGAALLNINTPEPMDFEDLSDNMKRFYSERKLVSNLKIKNELNISLQYPSYIQGLQSLIKIETLL

SEQ ID NO: 64605 - protein, 489 aa, Bacillus cereus ATCC 10987
MPQDRKAEVQKHAYERKEIMPDNSQSLPRHMQKELPHEFSVNPLFAREGESVVPRFHISDEGMLPETAYQIVHDEITLDGNARLNLATFVSTWMEPAAEQLYAKSFDKNMIDKDEYPQTAEIEERCVRILANLWHSPSPLTTMGVSTTGSSEACMLGGLALKRRWQNARKSEGKPLDRPNIVFSSAVQVVWEKFANYWEVEPRYVKVSPEHPQLDPQGVLAAVDENTIGVVPILGETYTGLYEPVAEIAKALDDLQARTGLDIPMHVDAASGGFIAPFLQPDLVWDFQLPRVKSINVSGHKYGLVYPGLGWIIWREAEDLPEDLIFRVSYLGGNMPTFALNFSRPGAQVLLQYYNYLRLGKSGYYDIQRASQKVALFLSKAIQKMEPFELLSDGSDIPVFAWRLKEGYTSNWNLYDLSRQLRVFGWQVPAYPLPPDMESVTIMRVVVRNGFSMDLAHLFLRNLKQTVAFLDSLDGPMPHDTKCNNGFHH

SEQ ID NO: 64606 - protein, 116 aa, Arabidopsis thaliana
LVEKFGIDPNNAFAFWDWVGGRYSVCSAVGVLPLSLQYGFSMVEKFLKGASSIDQHFQSTPFEKNIPVLLGLLSVWNVSFLGYPARAILPYSQALEKFAPHIQQVSMESNGKGVSI

SEQ ID NO: 64607 - protein, 403 aa, Bordetella parapertussis 12822
MSNRPIYLDYSATTPVDPRVVEKMIPWLYESFGNPASRSHAFGWEAEDAVEKAREEVAKLVNADPREIVWTSGATESDNLAIKGAANFYAERGKHIITVKTEHKAVLDTCRELERQGFEVTYLDVQDDGLLSLDAFKAALRPDTILVSVMMVNNEIGVIQDIAALGEICREKGIIFHVDAAQATGKVEIDLQKLKVDLMSFSAHKTYGPKGIGALYVRRKPRVRIEAQMHGGGHERGFRSGTLATHQIVGMGEAFRLAREEMGTENERVRMLRDRLLAGLTQIEEVYVNGSMEHRVPHNLNISFNYVEGESLIMAIKELAVSSGSACTSASLEPSYVLRALGRNDELAHSSIRFTLGRFTTEQEIDFTIELIKSRVGKLRDMSPLWEMAQEGIDLNSVQWAAH

SEQ ID NO: 64608 - protein, 221 aa, Pseudomonas syringae pv. syringae B728a
MQILRISSLHTDQEHTVPVVFVAASKLPTPFAEFAMHGFIESATGREHVVLSLGDVADGEPVLGRVHSECLTGDALFSQRCDCGSQLEAALRAIATEGRGVLLYLRQEGRGIGLMNKIRAYELQDGGADTVEANERLGFAADQRDYAICLPMLQHLGVQSLRLMTNNPRKVKALTEMGIRVAERVPLHTGQNPHNRLYLATKAGKLGHMMGNEHQSEVGPA

SEQ ID NO: 64609 - protein, 143 aa, Archaeoglobus fulgidus DSM 4304
MEKVKLGMVVAEFNRDITYMMEILGKEHAEFLGAEVSEVIRVPGTFDIPIAVKKMLEKGRVDAVVAIGCVIEGETEHDEIVAQHAARKIMDLSLEYGKPVTLGISGPGMGRIAATERVDYAKRAVEAAVKLVKRLKEYDAEGS

SEQ ID NO: 64610 - protein, 480 aa, Pseudomonas syringae pv. phaseolicola 1448A
MQLKDSTLFRQQAYINGQWLDADGGQSIKVNNPANNEILGTVPKMGAAETRRAIEAADKALPAWRALTAKERGNKLRRWFELMIENQDDLGLLMTLEQGKPLAEAKGEITYAASFIEWFAEEAKRVYGDVIPGHQPDKRLIVLKQPIGVTAAITPWNFPAAMITRKAGPALAAGCTMVLKPASQTPFSALALAELAERAGIPAGVFSVVTGSAGDIGAELTGNPIVSKLSFTGSTDIGRQLMAECAKDIKKVSLELGGNAPFIVFDDADLDKAVEGAMISKYRNNGQTCVCANRIYVQDAVYDAFAEKLKAAVGKLKIGNGLEDGVTTGPLIDDKAVAKVKEHIADAVSKGATVLTGGNSLEGSFFEPTILVNVSKDAAVAREETFGPLAPLFRFKDEAEVIAMANDTEFGLASYFYAQNMSRVFRVAEALEYGMVGINTGLISNELAPFGGIKSSGLGREGSKYGIEDYLEIKYLCLSV

SEQ ID NO: 64611 - protein, 379 aa, Archaeoglobus fulgidus DSM 4304
MMQRGANRIEVVQPSATLRVSTMAKELKREGKDVVDMSVGEPDFPTPDFIIEAAYKAMKEGKVFYTPTKGVPELIDAIVEKLRNENGIDVGAENIIVTPGAKYAIFEAMMCLLQEGDEVILLDPSWVSYEACILMAGAKPVWVPHEEGFEDAPIEDYITSNTKMIVVNTPSNPLGVVYPKEFLKKVRDLAVDKDILVMSDEIYEKIIFEGEHYSLAAMDGMLERTITINGFSKTYSMTGWRLGYAAAPEWIIKLMNRMQSHSVSHPTSFVQYAGVAALKGDQSFIKEIVEEFRARRDMIMAKLDEMGIEYAPPKGAFYIFMNVGRDSNEFCEEFLKREYVALTPGSAFGVAYKSWVRLSYATSRERIGEFLSRLERFLG

SEQ ID NO: 64612 - protein, 337 aa, Mesorhizobium loti MAFF303099
MLEKFERYPLTFGLTPIEKLDRLGKHLGGKVEIYAKREDCNSGLAFGGNKLRKLEYVIPDAIASDADTLVTVGGVQSNHTRMVAAVAAKIGMKCLLVHESWVPHEDVVYDRVGNILLSRILGAEVRLVDDGFDIGIRRSWEKALYEVKARGGRPYAIPAGASVHPNGGLGYVGFAEEVRAQEEQLGFAFDYMVVCTVTGSTHAGMLVGFAKDGRQRNVIGIDASATPAKTKAQVLSIARHTATLVELGSELAEDDVVLLEDYAHPRYGIPSEETKEAIRLCARLEGMITDPVYEGKSMQGMIDLVQKGFFPAGSRILYAHLGGAPAINGYGYTFRNG

SEQ ID NO: 64613 - protein, 363 aa, Pseudomonas syringae pv. syringae B728a
MALNSIEELVEDIRQGKMVILMDDEDRENEGDLIMAAECVKPEHINFMARFARGLICMPMTRERCETLKLPLMAARNGSGFGTKFTVSIEAAEGVTTGISAADRARTVQAAAAKDAKAEDIVSPGHIFPLMAQAGGTLARAGHTEAACDLARMAGFEPTGLICEVMNDDGTMSRRAELEAFALQHDIKIGTIADLIHYRMIHERTVQRIAEQPMDSELGSFNLVTYRDSVEGDVHLALTLGTICAEEPTLVRVHNMDPLRDLLMVNQPGRWSLRAAMRAVNEAGSGVVLLLGHPLDGDVLLAHIRETAGQQPIKTPTTYSTVGAGSQILRDLGVRKMRLMSSPMKFNAISGFDLEVVEYVPSE

SEQ ID NO: 64614 - protein, 112 aa, Arabidopsis lyrata subsp. petraea
LVEKFGIDPNNAFAFWDWVGGRYSVCSAVGVLPLSLQYGFSVVEKFLKGASSIDQHFQSTPFEKNIPVLLGLLSVWNVSFLGYPARAILPYSQALEKFAPHIQQVSMESNGK

SEQ ID NO: 64615 - protein, 282 aa, Burkholderia thailandensis E264
MRNSPHFRHRLMAITLKNEHDIAQMRIACRLASEVLDYITPFVVAGVTTGELDRLCHEYMINVQGTVPAPLNYQPPGYPPFPKAICTSVNDVICHGIPGDKTLKNGDALNIDITVIKNGYFGDTSRMFLIGEGSILAKRLVQTTYECMWLGIDQVKPGAHLGDIGHAIQKHAEAQGYSVVREYCGHGIGTVFHEDPQVVHYGRPGTGIELKPGMIFTIEPMINAGKRDIRTMPDQWTVKTRDRSLSAQWEHTILVTETGHEVLTVSAGTPARPTFAAPATAA

SEQ ID NO: 64616 - protein, 174 aa, Glycine max
VFVCLKCCGVHRSLGSQISKVLSVTLDEWSSDEIDAMIEVGGNSSANSIYEAYFPEGFTKPGPDATHDQRVKFIRLKYEHQEFLQPSLRIVSGKSNPPKSISKGIMDSFRITSDSQHMEGMVEFIGMLKVKVIKGTDLAIRDMMTSDPYVIFKLGQQTVQTTVIKSNLNPVWNE

SEQ ID NO: 64617 - protein, 131 aa, Saccharomyces cerevisiae
SGGKGGKAGSAAKASQSRSAKAGLTFPVGRVHRLLRRGNYAQRIGSGAPVYLTAVLEYLAAEILELAGNAARDNKKTRIIPRHLQLAIRNDDELNKLLGNVTIAQGGVLPNIHQNLLPKKSAKATKASQEL

SEQ ID NO: 64618 - protein, 349 aa, Bacillus sp. SG-1
MEKPLKTITVLGAGSWGTALAMVLADNGHTVNLWGHNAVQMEEINSKHTNEKYLKNIQLPKGIKGFTDLETALESVETVILAVPTKAVREVLQKVKNTVSRALTIVHVSKGIEPDTLLRISEMIEEEMDETTLKDVVVLSGPSHAEEVSLRHPTTVTVSSKNMEAAELVQDLFMNQSFRVYTNPDVVGVEIGGALKNIIALAAGITDGLGYGDNAKAALITRGLAEIARLGSKMGANPLTFSGLTGIGDLIVTCTSVHSRNWRAGNQLGKGMKLQNVLDEMGMVVEGVRTTKAAHQLAEKYNVQMPITQALYDVLFNDVPPKQAVDLLMGRMKTHEMEDLFNILGEKMT

SEQ ID NO: 64619 - protein, 640 aa, Moorella thermoacetica ATCC 39073
MSLLEKINEPAAIKKFTLAELDILAREIRQELVQTVARTGGHLAPNLGVVELTLALHSVFDLPRDKIIWDVGHQCYVHKILTGRRQEMTSLRQFGGLSGFPKRAESPYDAFDTGHSSTSISAALGMALARDLKGEDYQVVAVIGDGALTGGMAFEAMNHAGHLQANLIVVLNDNEMSIAPPVGGLAAYLSRLRTDPMYSRGKEELENLLNRLPHLGPRVLKVIDRLKDSFKYLVVPGMFFEEIGFTYLGPIEGHNIARLKEVLQHARNTRGPVLVHVITTKGKGYQPAEDHPDRFHGIGPFDPATGEPLAGGGPPTYTSVFGAELVRQGEKNNRLVAITAAMPDGTGLTPFARRFPKRFFDVGIAEQHALTLAAGLAAAGMHPVVAIYSTFLQRAIDQVIHDIALMELPVVLAIDRAGLVGEDGETHQGLFDVSLLRCVPGLVLMAPKDEQELRHMLVTALQYQGPAALRYPRGAGMGVPLTGTAQPLPIGKGEVLRRGRDVTILALGPLAYAALEAAGDLAARGIEATVINPRFIKPLDEDLILTWADRTGHLVTVEEHVLAGGFGSAVLELLARNGRKGIRVRCLGVKDEFVHQGKPAILREHLGLTPAGIRAAVQALLAETPVLHRRRNQTKGISGG

SEQ ID NO: 64620 - protein, 490 aa, Avena strigosa
MDLLADAKPQWLLAGAALLLATLAFLKVLFGSGGGGKRAPPTIPGAPVVGGLLRFLKGPIPLIRAEYARLGSVFTVPILTRRITFLIGPEVSGHFFKGNESEMSQQEVYRFNVPTFGPGVVFDVDYLVRQEQFRFFTEALKSNKLRSYVDMMVAEAEDYFSTWGESGTVDLKYELEHLIILTASRCLLGREVREKLFDDVSALFHDLDNGMQPISVIFPYLPIPAHRKRDQARARLAEIFATIIKSRKASGQSEEDMLQCFIDSKYRNGRPTTEIEVTGLLIAALFAGQHTSSITSTWTGAYLLKFQQYFAEAVEEQKRVMKRHGDKIDHDILAEMDVLYRCIKEALRLHPPLIMLLRQSHTDFSVTTREGKEYDIPKGHIVATSPSFANRLPHIFKNPDSYDPDRFAPGREEDKAAGAFSYISFGGGRHGCLGEPFAYLQIKAIWTHLLRNFEFELVSPFPENDWNAMVVGIKGEVMVNYKRRKLVVDN

SEQ ID NO: 64621 - protein, 122 aa, Pseudomonas aeruginosa PAO1
MALTNEDIINAVSEMSVMQVVELIKAMEEKFGVTAAAATVAAAGPAAAAAEEQTEFTIVLAEAGDKKVNVIKVVRELTGLGLKEAKAVVDGAPGVVKEGASKEEAEAAKKALEEAGAKVELK

SEQ ID NO: 64622 - protein, 297 aa, Moorella thermoacetica ATCC 39073
MKTTELESYLAERRQLVQEALARNLPPPDTYPPAVHQAMHYSLFAGGKRLRPILVLAAGEAVGSQPEPLLPAACAVEFIHTYSLIHDDLPAMDNDDYRRGRPTCHKVYGEAIALLAGDALLTLAFEVLSRIPATIPPERILRATRELAASAGSQGLIGGQVVDMEAEGQPVTLEKVNYIHNHKTGSLIRACLRLGGILGGAGEEQLALLTRYGEALGLAFQITDDILDITGDFSQTGKQGGVDAARGKATYPACLGVEASRQKAGELCAEAGALARALGPAAEPLELLAGFVLRRQG

SEQ ID NO: 64623 - protein, 196 aa, Lactobacillus plantarum WCFS1
MYPVPTVIEQSSRGERAYDIYSRLLKDRIIMLSGPIEDNMANAIIAQLLFLDAQDSGKDIYLYINSPGGVVTAGLAIYDTMNFIKSDVQTIVMGMAASMASVLASSGTKGKRFALPNSEILIHQPSGGAQGQQTEIEIVAEEILKTRKKINQILADNSGQSVEKLNHDTERDNYLSAQEAKDYGLIDDIMENNKLK

SEQ ID NO: 64624 - protein, 490 aa, Avena strigosa
MDLLADAKPQWLLAGAALLLATLALLKVLFGSGGGGKRAPPTIPGAPVVGGLLRFLKGPIPLIRAEYARLGSVFTVPILTRRITFLIGPEVSGHFFKGNESEMSQQEVYRFNVPTFGPGVVFDVDYLVRQEQFRFFTEALKSNKLRSYVDMMVAEAEDYFSTWGESGTVDLKYELEHLIILTASRCLLGREVREKLFDDVSALFHDLDNGMQPISVIFPYLPIPAHRKRDQARARLAEIFATIIKSRKASGQSEEDMLQCFIDSKYRNGRPTTEIEVTGLLIAALFAGQHTSSITSTWTGAYLLKFQQYFAEAVEEQKGVMKRHGDKIDHDILAEMDVLYRCIKEALRLHPPLIMLLRQSHTDFSVTTREGKEYDIPKGHIVATSPSFANRLPHIFKNPDSYDPDRFAPGREEDKAAGAFSYISFGGGRHGCLGEPFAYLQIKAIWTHLLRNFEFELVSPFPENDWNAMVVGIKGEVMVNYKRRKLVVDN

SEQ ID NO: 64625 - protein, 431 aa, Methanothermobacter thermautotrophicus str. Delta H
MDDQRIAVFGLGHIGLPTAALFARAGFKVTGVDINPETVEKVNIGRSPVLEPGLDELVAEVVGTGNLGATMDGERAAAESEVMIIVVPTPVNSENTSDLSAVISAAETISRGLKKGDLVIVESTVPPGACQNVVLPILEKTGLKVSEDFGLAYTPERALPNNTLHEMQNNARVIGGADPESARRAAALYRRITSGEVIVVDDLMTAEMVKLMENTYRDTNIALANELAVICEALGIDAINAIEAANHHPRVNIHTPGPGVGGHCLSIDPYFIVEMAERKGVPARLIRTAREVNESMPLHVLEIVRETLESRGKTLKGSNVGILGVAYKGDVADARETPTRPLVAALLSEGARVLVNDPHVSPEIIRGMGVEPVSLEEALNSDCVVLMTDHTEYLEITPEMIPGGIFICTRPVMDPERFRTRGITFRGVGRP

SEQ ID NO: 64626 - protein, 159 aa, Oryza sativa
MDSEHWISRLAAAKRFYAAQLGHADRAGMEEVDMDEEVRPEFACPYCYEDHDVVSLCAHLEEEHPFEPHAAPCPICSDKIAKDMRYHITVQHGYLFKNRRRLRRFVIPGSQALSLLSRDLREAHLQVLLGRGGHRSNNRRKTKNNLGDPFCHRWLNFQF

SEQ ID NO: 64627 - protein, 196 aa, Chlamydophila pneumoniae CWL029
MTLSLVGKEAPDFVAQAVVNGETCTVSLKDYLGKYVVLFFYPKDFTYVCPTELHAFQDALGEFHTRGAEVIGCSVDDIATHQQWLATKKKQGGIEGITYPLLSDEDKVISRSYHVLKPEEELSFRGVFLIDKGGIIRHLVVNDLPLGRSIEEELRTLDALIFFETNGLVCPANWHEGERAMAPNEEGLQNYFGTID

SEQ ID NO: 64628 - protein, 490 aa, Avena strigosa
MALTVSVMLFSLALVLITAVVAKITSGRIITDPVCALPAPPEVKGIALLRLLPTLFTEGPEATMHYLHNKLGSAFTVSFLWKKTTFLVGQEASAIFFQGLESEVTQGNLFEFTVPMFGTEVGFGVDYATRREHTRFIVESLKPSQLRSYVDPMLQEVENYFAKWEEEGVVDLKYEFKELLMLISGRCLVGKEVREKMFGQFCTLYHQIEEGLNFASFMFPYIPIPVNHRRDRARIKLRGILSEVVRSRKSLNHVKEDVLQRFIDATYKDGRGTTVEEVSALIITLIFAGKHSSAMTSTWTAACLLDHANSLDAALEEQRKIIGKYKDKIDYNILSEMGVLHSCIKEAARMHPAPPALVRQVKKHVTVRTKEGNEYGISRGHTLVHLVMLNGLLPHIYKDPEVYDPDRFRPIREEDKAAGKFSYTSFGAGRHACGGEAYAYMQIKIIFSHLLRNFELKLVSSFPKPDWTQFLPEPKGEVMVSYKRRRLPSD

SEQ ID NO: 64629 - protein, 251 aa, Synechococcus sp. RS9917
MLKAIRADLAIIRERDPAARGPLEILLCYPGFQAVTLHRISHRLWRSRLPLKLPARLLSQLGRSLTGVEIHPGARIGSGVFIDHGMGVVIGETSEIGDRCLLYQGVTLGGTGKEHGKRHPTLASDVVVGAGAKVLGAIQVGSNTRIGAGSVVVRDVEADCTVVGIPGRVIHQSGVRINPLAHSALPDAEANVIRNLMERIDQLESQVGTLQTCLKAVAAGRPLSEICQGDSQNLKDREILEFLGDNPGSAG

SEQ ID NO: 64630 - protein, 206 aa, Fusobacterium nucleatum subsp. vincentii ATCC 49256
MDLKEEDLLKRNVKGISEKLKKAKVCILGLGGLGSNVAVLLARAGIGYLKLIDFDVVEASNLNRQQYRISHIDMKKTEAMKTIIREINPFVEVDILDIKVDRKNIYSIVGDIEIVVEAFDKAEIKAMLMEELLTNTNKIVVSASGMAGLGSANEIVTKKIKDNFYLVGDNYSDYEEYLGIMSTRVMICAAHQANVVLRLILGEKGE

SEQ ID NO: 64631 - protein, 161 aa, Synechococcus sp. RS9917
MATFEGRFTDVQELRIAVVVARFNDLVTGKLLSGCLDCLGRHGVDTSAESSQLDLAWVPGSFELPVVAQSLARSGRYQVLITLGAVIRGDTPHFDVVVAEASKGIAAVARDTGVPVIFGVLTTDTMQQALERAGIKSNLGWSYGLQALEMGSLMRALPGAA

SEQ ID NO: 64632 - protein, 497 aa, Staphylococcus xylosus
MELVKNLSRRQFIDGEWVESSNKETRKIINPFNQEVIFEVAEGTADDSERAILAARRAFEDGEWANETSENRGKKVRAISDLIVKHREELAKLETLDTGKTLEESYADMDDIANVFNFFAGLADKDGGEIIDSPIPNTESKVIKEPIGVVTQITPWNYPLLQASWKIAPALASGCSLVMKPSEITPLTTIRVFELMEEVGFPQGVINLVLGKGSEVGEPLSAHKEVDLVSFTGGIQTGKHIMKNAADHVTNIALELGGKNPNIIFDDADFDLAVDQALNGGFFHAGQVCSAGARIIVHNDIKEKFEAALIERIKNIKLGNGFDEDTEMGPVISAEHREKIENYMEVAKSENATIAIGGKRPEREDLQDGFFFEPTVITDCDTSMRIVQEEVFGPVVTIESFTTEAEAIKLANDSIYGLAGGVFTNDVGKAQRIANKLKMGTVWINDFHPYFAQAPWGGYKQSGIGRELGKAGLAEYQEEKHILRNTNPEPVNWFGKA

SEQ ID NO: 64633 - protein, 240 aa, Ehrlichia chaffeensis str. Arkansas
MSLLIVANWKMYGDFLTFSSFTKELSANLVNVKADVEVVLCPPFIACSKIVDCAPNIKLGAQNCFYESEGKYTGEVSAKMLYSCGCSYVIVGHYERRSIFYESDYCVQLKAKSAIDAGLIPIICIGETLLDRENGMLKNALLDQCYNSFPKHGEFVIAYEPVWAIGSNTIPSIDMITESLDIIRSYDSKSNIIYGGAVNQSNIKDVIAINQLSGVLVGSASLKVSSFCDIIYGAVNVRQN

SEQ ID NO: 64634 - protein, 483 aa, Pseudomonas syringae pv. phaseolicola 1448A
MIPVILSGGSGSRLWPLSRKQFPKQFLALTGEHTLFQQTLERLVFEGMQEPIVVCNKDHRFIVNEQLAALNLETQAILMEPFGRNTAPAVALTAMKLVNEGNDGLMLVLPADHVIEDQKALQRALALATVAAERGEMVLFGVPANKPETGYGYIKSTADALLPEGVSRVSQFVEKPDEKRAREFVEAGGYYWNSGMFLFRASRFLEELKKHDPDIYDTCLLTLERSVQDGDALEIDASTFACCPDNSIDYAVMEKTQRACVVPLSAGWSDVGCWSSLWEVNAKDVNGNVTKGDVVIQDSRNCMIHGNGKLVSVIGLDNIVVVETKDAMMIAHKDKVQGVKQMVATLNEQGRTETQNHLEVYRPWGSYDSVDMGGRFQVKRISVKPGACLSLQMHHHRAEHWIVVSGTAQVTCDENVFLLTENQSTYIPIASVHRLRNPGKIPLEIIEVQSGSYLGEDDIERFEDIYGRSNALEAGVKTQTIAR

SEQ ID NO: 64635 - protein, 336 aa, Rhizobium leguminosarum bv. viciae 3841
MTVKVAINGFGRIGRNVLRAIVESGRTDIEVVAINDLGPVETNAHLLRYDSIHGRFPATVKVEGDTIIVGNGKPIKVTAIKDPATLPHRELGVDIAMECTGIFTARDKAAAHLTAGAKRVIVSAPADGADLTVVFGVNHDQLTKEHLVISNASCTTNCLVPVVKVLDDAVGIDHGFMTTIHSYTGDQPTLDTMHKDLYRARAAALSMIPTSTGAAKAVGLVLPHLKGKLDGTSIRVPTPNVSVVDFKFVAKKATTVGEINEAVMAAANGKLKGILGYTDEPLVSRDFNHDSHSSILATDQTKVMEGNFVRVLSWYDNEWGFSSRMSDTAVAFAKLI

SEQ ID NO: 64636 - protein, 406 aa, Physcomitrella patens subsp. patens
MAATAFAAASVPSTASLKGAGSKGFSEFSGMKSTSIATFGKQIDDLASIVAAQSAVSASSGASRAVTEAKIKVAINGFGRIGRNFIRCWHGRKDSPLDVVVINDTGGVKQASHLLKYDSMLGTFNADVKVEGNDAISVDGKVIKVVSDRNPLNLPWGEMGIDLVIEGTGVFVDEAGAGKHIQAGAKKVLITAPGKGAIPTYVVGVNEQDYKHSDAIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACETEQLKGVLAVCDEPLVSVDFRCTDVSSTVDSSLTMVMGDDMVKVVAWYDNEWGYSQRVVDLANLVAEKWQ

SEQ ID NO: 64637 - protein, 626 aa, Rhizobium leguminosarum bv. viciae 3841
MGMEAFYIVVLVSTALVLLAAFSSLLAFRFGAPLLLLFLMIGLAAGVDGLGIEFSNNYLAYILGSIALAIILFDSGFGTPMQAFRLAAVPSLALASVGVLITASLFAFAAMWLLNFTWLEGLLLGSIVASTDAAAVFFLLRIGGINIRDKVRSTLEVESGTNDPMAIFLTIALVEVLASGERYAGINIGMLAMFVQQMGLGVILGLLGGMMIVLIVSKLDTDRGLTPIFVLALALLVFSFTGAVGGSGFLAVYVAGIYAGNRKMQAIGTIKRFQDGMTWLAQIIMFLVLGLLATPSQFPVIIVPAILLALFLIFVARPLAIWLSLLPFDYTQQEIGFVAWVGLRGAVSILLAIMPILGGLENGQIYFNTAFIIVLVSLLLQGWTIKPVAKKLGLIIPPRIGAVDKVEVDLPGAANHELLSYRVIKDSPVLRGERIPRWATPSLVIRDGKSMRYQYAGRLREHDLVYLFIVPSYSRLLDRLFASRAPVDDDDAEFFGAFALSPARPAADLDAAYGPGLLNESEKGLTIAELMRQRLGGKADYADRVRLGSIILIVRDLDEHDHITSVGMSLEAVEPAITLPIFLNLKDIIQRIRDRLNGRRNRETAASESTPKAPVGRDEGTRENGR

SEQ ID NO: 64638 - protein, 463 aa, Moorella thermoacetica ATCC 39073
MPLIPKKTPMPSQEPRERIHNFNEVAQGYTREMALAEAQRCLQCKKAPCRQGCPVEVDIPAFIARLKEQDFDGAIAKIKEKNNLPAICGRVCPQENQCEKFCTLGKKHEPVAIGRLERFLADYQLAKGETASSEKAPPSGYKVAVIGSGPAGLTAAADLARMGHQVTVFEALHVPGGVLMYGIPEFRLPKRIVQQEIDTIRRLGVEIRTNAVVGKLTTVDELLENGYDAVFIGTGAGLPHFMGIPGENLLGVYSANEFLTRTNLMKAYLFPRYATPIKVGKRVAVIGAGNVAMDAARTALRLGAEESYIVYRRSAAEMPARKEEVEHAEEEGVQFRLLTSPVRIHGNDQGVVTGMTCQRFELGEPDASGRRRPVPIPGSEYDMAVDTVVIAIGQGPNPLVLRTTPGLKLTSKGTIAADEATGATSRKGVFAGGDIVTGAATVILAMGAGKAAARAIDAYLREK

SEQ ID NO: 64639 - protein, 292 aa, Oryza sativa Japonica Group
MTPGCVITIFLMIGVTFVPVGLVCLHASNHVAEIAHRYDIDCVPNAYKRNRQAYIKDSSISKNCTQEVKVKYLMRAPIYVYYELDNFYQNHRRYVKSRSDKQLRYGQKYTHSSCDPIERNDGLPIVPCGLIAWSLFNDTYGFTCGSTEIKVNRKNISWKSDREHKFGKDVYPFNFQNGSLIGGGKLDPALPLNQQEDLIVWMRTAALPQFRKLYGVIEEDLQADEIITMHIANNYNTYSFGGKKSLILTTSTWLGGKNDFLGYAYLITGSLSLFLTILFALIHVKNPSLSIN

SEQ ID NO: 64640 - protein, 340 aa, Lactobacillus plantarum WCFS1
MSVKIGINGFGRIGRLAFRRILELGEKSSDIEVVAINDLTSPALLAHLLKYDSTHGTLNADVSATDDSIVVNGKNYRVYAEPQAQNIPWVKNDGVDFVLECTGFYTSKAKSQAHLDAGAKRVLISAPAGSDLKTIVYNVNDDILTADDRIVSAGSCTTNCLAPLAFFENKEFGIKVGTMTTIHAYTSTQMLLDGPVRGGNFRAARAAGVNTIPHSTGAAKALGLVIPELNGKLQGHAQRVGVVDGSLTELVAILDKKVTADEVNAAIKKHTEGNESFGYNDDEIVSSDVIGTTFGSIFDPTQTEVTSDGDNQLVKTVAWYDNEYGFTCQMVRTLLKFATL

SEQ ID NO: 64641 - protein, 446 aa, Desulfitobacterium hafniense DCB-2
MGKISISDVVDQIGVSKYTYKTYFLVGLTLIFCGFSYMIVSYTMPQMSAEWGLTKVQTGSLASWSLLGLMVGGMIAGIISDSIGRKKGLAIFTIWFSLLTFPIYFVNSFEAFAILRILGGVGFGACIPIAITLMAENVPTKNRGFFISSIMSFYVLGWVVAGVVAIYVVPTFGWRVCYLIGVLPVLYAFVLMAALQESPHWLLGKGREKEAIEVLKRIEMVSKGKANDYAPGSLFLPPRPKKVGVGALFSREYSRATMALWIIYFMGSVVIYGINGWLPTLLVDKGYGLVKGYSFAVLQNVFGAIGGLCTGYVADIIGRRTNVIIGWIATAVAILLLGVASNQWMVVICGMLVGLAMNWGLSGTQPLLAEGYPTEFRSTGVASAQAFGRVGGFLGPIVAGYVQQLGVGFTGTFVFFAVPAVIASFVALFFVVETKGKSIERISANA

SEQ ID NO: 64642 - protein, 400 aa, Lactobacillus plantarum WCFS1
MAKLIVSDLDVKDKKVLIRVDFNVPIKDGKIGDDNRIVAALPTIKYVIEHDGKAILFSHLGRIKSEDDKKGLSLRPVAERLSNLLNKPVTFVPVTEGEQLETAINNMNDGDVLVVENTRFEDVVNGEQVKRESGNDPELGKYWASLGDVYVNDAFGTAHRSHASNVGIASNMDQVAAGFLMEKEIKFLGDAVDNPKHPFVAILGGAKVSDKIGVIDHLISKADKIIIGGGMTYTFYAAKGMGIGNSLVEKDKIELAKSIIEKAGDKLVLPSDSIVAEKFDNDVPSKVVEGSIPDGYMALDIGPKSIEEFEDVLRDAKTVVWNGPMGVFEMSNYAKGTLEIGKFLGTLSDATTIVGGGDSTAAVKQLGVGDKLTHISTGGGASLEYLEGKELPGIAAISEK

SEQ ID NO: 64643 - protein, 252 aa, Lactobacillus plantarum WCFS1
MRTPIIAGNWKMNKTASEALAFVNAVKDQLPDPSKVESVVAAPALFLQEMVEAAKGSDLKIAAENAYFEDAGAFTGETSPAALADLGVDYVVIGHSERRGYFHETDEDINKKAHAIFKNGMKPIICCGESLEQREAGEAESWVSGQIKAALKDLSADQVSSLVIAYEPIWAIGTGKTATSDQAEEICAVVRKTVADLYSQEVADKVRIQYGGSVKPANVNELMGKDDIDGGLVGGASLQPDSFLELVNYQNN

SEQ ID NO: 64644 - protein, 107 aa, Oryza sativa
PPRPNPSTLFRLRLRLAAVVDFVADKMNRAWIGFGSAPEGSMKNRIHSFGLKLLSRVRPSEVLLKSVTKDVSLLEIVHPASINPRLVRRRLRHIAVRGASVHSKKKD

SEQ ID NO: 64645 - protein, 442 aa, Lactobacillus plantarum WCFS1 [sequence omitted]

SEQ ID NO: 64646 - protein, 403 aa, Candida albicans SC5314
MRIFFSSMKTIRYLSHTTRLLAKSTSTPKVLGRASNNLSVGLVGLANVGKSTFFQALTKSTLGNPANYPFATIEPEKSIVLVPSDKLTHYAKLYSSQKTVPTNLTIWDIAGLVRNASSGAGLGNKFLNDIRQVDGILQIVRGFVDDEIVHIEDNKVDPVRDLVIVNDELILKDLEIIESEIERVNKMKNKPGIGGSYEINLQTLDKLSTLLYDGIKVVNGDWSDEEVDVINGLNLLTAKPTVYLLNVSKEDYESGNNQFYKEVDQWIATNSPNDKLIMFSAEYETALNNPEESLGTGSAIGTVVEEMRSVLSLISFFTCGEMEARQWTIRKGSTAPEAAGLIHTDLQKTFINSIVYKWDDLKQLDTFDESKLKSQGKQHKCGKKYIVEEGDVLIIKAGSGKAR

SEQ ID NO: 64647 - protein, 389 aa, Xanthomonas campestris pv. vesicatoria str. 85-10
MRALCWNGINDLRVETVPDPVLVNPRDVILKVGLTTTCGSDLHFIDGYLPTMREGDVIGHEFMGTVVEVGNAVKNVRVGQRVVVPSFISCGGCWHCERKEFSLCDNTNPNWEMQEPLLGHATAGIYGYTHAFGGYAGSHATYIRVPHADVGCFEVPDGVSDEDALFLSDAGPTGFMGADFCNIQPGDTVAVWGCGGVGLMAQQSARILGAERVIGIDRLPERLAMARDVLGVEVIDYSAVDSVVDVLREMTGGRGPDACIDAVGMEAHGTGIGHTYDRVKQALHLHTDRGQALREAILACRKGGILSVLGVYGVMDKFPLGAVMNKGLTVRTAQQHGQRYVPRLLDLAQAGRLKSGFLLTHKMPLEDAVRGYDMFKHKHDGCVRAGFVP

SEQ ID NO: 64648 - protein, 185 aa, Shigella boydii
RPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPL

SEQ ID NO: 64649 - protein, 79 aa, Glycine max
LGWRAVERFRSKFSVPEAAPFTAVLKFAAEEFKVPPQTSAIITNDGAGINPQQSAGNIFLKHGSELRLIPRDRVGAAGV

SEQ ID NO: 64650 - protein, 389 aa, Photobacterium profundum SS9
MEMKSFMLPDLGEGLAESEIVEWHIKSGDVVRVDQIVLTVETAKATVDIPAPYSGKIISRYGKEGDVINIGSLLLEIEEVGATAQSTISTTASTTAAKKEDAATVVGNVSHQSHHVDIDDFWVGSDQNTTHDNIITAMPSARLLAQRLGVDLHGIIGSGPDGLIVDADIYNECDKQLPGTEVLKGARRTMVNTMAESHHNVAAVTITEEALLADWLANEDISIRLIQAVINACQQEPALNAWFDAETMTRCVHSTVNVGIAVDSAHGLYVPVLRHADEYSPKGVRQWLDKTVKGIRDRRIGREQLQHATITLSNFGAIAGIYATPVVSPPQVAIVGAGRIIEKVIIKDGQPIAVKAMPLSMTFDHRACTGGEAARFIKALVEHLQQATV

SEQ ID NO: 64651 - protein, 190 aa, Shigella boydii
RPGKINLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPLLDFAY

SEQ ID NO: 64652 - protein, 433 aa, Arabidopsis thaliana
MRRRRCDLQPKRTRMCDLQPKRTSMCDLPPKLVGEKILTRIPITSLRAVRSTCKLWNALTKDRVLGKAAAQFLGFMTMDSKVCSVRFHLRRSKEEEEDTMDLSIKQVDLLNQVEISRVYHCDGLLLCVAKDNSRVVVWNPYLGQTRWIRPRTESNIGDSYALGYDINRNHKILRMVQTRNVSVYRYEIYDLRSNSWRVLEVTPNGEMDPNHPLYGVSVKGNTYFFAHEDSSSGEIDEDGDIIDLEDFLLCFDFTTETFGLRLPLPFHSTIDATVTLSCVRDQQLAVLYHNEGLHSDDRFTTVEFWVTTSIEPNSVSWSKFLTVDMRPLALTGVRFDNDMGATFFIDEDEKVAVVFDLDGYLSTESARYHTTFISGKDGFFKPVTLGVAPNVGEPCPRTGHIPTTYRPPLVCSSTYLPSLVQVNQQRKRKERHV

SEQ ID NO: 64653 - protein, 600 aa, Synechococcus sp. RS9917
MALLVQKFGGTSVGSVERIQAVARRIANRRDEGHDLVIVVSAMGHTTDELTAKARALCSNPPQREMDMLLATGEQVSIALLSMALHALGVPAMSMTGAQVGIVTESAHGRARILDVRTDRLRSRLGDGQVVVVAGFQGTSQSSGGTAEITTLGRGGSDTSAVALAAALGADACEIYTDVPGVLTTDPRKVADAQLMEQISCDEMLELASLGAAVLHPRAVEIARNYGVTLVVRSSWSEEPGTTLTSRSARPIGREGLELGRPVDGAELVERQAVLALSHVPDQPGVAARLFEALSAGEVNVDLIIQATHEGNSNDITFTVAETDLESARRICTDLVDAMGGELVAEGGMSKLSISGAGIMGRPGIAAGLFDTLSRQGINLRLIATSEVKVSCVIAAAMGGKALRAASEAFELSERQLQINPPASGAGEPEVRGVALDRDQAQVSVRHVPDRPGTAAALCSALADAGISVDAIVQSERQHADGSRDISFTLKREDRAAADQALGSLLAQWPGALLEDGPAIARVSAVGAGMPATAGTAGRMFRYLAEAGLNIELIATSEIRTSCVVAEADGVAALQAVHAGFGLGGAVRHAAQGTASPLDS

SEQ ID NO: 64654 - protein, 401 aa, Rhizobium leguminosarum bv. viciae 3841
MPSFKTLDDLSDIRGKRVLVRVDLNVPVKDGKVTDVTRIERVAPTILELSEKGAKVILLAHFGRPKDGPSSDLSLSLIAPSVEEVLDHAVLTASDCIGEAAASAVAAMNDGDILLLENTRFHKGEENNDSDFTKALAANGDIYVNDAFSAAHRAHASTEGLAHHLPAYAGRTMQAELEALEKGLGDPARPVVAIVGGAKVSTKIDLLMNLVKKVDALVIGGGMANTFIAARGTNVGKSLCEHDLAETAKQIMIEAATAGCAIILPEDGVIAREFKAGAANETVDINAIPADAMVLDVGPKSVEAINAWIERAATLVWNGPLGAFEIGPFDAATVAAAKYAAGRTIAGKLTSVAGGGDTVSALNHAGVADDFTYVSTAGGAFLEWMEGKELPGVAVLNAAAA

SEQ ID NO: 64655 - protein, 332 aa, Rhizobium leguminosarum bv. viciae 3841
MQMVTGGRGLLAADESTSTIKKRFDAINLESTETSRRDYREMLFRSDEAMKKYISGVILFEETLFQKAADGTPFVDIIRAAGAIPGIKVDTGAKPMAKYPAETITEGLDGLGERLARYYEAGARFAKWRGVIAISSTLPTRGSVRANAQALARYAALCQEAGIVPIVEPECLMDGKPGDHNIDRCAEVTEFTLRIVFEELADARVNLEGMILKPNMVIDGRNARKASVAEVAERTVKVLKATVPPAVPGIAFLSGGQTTEEATAHLSAINAIGHLPWFVTFSYGRALQDSSLKAWNGKQENVAAGQREFTHRAEMNSLAAKGNWKKDLEKAA

SEQ ID NO: 64656 - protein, 348 aa, Sesamum indicum
MDLIHTFLNLIAPPFTFFFLLFFLPPFQIFKFFLSILGTLFSEDVAGKVVVITGASSGIGESLAYEYAKRGACLVLAARRERSLQEVAERARDLGSPDVVVVRADVSKAEDCRKVVDQTMNRFGRLDHLVNNAGIMSVSMLEEVEDITGYRETMDINFWGYVYMTRFAAPYLRNSRGRIVVLSSSSSWMPTPRMSFYNASKAAISQFFETLRVEFGPDIGITLVTPGFIESELTQGKFYNAGERVIDQDMRDVQVSTTPILRVESAARSIVRSAIRGERYVTEPAWFRVTYWWKLFCPEVMEWVFRLMYLASPGEPEKETFGKKVLDYTGVKSLLYPETVQVPEPKND

SEQ ID NO: 64657 - protein, 307 aa, Rhizobium leguminosarum bv. viciae 3841
MNTLSYVTVDVFTSTRFEGNPLGVISDARGLSDAAMQKIATEFNYSEVTFVLPPEDPQNSARVRIFTPTMEIPFAGHPNVGTAYVLGQQAEIFGKPVGYKLRFEEKAGIVEVSLKRSGGKVSAAAIRAPQPLTIGDTIAAQTIAGCVSLDPGVIVDTSHAPVFASVGLNFAIAELNGLEALAAARPNLAGFQAAAGRQTTSGHDFSLFLYVRTAERPWNIRARMFAPLDNVPEDPATGSASAALGAYLVSLAPEADMNARITIEQGVEMGRRSVITLDVVKSNGIVTDVVISGDCVSVMRGEISLQD

SEQ ID NO: 64658 - protein, 185 aa, Shigella boydii
INLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNSAGLEVREYAYYDAENHTLDFDALINSLNEAQAGDVVLFHGCCHNPTGIDPTLEQWQTLAQLSVEKGWLPLFDFA

SEQ ID NO: 64659 - protein, 465 aa, Methylobacillus flagellatus KT
MSQGKVVQCIGAVVDVEFPRDQMPKVYDALILDEDSPTVEAGLTLEVQQQLGDGVVRTIAMGSSDGLSRGMKVKNTGSQIQVPVGHGTLGRIMDVLGRPIDEAGPIEADEKRSIHQKAPTFEELSPSVDLLETGIKVIDLVCPFAKGGKVGLFGGAGVGKTVNMMELINNIAKQHSGLSVFAGVGERTREGNDFYHEMKDSNVLDKVGMVFGQMNEPPGNRLRVALTGLTMAERFRDEGRDILFFVDNIYRYTLAGTEVSALLGRMPSAVGYQPTLAEEMGRLQERITSTKVGSITSIQAVYVPADDLTDPSPATTFLHLDSTVVLSRDIAALGIYPAVDPLDSTSRQLDPQIVGEEHYSVARAVQSTLQRYKELRDIIAILGMDELSPEDKLAVARARKIQRFLSQPFHVAEVFTGAPGKYVPLKDTIKGFKAIVNGEYDHLPEQAFYMVGSIEEAVEKAKTLN

SEQ ID NO: 64660 - protein, 226 aa, Gracilaria tenuistipitata var. liui
MLLCCFITVILYNIDNTKFYNRKCSIKMITNNNILRVGQQAPNFSAIAVYDQEFKKITLSDYLGKYVILLFYPLDFTFVCPTEITAFSDSYKEIQSLNTEVLGISVDSEYSHLAWLQMERDIGGLGDLNYPLVSDLTKQISASYNVLTEEGKALRGLFIVDQQGIIQYSLVNNLDFGRSISETIRTLKAIQYVQSHPDEVCPANWQPGKATIINSPQKSKNYFQSI

SEQ ID NO: 64661 - protein, 321 aa, Oryza sativa Japonica Group
MGETIAKDVTELIGNTPLVYLNRVTDGCVGRVAAKLESMEPCSSVKDRIGYSMITDAEEKGLITPGKSVLIEPTSGNTGIGLAFMAAAKGYRLVLTMPASMSMERRIILKAFGAELILTDPLLGMKGAVQKAEELAAKTNNSFILQQFENPANPKIHYETTGPEIWKGTGGKVDGLVSGIGTGGTITGTGRYLREQNPDIKIYGVEPVESAVLSGGKPGPHKIQGIGAGFVPGVLDVDLINETVQVSSDEAIEMAKALALKEGLLVGISSGAAAAAAVRLAQRPENEGKLFVVVFPSFGERYLSSVLFQSIKKEAENMVVE

SEQ ID NO: 64662 - protein, 338 aa, Salmonella typhimurium LT2
MKTLICNNPGNIEYIERDIPHLKDDEVLLKIKAVGICGTDIHAFAGRQPFFAYPRVLGHEICGVAEMLGKSCSTAKVGQRYSVIPCIPCGACAACREGKTNCCENVSLYGVHQDGGFSEYLAVREQNLVELSDNLTDSAGALVECFAISAHAVRRADVKPQQNIVVVGAGPIGLAAAAIAKAKGARVAVADIDAERRRLVAEKVGVATLDPSSDDYIDALKACFSGELAGTVLDATGNKSSMSRAVDLIRHGGKIVFIGLYIGELVIDDPTFHKKETTLLSSRNATREDFECVIELMAQGAISETMMKNQEFDFYTFGNQYQKNVVENKKLVKGVIKF

SEQ ID NO: 64663 - protein, 323 aa, Bacillus pumilus SAFR-032
MADIFSTVQEKVAGKGVKIVFPEGMDERILTAVQKLADGKVLQPIVVGKTQEVEAKAKELGLTLDGVDVYDPHTYEGFEELVQAFVERRKGKATEEQARKALLDENYFGTMLVYKGLAHGLVSGAAHSTADTVRPALQIIKTKEGVKKTSGVFIMARGEEQYVFADCAINIAPDSQDLAEIAIESANTAKMFDIEPRVAMLSFSTKGSAKSDETEKVSEAVQIAKEKAPELVLDGEFQFDAAFVPSVAAKKAPDSVIKGDASVFVFPSLEAGNIGYKIAQRLGNFEAVGPILQGLNQPVNDLSRGCNAEDVYNLALITAAQAL

SEQ ID NO: 64664 - protein, 279 aa, Arabidopsis thaliana
MEIKVKAKDVESTMMSTKEEDEIKKMKECVVIQKADEEVTKGQETMKILDGSRQNQDETRQADSKNIDSPSSSSLEMKKKLEIENTKKEEEKKKETNNNNLSNMKHKKTSSHVWDCGSTLYDSFELNSFKRQLDSAISASSARTMSMSHLPDRRIPSLSSLSPEYSPPLPPPPTTSSSSSSGGKKHSNKISRSLQRFLKSMFKPKQHQSLTTPSSPVYKAVGHGGGDKDRYYVVYDKSGSLTTIPESTEKEVSPEINSLVRKTVSERFPASRVVGISCA

SEQ ID NO: 64665 - protein, 307 aa, Thermoplasma volcanium GSS1
MIMAKRDILSVLDMKNDLDEIINLSIELKKNRYRSYESLRNKMLGLIFEKPSTRTRTSLEVAIDQLGGHAVYLNPSEMQLGRGETISDTGHVLSRFLDAIAYRAFDHKNVVELARSTSIPVINALDDVEHPLQIVADFMTVKEKKGKFSGLKFSYIGDGNNMANSLMLGAAILGVDIYVATPHGYEPKSEFVDKAKQVAKERGSKVIITNDAIEAAKDADVIYTDVWISMGEESKRGEKEKAFTKYQINSDLVSNAKKDYIFMHCLPAHRGLEVTDDVADSINSVIFDEAENRLHSEKGVLYKLLSY

SEQ ID NO: 64666 - protein, 465 aa, Moorella thermoacetica ATCC 39073
MTGGKGEERRKNLSAFSLIFLGLGSTIGSSFFLASGMAIRAAGPAVILGYIFSGFVFYLVLVSLGHLALKYRQRESVRGYVEEALGPTGAFITGWNLWLTSLVGMVSEAVAMAIYTRFWFPWLPIWILVMAYGFLVAGINYFGVDIVDKFEGGLTVIKAGSVLAFTGVMLYIVLARRIAVAATGLLPFFPNGLRGLSQAIVVTTFAYGAGALAAAVGDTRNPRRAVPLATAGMALAQALFFLLPVTALVAVTPWFLISSQSSPFVTGLEHAGIRLGGSVLNAIVLVASSSVLLGSMFTAVTMLASLARDREAPAFLIAGEGEKPVKALVVTAGVMLLVSLLAIFLPRHIYQYAVTATGYFSFVNWGAILAARLYLSLPIKNEGRLDTKGLVVAGAGLAGLTAISLLGLTMPEQRFSLLVMVASTLILLGIGILVKREKLAPEAGNREEAAGWLERLLGGPGRNPV

SEQ ID NO: 64667 - protein, 365 aa, Thermoplasma volcanium GSS1
MNLYEYMGKDIFREYGIPVPNGYVVSSPQDVKKFTNPVAVKSQILLGGRGKAGGIKFAKTDEELKNAVSTLLSTKVRNMTVTKVLIEDMLNIKHEYYVSIALNRAAKSPMLIASAMGGMEIENVPDDKIFKRIIDPSLGYSDFIGREASQFMGLPPELSKQFLDILKKLYNVYRGEDCELVEINPLVETGDGKLIAADAKVVIDSDAIYRHREFSIQDPEKTPLELKAEGKGYAFVELDGDIGVIANGAGLTMATLDALLLHKGKPRNFLDLGGTDNVDIVINAFDLVLEAKPKAILVNIFGGVTKCDTVAQGIVEAKKKFDIKIPVVVRLSGVHEVEGRKILQDNGIEAFSEMMPAIERVTKVF

SEQ ID NO: 64668 - protein, 244 aa, Arabidopsis thaliana
  misc_feature (134)..(134): Xaa can be any naturally occurring amino acid
  misc_feature (140)..(140): Xaa can be any naturally occurring amino acid
  misc_feature (180)..(180): Xaa can be any naturally occurring amino acid
  misc_feature (202)..(202): Xaa can be any naturally occurring amino acid
  misc_feature (205)..(205): Xaa can be any naturally occurring amino acid
  misc_feature (210)..(210): Xaa can be any naturally occurring amino acid
  misc_feature (214)..(214): Xaa can be any naturally occurring amino acid
MEYVNPEGLRLDGRRFNEMRQIVAEVGVVSKADGSAVFEMGNTKVIAAVYGPREIQNKSQQKKNDHAVVLCEYSMAQFSTGDRRRQKFDRRSTELSLVIRQTMEACILTELMPHSQIDICLQVLQADGVLCSVXGTRSAXINAATLALADAGIPMRDLAVSCSAGYLNRTPLLDLNYVEXSAGGADVTVGILPKLGKVSLLXQMXAKLPXGTFXASVNWKGSKNFDTGFFKETTGGFPRINFWV

SEQ ID NO: 64669 - protein, 253 aa, Raphanus sativus
MPIRNIAIGGVQEEVTHPSALRAALAEFISTLIFVFAGSGSGIAFNKLTDNGATTPSGLVAAALAHAFGLFVAVSVGANISGGHVNPAVTFGAFVGGNITLLRGILYWIAQLLGSVVACLLLKFATGGLAVPAFGLSAGVESLNGFVFEIVMTFGLVYTVYATAVDPKNGSLGTIAPIAIGFIVGANILAGGAFSGASMNPAVAFGPAVVSWTWTNHWIYWAGPLVGGGLAGLIYEFVFINQNGHEQLPTTDY

SEQ ID NO: 64670 - protein, 427 aa, Desulfitobacterium hafniense DCB-2
MKGMYQKTVLPNGVRIITEEIDYVRSVAVGIWVGAGSRDEREGYEGISHFIEHMFFKGTKNRTARDIAESLEAVGGQLNAFTTKEYTCYYAKVLDEDMDLAMDVLNDMFFESLFDENEIEKEKKVVIEEIKMYEDSPDELIHDLFSDHVWNDHPLGRPILGTEESVKGLSREKILDFMDHHYAPDNLVIAVAGKIKHDEVLKKLAPLYGEFKRGGRRILEETPKGQQVQEMILKDTEQMHLILGVPGLGQEDEDLYPMHILNNILGGGLSSRLFQEIREQRGMAYTVFSYHSTYVDTGLFAIYAGTTPSNSQEVVECVLAEILDIKKNGISQSELQRTKSQIKGGLYLGLESASSRMSRLGKTELTYNRVISPEEVVEKLERVTVEDTKRVINRLWKRDKISLLMLGPAGNEVDMDALFEKIGWDEE

SEQ ID NO: 64671 - protein, 325 aa, Lactobacillus plantarum WCFS1
MDLFESLAQKITGKDQTIVFPEGTEPRIVGAAARLAADGLVKPIVLGATDKVQAVANDLNADLTGVQVLDPATYPAEDKQAMLDALVERRKGKNTPEQAAKMLEDENYFGTMLVYMGKADGMVSGAIHPTGDTVRPALQIIKTKPGSHRISGAFIMQKGEERYVFADCAINIDPDADTLAEIATQSAATAKVFDIDPKVAMLSFSTKGSAKGEMVTKVQEATAKAQAAEPELAIDGELQFDAAFVEKVGLQKAPGSKVAGHANVFVFPELQSGNIGYKIAQRFGHFEAVGPVLQGLNKPVSDLSRGCSEEDVYKVAIITAAQGLA

SEQ ID NO: 64672 - protein, 184 aa, Triticum aestivum
QAIYLPSTGLAPPVMASWATSVFPFQGVKSTPGLPVSRRSNGVSLGSVSNGGRIRCMQVWPIEGIKKFETLSYLPPLSTEALLKQVDYLIRSKWVPCLEFSKVGFIFREHNASPGYYDGRYWTMWKLPMFGCTDATQVINEVEEVKKEYPDAYVRIIGFDNMRQVQCVSFIAFKPPGCEESGKA

SEQ ID NO: 64673 - protein, 316 aa, Glycyrrhiza glabra
MAAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 64674 - protein, 436 aa, Bordetella parapertussis
MIDLLARARPRAGVGPRPAFRPAHAAGARRPSGSAPFFVENPAMSSALANIYARLPVSFTHGRGVWLWDTGERRYLDALAGIGVSCLGHGHPGLVAAISEQAARLIHTSNIYEVPQQAALARRLAELSGMSEVLFSNSGSEANEAAIKLARYYGYKQGNTHAHIITMDSSWHGRTLATLAATGSDKARQGFGPMPSGFIQVPYNDLPAIRAAGEAEPRVTAVLLEVLQGEGGIRPSDMAFLRGVRQLCTERGWLLMIDEVQSGIGRTGKWFAHQWADIRPDVMTLAKGLAGGVPIGAMLAAGPAAGVFAPGSHGTTFGGGPLACAAGLAVIDAIEQEGLLANAHEVGAHLHAALASELAGVPGIIEVRGHGLMLGIELDRPCGILATRAMEAGLLINVTRERVVRLLPPLILSGEEADQIVRILVPLIKQFLAQQQ

SEQ ID NO: 64675 - protein, 167 aa, Syntrichia ruralis
MSTAAVFNGDEVAPFFGFIGAAAALVFSCMGAAYGTAKSGVGVASMGVMRPELVMKSIVPVVMAGVLGIYGLIIAVIISTGINPKSKPYYVFDGYAHLSSGLSCGLAGLSAGRAIGMVGDPGGRANAQQPKLFGGMILILIFAEALALYGLIVGIIWSSRAGQSRAD

SEQ ID NO: 64676 - protein, 181 aa, Shigella boydii
INLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKGWLPL

SEQ ID NO: 64677 - protein, 186 aa, Populus trichocarpa
MSSPSKRREMDVMKLMMSDYNVETINDGLNDFNVEFHGPKESLYEGGVWKIHVELPDAYPYKSPSIGFVNKIFHPNVDELSGSVCLDVINQSWSPMFDLLNVFEVFLPQLLIYPNPSDPLNGDAASLMMKDKEQYDQKVKEYCERYAKKEHIMNSTGEELSDEEDVSDEESGSSDEEDEIAGHVDP

SEQ ID NO: 64678 - protein, 176 aa, Escherichia albertii
NLGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEKG

SEQ ID NO: 64679 - protein, 174 aa, Zea mays
  misc_feature (151)..(151): Xaa can be any naturally occurring amino acid
PGPAPLRSLPSSSPNRSSSSSLNPFSSLSTTHNSFARPESFISDEQRAATKDDDVYHFISYLPFEGVLYELDELKEGPVNLGQCGGADDLDWLRVVQLVIQERIERYSQNGIRSTIKNRKEKIIMKEEKFKNWKAKNIRRKHNYIPFLFNXMLAKKQQLKPLVEKAKQQKSSSP

SEQ ID NO: 64680 - protein, 174 aa, Shigella boydii
LGIGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVEK

SEQ ID NO: 64681 - protein, 297 aa, Fusobacterium nucleatum subsp. vincentii ATCC 49256
MNDFQVYLKEKTDFFETELKRELKELSYPETIAKGMEYATLNGGKRLRPFLLFATLELLNENIKKGVKSAIALEMIHSYSLVHDDLPALDNDDYRRGKLTTHKVFGEAEGILIGDSLLTYAFYVLSQKNLELLSSEQIVNIISKTSEYAGINGMIGGQMIDIESENKKIGLETLKYIHSHKTGKLIKLPIEIACIIADLEKDKRKVLEEYADLIGLAFQVKDDILDVEGTFEELGKPVGSDVDLHKATYPSILGMEESKKILNDTVEKAKEIIKNKFRDEKGKVLISLADFIKDRNK

SEQ ID NO: 64682 - protein, 388 aa, Mycobacterium avium subsp. paratuberculosis K-10
MTDRVSLRAGITPFYVMDVWLAAAERQRSHGDLVNLSAGQPSVGAPEPVRAAAAAAVHSNELGYSVSLGTPELRAAIAADYRRQHGLEVEPDAVVITTGSSGGFLLTFLACFDVGDRVALASPGYPCYRNILSALGCEVVEIPCGPQTRFQPTAAMLAELDPPVQGVIVASPANPTGTVIAPEELAAIASWCEASGARLVSDEVYHGLVYEGAPPTSCAWQTSRNAVVVNSFSKYYAMTGWRLGWLLVPVELRRAVECLTGNFTICPPVLSQLAAVAAFTPEATAEADGHLHHYAKNRALLLDGLRGIGITRLAPTDGAFYVYADVSDFTDNSMEFCSKLLEQTGVAIAPGIDFDTTRGNSFVRLSFAGPTTDIEEAVRRLGSWLRAR

SEQ ID NO: 64683 - protein, 171 aa, Escherichia albertii
IGVYKDETGKTPVLTSVKKAEQYLLENETTKNYLGIDGIPEFGRCTQELLFGKGSALINDKRARTAQTPGGTGALRVAADFLAKNTSVKRVWVSNPSWPNHKSVFNAAGLEVREYAYYDAENHTLDFDALINSLNEAQAGDVVLFHGCCHNPTGIDPTLEQWQTLAQLSVE

SEQ ID NO: 64684 - protein, 400 aa, Physcomitrella patens subsp. patens
MLLLSHLHAFVQIAGSNGLAEFSGMKSVNCVTFEKRSDDLSTIVAAQTVVAASSGASRAVTEAKIKVAINGFGRIGRNFIRCWHGRKDSPLDVVVINDTGGVKQASHLLKYDSMLGTFNADVKVEGNDAISVDGKVIKVVSDRNPLNLPWGEMGIDLVIEGTGVFVDEAGAGKHIQAGAKKVLITAPGKGAIPTYVVGVNEQDYKHSDAIISNASCTTNCLAPFVKVLDEKFGIIKGTMTTTHSYTGDQRLLDASHRDLRRARAAALNIVPTSTGAAKAVALVLPNLKGKINGIALRVPTPNVSVVDLVVQVEKKTFAEEVNQAFRDACETEQLKGVLAVCDEPLVSVDFRCTDVSSTVDSSLTMVMGDDMVKVVAWYDNEWGYSQRVVDLANLVAEKWQ

SEQ ID NO: 64685 - protein, 266 aa, Rhizobium leguminosarum bv. viciae 3841
MARSALLNVMVQAALKAGKSLGRDFGEVQNLQVSVKGPGDFVSTADRKAEKIVREELLKARPTYGFLGEESEEINGTDGAHRWIVDPLDGTTNFLHGIPAFAVSIALERNGEIVAAVVFNPATDELYTAERGGGAFLNDRRLRVAARRALSDSVIGCGVPALGKRNHGKFLVELRHVMGEVAGIRRLGSPTLDLAYVAAGRFDGFWEAELAPWDMAAGILLIREAGGFATDWDGGATMLESGAIVAGNEIIHKALIEVVKRPVPAK

SEQ ID NO: 64686 - protein, 124 aa, Glycine max
MSQDKAAGEKAAAEPKRQTPRLNERILSSLSRRSVAAHPWHDLEIGPGAPAVFNVVVEITKGSKVKYELDKKTGMIKVDRILYSSVVYPHNYGFVPRTLCEDNDPIDVLVLMQEPVLPGTFLRA

SEQ ID NO: 64687 - protein, 272 aa, Oryza sativa Japonica Group
MAVATLSSRSRRACAEAASVLLVLLVIAPSVAAGGDTNGVYEPCADAAVQRGDGFTFGVAFAARGDFFSGGVQLSPCDGRLSLASKGAKLAVFRPEVDEISLLTVNTSAAGGFDPLNIMKPLVFLIGHYFAMCQATSGGYMVAFAGRKYAARSPPVFVSNSSYTVTSFTLVFEFNKGTLQNLYWKANGCSACSGQPSFTCVDQNCAISTANCTGKGGSVDCSPGIQLAFSGTDKHEAVLNSWYEVSKLRQYSLVGLFSNLKDSLTSQFSIFF

SEQ ID NO: 64688 - protein, 207 aa, Geobacillus stearothermophilus
AAMKVYDVTAPIYEGMPVYKNKPEKQPKRTTITNGYVTESRIDMDVHTGTHIDAPLHMVEGGATFETIPLNDLVGPCKLFDLTHVNDRITKDDIAHLDIQEGDFVLFKTKNSFEDAFHFEFIFVAEDAARYLADKQIRGVGIDALGIERAQEGHPTHKTLFSAGVIIIEGLRLKDVPEGRYFMVAAPLKLVGTDAAPARVLLFDREP

SEQ ID NO: 64689 - protein, 253 aa, Bacillus pumilus SAFR-032
MNLAGKVVLITGGASGIGLAAVKLFLEHGAIVAVADINEKSGKQLVESLPHEHLAFFKTDITNESDCQKTVQSVLNQFGTIDVLINNAGIEIVSPVHEMTLEDWNHIVQVNLTGVFLMSKHTLPHMLEKKSGSIINTGSVGGLVGWPDIPAYNATKGGVIQLTKSMAVDYAAHQIRVNCIAPGIIDTPLNEKSFVDNHSESLEVVKKEKAKVNPLRRLGKPEEIAGVMLFLASDLSSYMTGSVVTADGGYTAR

SEQ ID NO: 64690 - protein, 162 aa, Glycine max
MAPITVGDVVPDGTISFFDENDQLQTVSVHSIAAGKKVILFGVPGAFTPTCSMSHVPGFIGKAEELKSKGIDEIICFSVNDPFVMKAWGKTYPENKHVKFVADGSGEYTHLLGLELDLKDKGLGIRSRRFALLLDNLKVTVANVESGGEFTVSSAEDILQAL

SEQ ID NO: 64691 - protein, 398 aa, Bacillus pumilus SAFR-032
MVKILPSNMIERLPEQKFGTVFEKIAHKTQQGANIINLGQGNPDLPTPAHIVCALQEAAGSLPFQQYAPFRGFDFFKQAIADFYRKEFSIEVDPKKEIALFTGGKTGLYVMSQCLLDPGDIAFVPDPGYPEYHSGILMADAKPYCIRLEEENGYLPNFSSIDPGVLKKAKVLFLNYPNNPTGAVANEAFFEEAAAFASTHGLHVIHDFAYGSFHYEQKPISFLKAPLGKNVGVELYSLSKTFNMAGWRVAFAVGNEDIIHAINAFQDHIFVSMYGGFQHAATVALQSDDSHIQSLKEVYLERMTFFIRQAEKQLGWTIARPAGAFYLWAPIPDEFEDSHTFADYLLEHADVVVTPGGVFGTHGRRHVRISMVAPIEQLALFIDRLHILPIRFHQKTRI

SEQ ID NO: 64692 - protein, 315 aa, Glycyrrhiza glabra
MAAAIEIPTKVLPNSTCELRVPVIGMGSAPDFTCKKDTKEAIIEAIKQGYRHFDTAAAYGSETALGEALKEARDLGLVTREDLFVTSKLWVTENHPHLVVPALRKSLETLQLEYLDLYLIHWPLSSQPGKFSFPIQAEDLLPFDVKGVWESMEESLKLGLTKAIGVSNFSVKKLQNLLSVATIRPAVNQVEMNLAWQQKKLREFCNANGIVLTAFSPLRKGASRGPNEVMENDMLKGIAEAHGKSIAQVSLRWLYEQGVTFVAKSYDKERMNQNLQIFDWELTTEDHQKIDQIKQNRLIPGPTKPQLNDLWDDEI

SEQ ID NO: 64693 - protein, 313 aa, Ustilago maydis 521
MEFVSQQFNSTVGSILNPTTTHLAADLYKNTDFASLNVLERAWANWYLYWGNPVLATGIMSFVLHELVYFGRAIPWIIIDSMPSMRKYKLQDEKIPTPEQQWKCTKYVLLSHFTVELPQIWSFHPICEYFGLATHDVPFPHWTKIAWQIGVFFLFEDAFHYWAHRALHWGPLYKHIHKKHHEYSAPFGLAAEYAHPLEVLILGMGTIGGPFALCAFTKDLHILTVYIWIVLRLFQAIDAHSGYDFPISLHNWVPFWAGADHHDYHHQAFVGCYSTSFRWWDHMLGTDLSYKRARARQAEKKREALQAAKAKAQ

SEQ ID NO: 64694 - protein, 187 aa, Triticum aestivum
  misc_feature (87)..(87): Xaa can be any naturally occurring amino acid
  misc_feature (122)..(122): Xaa can be any naturally occurring amino acid
  misc_feature (138)..(138): Xaa can be any naturally occurring amino acid
  misc_feature (145)..(145): Xaa can be any naturally occurring amino acid
PACSEPPVGSIEYSYASNASGALPYGRPAGGRASDFDRPPGQWYQRRARRGDQILTTNLWSAELSKLAANASLAQRISSVNAMSALXEATGGDVAEASYAVAEDAPTGPKGGTASGGCGGAXSRKDILHLRAVCECTXLPEVPNXGNGGIAHPRTPPAAGGGRGVPPPCSAGARTGGRPRRARPRDR

SEQ ID NO: 64695 - protein, 137 aa, Glycine max
MSEEFDESEIIFSDSFFPIRRREDVIEKENRPVNFRENSESRMRNTSRLSKTTPLPSPAVFSSSLPVNIPGRRYSEDEEYSEDGGRRMVPPHLIVGRRIESGQMAFSVCTGQGRTLKGRDLSRVRNSVLRLTGFLEA

SEQ ID NO: 64696 - protein, 352 aa, Glycine max
MGTEGYTYMGRSLSELRINDDSSSSAFSDCNSDRSGEFATASSQTRRFLIACATENSDDLIRQLVADLHSSSIDDQKQAAMEIRLLAKNKPENRIKIAKAGAIKPLISLISSPDLQLQEYGVTAILNLSLCDENKEVIASSGAIKPLVRALNSGTATAKENAACALLRLSQVEENKAAIGRSGAIPLLVSLLESGGFRAKKDASTALYSLCTVKENKIRAVKAGIMKVLVELMADFESNMVDKSAYVVSVLVAVPEARVALVEEGGVPVLVEIVEVGTQRQKEIAVVILLQVCEDSVTYRTMVAREGAIPPLVALSQSGTNRAKQKAEKLIELLRQPRSGNGAARSTSEVVA

SEQ ID NO: 64697 - protein, 444 aa, Klebsiella pneumoniae subsp. pneumoniae MGH 78578
MSSAKKIGLFACTGVVAGNMMGSGIALLPANLASIGGIAIWGWVISIIGAMSLAYVYARLATKNPQQGGPIAYAGEISPAFGFQTGVLYYHANWIGNLAIGITAVSYLSTFFPILNNPVPAGIACIAIVWIFTFVNMLGGTWVSRLTTIGLVLVLIPVVMTAVVGWHWFDVATYQANWNTSSTTDSHAVIKSILLCLWAFVGVESAAVSTGMVKNPKRTVPLATMLGTAMAGIVYIAATQVIAGMYPASQMAASGAPFAISASTILGGWAAPMVSAFTAFACLTSLGSWMMLVGQAGVRAANDGNFPKVYGEVDNNGIPKKGLLLAAVKMTALMVLITLMNSAGGKASDLFGELTGIAVLLTMLPYFYSCVDLIRFEGINIRNFVSLICSVLGCVFCFIALMGASSFELAGTFIVSLIILMFYGRKMHQRQNNASDNNTTANAH

SEQ ID NO: 64698 - protein, 527 aa, Photobacterium profundum SS9
MYWRGRSDSNGYRNSAIRFCDNGSSKKDIAMIKSVPLFIDGEFRQSVTEEWVDVTNPATNDVIAELPCATEPEMVEAITSAANAFQSWKAVAVPDRARLMLRYQHLLKEHHDELATLLSQETGKILADAKGDVWRGIEVVEQAANIASNMMGEMVENVATDIDTYSITQPLGVCCGITPFNFPAMIPLWMFPIAIASGNTFVLKPSEQVPLTSIRLAELFEQAGAPKGVLQIIHGRKQQVDFLLSHPDIRTISFVGSVPVAQYIYQTGTQHFKRVQAFAGAKNHMVVMPDANKAQVISNLVGASVGAAGQRCMAISVAVFIDGAKEWIPDLKNEMEKIQPGCWDDANAGYGPLISAPAKTRVLGLIQEGKDQGAVCELDGSQCTVDGFPNGNWIGPTLFSGVKTNMSIYQQEIFGPVLMCIEVDTLEDAIALVNNNPYGNGTSIFTASGGAARKYQHEIQVGQVGINVPVPVPLPFFSFTGWRGSFYGDLHAYGKQAVRFYTETKTVTARWFDDDIPSGPNFTIHLK

SEQ ID NO: 64699 - protein, 283 aa, Photobacterium profundum SS9
MAILQTKAKPNDPHFLANQQIMVELIDNLQSNLHVIKQGGGQTAIDRQRQKGKLPVRERVALLLDKGTHFLEIGQFAAWRVYDEPVPCAGVVAGIGKIEGIECMVIANDPSVKGGTYYPLTVKKHLRAQEIAERCHLPCVYLVDSGGANLPHQAEVFPDKDHFGRIFYNQARMSAKGIPQIAVVLGLCTAGGAYVPAMADVSIIVKEQGTIFLAGPPLVKAATGEIVTAEELGGADVHCKKSGVADYYANNEIHALTIARQTIASANQVPTVTAQKTTLPPTL

SEQ ID NO: 64700 - protein, 194 aa, Photobacterium profundum SS9
MANNGILFSESSQKGAHFIELCAKRKIPLLFLQNITGFMVGKKYESEGIAKHGAKLVMAVACADVPKFTVIVGGSYGAGNYGMCGRAYSPTMMWMWPNARISVMGGEQAAGVMAQVKRDAKNRQGEQWSAEEENDFKQPIIELYENQGHPYYASARLWDDGIIDPKDTRDIVGQALTAALRAPIPDSQFGIFRM

SEQ ID NO: 64701 - protein, 181 aa, Alteromonadales bacterium TW-7
MWNIPNTLTTFRLFLIPIFLVIFYLPYSWAFFAAAFIFWLASITDILDGYLARKLEQSTPFGAFLDPVADKVMVCAALVALSDQYQSMYMTIPALIIISREIVISALREWMAEQGKRGNVAVSNMGKIKTAAQMLAIIGLIWQYDTWMNYLSFGLLYIATFLTLSSMLQYLNAAWSELTKN

SEQ ID NO: 64702 - protein, 550 aa, Cryptococcus neoformans var. neoformans B-3501A
MEGFDLPMSFGKKSKAGNSNLKAKVENTKRADIPTPVKEEKPEEEVPGPSISTSGRKTEAEEEDDEEIGPIPPSATGKRKAEENDESDDEQEAEEEVDRLPISHEIILKDHTKVVSALAVDPSGARIATGSHDYDTKLWDFGGMDHRLKPFKSFEANGNYYVHDLSYSPDGQQLLVISGTVHPKVFNRNGEDEMEFNKGDVYLRDMKNTNGHTAEINAGAWHPTDKSIFLTCSNDSTLRIWDTSNKRKQKQVIVVKSKERGARTKVTACAWSPDGKWIAGVCLDGTLHIWDTSSNFARPKYSCENAHPKNTDTTGVAFSRDGLRVATRGGDDTVKLWDIRSIRNPLAVAKNLDNLYPETNIIFSPDDTQILTGTAAPKGQKGGLVFLNSKDLKEERRIAIGDGSVVRVLWHSRINQIFATLSTGGVHVLYSPNSSIHGALLPLAKLPKTAPRDPSFSTVDLKPVIYTPDALPMYQEQGHRESLHQKEKKAKKMKPMEPVSGVGRAGRLGASETQSFVHSMYPETLKFEDPREALLKYASKEEQEKKKQEM

SEQ ID NO: 64703 - protein, 335 aa, Candida albicans SC5314
MTIKVAFLGPEGTYTHQVCSHTIPYTDFIFLFLLGYLLTIIFKALIQQFGTENVSIYPQQSIGDCFHILNEKKVDYAVVPFENSTNGQVVFTYDLLRDWYFQTSTPPKFRIIAEQFVSIHHNLLTNASKIEDIKTIYSHPQVWTQVNKFLQSLPQQITKIDVGSTSKAAEIVSQDTITTSGSSSAAISSYMSSELYKLPILKEGIEDNQSNTTRFLILGYDSPISPPPAAASNNDDDNSKRNTTIVSSIMFTLNHDDPGALCDVLVKFKEYGITLTSINSRPANLKPWQYVFFVEMIGDIHQEGLVEKIKESCLELVILGVFQRSWRYNNNSNDQ

SEQ ID NO: 64704 - protein, 259 aa, Triticum aestivum
MDITINSLTYKGSIPDAINQSRREKKLFVIYISGQDETSSSLEQSTLVDEHVAAVISRCCIFLQLKQGNVDALQFSAIYPQKSVPSISVVGLNGAMLWNHEGYISPEELKESIDKAWAALQLQETAATLLAASLASRMSEPANTASTTMPGEDGSSTSENHSNSSGQSSESSAVRGFANSTALVAQPPSSTSHAELLKTSKIPKSDSAPCNITAEEKLDSACQALLPRFSSKSNVDIPQVPNQTGSTPSPKRKNMVDGE

SEQ ID NO: 64705 - protein, 498 aa, Oryza sativa
  misc_feature (48)..(48): Xaa can be any naturally occurring amino acid
  misc_feature (68)..(68): Xaa can be any naturally occurring amino acid
  misc_feature (279)..(279): Xaa can be any naturally occurring amino acid
PPVSAYSDEDLVERAFEPAQKIVVSISSDPDDPDADDEHLYYGGHAPXFSWRKLWLFTGPGFLMSIAXLDPGNLEGDLQAGATAGDTLLWLLFWATAMGLLVQLLAARLGVATGKHLAELCRDEYPDWARRALWLMAEVSMVSADIQEVIGSAIAIKILSNGFLPIWVGVVITALDCFFFLSLENYGVRKLEAVFAVLIATMALSFAWMFFKTKPNGKDIIIGILVPRLSSRVISQAVGLVGCVITPHNVFLHSALVQSRKIDPHKEYQVREALRYYTXESTMALVVPFMINLFVTTVFAKGFYGTKEAGNIGLENAGHFLQEKFGEDFFPILYIWGIGLLAAGTSSTITGTYAGQFIMSGFLNWRLKKWIRALITRSFAIVPTITVAVYFNTSDSALDVLNEWLNVLQSIQIPFALIPLITLVSKEQVMGVFKIGPRTQIATWAVASVPIIINGCLLLDFFSSEVKGLLSGLVLFAAVLAYVSFLLYLIFRGIAVFS

SEQ ID NO: 64706 - protein, 211 aa, Triticum aestivum
  misc_feature (36)..(36): Xaa can be any naturally occurring amino acid
  misc_feature (151)..(151): Xaa can be any naturally occurring amino acid
  misc_feature (160)..(160): Xaa can be any naturally occurring amino acid
  misc_feature (169)..(169): Xaa can be any naturally occurring amino acid
HTKRGCKKRGATGPEFPGYRRPTRPSHVPPVMASSXTSVAPFQGLKSTAGLPVSRRSNGASLGSVSNGGRIRCMQVWPIEGIKKFETLSYLPPLSTEALLKQVDYLIRSKWVPCLEFSKVGFIFREHNASPGYYDGRYWTMWKLPMFGCTXDATQVINEXEEVKKEYPXAYVRIIGFDNLPQGQCVSFIAFKPPGCKEPAKAKQFLTTGPI

SEQ ID NO: 64707 - protein, 200 aa, Rickettsia sibirica 246
MSVFVGKTAPDFTAKAIMPNNNIDDKFKLSNYAAGDNIVLFFYPLDFTFVCPSEIIAFHNKLGEFTERRTKVVAVSVDSHFSHLAWKNTPHNKGGLGQVQFPMVSDIKKDISSKYNVLNEDGVALRGTFLIDKDFIVRHMLVNDLPIGRDINYTLKVIDALIHHQKHGEVCPAGWHKGEEAITPSHEGIAHYLSSHAEKL

SEQ ID NO: 64708 - protein, 599 aa, Oryza sativa Japonica Group
MGNTCVGPSISKNGFFQSVSTVLWKARQDGDDALPGANGAPDFCCQGRLPAPPPPTSDAPLAVQNKPPEHVKIVSTTDTASAEQDASKSSAGSDSGEAARPRPRVPPVKRVSSAGLLVGSVLKRKTESLKDKYSLGRKLGQGQFGTTYLCVERATGKEFACKSILKRKLVTDDDVEDVRREIQIMYHLAGHPNVISIRGAYEDAVAVHLVMELCAGGELFDRIVQKGHYTERKAAELARVIVGVVEVCHSMGVMHRDLKPENFLFADQTEEAALKTIDFGLSIFFRPGQVFTDVVGSPYYVAPEVLKKKYGQEADVWSAGVIIYILLCGVPPFWAENEQGIFEEVLHGRLDFQSEPWPSISEGAKDLVRRMLVRDPKKRLTAHEVLRHPWVQVGGLAPDKPLDSAVLSRMKQFSAMNKLKKMALRVIAENLSEDEIAGLKEMFKMIDTDNSGQITFEELKVGLKKVGANLQESEIYALMQAADVDNSGTIDYGEFIAATLHMNKIEREDHLFAAFQYFDKDGSGYITADELQLACEEFGLGDVQLEEMIREVDEDNDGRIDYNEFVAMMQKPTMGLPAKKSGGLQNSFSIGFREALRMS

SEQ ID NO: 64709 - protein, 284 aa, Pseudomonas syringae pv. phaseolicola 1448A
MVSHNLPHKDPFMSKTRIAFVGAGNMAASLIGGMRAQGVDAALICASAPGAETRERIANDHGIQVFADNAEAIKGADVVVLAVKPQMMKNVCQALKSSLEANQLIVSVAAGITCASLTQWLGDQPVVRCMPNTPSLLRQGASGLYATDKVTAEQREQAEQLLSAVGVAVWVEQEKHMDAVTAVSGSGPAYFFLMMEAMTAAGVKLGLPEDIAKKLTLQTALGSALIATGSDVGAGELRRRVTSPGGTTEAAIKAFQAGGFEALVETALTAADHRAAELAEQLGK

SEQ ID NO: 64710 - protein, 201 aa, Triticum aestivum
LMNQDKVLMESWYYLKDAVLDGGIPFNKAYGMSAFEYHGTDPRFNRVFNEGMKNHSIIITKKLLELYKGFNGVGTLVDVGGGIGATVGAITAHYPTIKGINFDLSHVISEAPPFPGVTHVGGDMFQKIPSGDTILMKWILHDWSDEHCATLLKNCYDALPTHGKVMLVECILPVNPEATPKAQGGFHLDMIMLAHNPGGKE

SEQ ID NO: 64711 - protein, 339 aa, Neisseria meningitidis
MKNILVTGGTGFIGSHTVVSLLKSGHQVVILDNLCNSSINILPRLKTITGQEIPFYQGDIRDREILRRIFAENRIDSVIHFAGLKAVGESVAEPMKYYDNNVSGSLVLAEEMARAGVFSIVFSSSATVYGDPGKVPYTEDMPLGDTTSPYGTSKSMVERILTDIQKADPRWSMILLRYFNPIGAHESGLIGEQPNGIPNNLLPYICQVAAGKLPQLAVFGDDYPTPDGTGMRDYIHVMDLAEGHVAAMQAKSNVAGTHLLNLGSGRASSVLEIIRAFEAASGLTIPFEIKPRRAGDLACFYADPSYTKAQIGWQTQRDLSQMMEDSWRWVSNNPNGYDD

SEQ ID NO: 64712 - protein, 239 aa, Magnaporthe grisea 70-15
MKFNISNPSTGAQKLVEVEDERKLRFFMEKRMGAEVSAEPLGDEWKGYILKITGGNDKQGFPMKQGVLLPNRTRLLLSDGHSCYRARRTGERKRKSVRGCITGMDLSVLAVSIAKRGEQDIPGLTDVVHPKRLGPKRATKIRKFFDLSKEDDVRKYVIRREVQPKGEGKKPYTKAPKIQRLVTPQRLQHKRHRIALKKRQSEKVKDAANEYAQILAKRVAEAKATKADARKRRASSMRK

SEQ ID NO: 64713 - protein, 379 aa, Pseudomonas syringae pv. phaseolicola 1448A
MKAIVYGGPRDVSVKNVPDAKIQKPTDALVRVTSTNICGSDLHMYEGRTSFETGRIFGHENLGQVIEVGAGVDRIKVGDWVCLPFNIGCGFCENCEKGLTGYCLTANPGSAGAAYGFADMGDHEGGQAELLRVPYADFNCLLLPEDAAEREEDYVMLSDIFPTGWHATELAGLLPGESVAIYGAGPVGLMAAHSAMIKGASQVFVVDNHPDRLALAAKMGATPINSLEQGAVDQILNLTNGKGTDRGCECVGYQCCDRHGHEANHVTMNNLVASTKATGGIGVVGVFVPQDPGAHNDLAKEGKMAFDFGSFWFKGQQIRTGQANVKAYNRRLAELIHHDRAKPSQIISHRLKLEEGPAAYQHFDARDEGWTKVVLKPSA

SEQ ID NO: 64714 - protein, 280 aa, Methanothermobacter thermautotrophicus str. Delta H
MEESDIYYWKGVAVRMAEQVERAVSPLVGTEDAGEIIKMGADGTPTKLIDLVAEDEAVGVLESTGRPVTIISEEIGVLHINSEGDEPGIIFVVDPLDGTSNAIRNIPFYGISVAVAERHPDGAAPTLNNVLMGFVKNFATGDLYWAIKGQGAFLNEKAISSSSQSSLDRTSLGAFIYGTRFRRVDSICRVIRRMRILGSVALELAYVASGSYDAFMDLRENLRIVDIAASKLIVEEAGGVVTNERGGEIDGLLNVKARTSLVAAGNLELHEKIMQTLEVI

SEQ ID NO: 64715 - protein, 310 aa, Thermoplasma volcanium GSS1
MSFSDYISRIKDNIRNSIKGKAIIAVSGGQDSSLLSLLASEVLGNNLLCVFIDTGLLRKNETGRVKDFFEKHSMNYVIVDAADTFINNLKGVTDPEEKRKIIGKTFIDVLSEQAQNFGAEYLLQGTIAPDWIESGGQKRDTIKSHHNVGGLPKDMKLKLVEPLRDYYKDEIRGMSKELGLPTDIQPFPGPGLAVRIIGEVTKEKLDLLRAVTDIVERKISEAMPSESRPWQYFAVLLPVRTTGVHGDRRAYGLTVGIRMIETTDAMTGTFSKPSWDLLEDISNTITDEIPEINRVVYDITNKPPATIEWE

SEQ ID NO: 64716 - protein, 583 aa, Arabidopsis thaliana
MSGPVDRFAIPCFEGILSSDEKKERKSDFENSEDERRTRIGSLKKKAINASTKFKHSLKKKRRKSDVRVSSVSIEDVRDVEELQAVDEFRQALVMEELLPHKHDDYHMMLRFLKARKFDIEKAKHMWADMIQWRKEFGTDTIIQDFQFEEIDEVLKYYPHGYHSVDKEGRPVYIERLGKVDPNKLMQVTTLDRYIRYHVKEFERSFMLKFPACTIAAKKYIDSSTTILDVQGVGLKNFTKSARELITRLQKIDGDNYPETLHQMFIINAGPGFRLLWSTVKSFLDPKTTSKIHVLGCKYQSKLLEIIDSSELPEFLGGACTCADQGGCMLSDKGPWKNPEIVKMVLHGGAHRAKHVVKVLNSDGKVIAYAKPSYPWIKGSDTSTAESGSEAEDIVVSPKAVKSYSHLRLTPVREEAKVGSGETSFAGSFAGYDEYVPMVDKAVDATWKVKPTAINRAPSKGAHMPPNVPKDHESFSARVLVTFMAFVMAILTFFRTVSNRVVTKQLPPPPSQPQIEGSAAAEEADLLNSVLKKLTELEEKIGALQSKPSEMPYEKEELLNAAVCRVDALEAELIATKKALYKL

SEQ ID NO: 64717 - protein, 355 aa, Triticum aestivum
  misc_feature (264)..(264): Xaa can be any naturally occurring amino acid
  misc_feature (282)..(282): Xaa can be any naturally occurring amino acid
  misc_feature (293)..(293): Xaa can be any naturally occurring amino acid
MARRSAPLLRRVLSPAPPSPLAGAVSRRTVTYMPRPGDGAPRTVTLIPGDGIGPLVTGAVRQVMEAMHAPVCFETYEVHGDMPSVPPEVIESIRRNKVCLKGGLATPVGGGVSSLNLQLRKELDLYASLVNCFNLPGLPTRHDNVDIAVIRENTEGEYSGLEHEVVPGVVESLKVMTKFCSERIAKYAFEYAYLNNRKKVTAVHKANIMKLADGLFLESCREVATKYPGIQYSEIIVDNCCMQLVAKPEQFDVMVTPNLYGNLXVSNVAAGIAGGTGVMPGXGNVGQDHAIFXQGASARNVGNDKIGATRRTTNCPFSFNNLFNSIQRWTIKFRNSGKVLGTPPRFPGTPNFTPL

SEQ ID NO: 64718 - protein, 233 aa, Ralstonia eutropha JMP134
MSTPTYRIAPSILSADFARLGEEVRRVTEAGADWIHFDVMDNHYVPNLTVGPLVCEAIRPHVTAPIDVHLMVRPVDRIIPDFAKAGANIITFHPEASEHVDRSLALIRDNGCQAGLVFNPATPLHHLDHVMDRLDVILLMSVNPGFGGQSFIPETLNKLRAVRQRIDAYTERTGRKILLEVDGGVKVDNIAEIAAAGADTFVAGSAVFGKPDADGGYRGIISALRGELAKVGQ

SEQ ID NO: 64719 - protein, 654 aa, Leptolyngbya boryana
MTDTLAAPTLNKFEKLKAEKDGLAVKAELEHFARLGWEAMDETDRDHRLKWLGVFFRPVTPGKFMLRMRVPNGIITSGQTRVLGEILQRYGDDGNADITTRQNFQLRGIRIEDLPEIFRKFDQAGLTSIQSGMDNVRNITGSPVAGIDADELIDTRGLVRKVQDMITNNGRGNSSFSNLPRKFNIAIAGCRDNSVHAEINDIAFVPAFKDGTLGFNILVGGFFSGKRCEAAIPLNAWVDPRDVVAVCEAILTVYRNLGLRANRQKARLMWLIDEMGLEPFREAVEKQLGYAFTPAAAKDEILWDKRDHIGIHAQKQPGLNYVGLHVPVGRLYAQDLFDLARIAEVYGSGEIRLTVEQNVIIPNVPDSRVSALLREPIVKRFSIEPQNLSRALVSCTGAQFCNFALIETKNRAVALMQELEQDLYCPRPVRIHWTGCPNSCGQPQVADIGLMGTKVRKDGKTVEGVDLYMGGKVGKHAELGTCVRKSIPCEDLKPILQEILIEQFGARLWSDLPESARPNPTALITLDRPTVETPNGKSTTVQELNAQEFDYVLSAPPVVKAPTEIAAPATIRFAQSGKEITCTQDDLILDIADQAEVAIESSCRSGTCGSCKCTLLEGEVSYDSEPDVLDEHDRASGQILTCIARPVGRILLDA

SEQ ID NO: 64720 - protein, 205 aa, Ralstonia eutropha JMP134
MAWTPTSEPGNKGEKAMLLMIDNYDSFTYNLVQYFGELGEDVRTYRNDEITIEEIEALKPDHICVSPGPCSPKEAGISVAALQHFAGKVPLLGVCLGHQAIGEAFGGKVIRAKQVMHGKVSTIETTQQGVFAGLPKHFDVTRYHSLAIERETLPDCLEVTAWTPDGEIMGVRHKTLAIEGVQFHPESILSEQGHALLANFLKTTR

SEQ ID NO: 64721 - protein, 332 aa, Capsella rubella
RTYAWVANRDHPLSSSIGTLRISDNNLVVLDQSETPVWSTNLTGGSVSTPVVAELLDNGNFVLRDSNNNNPDGYLWQSFDFPTDTLLPEMKLGWDLKTGSNRLIRSWKRPDDPASGDFTFKLETGGFPEIFLWYKESLMYRSGPWNGIRFSGVPEMQPFDYMVFNFTTSSDEVTYSFRVTKSDVYSRVSLSSMGVLQRFTWIETAQTWNLFWYAPKDQCDEYKECGAYGYCDSNTSPVCNCIKGFKPRNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64722 - protein, 322 aa, Alteromonadales bacterium TW-7
MSTIFEDNSLSIGNTPLVKLKRVTGGNVFAKVEARNPSFSIKCRIGASMIWEAEKAGQLTEGKELIEPTSGNTGIALAFVAAARGYKLTLTMPNTMSLERRKLLKALGANLVLTDGAKGMNGAIQKAKEIQATDPEKYILLQQFENPANPKIHFETTGPEIFDALDGKVDYFVAGVGTGGTITGVSRYLKTEKGLNVKSIAVEPTNSPVISQTLAGEEVKPGPHKIQGIGAGFIPGNLDMSLIDAAEQVSNEDAIAMAHELMKKEGILVGISSGAAVVAAKRIAEKPENADKNIVVILPSATERYLSSPLFDEEFSDQELVQ

SEQ ID NO: 64723 - protein, 254 aa, Triticum aestivum
MGAPGAAPLAGNSFVILSVAVVGILATSLLLLAYYLFLTRCGLASWRRDHDDVVTTTQHHHHIVYSTAPEPSRGLEEAAIRRIPTLRYRESKQLQAPQAQAASECAVCLSEFQEGERLRLLPPCLHLFHIDCIDAWLHATANCPLCRTAISGSACQPQPHVILNQIDIVNVLQADHQPMRRSLSMDSCNDKHLYLALQKVLRHHHSHSASLGEDRKGESSTPAAAASSRAAGRLRRSFLSFSHSRSSRSAILPI

SEQ ID NO: 64724 - protein, 453 aa, Populus trichocarpa
MQKRDLNKSGGSGGGSAAPAPKRGRPFGSTSGSAAASFAADFVAPSTLLGPSLQVHTSFAASDQNNKRIVLALQSGLKSELTWALNTLTLLSFKEKEDMRKDSLAKISGLLDALLQVIDDWRDIALPKELQKTRRVRTLGSNSLVTGFGYEYEALGSNDNVKQSGLTDASVQKNVAKFRPSEWWYDEDGLFNLDDEGRAEKQQCAVAASNIIRNFSFMPENEVIMAANRHCLETVFQCIEDHSTEDEELVTNALETIVNLAPLLDLRIFSSSKPSYIKITEKRAVQAIMGMLGSAVKAWHCAAAELLGRLIINPDNEPFLLPFFPQIHKRLVDLMSSPALDAQAAAVGALYNLAEVNMDCRLKLASERWAVDRLLRVIRAPHPVPEVCRKAAMILESLVSEPQNKALLLAYENAFAEILFSDTRYSDTFARILYELTSRPSNKFTAARGVWGM

SEQ ID NO: 64725 - protein, 175 aa, Triticum aestivum
MAPTVMASLATSVAPFQGLKSTAGLPVSRRSNGASLGSVSNGGRIRCMQVWPIEGFKKFETLSYLPPISTEALLKQVDYLIRSKWVPCLEFSKVGFIFREHNASPGYYDGRYWTMWKLPMFGCTDATQVINEVEEVKKEYPDAYVRIIGFDNMRQVQCVRFIAFKPPGCEESGKA

SEQ ID NO: 64726 - protein, 307 aa, Klebsiella pneumoniae subsp. pneumoniae MGH 78578
MNGKIWVLGDAVVDLLPDGEGRLLQCPGGAPANVAVGVARLGGDSGFIGRVGDDPFGRFMRHTLAQEQVDVNYMRLDAAQRTSTVVVDLDSHGERTFTFMVRPSADLFLQPEDLPPFAAGQWLHVCSIALSAEPSRSTTFAAMEAIKRAGGYVSFDPNIRSDLWQDPQDLRDCLDRALALADAIKLSEEELAFISGSDDIVSGTARLNARFQPTLLLVTQGKAGVQAALRGQVSHFPARPVVAVDTTGAGDAFVAGLLAGLAAHGIPDNLAALAPDLALAQTCGALATTAKGAMTALPYRDDLQRSL

SEQ ID NO: 64727 - protein, 861 aa, Arabidopsis thaliana
MAAVIRKLLPFPSPNPKRDNRESDDDDETSSGYRIEYSFASEYKGPLIANVPRALPVEVDQIPTALPVSFSSLRSGISYPVAPLVMTKDTKRPPDSGIEKKNGFVDSAAGSSVVLIGRDVVSGSSSSSSSKRLDVPEEVKSPADFRLSPSSPLSASAREEDHLDDDRVSDVGPRAVRFVEPFQSSECDESSYVSDGESIAATHRAERKGKRGSCYRCQLGNRFTEKEVCIVCDAKYCFNCVRRAMGAMPEGRKCQACIGYRIDESKRASLGKCSRMLKRHLTDSELRQVMNAEITCKANQLPSRLIIVNDKPLSEDELYTLQTCPNPPKKLKPGHYWYDKVAGYWGKIGEKPSQIISPNNSIGGYISEKVSNGDTEIYINGREITKPELTMLKWAGVQCEGKPHFWVDSDGSYREEGQKHPIGNIWSKKRAKIACAVFSLPVPPASSAVEPYDVPLYEQKMLNKLLLIGSEKGGATTIYKQARSLYNVSFSLEDRERIKFIIQTNLYTYLAMVLEAHERFEKEMSNDQSSGNVGDETSAKPGNSINPRLKHFSDWVLKEKEDGNLKIFPPSSRENAQTVADLWRVPAIQATYKRLRDTLPRNAVYFLERILEISRSEYDPSDMDILQAEGLSSMEGLSCVDFSFPSTSQEESLESDYQHDTDMKYQLIRLNPRSLGENWKLLEMFEDADLVIFCVSLTDYAENIEDGEGNIVNKMLATKQLFENMVTHPSLANKRFLLVLTKFDLLEEKIEEVPLRTCEWFEDFNPLISQNQTSRHNPPMAQRAFHYIGYKFKRLYDSILEPVNMRGRSFKPKLFVCQVSLESDTVDNALRYAREILKWHVEETSMFQEMSTTSIEASSSS

SEQ ID NO: 64728 - protein, 320 aa, Aspergillus oryzae
MTFHPDTLPNLKGKVFIVTGGNSGIGYYTVTHLAEHGAHVYLCARSLEKGTAAIANIKEMHPSANINLLQMDFMDLTSVVAAAKHFLTLETALHGLVNNAGIMATPFEITKDGHEAQWQTNYLAHWVLTEHFLPLMLLTAKGLYPGSVRIVNLTSSGHLGAPKGGINFKDLSLKDSGPWARYGQSKLANILHAKALHKAYGPGSPSARNGEGEIWVSSVHPGLVETNLATSVEDSGSGMTCVFSVLRMFGLMWSADKGSWTSLFCVASQDMKAEQSGTYLEIFRRFGEPRWQSDMANDWKLVKRLEEWTREVVRKEGWVL

SEQ ID NO: 64729 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGAPWLKVKNPNTGKEIVIKDVIADAFLQQILLRPAEYDVIACMNLNGDYISYALAAQVGGIGIAPGANIGYECALFEATHGTAPKYAGQDKVNPGSIILAAEMMVRHMGWTEAADLIVKGMEGAINAKPVTYDFERLMEGAKLL

SEQ ID NO: 64730 - protein, 526 aa, Oryza sativa Japonica Group
MASESESNGHHHAGDEARAENSGAGCLHGGDDGGGTPRTTPEIRYTKLFINGRFVDAASGKTFETRDPRTGDVIARVAEGDKEDVDLAVKAAREAFDHGEWPRMSGSERGRVMAKYAEVVERHADELAALESLDAGKPLAAARAVDVGECVGILRYFAGAADKIHGETLKMSRQLQGYTLREPLGVAGLIVPWNFPAIMFFSKVSPALAAGCTVVVKPAEQTPLSALFLAHLSKQAGVPDGVINVVTGFGPTAGAAISSHMDVDVVAFTGSTEVGRLIMEASAKSNLKPVALELGGKSPFIVFDDADLDKAVELAIGGNFFNKGEACVAGSRVFVQEGIYDRFEQKLADTMKSWVVGDPFDPRVNQGPQVDKAQYERVLGYIEQGKAEGATVLTGGKPCGKKGYYIEPTIFTNVKDDMVIAREEIFGPVMCLMKFKTVEEAIERANGTRYGLAAGLVTRDIDVANRMARSIRAGVVWVNCYFAMDRSCPFGGRKMSGFGKDDSMHALDKFLAVKSVVTPVHGSPWF

SEQ ID NO: 64731 - protein, 389 aa, Escherichia coli
TLQNGKLNVPENPITPYIEGDGIGVDVTPAMLKVVDAAGEKAYKGERKISWMEIYTGEKSTQVYGQDVWLPAETLDLIREYRVAIKGRMTTPDGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64732 - protein, 332 aa, Bdellovibrio bacteriovorus HD100
MFAARYVPGKKELSLVEVPKPTPGPLDVILKIRAAGICHSDLHVLHGEVPYKESFTMGHEACGEVVEKGSEVFGTFNPGDLYAVHGPNPCGHCNYCRTGHDNLCNDPSRTFIGLGQDGAYAEYLKVPARNIVKVPKGISPEVAAVATDAVLTPYHAIKTKGGVGLGSKVLAIGLGGLGMNGVQIALALGAEVTAVDLKDANLETAKSFGVQKVLNSKQISSLTPLSFDVVVDFVGLESTFKDAQNFVKPGGTILLIGLGSAQVPLTTATAITFETKVQASFWGTHVEMQELYELIAEGKIKPQVETAPMKEVNHWLHELEAGRVKSRMALIP

SEQ ID NO: 64733 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGDKLV

SEQ ID NO: 64734 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALASTVGGIGIAPGQTLGDECALFEATHGTAPKYAGQDKVNPGSIILSAKMMLRHMGWTETADLIVKGMEGAINAKTVTYDFERLMEGAKLL

SEQ ID NO: 64735 - protein, 110 aa, Zea mays
MKFNIANPSTGCQKKLEIDDDQKLRAFYDRRISQEVSGDALGEEFKGYVFKIMGGCDKQGFPMKQGVLTSGRVRLLLHMSEIGAVGFTAWQVGESCYNPNRLILSVTCTM

SEQ ID NO: 64736 - protein, 578 aa, Rhizobium leguminosarum bv. viciae 3841
MGRLHIGTISVISALSLSLTSAFAASPAPVEAEHGMVVTAQHLATDVGVEVLKGGGNAVDAAVAVGYALAVVYPSAGNLGGGGFMTIRLKDGTKTFLDFRERAPLAATKTMYLDAKGDIVPRASLDGYLAVGVPGSVMGFETAREKYGTKSREELIAPALRFAKEGFTLEQGDAASFAGNAKRLAKDETAAKIFLKPDGKPYASGEKLQQPDLAAVLEGISEKGPDAFYKAAPAEAIVKASQAKGGILAKEDFEQYAVRELNPIECNYRGYDIISSPPPSSGGVIICEILNVLEGYPLSYLGYNSAETVHIMVEAMRYAYVDRNAALGDPDFVENPVTKLLDKKYALEIAAKIDPYKAGTSANLKPLGGKESTETTHYSIIDDEGNAVAVTYTLNGSFGAAVVAPGTGVLLNNEMDDFTSKPGVPNLYGLVQGEANAIAPKKTPLSSMSPTIVTRDGKPFMVIGSPGGSRIITITLEAILNVVDFGMDISQAVNAPRLHHQWQPDKVFLEPYALSPDTEKTLAAMGYSFDGGNDTPQWGQAAGILVGGKSLAAIAKGGGARYNGAMDSRAAEGSASGY

SEQ ID NO: 64737 - protein, 134 aa, Circaea cordata
ERVRNGSWVGATGKVLKDVIAVGIGGSFLGPLFVHTALQTDPEAGKNARGRELRFLANVDPIDVARSISGLNPETTLVVVVSKTFTTAETMLNARTLREWISSALGSSAVAKHMVAVSTNLPLVEKFGIDPKNA

SEQ ID NO: 64738 - protein, 587 aa, Cucumis melo
MAKVADKPFFPKPFLVFFVLSIIFGFGITLSEAGFPKIRHYKWEVEYMFWSPDCVENIVMGINGQFPGPTIRANAGDMVVVELTNKLHTEGVVIHWHGILQRGTPWADGTASISQCAINPGETFTYRFVVDKAGTYFYHGHLGMQRSAGLYGSLIVDPQEGTSEPFHYDEEINLLLSDWWHQSVHKQEVGLSSKPMRWIGEPQSILINGRGQFDCSIAAKYKNGLKQCELSGKEQCAPFILHVHPKKIYRIRIASTTALASLNFAIGNHKLLVVEADGNYVQPFSTSDIDIYSGESYSVLITTDQNPSENYWVSIGVRARLPKTPPGLTVLNYLPNSVSKLPISPPPETPDWEDFDRSKNFTFRIFAAMGSPKPPVRYNRRLFLLNTQNRINGFMKWAINNVSLALPPTPYLAAMKFRLSTAFNQNPPPETFPIDYDINNPPRNPETATGNGVYKFNMGETVDVILQNANMLNANTSEIHPWHLHGHDFWVLGYGEGKFSAAEDGRKLNLKNPPLRNTVVIFPYGWTAIRFVADNPGVWAFHCHIEPHLHMGMGVIFAEGVHKVGMIPPNAMACGSTAMIKNYPRKP

SEQ ID NO: 64739 - protein, 87 aa, Circaea cordata
GGRYSVCSAVGVLPLSLQYGFAIVEKFLQGAHSIDQHFSSAPFEKNIPVLLGLLSVWNVSFLGYPARAILPYSQALEKLAPHIQQVS

SEQ ID NO: 64740 - protein, 378 aa, Arabidopsis thaliana
MTKMSNLPNDLAEEVLSRVSLTSLRNVRLTCKDWNTLSKGESFAKNHLGYQAIVAAKEKEFMMVLMMDFRVYLIRVNVHNDIESCIKPEGELISLGDEVDVSQVFHCDGLLLCITEDNEDNAKVVLWNPYWGQTRWIESTNNFHKLDMYTYALGYKKSSKSSRSYKILRFIDFSPTCSEFKIYNINSDSWKVLDVSPDWKIDSYIRGVSLKGNTYWIARERHGYGHTFLVCFDFTRERFRSRLPLPSQPCVLDTVSLSSVREEQLAVLFQCSSTLEMQIWVTTKIEPNAVLWNSKVFLAVDMHSLKFQFQVRASSFFIDEEKRVVVVFDKEKRYLASSRNKAYIVGVDGTWEQVDLGMSVDKFVYPLVCSYVPSLVHF

SEQ ID NO: 64741 - protein, 136 aa, Circaea cordata
VSIDGLPLPFESGEIDFGEPGTNGQHSFYQLIHQGRVIPCDFIGVMKSQQPVYLKGEVVNNHDELMSNFFAQPDALAYGKTPEQLKKENVSEHLIPHKTFTGNRPSLSILLPSLDAYRIGQLLAIYEHRVAVQGFI

SEQ ID NO: 64742 - protein, 382 aa, Candida albicans SC5314
MSEQPTEPLSIKEEYQLWRKNCRYMYEFVSETALMWPSLTIQWLPNYTTTNGLIDAKLLLGTHTSNQSANQLKVASTQLSADPNVKANSKIKTVQKLENNAEICRARYMPQDANIVATINGLGEVDLYNLDTETRYSHFAPHTKNGYGLSWNPKQKGLLVTGADDNFVCVTDTTTNKTTFKSDIQKDIVNDVKWHQFNGNLFASVSEDSHVYLFDARDNKVVSQYYAESSNGINSLAFSPFAENLVAIGNTSSNINLLDLRKLGENSGLLHTMMGHSEGITCMEFSPHHDGILATGSQDRRIIIWDLFKVGEEQQQEDAEDGCPELFMMHAGHTAGVSDLSWCPFKDWMIGSVADDNIVHLWEISKKLITNEEAEVDVSILE

SEQ ID NO: 64743 - protein, 380 aa, Archaeoglobus fulgidus DSM 4304
MRLHEYQAKQIFSKHGIRVARGELATSVEDVRGIAEELGGKVVLKSQVLVGGRGKAGGIKKAYSVEEAVEKAKEMFGSVLKGHIVEKIYVEEMIEVQREMYAGLTIDRANKGIAAILSSVGGMDIEEIAVKHPEKIARIAVNPKWGLWDYQIRELLLNSQMPREYWKEVASILKTLYRIMVHYEAELVEINPLVVTPDGLVAADARLNIDDSALFRHRDLEKLRDYTEADQMERIAMEKGLNYVKLDGNVGVLANGAGMAMATMDLIYIYGGKPANFLDIGGGASAEVVREAINLILSDKNVKVVFINIFGGITRCDEVAKGLKEALADVSTPVVVRLAGTNEEEGRKIMDEFAKDRPNFHIVETMEEGAEKAVKLAEEV

SEQ ID NO: 64744 - protein, 332 aa, Capsella rubella
RTYAWVANRDHPLSSSIGTLRISDNNLVVLDQSETPVWSTNLTGGSVISPVVAELLDNSNFVLRDSNNNNPDGYLWQSFDFPTDTLLPEMKLGWDLKTGSNRLIRSWKRPDDPASGEFTFELETGGFPEIFLWYKESLVYRSGPWNGIRFSGVPEMQPYDYMVFNFTTSSDEVTYSFRVTKTDVYSRVSLSSTGVLQRFTWIETAQTWNLFWYAPKDQCDEYKECGAYGYCDSNTSPVCNCIKGFKPRNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64745 - protein, 592 aa, Saccharomyces cerevisiae
MTEDFISSVKRSNEELKERKSNFGFVEYKSKQLTSSSSHNSNSSHHDDDNQHGKRNIFQRCVDSFKSPLDGSFDTSNLKRTLKPRHLIMIAIGGSIGTGLFVGSGKAIAEGGPLGVVIGWAIAGSQIIGTIHGLGEITVRFPVVGAFANYGTRFLDPSISFVVSTIYVLQWFFVLPLEIIAAAMTVTYWNSSIDPVIWVAIFYAVIVSINLFGVRGFGEAEFAFSTIKAITVCGFIILCVVLICGGGPDHEFIGAKYWHDPGCLANGFPGVLSVLVVASYSLGGIEMTCLASGETDPKGLPSAIKQVFWRILFFFLISLTLVGFLVPYTNQNLLGGSSVDNSPFVIAIKLHHIKALPSIVNAVILISVLSVGNSCIFASSRTLCSMAHQGLIPWWFGYIDRAGRPLVGIMANSLFGLLAFLVKSGSMSEVFNWLMAIAGLATCIVWLSINLSHIRFRLAMKAQGKSLDELEFVSAVGIWGSAYSALINCLILIAQFYCSLWPIGGWTSGKERAKIFFQNYLCALIMLFIFIVHKIYYKCQTGKWWGVKALKDIDLETDRKDIDIEIVKQEIAEKKMYLDSRPWYVRQFHFWC

SEQ ID NO: 64746 - protein, 248 aa, Thermoplasma volcanium GSS1
MIKTETSKIKLINEDNLRLDGRSFNELRPIKIEAGVLNRADGSAYIEWGGNKIIVGVYGPKEAYPKHSQDIDHAVVKARYNMAAFSVDERKRPGPDRRTMEISKVISEALSSSIMIEQFPRAEIDVYIEVLQADAGTRIAGLTAATVALADAGIPMRDMVVGCTAGKVDGHIVLDLSKEEDNFGEADIPMAIMPKTGEIVLLQMDGDVTEDEFYEATSMIIEATKKISQIQRNALLNKYKIEGIEGGE

SEQ ID NO: 64747 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGEFTFKLETRGFPEIFLWYKESLVYRSGPWNGIRFSGVPEMQPYDYMVFNFTTSSEEVTYSFRVTKSDVYSRVSLSSTGVLQRFTWIETAQTWNLFWYAPRDQCDEYKECGAYGYCDSNTSPVCNCIKGFKPRNPQVWGLRDGSDGCVRKTLLTCGGGDGFARLEKMKLPDTTDASVDRGIGVKECEQKCLKDCNCTAFANTDIRGGGSGCVIWTGE

SEQ ID NO: 64748 - protein, 495 aa, Arabidopsis thaliana
MDIISGQALLLLFCFILSCFLIFTTTRSGRISRGATALPPGPPRLPIIGNIHLVGKHPHRSFAELSKTYGPVMSLKLGSLNTVVIASPEAAREVLRTHDQILSARSPTNAVRSINHQDASLVWLPSSSARWRLLRRLSVTQLLSPQRIEATKALRMNKVKELVSFISESSDREESVDISRVAFITTLNIISNILFSVDLGSYNAKASINGVQDTVISVMDAAGTPDAANYFPFLRFLDLQGNVKTFKVCTERLVRVFRGFIDAKIAEKSSQNNPKDVSKNDFVDNLLDYKGDESELSISDIEHLLLDMFTAGTDTSSSTLEWPMTELLKNPKTMAKAQAEIDCVIGQNGIVEESDISKLPYLQAVVKETFRLHTPVPLLIPRKAESDAEILGFMVLKDTQVLVNVWAIGRDPSVWDNPSQFEPERFLGKDMDVRGRDYELTPFGAGRRICPGMPLAMKTVSLMLASLLYSFDWKLPKGVLSEGFGHGRDLWSNFA

SEQ ID NO: 64749 - protein, 260 aa, Thermoplasma volcanium GSS1
MVKESAEILSEIRKNYILTTMKGGKRIDGRLPDEFREITIIENYVPRANGSAYVALGKTRVVAGVKIEAGEPFPDTPDQGVLTTNVELLPIAFPSFEAGPPNDLAIEVSRVVDRGIRESKMISPDKLVIEQGKKVWIVFLDINVLDYDGNLIDACTIAAVSALRNAIVPASREGGEDFKLPVVNTPISVTMVKIGDTLVCDPSLEEDQICGGRITVTTTEDGHIRAMQKGEIGVFTLDDVKKAIKMSLKVGKNIREKYFR

SEQ ID NO: 64750 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGDFTFKLETGGFPEIFLWYKESLMYRSGPWNGIRFSGVPEVQPYDYMVFNFTTSSEEVTYSFRVTKSDVYSRVSLSSMGVLQRFTWIETAQTWNLFWYAPKDQCDEYKECGAYGYCDSNTSPVCNCIKGFKPRNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64751 - protein, 218 aa, Arabidopsis thaliana
MSQEEQPKRPQEPVTYGDVFEVSGELADKPIAPEDANMMQAAETRVFGHTQKGGAAAVMQSAATANKRGGFVHPGDTTDLAAERGVTVAQTDVPGARVTTEFVGGQVVGQYVEPRPVATAAVYGKQKLVGLSLQSAITIGEALEATVQTAGNKPVDQSDAAAIQAAEVRACGTNVIAPGGIAASAQSAANHNATIDRDEDKIKLIDVLAGCDREVSRR

SEQ ID NO: 64752 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGEFTFKLETGGFPEIFLWYKESQVYRSGPWNGIRFSGVPEMQPYDYMVFNFTTSSDEVTYSFRVTKTDVYSRVSLSSMGVLQRFTWIETAQTWNLFWYAPKDQCDEYKECGAYGYCDSNTSPVCNCIKGFKPKNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64753 - protein, 501 aa, Arabidopsis thaliana
MSILLYFFFLPVILSLIFMKKFKDSKRNLPPSPPKLPIIGNLHQLRGLFHRCLHDLSKKHGPVLLLRLGFIDMVVISSQETTEEVLKVHDLECCTRPKTNASSKFSRDGKDIAFAPYGEVSRELRKLSLINFFSTQKVRSFRYIREEENDLMVKKLKESAKKKNTVDLSQTLFYLVGSIIFRATFGQRLDQNKHVNKEKIEELMFEVQKVGSLSSSDIFPAGVGWFMDFVSGRHKTLHKVFVEVDTLLNHVIDGHLKNPEDKTNQDRPDIIDSILETIYKQEQDESFKLTIDHLKGIIQNIYLAGVDTSAITMIWAMAELVKNPRVMKKAQEEIRTCIGIKQKERIEEEDVDKLQYLKLVIKETLRLHPPAPLLLPRETMADIKIQGYDIPRKTILLVNAWSIGRNPELWENPEEFNPERFIDCPMDYKGNSFEMLPFGSGRKICPGIAFGIATVELGLLNLLYYFDWRLAEEDKDIDMEEAGDATIVKKVPLELVPIIHH

SEQ ID NO: 64754 - protein, 504 aa, Arabidopsis thaliana
MVSLLSFFLLLLVPIFFLLIFTKKIKESKQNLPPGPAKLPIIGNLHQLQGLLHKCLHDLSKKHGPVMHLRLGFAPMVVISSSEAAEEALKTHDLECCSRPITMASRVFSRNGKDIGFGVYGDEWRELRKLSVREFFSVKKVQSFKYIREEENDLMIKKLKELASKQSPVDLSKILFGLTASIIFRTAFGQSFFDNKHVDQESIKELMFESLSNMTFRFSDFFPTAGLKWFIGFVSGQHKRLYNVFNRVDTFFNHIVDDHHSKKATQDRPDMVDAILDMIDNEQQYASFKLTVDHLKGVLSNIYHAGIDTSAITLIWAMAELVRNPRVMKKAQDEIRTCIGIKQEGRIMEEDLDKLQYLKLVVKETLRLHPAAPLLLPRETMADIKIQGYDIPQKRALLVNAWSIGRDPESWKNPEEFNPERFIDCPVDYKGHSCELLPFGSGRRICPGIAMAIATIELGLLNLLYFFDWNMPEKKKDMDMEEAGDLTVDKKVPLELLPVIRISL

SEQ ID NO: 64755 - protein, 465 aa, Alteromonadales bacterium TW-7
MSFEGLGLSQSLVNAVLEKGYETPTPIQAQAIPAIIERRDVMAAAQTGTGKTAGFTLPLIERLSTGPKAKSNHVRALILAPTRELALQVSENVEEYAKHSNVSSFVVYGGVKINPQMQRLRKGVDILVATPGRLIDLHNQNAVKFDSVEVLVLDEADRMLDMGFIHDIKRLIAKMPAKRQNLMFSATFSDDIRALAKGLINDPVEISVAAKNTTAKSVTQSVYAVDKGRKTALLSHLIRSNDWQQVLVFSRTKHGANRLVKQLERDDIVGAAIHGNKSQGARVKALDGFKSGEVRVLVATDIVARGLDIVELPHVVNYDLPNVYEDYVHRIGRTGRAGASGHAISFVTVDDAVDLYGIERFIGELIPRAEEEGFEPVNPVAERALDARPLPAKKPKKKQPFNKPKSDSSKPNSKKPNNGGNGTGPRRGGSKKPATKKDDNAQNPWAKRQSVGGNGQRRRRPNNND

SEQ ID NO: 64756 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGRPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64757 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLHQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64758 - protein, 107 aa, Zea mays
  misc_feature (38)..(38): Xaa can be any naturally occurring amino acid
DGVWYPDESLLRRIRAAFCYTEPGLRGAYRNYKRDLVXWTKRGNRLHTILVILGGTITLITLTGLLTFMFFLLGATGNANICSSLMSLASDRGILDIFFACLGGEDI

SEQ ID NO: 64759 - protein, 454 aa, Myxococcus xanthus DK 1622
MVGPDRRLVDELKRAPRREAPPPAPRLCSRARKEGAPMAEKKNLNHIRLTSHPDGDVPSVPIRWGDGEPTRRGPVVATLTEAGHRNVIGTHAGAYAVYRALAVAAGMLPQDHRADLKNTAPAAQVGPHPSWSDPQRIVSLDPWGAIAPQAFRPFAEQGIDFRPTIAVTKAHINFPEVRDAIDAGRLTPDGDLLRGNGDIKVTKAAVDPVWYLPGIAKRFGMTESALRRGLFEQTGGMFPELITRPDLHVFLPPIGGLTLYVFGGIETLADRDVPLTVRVHDECNGSDVFGSDICTCRPYLAHGIEECVRTAQAGGAGLIVYLRKEGRALGEVTKFLVYNARKRQEGGDSAATYFQRTECVAGVQDMRFQELMPDVLHWLGITRIHRFVSMSDMKHDAITRSGIEILERVPIPDELIPADAKVEMEAKKAAGYFTQGPVADAAGLAQVKGRDLDV

SEQ ID NO: 64760 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64761 - protein, 218 aa, Streptococcus pneumoniae R6
MSQYKIAPSILAADYANFEREIKRLEATGAEYAHIDIMDSHFVPQISFGAGVVESLRPHSKMVFDCHLMVSNPEHHLEDFARAGADIISIHVEATPHIHGALQKIRSLGVKPSVVINPGTPVEAIKHVLHLVDQVLVMTVNPGFGGQAFLPETMDKVRELVALREEKGLNFEIEVDGGIDDQTIAQAKEAGATVFVAGSYVFKGEVNERVQTLRKQLD

SEQ ID NO: 64762 - protein, 212 aa, Geobacillus kaustophilus HTA426
MREDMATTLYLTRHGETKWNVERRMQGWQDSPLTEKGRQDAMRLGKRLEAVELAAIYTSTSGRALETAEIVRGGRLIPIYQDERLREIHLGDWEGKTHDEIRQMDPIAFDHFWNAPHLYAPQRGERFCDVQQRALEAVQSIVDRHEGETVLIVTHGVVLKTLMAAFKDTPLDHLWSPPYMYGTSVTIIEVDGGTFHVAVEGDVSHIEEVREV

SEQ ID NO: 64763 - protein, 459 aa, Synechococcus
MTAVVLPAAAETLAALQATFDRGDTRTLAFRLARLQDLAKLVADNEAELLQALASDLRKPALEAYASEIYFVRDQIKLTCKHLRRWMQPEKQSISLMQQPGQAYRQAEPLGVVLIIGPWNYPFQLLITPLIGAIAAGNCAVLKPSELAPATSSLIQRLISDRFDPDYIRVLEGDASVSQALITQPFDHIFFTGGTAIGRKVMAAAAENLTPVTLELGGKSPCIVDTDIDLDVAARRIAWGKFFNAGQTCIAPDYLLVQRTVAEPFIEALIDNIQQFYGEDPQQSADYARIVSDRHWQRLNSLLVDGTIRHGGQVDRSDRYIAPTLITDVNWRDPILQEEIFGPLLPILIYDQLDEAIAQIRAQPKPLALYLFSRDRQVQERVLAETSAGSVCLNDTILQVGVPDAAFGGVGPSGMGGYHGKASFETFSHYKLVLKRPFWLDLALRYPPTGDKINLFRKL

SEQ ID NO: 64764 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATPGTAPKYAGQDKVNPGSIILSAEMMLRHMGWTEAADLIVKGMEGAINAKTVTYDFERLMEGAKLL

SEQ ID NO: 64765 - protein, 174 aa, Mycobacterium avium subsp. paratuberculosis K-10
MPLFAFEGRSPRVDPTAFVAPTATLIGDVVVEAGASVWFNAVLRGDYGPIVVREGANVQDGSVLHAPPGIPVDIGPGATVAHLCVIHGAHVGPEALIANHATVLDGAVIGAGSLVAAHSLVTAGTQIPAGMLAMGAPAQIKGPVAGTDAQLWVKLNPQAYRDLAQRHLAGLEPI

SEQ ID NO: 64766 - protein, 505 aa, Oryza sativa Japonica Group
MELTTISPVFLISLLGVPLLYLLWSKASKSPSGAPAAPPPPPGPTPFPVIGNIPDLLRGGELHRALTGLAASYGPVMSLRLGMASTVVLSSPDVAHEALHKKDGAISSRWVPDNANVLGHQDVSMAWLPSSSPLWKHMRTLASTLLFTSRRLGASRGIRERKARELVDYLGARSGRPVRVGLAVFGSVLNFMSNVFFSEDVVELGSETGQEFQQLIADSVAETAKPNISDFFPFLSALDLSRRRRAAAKNLKKFYDFFDDVIDRRLSSGEKPGDLLDSLLELHAKSQLERPLIRALMTDLFIAGSHTTTTTVEWAMAELLRNPSKMAKARAELGEAFGRGAVEEGELARLPYLNAVIKETLRLHPPAPLLLPHRVSSDSEPAGGVTLGGYSVPSGARVLINAWAIGRDPAAWSPEPDAFSPERFLGREADYWGRTLEFIPFGSGRRACPGIPLAVAVVPMVVAAMVHSLEWRLPEGMAPGDVDVGDRFGAVLELATPLWAVPVKV

SEQ ID NO: 64767 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPSSEEGTKRLVRAAIEYAIANDPDSVALVHKGNIMKLTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64768 - protein, 218 aa, Glycine max
MATISAVHVEFLEFPAVVTSPASGKTYFLGGAGERGLTIEGKFIKFTGIGVYLEDKAVPSLAAKWKGKTSEELVHTLHFYRDIISGPFEKLIRGSKILPLAGAEYSKKVMESCVAHMKSVGTYGDAEAAAIEKFAEAFKNVNFAPGASVFYRQSPDGILGLSFSEDATIPEKEAAVIENKAVSAAVLETMIGEHAVSPDLKRSLASRLPAVLSHGIIV

SEQ ID NO: 64769 - protein, 233 aa, Triticum aestivum
  misc_feature (105)..(106): Xaa can be any naturally occurring amino acid
  misc_feature (111)..(111): Xaa can be any naturally occurring amino acid
  misc_feature (114)..(115): Xaa can be any naturally occurring amino acid
MASSADPWVREYGEAARLADDVAAMVADRAALPQSGPEVMRHTSAIRRKITILGTRLDSLEGMLARLPPKSITDKELNKRRDTLSNLKSRAKQMAESFNMSTFAXXKDLLXQEXXRTADDMSRVAGLDNQGIVGLQRQIMKEQDEVLEKLEHTMLSTKHIALAVNEELDLHARLIDDLDDHVDGTNSRLQRVQKRLAVLNKRAKGGCSCMSLLLSTVGIVMLVVIVWLLIKYL

SEQ ID NO: 64770 - protein, 479 aa, Rhizobium leguminosarum bv. viciae 3841
MKRNRKVKILATLGPASSEESMIEKLHQAGADVFRINMSHASHDMMRMLIQRIRSVEARSGRPIGILADLQGPKLRVGKFVDGKVDLRPGQTFTLDNNEALGDQSRVYLPHPEILESVQPGHRLLIDDGKLALRAEKCDGKSIVTTVISGTRISDRKGVSLPDTLLGVGALTDKDRADLDAVLATDDVDWVALSFVQRPDDLAEVRKIARGRVGLMSKIEKPQALERIEEIIELSDALMVARGDLGVEMPLESVPGIQKQLIRACRRSGKPVVVATQMLESMISAPVPTRAEVSDVATAVFEGADAVMLSAESASGDYPVEAVTTMASIATAIEREPHYPGIIYAQRAQPEATGADAISLAARQIAETLKLSAIVCYTSSGTTGLRASRERPQVPILALSPIIKTARRLAVVWGLHCVVTHDATDLDDMVNRACRIVADEGFGKPGDRIIISAGVPLGTPGATNMIRIAYIGSDGQSGV

SEQ ID NO: 64771 - protein, 757 aa, Candida albicans SC5314
MKRTPRSDTVSPDRSRLTSPSPSIRHISHTRVNTERSYLLHKDSTPQVADAESIIYQDEYTPANTHNVESLSWSEILPYYIPCLSWIGQYSVEFFVGDLIGGLSLVFFQLPLSLSYATSLAHVPVTSGLYSLGISPLIYLIFGSVPQMIVGPEAPISLIVGQAIEPLLHHAKKAHLDPVEYVVAITFVSGSTLLGFGLARFGFLDNVLSASLLKGFIAGVGIVMIITSSIIVLGLEKLMKQISDDPNEMDIHSPFDKVRFLIQYIGQRNQQSLNIGLVGFFIIFTIRLFKKHAAKQNGRLYKYAVFIPEIMLVVAGSTILCQHYRWDLGGLPVIGKVRNEGDFKFYNPLSLSNLHLIKKLCASGFMCAMLGFFESTTASKSLGSMYDLPISSNRELVALGSINIFGSVFGALPAFGGYGRSKVNAISAKTTMSGGIMGICTLLTIHFLLKYLYFVPQCMLSVVAAVIGISLIEEAPYELYFHWKTRGIDEIITFCVTVVTTLFFSMEGGIAVGIGYSLVRVVKNSTFSRIQILGRYPNTNKFVNADIPAYQTSQEKVAGSYLNLFDDAQHMQLNTQVLEEVEGCLIIKVPEPLTFTNCSDLTTRLKRVEMYGSTRAHPASKRSRDIGMTKYVIFDLKGMSSLDSTAAKILKTLLEGYRKRGIRTCFVRMSSDKHLRKMLADSGICKLLIDDLTDLKYFAIQEIAEQNSQPLTTPEMEAMVECYSLIESSSHPYFNHISDALKVIDCFETNYVDTIDA

SEQ ID NO: 64772 - protein, 430 aa, Oryza sativa
  misc_feature (369)..(369): Xaa can be any naturally occurring amino acid
MAAGAVSALFLLDIKGRVLVWRDYRGDVSALQAERFFTKLLDKESDAEVLSPVVHDDAGVSYMFIQHNNVFLLTASRQNCNAASILLFLHRVVDVFKHYFEELEEESLRDNFVVVYELLDEMMDFGYPQYTEAMILSEFIKTDAYRMEVTQRPPMAVTNAVSWRSEGIRYKKNEVFLDVVESVNILVNSNGQIVRSDVIGELKMRTFLSGMPECKLGLNDRVLLEAQGRTTKGKAIDLDDIKFHQCVRLARFENDRTISFIPPDGSFDLMTYRLSTQVKPLIWVEAQVEKHSRSRIQITVKTRSQFKERSTATNVEIEVPVPEDSTNPNIRTSMGSAAYAPERDAMVWKIKSFPGGKEYMCRAEFSLPXITSEDGMPEKKAPIRVKFEIPYFTVSGIQVRYLKIIEKSGYQALPWVRYITMAGEYELRLI

SEQ ID NO: 64773 - protein, 152 aa, Chlamydomonas reinhardtii
MGGRIIQVKSAEEWTSHMRECRAFGGKSYLVDFTASWCGACQKIAPLYEKYSAENPNITFLKVDVDELADVAGECGVKAMPTFIGYFNGEQVDTVVGADDAKLRELIATLNTKGGAGAGQKLGGAAAAPDDSPEARRARMLAAIEARNKPAS

SEQ ID NO: 64774 - protein, 373 aa, Escherichia coli
MSYQVLARKWRPQTFADVVGQEHVLTALANGLSLGRIHHAYLFSGTRGVGKTSIARLLAKGLNCETGITATPCGVCDNCREIEQGRFVDLIEIDAASRTKVEDTRDLLDNVQYAPARGRFKVYLIDEVHMLSRHSFNALLKTLEEPPEHVKFLLATTDPQKLPVTILSRCLQFHLKALDVEQIRHQLEHILNEEHIAHEPRALQLLARAAEGSLRDALSLTDQAIASGDGQVSTQAVSAMLGTLDDDQALSLVEAMVEANGERVMALINEAAARGIEWEALLVEMLGLLHRIAMVQLSPAALGNDMAAIELRMRELARTIPPTDIQLYYQTLLIGRKELPYAPDRRMGVEMTLLRALAFHPRMPLPEPEVPRQ

SEQ ID NO: 64775 - protein, 397 aa, Synechococcus sp. CC9311
MLTSKRLARLGSGVFDRNDQRKRLYKLGGTQQQQPLIDLSLGCTDLLPPPAAVQAMGDRLQEPRSAAYCLHAATASFREAAGAWCNQRLGVSVDPEREVLLLVGSQEGTAHFPLTVLDPGDQALILDPSYPSHRGGLELADACIQTLPLTAEQGWAPDFKAITISQWDQLRLLMLGFPHNPTACVGQQSWLDEAMGQAQRHDLVVAHDNPYLDLALEGEAPSLLRCPHWRERGIEFFSLSKGWCLGGFRLAFAIGAEPLITALRQIKSVIDFNQCQALQQGAVVALSDHADWPAHLLPTYRERRDRTRTALSELGWPIPSPSMALYLWMPVPAWASAQGWGDEQMAAQLLEHCGVAITPGSGFGEAGRDWLRLALVRPVAELEAAVARLKPWWHQQC

SEQ ID NO: 64776 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGEFTFKLETGGFPEIFLWYKESLVYRSGPWNGIRFSGVPEMQPYDYMVFNFTTSSEEVTYSFQVTKTDVYSRVSLSSTGVLQRFTWIETAQTWNLFWYAPKDQCDEYKECGPYGYCDSNTSPVCNCIKGFKPRNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64777 - protein, 387 aa, Ralstonia eutropha JMP134
MARRGKAESPHPLEYGFCYFPPDTMSLQCGIVGLPNVGKSTLFNALTKAGIAAENYPFCTIEPNVGVVEVPDPRLAKLAEIVKPERILPATVEFVDIAGLVAGASKGEGLGNQFLANIRECDAITHVVRCFEDENVIHVAGRVDPLSDIEVINTELALADLGTVEKALARYIKPARAGDKEAQRLVAVLEKAQAVLDQAKAVRTLDLAPEEWDAIRPFCLITAKPTMYVANVREDGFENNPHLDAVREYAKQTNSPVVAVCAAIEAEIADLDDADKAEFLADLGMEEPGLDRVIRAGFKLLGLQTYFTAGVKEVRAWTIHVGDTAPKAAGVIHTDFERGFIRAQTISYDDYIAFKGETGAKEAGKMRAEGKEYVVKDGDVLNFLFNV

SEQ ID NO: 64778 - protein, 587 aa, Lactobacillus plantarum WCFS1
MMTKMIAGQALVKVLEAWGVDHIYGIPGGSINHTVEGLYLEKADIDYIQVRHEEVGALAASADAKFTGKIGVSFGSAGPGATHLFNGLYDAKMDHVPVLALVGQVPQATMNTNYFQEMDETPMFSDVAVYDRTVTTAGQLPYVINQAIREAYRQKGPAVVIIPENLSAEEIDYQPVSTPNTVSDTFEQRVDPQAITATLKMLKAAKHPLVYAGRGLLGAKADLVKFSEQFNIPVMNTVPATGVIPTNHPNAIGTFGRLGSKSGFEALQHADLILFLGSEFPFASFWPKGIKIIQVNNNSFDIGKMVPIDYAVISDAQAYLQAMIATGETLPETAWLTTNRQNKRNWDKWLQQLAADDHDGLAPEAVMHKVASMVGPRDTYGVDTGNVSEWAVRGLPMDQEQRFALSGLFATMGFGLPAGMAGALSVPDSQAWSFSGDGGFAMVAPDIITEARYGLPVINVIFSNQRFGFIYREQVDTKQHLYGVDLTDADWAKVADGLGGIGFTVQNNQEVETVFDQIKALQAKGNKRPIVVNAVIKNDDPIGTAYMPLDPELYGQAEVDAYAKANHIDIKEQPSLGALLRAQGDQL

SEQ ID NO: 64779 - protein, 235 aa, Kluyveromyces marxianus
MKLNISYPINGTQKCVEIDDEHRVRVFYDKRIGQEVDGEAVGDEFKGYVFKIAGGNDKQGFPMKQGVLLPTRVKLLMAKGTSCYRPRRNGERKRKSVRGAIVGPDLAVLALVIVKKGDQEIEGVTNETVPKRLGPKRANNIRKFFGLTKEDDVRDYVIRREVTKGEKTYTKAPKIQRLVTPQRLQRKRQQKALKIKNAQAQREAAAEYAQLLAKRLAERKAEVRKRRASSLKAAE

SEQ ID NO: 64780 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGEFTFKLETGGFPEIFLWYKESLMCRSGPWNGIRFSGVPEMQPYDYMVFNFTTSSQEVTYSFRVTKSDVYSRVSLSSTGVLQRFTWIETAQTWNLFWYAPKDQCDEYKECGAYGYCDSNTSPVCNCIKGFKPRNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64781 - protein, 224 aa, Oryza sativa Japonica Group
MSSENGENGHGAADEVVEPYQQTPRPGPKLNERILSSLSRRSVAAHPWHDLEIGPDAPAVFNVVVEITKGSKVKYELDKKTGLIKVDRILYSSVVYPHNYGFIPRTLCEDNDPMDVLVLMQEPVLPGSFLRARAIGLMPMIDQGEKDDKIIAVCADDPEYRHFNNLSELSPHRLQEIRRFFEDYKKNENKEVAVNDFLPAPTAREAIQYSMDLYAQYILQSLKR

SEQ ID NO: 64782 - protein, 810 aa, Arabidopsis thaliana
MAAVIRKLLPFPSPNPKRDNRESDDDDETSSGYRIEYSFASEYKGPLIANVPRALPVEVDQIPTALPVSFSSLRSGISYPVAPLVMTKDTKRPPDSGIEKKNGFVDSAAGSSVVLIGRDVVSGSSSSSSSKRLDVPEEVKSPADFRLSPSSPLAERKGKRGSCYRCQLGNRFTEKEVCIVCDAKYCFNCVRRAMGAMPEGRKCQACIGYRIDESKRASLGKCSRMLKRHLTDSELRQVMNAEITCKANQLPSRLIIVNDKPLSEDELYTLQTCPNPPKKLKPGHYWYDKVAGYWGKIGEKPSQIISPNNSIGGYISEKVSNGDTEIYINGREITKPELTMLKWAGVQCEGKPHFWVDSDGSYREEGQKHPIGNIWSKKRAKIACAVFSLPVPPASSAVEPYDVPLYEQKMLNKLLLIGSEKGGATTIYKQARSLYNVSFSLEDRERIKFIIQTNLYTYLAMVLEAHERFEKEMSNDQSSGNVGDETSAKPGNSINPRLKHFSDWVLKEKEDGNLKIFPPSSRENAQTVADLWRVPAIQATYKRLRDTLPRNAVYFLERILEISRSEYDPSDMDILQAEGLSSMEGLSCVDFSFPSTSQEESLESDYQHDTDMKYQLIRLNPRSLGENWKLLEMFEDADLVIFCVSLTDYAENIEDGEGNIVNKMLATKQLFENMVTHPSLANKRFLLVLTKFDLLEEKIEEVPLRTCEWFEDFNPLISQNQTSRHNPPMAQRAFHYIGYKFKRLYDSILEPVNMRGRSFKPKLFVCQVSLESDTVDNALRYAREILKWHVEETSMFQEMSTTSIEASSSS

SEQ ID NO: 64783 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGEFTFKLETGGFPEIFLWYKESLMYRSGPWNGIRFSGVPEMQPFDYMVFNFTTSSDEVTYSFKVTKTDVYSRVSLSSTGVLQRFTWIETAQTWNLFWYAPKDQCDEYKECGAYGYCDSNTSPVCNCIKGFKPKNPQVWGLRDGSDGCVRKTLLTCGGGDGFARLEKMKLPDTTAASVDRGIGVKECEQKCLKDCNCTAFANTDIRGGGSGCVIWTGE

SEQ ID NO: 64784 - protein, 502 aa, Arabidopsis thaliana
MTILLCFFLVSLLTIVSSIFLKQNKTSKFNLPPSPSSLPIIGNLHHLAGLPHRCFHKLSIKYGPLVFLRLGSVPVVVISSSEAAEAVLKTNDLECCSRPKTVGSGKLSYGFKDITFAPYGEYWREVRKLAVIELFSSKKVQSFRYIREEEVDFVVKKVSESALKQSPVDLSKTFFSLTASIICRVALGQNFNESGFVIDQDRIEELVTESAEALGTFTFSDFFPGGLGRFVDWLFQRHKKINKVFKELDAFYQHVIDDHLKPEGRKNQDIVTLILDMIDKQEDSDSFKLNMDNLKAIVMDVFLAGIDTSAVTMIWAMTELIRNPRVMKKAQGSIRTTLGLKKERITVEDLGKVEYLNHILKETFRLHPALPFVVPRETMSHIKIQGYDIPPKTQIQLNVWTIGRDPKRWNDPEEFNPERFANSSVDFRGQHFDLLPFGSGRRICPGMPMAIASVELALMNLLYYFDWSMPDGTKGEDIDMEEAGNISIVKKIPLQLVPVQRY

SEQ ID NO: 64785 - protein, 332 aa, Capsella grandiflora
RTYAWVANRDHPLSSSIGTLRISDNNLVVLDQSETPVWSTNLTGGSVISPVVAELLDNGNFVLRDSNNNSPDGYLWQSFDFPTDTLLPEMKLGWDLKTGSNRLIRSWKRPDDPASGDFTFKLETGGFPEIILWYKESLVYRSGPWNGIRFSGVPEMQPYDYMVFNFTASSEEVTYSFKVTKTDVYSRVSLSSMGVLQRFTWIETAQTWNLFWYAPKDQCDEYKECGAYGYCDSNTSPVCNCIKGFKPRNPQVWGLRDGSDGCVRKTLLTCGGGDGFARLEKMKLPDTTAASVDRGIGVKECEQKCLKDCNCTAFANTDIRGGGSSCVIWTGE

SEQ ID NO: 64786 - protein, 500 aa, Arabidopsis thaliana
ETNIRVVLYSIFSLIFLIISFKFLKPKKQNLPPSPPGWLPIIGHLRLLKPPIHRTLRSFSETLDHNDGGGVMSLRLGSRLVYVVSSHKVAAEECFGKNDVVLANRPQVIIGKHVGYNNANMIAAPYGDHWRNLRRLCTIEIFSTHRLNCFLYVRTDEVRRLISRLSRLAGTKKTVVELKPMLMDLTFNNIMRMMTGKRYYGEETTDEEEAKRVRKLVADVGANTSSGNAVDYVPILRLFSSYENRVKKLGEETDKFLQGLIDDKRGQQETGTTMIDHLLVLQKSDIEYYTDQIIKGIILIMVIAGTNTSAVTLEWALSNLLNHPDVISKARDEIDNRVGLDRLIEEADLSELPYLKNIVLETLRLHPATPLLVPHMASEDCKIGSYDMPRGTTLLVNAWAIHRDPNTWDDPDSFKPERFEKEEEAQKLLAFGLGRRACPGSGLAQRIVGLALGSLIQCFEWERVGNVEVDMKEGVGNTVPKAIPLKAICKARPFLHKIIS

SEQ ID NO: 64787 - protein, 302 aa, Triticum aestivum
HYRTSLYKKAGWYRSGIPGISSTHASAHASEMLNDLLVKKNEETGWDTPIHVDAASGGFIAPFLYPELEWDFRLPLVKSINVSGHKYGLVYAGIGWCIWRSKEDLPDELIFHINYLGADQPTFTLNFSKGSSQVIAQYYQLIRLGFEGYRNIMDNCQENAMVLKEGLERTGRFNIVSKDQGVPLVAFSLKDSSRHDEFEISEFLRRFGWIVPAYTMPPDAQHVTVLRVVIREDFSRTFAERLVIDIEKVLHELDALPSRSSGPALQHPNGDTVSEKDLARQREVVSVWKRAVAARKKTQGVC

SEQ ID NO: 64788 - protein, 332 aa, Capsella grandiflora
RTYAWVANRDHPLSSSIGTLRISDNNLVVLDQSETPVWSTNLTGGSVISPVVAELLDNGNFVLRDSNNNNPDGYLWQSFDFPTDTLLPEMKLGWDLKTGSNRLIRSWKRPDDPASGEFTFKLETKGFPEIFLWYKESLVYRSGPWNGIRFSGVPEMQPYDYMVFNFTTSSNEVTYSFRVTKSDVYSRVSLSSMGVLQRFTWIETAQTWNLFWYAPKDQCDEYKECGTYGYCDSNTSPVCNCIKGFKPRNPQVWGLRDGSDGCVRKTLLTCGGGDGFARLEKMKLPDTTAASVDREIGVKECEQKCLKDCNCTAFANTDIRGGGSGCVIWTGE

SEQ ID NO: 64789 - protein, 500 aa, Arabidopsis thaliana
MLYFILLPLLFLVISYKFLYSKTQRFNLPPGPPSRPFVGHLHLMKPPIHRLLQRYSNQYGPIFSLRFGSRRVVVITSPSLAQESFTGQNDIVLSSRPLQLTAKYVVYNHTTVGTAPYGDHWRNLRRMCSQEILSSHRLIIFQHIRKDEILRMLTRLSRYTQTSNESNDFTHIELEPLLSDLTFNNIVRMVTGKRYYGDDVNNKEEAELFKKLVYDIAMYSGANHSADYLPILKLFGNKFEKEVKAIGKSMDDILQRLLDECRRDKEGNTMVNHLISLQQQQPEYYTDVIIKGLMMSMMLAGTETSAVTLEWAMANLLRNPEVLEKARSEIDEKIGKDRLIDESDIAVLPYLQNVVSETFRLFPVAPFLIPRSPTDDMKIGGYDVPRDTIVMVNAWAIHRDPEIWEEPEKFNPDRYNDGCGSDYYVYKLMPFGNGRRTCPGAGLGQRIVTLALGTLIQCFEWENVKGEEMDMSESTGLGMRKMDPLRAMCRPRPIMSKLLL

SEQ ID NO: 64790 - protein, 382 aa, Zea mays
MENQGPKPIRCKAAVCRAAGEPLAIEEVVVDTPKAHEVRIRIICTSLCHSDVTFWRMKDLPDNIPRIFGHEAFGVVESVGEQVDEFAAGDAVVPTFLGQCSECVDCRSARSNMCSKYRFAVRPGMPRDGTTRFTDGQGRPLHHFFGVSSFAEYTVVDVNQVVKLNPAVPPALACLLSCGASTGVGAAWKQAKVEPGSSVAIFGLGAVGLAVAEGARICGASKIIGVDINPDKCELGKKFGVTHFINPKELGEEKPVHQAIAEMTDGGADYCFECIGLAALMNDAFRSSRDGWGKTIILGVEMHGAPLCISPHEILHGKSVIGSMFGGVKPKQDIPILADKYMNKELELDKFITHEVGLKDINQAFDLLLQGKSLRCTIWMDK

SEQ ID NO: 64791 - protein, 344 aa, Aspergillus oryzae
MGDTGTYVPNFDGENRVDPSVVANLPKGCRVVSTESHGISFWGHTGRINVELEDGTPFSFFMKVVSNERGKNMVHGEYESMKAIHTLLPDFAPKPIAWGTYQDVPDMHYLLCDYREMTDDMPDPHKFAARLATLHESSKSPTGKFGFHMTTYSGNLPQMTEWEDSWETFFAKSLKKALDLEIKAKGPDPELDHLLPLLFDKVIPHLLRPLESDGRSVKPSLVHGDLWYANSGIDVETGDSLVFDACSFYAHNEYEFGQWRPICNRFGDEYLAAYHSYVQVSAPEEDYDGRLDLYKLRFNTHVSALFTENHTLREHIATSLGTLHDMAMFIIAVNMDTPKPRPFK

SEQ ID NO: 64792 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVAGMGIAPGANIGDECALFEATHGTAPKYAGQDKVNPGSIILSAEMMLRHMGWTEAADLIVKGMEGAINAKTVTYDFERLMEGAKLL

SEQ ID NO: 64793 - protein, 283 aa, Novosphingobium aromaticivorans DSM 12444
MDRYMAPMTEYVTVEDHSVLPRDGTIKLHGPAGFEGMRKAGRLAAEILDALAPLVQPGVRTDYLDDVVRQMTLDAGAVPATMGYRGYAHSSCISINHVVCHGIPSDKTLKDGDIVNIDVTPLLDGWHGDSSRMYLVGDVPLKARRLVDVTYECLMIGIEQAKPGARLGDIGAAIQAHAEKQRYGVVREFCGHGLGRLFHDAPEVVHAARAGTGPELRPGMFFTIEPMINLGKPGVKILEDGWTAVTRDRSLSAQFEHSIGITEDGCEIFTASPKGLDKPPYAV

SEQ ID NO: 64794 - protein, 362 aa, Ehrlichia chaffeensis str. Arkansas
MGLNCGIVGLPNVGKSTLFNALTQTMVAEVANYPFCTIEPNIGKAIVQDHRLKTLANIASSKKIIYNQVECVDIAGLVSGASQGEGLGNKFLSHIREVDAIIHVLRCFGDQNISHVNQTVDPISDAEIVEMELILADIESLKRRLPATEKAVKANKEPRKKLDTILEVLSVLEAGNLAKSAKHLGDDLKQLQLITTKPMMYVCNVEESNVTTGNALSEKVKLMAEKKHNKFCCISAKLEADVSSLETEEEKQIFLAEFNLQESGTTSVVKTMYDLLDMITFFTLGPQEARAWPIKRFSTASSAAGVIHTDFEKGFIKAELISFDDYIKYNGEAKCKEAGKVRFEGRDYIVQDGDIIHFRHNK

SEQ ID NO: 64795 - protein, 597 aa, Physcomitrella patens subsp. patens
MVSDASKKKAAAKKAAAAEKRGSKSAAAVAQSKLKEVQAGATAESLAEEMAAARITDRTCTGVLASHPQSRDIHIESLSVTFHGHELVSDSTLELNYGRRYGLLGLNGCGKSTLLTAIGLREVPIPEHMDIYHLTKEIDATDLTALEAVKNVDEERLKLEKEAEKLAAQDDGGGELLDRIYERLELMDSATAEMRAAQILHGLGFTKKMQAKKTRDFSGGWRMRIALARALFMNPTILLLDEPTNHLDLEACVWLEETLKKFDRILVVVSHSQDFLNGVCTNIIHMQSKKLKFYTGNYDQYCQTRAELEENQMKQYRWEQEQIAGMKEYIARFGHGSAKLARQAQSKEKTLAKMERGGLTEKVVKDKVLTFRFTDVGKLPPPVLQFVDLTFGYTPDQLIYEKVDFGVDLDSRIALVGPNGAGKSTLLKLMTGDVTPTDGMVRRHNHLRIAQYHQHLTEKLSLEMSALQYMMSEYPGLEEEKMRAAIGRFGLTGKAQIMPMGNLSDGQKSRVIFAWLAWRLPHLLLLDEPTNHLDIETIDSLAEALNEWDGGMVLVSHDFRLINQVAKEIWVCEKKSITKWNGDIMDFKRHLKKSAGL

SEQ ID NO: 64796 - protein, 109 aa, Chlamydomonas reinhardtii
MGGRIIQVKSAEEWTSHMRECRAFGGKSYLVDFTASWCGACQKIAPLYEKYSAENPNITFLKVDVDELADVAGECGVKAMPTFIGYFNGEQVDTVVGADDAKLRELIAT

SEQ ID NO: 64797 - protein, 658 aa, Cryptococcus neoformans var. neoformans JEC21
MPRPCLKNTTAPFLRTCSTRVPQNWADRSLYTTTTTRPTAGNDSTPCIWSFATASSSFSNLQIKRSSPHTHIIPLSCCCRINPRNMTTETGKPVIRVAVIGAGASGLTQTQQLLEAWSRKAVKTKLEVVAFEARGDVGGVWLSEDGPKQAERTSLPGENDKMDDVFSYSTASKISSPMYEGLRTNIPAPIMAFRGFKFPEKTPLFPDRAAVLKYLQDYAKAYELLPYIRFNTRVERVYLTSTTRGSDKRRWTVESVSGNSKTSEEFDYISVSNGHYSDGWIPNTPGLSSFPGQIIHSRFYRRASDHAGQTVLVVGSFASGGDISRLLASHNIDKYDPSGQPLSRSLTPDQKLDDSSSLKAATGENFIKVYVSSSGATSHSVSPDGPCAPYIHNLPLISHLSPPSSAYPKGVIHFEDGQQLSGVDTIIYATGYNFAYPFFKRADKPWDEVDLVDGVIRSGERKGGEEWEEGGVKGLGMKKLDELLLFLKGDRSIAFPALSYQVVPFPLAQVQARLTSLLWANLLPSFPEHPALPENPSNPYSKQSVSVPSINHLDVSSLSAPQPDITVTAAATPPTTTTKVCSSSSPSTTPLDRKTLSARQKLLFGTPYEWTYSEYLMSLMSEAEGGKEAEVEEHWKKIEPWRREMRDRKDLRKKTLGY

SEQ ID NO: 64798 - protein, 565 aa, Bdellovibrio bacteriovorus HD100
METDNKYARPVYIPYSGTVLLEMSLLNKGSAFSEEERTHLNLHGLVPQTIETIEEQAERVYSQYRLLKADIDKHVYLRNLQDTNETLFYHLVVNHLTEMMPIIYTPVVGEACEHFSEIYRASRGLFISYPNKDRIDEMLRNVTKQKVKVIVVTDGERILGLGDQGIGGMGIPIGKLSLYTACGGISPAYTLPVVLDVGTNNQALLNDPLYMGWRQPRITGKEYEDFVDAFVQAVKRRWPDVLLQFEDFAQKNASPILKRYRDEICSFNDDIQGTAAVTVGCLIAASRANGGRLRDQRVVFLGAGSAGCGIAEQIIAEMKHEGLSDEQARQRVFMVDRFGLLTDKMPNLLEFQSPLVQKTETLAGWEVTNDEISLLDTVRNAKPTILIGVSAQPGLFTEEVIRTMQSHCEHPIVMPLSNPTSRVEATPADILRWTDGKALVATGSPFMPVHMNDQIYPIAQCNNSYIFPGIGLGVLACGARRVTDSMLMAASSALADCSPLAQNGKGALLPELSQIEKVSRTIAFAVAKAAQADEVAVKVSDEELLSLIDKNYWYPKYRSYKHASS

SEQ ID NO: 64799 - protein, 392 aa, Acidobacteria bacterium Ellin345
MKIHEYQGKAILRKYGVAVPRGEMVTTREEAERVANDLMHDGAKGVVVKAQIHAGGRGKGGGVKIAKSVDEAGQLAGKILGMTLITHQTGPEGKKVQRLLIEETLPIERELYLSIVLDRSNGKPVFMASAAGGMEIEEVAAKDPNAIIKEWIEPGYGLGAFQARKIAFKLGLKPELIGQAVKFMQALYKTYDETDASLVEINPFITTSDNRLFALDAKFNFDDNGLFRHPDLKDLRDVTEEDPLEVEASKYGLNYIKLDGTVGCMVNGAGLAMATMDIIQYAGGMPANFLDVGGGANAEQVTHAFEILLSDKNVKAVLINIFGGILRVDTLATGVVQAATQTKIQLPIVLRLEGTNVEQGREILQKSGLNFIVAETMKDAAEKVVAAAKGVK

SEQ ID NO: 64800 - protein, 371 aa, Streptococcus agalactiae 2603V/R
MALTAGIVGLPNVGKSTLFNAITKAGAEAANYPFATIDPNVGMVEVPDERLQKLTELITPKKTVPTTFEFTDIAGIVKGASKGEGLGNKFLANIREVDAIVHVVRAFDDENVMREQGREDAFVDPIADIDTINLELILADLESINKRYARVEKMARTQKDKESVAEFNVLQKIKPVLEDGKSARTIEFTEEEAKVVKGLFLLTTKPVLYVANVDEDKVADPDDIDYVNQIRAFAETENAEVVVISARAEEEISELDDEDKLEFLEAIGLTESGVDKLTRAAYHLLGLGTYFTAGEKEVRAWTFKRGIKAPQAASIIHSDFERGFIRAVTMSYDDLIQYGSEKAVKEAGRLREEGKEYIVQDGDIMEFRFNV

SEQ ID NO: 64801 - protein, 255 aa, Mycobacterium avium subsp. paratuberculosis K-10
MTDFVKQHPRSPEGFFGWEAAGLRWLSSVDGGVPCARVLAVDATSLTLRRLQSVPAGRDAAHEFGRRLAVTHDAGAAAFGAGPDGWDGPGYFGPLSQPLPMSLRRHRHWGSFYAEERLVPMAERAAPRLAASTRDAIGAVAARCRAGDFDDDDGPARLHGDLWSGNVMWTPDGVVLIDPAAHGGHRETDLAMLALFGCPHYDAVLAGYQQVRALKPGWRNRIGLHQLYPLLAHVVLFGGGYAGQTDAAARAALAA

SEQ ID NO: 64802 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTAKKIVIKDVIADAFLQQILLRRPEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64803 - protein, 336 aa, Synechococcus sp. CC9311
MTIRIGINGFGRIGRLAFRQAVSMDDVEVVAVNDLIDVDYLAYLLRYDSTHRQFQGDVRVENKNLIVNGKLIRITAERDPKELRWGEIGADYVLESTGFFLTDDKARAHIDAGAKRVVMSAPSKDETPMFVMGVNHKDYLGQEIVSNASCTTNCLAPLAKVVNDNFGIVSGLMTTVHATTATQKPVDSPSLKDWRGGRGAGQSIIPSSTGAAKAVGRVIPELNGKLTGMAFRVPTPDVSVVDLTVNLEKSTSYEEVKAAMKAAAEGELKGILGYTNDQVVSNDLLGDSATSVFDAGAGMALNDRFMKLVAWYDNEWAYSCKCIDLIKHMESSTYVK

SEQ ID NO: 64804 - protein, 407 aa, Pseudomonas fluorescens Pf-5
MAIEIKAPTFPESVADGTVATWHKQPGDAVKRDELIVDIETDKVVLEVLATADGVLGAIVKNEGDTVLSDEVLGSIVEGGAAAAAPAAAAAPAAAAAAPAAADGEDDPIAAPAARKLAEENGINIASVAGTGKGGRVTKEDVVAAVAAKKAAPAAAPAKAPAPAAGAPVFAAGDRVEKRVPMTRLRAKVAERLVEAQSNMAMLTTFNEVDMTEVMALRSKYKDLFEKSHNGVRLGFMSFFVKAATEALKRFPAVNASIDGSDIVYHGYADIGVAVSSDRGLVVPVLRNAELMSLAEIEGGIATFGKKARDGKLSMEEMTGGTFTITNGGTFGSMMSTPIVNPPQAAILGMHNILQRPMAINGQVVIRPMMYLALSYDHRLIDGKEAVTFLVTIKNLLEDPARLLLDI

SEQ ID NO: 64805 - protein, 323 aa, Glycine max
AKGQTPLFPRIFGHEASGIVESVGEGVTHLKPGDHALPVFTGECGDCAHCKSEESNMCELLRINTDSGVMIHDGQSRFSKNGQPIHHLGTSTFSEYTVVHAGCVAKINPAAPLDKVCVLSCGICTGFGATVNVAKPKPGSSVAIFGLGAVAVAAAEGARVSGASRIIGVDLVSARFEEAKKFGVNEFVNPKDHDKPVQQVIAEMTNGGVDRAVECTGSIQAMVSAFECVHDGWGLAVLVGVPSKDDAFKTAPINFLNERTLKGTFYGNYKPRTDLPSVVEKYMSGELEVDKFITHTVPFSEVNKAFDLMLKGQSIRCIIRMQE

SEQ ID NO: 64806 - protein, 460 aa, Triticum aestivum
  misc_feature (433)..(433): Xaa can be any naturally occurring amino acid
MPKHYRPAGKKKEGNAAKYITRTKAVKYLQISLAVFRKLCILKGVFPREPKKKVEGNHKTYYHMKDIAFLAHDPLIEKFREIKVHRKKVKKAMAKKNRDLADRLLNRPPTYKLDRLIIERYPSFVDALRDLDDCLTMVHLFAALPAIEGERVQVQRIHNCRRLSHEWQAYISRTNSLRKTFISVKGIYYQAEVQGQKITWLTPHALQQVLTDDVDFNVMLTFLEFYETLLGFVNFKLYHSINVNYPPILDPRLEALAAELYALSRYMSSGRLPGNPESNGLIEDKETENNKESSKTDESELRLAQLQHQLPANEPGALMHLVEESTADDTEEESVKECRTLFKDLKFYLSREVPRESLLFIIPAFGGTVSWEGEGAPFDETDQDITHQIVDRPTQSHVFLSRHYVQPQWIFDCVNILKVIPTDDYIVGRVPPXPHISPFGCGQLKKGPYYLDLWPIGPFG

SEQ ID NO: 64807 - protein, 159 aa, Glycine max
  misc_feature (27)..(27): Xaa can be any naturally occurring amino acid
  misc_feature (39)..(39): Xaa can be any naturally occurring amino acid
QTQTRPLLLSRLRLPPTRPKNPSPQPXARTERGGGGGNXSTGGEMVFFALLVGAELDGLTNLQPRGGCDDPSYPYYFKLRCESCGETSAKTTCVSLDEVVQLPTGKGTANLLQKCKLCSREGSVVMIPGQGTPLTAEQSQKGEMTCLMVFECRGYEPIE

SEQ ID NO: 64808 - protein, 95 aa, Physcomitrella patens subsp. patens
MSHEKESGGKVSFKVTLTSDPKLPYKVFSVPEEAPFVAVLKFAAEEFKVPPQTSAIITNDGVGINPQQSAGNVFLKHGSELRLIPRDRVGHACCQ

SEQ ID NO: 64809 - protein, 298 aa, Bacillus cereus E33L
MPNIAVIGSISMDLVAVSKKRPKAGETVIGEAFHTIPGGKGANQAVAAARLGANVAMVGAVGDDNYGTVVKKNLENERVFIDYVVPVTDTATGIAHIVLAEEDNSIVVVQGANALVNESIVNRSKDLLIKADMVVLQLEIPLETVKYVLAICEEHKIPVMLNPAPAQVLSEDILEKATYITPNEHECRIVLDDFTSPIEDLLAKYPNKLLMTEGSNGVRFHNGAEIVHVPSIAVDVVDTTGAGDTFNGALAVALSEGETLQKAIRFANIAGGLSVTKLGAQGGMPTRDRVREVQVIVG

SEQ ID NO: 64810 - protein, 230 aa, Synechococcus sp. CC9311
MPPGKRAFSSDPALTMTTEPNNQTTSNDVPSASDVPAAAEGQGQQQEQRRGGGRGDRRGGRGDRRRGQERDSEWQERVVQIRRVSKTVKGGKKMSFRAIVVVGNERGQVGVGVGKAGDVIGAVRKGVADGKKHLVKVPLTRHNSIPTLSNGRDGAASVLIRPAAPGTGVIAGGSIRTVLELAGIKNVLAKRLGSKTPLNNARAAMVALQLLRTHKETAKERGISLEQIYS

SEQ ID NO: 64811 - protein, 191 aa, Burkholderia thailandensis E264
MSACAAAPITAHPLYGKNMEIGQYQPNLEGDGLRIGIVQSRFNEPVCNGLADACVEELERLGVSGEDVLLVTVPGALEIPLALQKLAESNQFDALIALGAVIRGETYHFELVSNESGAGITRIALDFNTPIANAVLTTETDEQAIARMTEKGRDAARVAVEMANLTMTLDQLSDDEEDEEDEDDEDEEERA

SEQ ID NO: 64812 - protein, 244 aa, Triticum aestivum
  misc_feature (140)..(140): Xaa can be any naturally occurring amino acid
  misc_feature (180)..(180): Xaa can be any naturally occurring amino acid
  misc_feature (195)..(195): Xaa can be any naturally occurring amino acid
  misc_feature (214)..(214): Xaa can be any naturally occurring amino acid
HYAYLGDTIEQVCTKKQAGTGPEFPGYRRPTRPRFYNSNVHRGIHALSAKATDAYESARRKVANFVNAADSREIIFTRNATEAINLVAYSWGLSNLKQGDEIILTVAEHHSAIVPWQFVSQKTGAVLKYVGLTKEEVPDXEQLKGLLSSKTKIVVAHHVSNVLGSMLPIEEVVSCANKVXPKALVNACPRGPPMXLDVTKAGGKIFLVHPSHKXCVAPTRPRNPLHGKIANLVTLLDPFSRGGR

SEQ ID NO: 64813 - protein, 319 aa, Shewanella sp. MR-4
MTVLLSFGEVLVDLLPTDISGKSHQAIAGGAPANVAVGYAKLGGKSYFAGGISTDDYGAMLKQALANEGVVTDYLTQVPEAPTATVVVNLDEHGERTFEFNRQGTADLCYSQRHFDAIPWQQMDIFHLCSNTFTEASIFNASLYGARCANSFNKIVSFDVNLRLSLWPDTALLAERVEQCFRYTQVLKMSREEAEYLALTRNKSFEDYLQFCLAQGVEVILITDGANPVQCITVNERFSVPVPQIKAVDTTAAGDSFMAGFLFALGSELAFDLEHLTLKHRLACQTQLRKAIEFAVRCGAVTCGQKGAFPALPTLSQVS

SEQ ID NO: 64814 - protein, 93 aa, Zea mays
PPNMYRCFTGLCEAASQGNAMPATAGGGNNKVKVFGGDGKVWFAGKRVRGKLAMWEEDETGSSGKWDWVDGVPGYDDGVYRGFVFDSGFTAIP

SEQ ID NO: 64815 - protein, 214 aa, Zea mays
MSEEDKAAASAEQPKRAPKLNERILSSLSRRSVAAHPWHDLEIGPGAPAVFNVVVEITKGSKVKYELDKKTGLIKVDRVLYSSVVYPHNYGFIPRTLCEDNDPMDVLVLMQEPVVPGSFLRARAIGLMPMIDQGEKDAKIIAVCADDPEYRHYNDISELFPPPLQEIKRFFEDSKKNENKEVAVDAFLPATTAQEAIQYSMDLYAQYILQSLRQ

SEQ ID NO: 64816 - protein, 487 aa, Aspergillus oryzae
MGSVSSPEVTLDNVAEILQRDTRVKLAGVDVDGMLRGKLVSKKKFLSIVSEGFGFCSVIFGWDMHDQTYFKELAISNKENGYRDIVAIPDLSSFRRIPWENNVPFFLVSFHDPDTREPVCACPRGLVRTALGKAEAAGYRAMAGAEYEFYQFRVPESHPSPERSASSTATFLRENPVEALPSLTEGMFGYSLTRPIHNQDYYYGIFDACEQFKCDIEGWHTESGPGVFEAALQFGEAKEMADKAGLFKYVVKSIGTKHGITPTFMAKPRQGLPGNSGHMHISLVTSDGKNAFLRDTPDPSPPYPDVAYLSDLGRYFLAGVLTGLPDIMPMFAPTVNSYKRLVENFWAPVTVSWGLEHRAASIRLITPPTGSPKATRLEVRVPGADANPHYVLAAIVALGWRGVEKKLEIPVPPLSKGEEMGGGSDQGVRLAKSLKEAVAAFTRKGSVAREVFGDAFVDHFGGTREHEVRLWEEAVTDWEVRRYIETV

SEQ ID NO: 64817 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLL

SEQ ID NO: 64818 - protein, 478 aa, Pseudomonas fluorescens Pf-5
MTQKFDVVVIGAGPGGYVAAIKAAQLGFTTACIEKYTDKEGKLALGGTCLNVGCIPSKALLDSSWKFHEAQDGFAIHGINHAGVTMDVPAMVGRKANIVKGLTSGVATLFKANGVTSIQGHGKLLAGKKVEVTKPDGSVEVIEAENVILAPGSRPIDIPPAPVDQNVIVDSTGALEFQSVPKRLGVIGAGVIGLELGSVWSRLGAQVTVLEALDTFLMAADTAVSKEALKTLTKQGLDIKLGARVTGSKVNGEEVVVTYTDANGEQTITFDKLIVAVGRRPVTTDLLAADCGVTLDERGFVHVDDHCATTVPGVYAIGDVVRGMMLAHKASEEGIMVAERIKGHKAQMNYDLIPSVIYTHPEIAWVGKTEQALKAEGVEVNVGTFPFAASGRAMAANDTGGFVKVIADAKTDRVLGVHVIGPSAAELVQQGAIGMEFGTSAEDLGMMVFSHPTLSEALHEAALAVNGTAIHIANRKKR

SEQ ID NO: 64819 - protein, 388 aa, Pseudomonas fluorescens Pf-5
MNLHEYQGKQLFAEYGLPVSKGYAVDTPEEAAEACDKIGGSEWVVKAQVHAGGRGKAGGVKLVRSKEDAKAFAQQWLGKRLVTYQTDANGQPVTKILVESCTDIAKELYLGAVVDRSSRRIVFMASTEGGVDIEKIAHDTPEKILKATIDPLVGAQPFQGRELAFQLGLEGKQVAQFAKIFVGLAKLFQDHDLALLEVNPLVIKADGDLHCLDAKINIDANAMYRQPKLKTFHDPSQDDPREAHAAKFELNYVALEGNIGCMVNGAGLAMGTMDIVNLHGGKPANFLDVGGGATKERVTEAFKIILSDTNVAAVLVNIFGGIVRCDMIAEGIIGAVKEVGVKIPVVVRLEGNNAELGAKVLAESGLNIIAATSLTDAAQQVVKAAEGK

SEQ ID NO: 64820 - protein, 141 aa, Triticum aestivum
  misc_feature (110)..(110): Xaa can be any naturally occurring amino acid
MNMEGSYDSSCNGEAGNESLQIIKYSPYKPCTMISLSSPWFVLRVFYVRVCGIQVDESTPEFLSLNHIPLSPDTLLEVNGVRSSIYSDGEESSVLRRDRVDKKSEEATFXVNTGYIRFTGNMKFEGYEKEKCILSGVPGDV

SEQ ID NO: 64821 - protein, 389 aa, Escherichia coli
TLQNGKLNVPENPIIPYIEGDGIGVDVTPAMLKVVDAAVEKAYKGERKISWMEIYTGEKSTQVYGQDVWFPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64822 - protein, 232 aa, Rhodococcus sp. RHA1
MPYLDRDGDVFILYLGNEGEADNENRFHPDWIDATHAALDEVEAHEGPAALVTTATGKFFTNGLDTTWIFANTDKLPEYLDRVHTIYSRLLAFPMATVAAVQGHSFGAGAMLATSHDFRFMRADRGFYCLPEVSLNMPFTVGMSALLNTRLPKQAAVEAMTTGRRFGGSDALAAGIVDEVADGDGVLAAAVTRAAALTATRGANLAGIKRGIHHDALAALATVTDKSNFSFG

SEQ ID NO: 64823 - protein, 332 aa, Novosphingobium aromaticivorans DSM 12444
MMAPAIAPDTISLIGNTPLVRLKGPSEETGCEIYGKCEFTNPGASVKDRAALWIVRDAEERGILKPGGTIVEGTAGNTGIGLALVANARGYKSVIVMPETQSREKMDTLRALRSELVLVPAAPFSNPGHFVHTSRRIAEETEGAVWANQFDNIANRRAHIESTAPEIWEQMEHRIDGFTCAAGTGGTIAGVGMGLKAFDENITIALTDPHGAALYNYYAHGELKAEGSSVAEGIGQGRITANLDGAPIDTQFRISDEEGLHWVERLLAEEGLCLGLSSGINVAGAVALARQLGKGSRVATILCDTGFRYLSSLYNPEWLKTKGLRVFPWLEQ

SEQ ID NO: 64824 - protein, 388 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISYALAAQVGGIGIAPGANIGDECALFEATHGTAPKYAGQDKVNPGSIILSAEMMLRHMGWTEAADLIVKGMEGAINAKTVTYDFERLMEGAKL

SEQ ID NO: 64825 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGDKLL

SEQ ID NO: 64826 - protein, 467 aa, Rhodococcus sp. RHA1
MTRIVIIGGGPAGYEAALVAAQHGASVSLIDSDGVGGACVLFDCVPSKTFIASTGVRTDMRRASDLGIALDPEQATVALPQIHARVKSLAQAQSSDIRTRLQTVGVELLSGTAEIADPRLGMASHQVCATLENGEKKTLDADVVLIATGASPRVIPGAEPDGERILTWRDLYDLDELPTHLVVVGSGVTGAEFVSAYTEMGVKVTLVSSRDRVLPGEDADAALVLEDVLAERGVTLVKHARADAVKRTEDGIVVVLADGRTVEGSHALMTVGSVPNTQGLGLEKVGIELDKGGYLRVDRVSRTPVSGIYAAGDCTGLLPLASVAAMQGRIAMYHALGEGVSPIKLKTVASAVFTRPEIATVGVSQAAIDDGEVPARTVMLPLNTNPRAKMSGLRRGFVKIFCRPATGVVIGGVVVAPNGSELILPIAIAVQNNLTVNDLAATFSVYPSLTGSITEAARQLMRHDDLD

SEQ ID NO: 64827 - protein, 294 aa, Arabidopsis thaliana
MQRRLVRLKKEYIYRKSLEGDERKVYEQKRLIREALQEGKPIPTELRNVEAKLRQEIDLEDQNTAVPRSHIDDEYANATEADPKILLTTSRNPSAPLIRFTKELKFVFPNSQRINRGSQVISEIIETARSHDFTDVILVHEHRGVPDGLIISHLPFGPTAYFGLLNVVTRHDISDKKSIGKMPEQYPHLIFNNFTTQMGQRVGNILKHIFPAPKLDAKRIVTFSNQSDYISFRNHVYDKGEGGPKSIELKEIGPRFELRLYQVKLGTVEQNEAEIEWVIRPYMNTSKKRKFIGE

SEQ ID NO: 64828 - protein, 258 aa, Rickettsia sibirica 246
MNDNLINALKDLIINTGKIALDIKKAGMLTDIKSDGSVVTNADKEISKIIYQTLQTLTSQIAIVCEEQPLPIFSSDTFWLIDPIDGTWSYVNGKSTYTVNIGLIENGFPTIGLIYHPETAKLYYTDVNGRLKIEQNSKEIFVNHEPKHEELNAVIGFYNSNKATKEFLSKYSFGQINAIGSSMKLCLIAEGAADIYPKFGQTMEWDIAAGHALIKAGGGNILDTHGQEITYGKESFANPNFFACSKYWLEREARLHRC

SEQ ID NO: 64829 - protein, 580 aa, Rhodococcus sp. RHA1
MSSQPGVQFLGPRQRDAAWDKLQTEQFDVVVIGGGVVGAGAALDAATRGLKVALVEARDYASGTSSRSSKMFHGGLRYLEQLEFGLVREALRERELSLTTLAPHLVKPLKFLFPITHRVWERPYMAAGIFLYDRMGGAKSVPAQKHLTRAGALRMAPGLKRNSLTGGIQYYDTVVDDARHTMTVARTAAHYGAVVRTSTQVVGFLREADRVSGVRVRDCEDGRTADVKAHVVINATGVWTDEIQALSRQRGRFRVRASKGVHIVVPRDRIVSDAAIILRTEKSVLFVIPWGSHWIIGTTDTDWNLDLAHPAATKADIDYILGHVNKVLVTSLTHDDIDGVYAGLRPLLAGESDETSKLSREHAVARVAPGLVAIAGGKYTTYRVMAEDAVDLAADDIPARMAPSITEKVPLVGADGYFALVNQTVHLGEMYGLHPYRVKHLLDRYGSLIDEVLDQARGKPELLQPLTDAPAYLQVEVVYAAAAEGALHLDDILARRTRIAIEYSHRGVNCAEQVAQLVAPVLGWDADAVDREVKTYQARVEAEVQSQAQPDDLSADALRAAAPESRVELLEPPVSVSEIP

SEQ ID NO: 64830 - protein, 475 aa, Ostreococcus tauri
  misc_feature (1)..(1): Xaa can be any naturally occurring amino acid
XVEDFRFDLMGELHATLPMEDETYFYKAGAEASGTFCAVPVTHANWTIAQPVPFWYVCDNFWAGHRNCTDAYEKNYDDEYGWYGLRALHTCLRLPIDALERGATELHFLHLDFQQSFEPKYEISEKALLRASVQHEVSVDINAPRVYWNPIQEPCCDALASQTNAVLTAVTILSLLPLVYLTFRDLLRPLRSASMRDTTRAFYTRAELLKAANKGPVTKMLSHANVLTGWIAVGAVTFPFLFTANAPYGKFLSKSWGPTMNGRVGWFLQEIISPPMLWVGLTRGADVFDDLGGGSIADEKYVRVLTVIWCAHYANRAIVYPATRTMGETAVATVVAAIAFNVFNGLLVGAELAHGCKRPSDFVICVGAATMAIGAWINISCDARLRALRAGRRSKREYVMPTGGLFDLVACPHYLGECIEWCGFAVLANFSPSTLAFAFWTFANLFPRAVATRRFYRARFKSYPARVRAMIPMLL

SEQ ID NO: 64831 - protein, 615 aa, Geobacter metallireducens GS-15
MANPSGKYQVKILGIEDYQALTACQSACPLGTDTKRYVRAITEGDYEKAFLIARQTNPLVSVCSRVCTAPCEKSCRKGEQGHPVDIRALKRFACDKHGVTSPRAVAGRLEEISRQNGGVGDRTGNHILTMAAVQKAGAAATSRKPAPRVAIIGSGPTGLSAAHDLALLGYGVTIFEAAPYAGGMLRTGIPAFRLPKDVLQQEIDAILNLGVELKLNSPIGEDLTLADLKAQGYESVFITIGLQDPLRILNIEGTDLAGIYSGVEYVRDHEKIRLGKRCLVIGGGGVAIDCAQHAVRQGAEQVMIACLESWETMPASLTEREDAQEEGIVFHPALGPRRFMGHNGHVARAEFLQVSSVFDSEGRFAPTFVPDSTTTLEVDSVILAVGQASTAPSLAGLAGLDLTPNGLIKAAEDMSTNLPGVFAGGDVRWRFTRNATDAIADGQKAARAIHGYLSGHTPQVIRKGFMRPVSPDFENTRCDTIAPVPIPKRDAGERVRTKEEITIGFGEAEAREQAARCRRCNIQTVFERSRCLRCGTCVDTCVNGALRIVRLADIQGDEDVAKLTDALKKSAQTRSKAMTAIIKDESRCASCGMCARRCPGGAITMAEFYCQEEWE

SEQ ID NO: 64832 - protein, 192 aa, Oryza sativa Japonica Group
MHAPRKFKKAFMERLLLSLQVAGLTSKSMGLRERRDAVRLSSDVAMASARGRAAPWARALVARHAAERRNEPLLRRIMGGDVYERAVSSAGAAVARSRRIVRRSQRVACSSRRKRRSLAMAAASGGGGALAARRMVKGRLRLLRRLVPGGEALRGFSLLSETLDYVVCLKTQVELMHSLCKGSQQKLHLQLG

SEQ ID NO: 64833 - protein, 366 aa, Staphylococcus aureus subsp. aureus MRSA252
MQSKRYLVLEDGSFYEGYRLGSDNLTVGEIVFNTAMTGYQETISDPSYTGQIITFTYPLIGNYGINRDDFESLVPTLNGIVVKEASAHPSNFRQQKTLHDVLELHQIPGIAGVDTRSITRKIRQHGVLKAGFTDRKEDIDQLVKHLQQVELPKNEVEIVSTKTPYVSTGKDLSVVLVDFGKKQNIVRELNVRGCNVTVVPYTTTAEEILAMAPDGVMLSNGPGNPEVVECAILMIQGILGKIPFFGICLGHQLFALSQGASSFKMKFGHRGANHPVKNLETGKVDITSQNHGYAIDIDSLKSTDLEVTHLALNDGTVEGLKHKTLPAFSVQYHPEANPGPSDSNYLFDDFVAMMTNFKEKERHINA

SEQ ID NO: 64834 - protein, 516 aa, Archaeoglobus fulgidus DSM 4304
MRKELVEELYGKKEKIRQMGGKERIERQHEQGKLTARERIELLLDPGSFVEINPFVEKRNTDFGLDKMDLPADGVVTGYGTVDGRPVAVFAQDFTVMGGSLGEMHGFKIAYILDFAMKLGIPVVGLNDSGGARIQEGVDALKGYGDIFYRNTLASGVIPQISVIMGPCAGGAVYSPAIGDFIVMTKNPNCYMFITGPQVIKTVTGEEVSAFDLGGWQAHAMKSGNCHLVAEDDRDAMMLVRRLLSYLPLNNMEDPPVVKTGDDPVRLTPEIYDVLPDDPQKPYDVRDVITAVVDNGELLEIHPYYAPNAVVGFARIDGKSVGIVANNPRHFAGCLDVDSSDKIARFVRFCDAFNIPIITFVDVPGYLPGVQQEYGGIIRHGAKVLYAYSEATVPLVTIILRKAYGGAYLAMGSKHLGADIVYAYPTAEIAVMGPEGAAEIVFRKEIKAAEDPKAMREEKIREYREKFANPYRAAARGYIDDIIDPKYTRVKVVSALRILESKREKLPPKKHGNIPL

SEQ ID NO: 64835 - protein, 304 aa, Oryza sativa
  misc_feature (202)..(202): Xaa can be any naturally occurring amino acid
  misc_feature (263)..(263): Xaa can be any naturally occurring amino acid
  misc_feature (274)..(274): Xaa can be any naturally occurring amino acid
MPSANVRGAQPSADRRLSTLVRHLLPSSARTATTTSTSSSAADADSSLQAFPTMASSSVFAGLAQAPEDPILGVTVAYNKDPSPVKVNLGVGAYRTEEGKPLVLNVVRRAEQMLINNPSRVKEYLPITGLADFNKLSAKLIFGADSPAIQENRVATVQCLSGTGSLRVGGEFLARHYHERTIYIPQPTWGNHPKVFTLAGLXTVRSYRYYDPATRGLDFQGLLEDLGSAPSGAIVLLHACAHNPTGVDPTLDQWETDHGIDEXKALLAFFESAXKGFARWKALAQNAQFRGPCFVAEGGEMAHG

SEQ ID NO: 64836 - protein, 366 aa, Zea mays
  misc_feature (177)..(177): Xaa can be any naturally occurring amino acid
MEGAAAGWPEPVVRVQSLSESGAATIPARYVKPEAERPASAAGEEEGGGGIPVVDLSSPATARAVSEACRDWGFFQAVNHGVPGELLRRARGAWRGFFRQPMEVKQRYANSPATYEGYGSRLGVEAGALLDWGDYYFLHVRPPHLCDPRKWPHLPPGLRKTTEEYSLEVAALCGRLXAAMSAGLGVGEARLREAFGGAEGAGVCVRVNYYPRCPQPELALGLSSHSDPGGMTVLLADDRVRGLQVRRRGAWVTVDPVPDAFIVNVGDQIQVLTNATYRSVEHRVVVNAADERLSVALFYNPRSDLPLAPMPELVSPDRPALYCPMTFDDYRMYIRRKGPRGKSQVDSLKVADAVDADADADGRRCY

SEQ ID NO: 64837 - protein, 309 aa, Burkholderia vietnamiensis G4
MTAKTIRHYLQFKDFSLEDYEYVLERTGILKRKFKNYETYHPLHDRTLAMIFEKSSTRTRLSFEAGIFQLGGHAVFMSTRDTQLGRGEPVEDSAQVISRMVDIIMIRTFEQDVITRFAQNSRVPVINGLTNEYHPCQVLADIFTYYEHRGPIAGKTVAWVGDANNMLYTWIEAAQILGFKLRLSTPPGYALDMKLVSPDSAPFYEVFDDPNEACKGADLVTTDVWTSMGFEAENEARKQAFADWCVDEEMMGYANADALFMHCLPAHRGEEVTAGVIDGPQSVVWDEAENRLHVQKALMEFLLLGRLKH

SEQ ID NO: 64838 - protein, 272 aa, Zea mays
MERAASVISSLLGGGGGSGAQAATVKSVLVYPIKSCRGISVPQAPITATGFRWDRQWMLVNSKGRACTQRVEPKLALVEVQMPPEAFAEDWHPTPDDHMVIRAPGMEPLKVPLSVECATISDVSVWEWTGAAYDEGAEAAEWFSTFLGCPTRLVRFNEDSETRLTDPDYARGYKTMFSDGFPYLIVSQGSLDALNEILKEPIPINRFRPNILVEGCHPYAEDMWKSVKINKLTFQGVKLCGRCKVYFGQNAVCKESLSANGEGRIVKVGDPV

SEQ ID NO: 64839 - protein, 249 aa, Zea mays
MVKLAFGSVGDSFSATSIKAYVAEFIATLLFVFAGVGSAIAYGQLTNGGALDPAGLVAIAIAHALALFVGVSVAANISGGHLNPAVTFGLAVGGHITILTGVFYWVAQLLGATVACLLLGFVTHGKAIPTHAVAGISELEGVVFEVVITFALVYTVYATAADPKKGSLGTIAPIAIGFIVGANILAAGPFSGGSMNPARSFGPAVAAGDFAGNWVYWVGPLVGGGLAGLVYGDVFIGGSYQQVADQDYA

SEQ ID NO: 64840 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLRREEFGGELIDGGPWLEVKNPNTGKEIVIKEVIADAFLQQILLGPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64841 - protein, 186 aa, Ehrlichia chaffeensis str. Arkansas
MFIQIGETPNPNTLKFMPGMPINNGKVSEFADSVAAEGSSLATALFKIEYVKSVFFGGDFVSVTKSDDIEWDVLKPEILTVIMEFLTLNSDNATESFDQEELEEFFDEKDIEMVGKIKELIDNYVKPAVIQDGGDIKFKGYSNGIVFVKLRGACSGCPSASITLKEGIYNMLSYYIPDIQGVESIQ

SEQ ID NO: 64842 - protein, 351 aa, Solanum lycopersicum
MNASNILLLIIVVQLVSVNLAFEKTQNVLSKSKIIHLNGSIGPESVAFDPNGEGPYIGVADGRILKLQLGSNNRLFWAEFAVTSSHRRDCTSPFAPKMEHICGRPLGLRFDTKTGELYIADAYLGLQVVGPKGGLATPLVQKFEGKPLVFTNDVDIDDDVIYFTDTSTKYQRWQFLTSFSSGDTTGRLMKYDKSTKKVTVLLGDLAFANGVALSKNKSFVLVTETTNFRILRYWLKGPLVGTHDVFVELPGFPDNIRINPKGDFWVALQAIRSVPSVSDSKFGMFSFNPQQMGDDGELHPTALKLSEDGRVLEVLEDVEGKTLRSISEIEEKDGKLWIGSVVMPFLRVYEM

SEQ ID NO: 64843 - protein, 154 aa, Myxococcus xanthus DK 1622
MKVRLLSIGKDRSGLYEPAVQEYAKRLGHYTRFELVEMAEASGKRLKPGDAKAAEAEAILSKRKPQDWLVALDERGSLLDSVELSRYVGKAQTGAKDLLFIIGGDEGLDARVRDAANLTLSLSKMTLPHRLARVVLIEQLYRAFTILKGEPYHK

SEQ ID NO: 64844 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIRCMNLNGDYISDALAAQVGGIGIAPGTNIGDECALFEPTPGTAPKYAGQDKVNPGSIILSAEMMLRHMGWTEAADLIVKGMEGAINAKTVTYDFERLMDGAKLL

SEQ ID NO: 64845 - protein, 359 aa, Streptococcus pneumoniae R6
MICSDSSYSFHNKNFMIFIRRKSLMVVKVGINGFGRIGRLAFRRIQNVEGVEVTRINDLTDPVMLAHLLKYDTTQGRFDGTVEVKEGGFEVNGKFIKVSAERDPEQIDWATDGVEIVLEATGFFAKKEAAEKHLKGGAKKVVITAPGGNDVKTVVFNTNHDVLDGTETVISGASCTTNCLAPMAKALQDNFGVVEGLMTTIHAYTGDQMILDGPHRGGDLRRARAGAANIVPNSTGAAKAIGLVIPELNGKLDGSAQRVPTPTGSVTELVAVLEKNVTVDEVNAAMKAASNESYGYTEDPIVSSDIVGMSYGSLFDATQTKVLDVDGKQLVKVVSWYDNEMSYTAQLVRTLEYFAKIAK

SEQ ID NO: 64846 - protein, 389 aa, Escherichia coli
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPARYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWMKVKNPNTGKEIVIKDVIADAFLQQILLRPAEYDVIACMNLNGDYISDALAAQVGGIGIAPGANIGDECALFEATPGTAPKYAGQDKVNPGSIILSAEMMLRHMGWTEAADLIVKGMERAINAKTVTYDFERLMEGAKLL

SEQ ID NO: 64847 - protein, 389 aa, Escherichia fergusonii
TLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIYAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTDKKIVIKNVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMEGAKLL

SEQ ID NO: 64848 - protein, 335 aa, Ostreococcus tauri
MDASWSAALAALRADARAFGVEIGVVKMTKTLKSVRKNAMRSTVRAPLGGLDARQAVMYAVIMFVFNWLLRVVVVEPLGRVLMGFSGKARTKARNARAEKFAQSALEMVTYGAFSYFGAMIVPKQSWFWPSSEWWRGFPVKTLATDGALRCYYLAYGARYVAGAVNVLLEHKRKDFWSMQLHHVSTIGVIWVSYVYGWTRVGAVIMLVLDPADVPLHAAKCAKYIGDARGNKRFQLLADVLFAIFLVTFFVMRLVMYPYVVWSSHFEARRYFGASFGYWTCVVLLYIILGLQVYWFKLIVNVVHRILITGSAEDVRSDDEDDDEEEDDDDAKKRR

SEQ ID NO: 64849 - protein, 455 aa, Debaryomyces hansenii
MVLPHEPEFQQAYNELVSALEDSTLFTEKPEYKKVIPVVSVPERIIQFRVAWENDNGDVEVNNGYRVQFNSALGPFKGGLRFHPSVNLSILKFLGFEQIFKNALTGLSMGGGKGGCDFNPKGRTDSEIRRFCVAFMRQLARYIGSDTDVPAGDIGVGSREVGYMFGAYKQMQNNWSGILTGKGLSWGGSLIRPEATGYGVVYFVEKMIEKATGGKESFKGKRVAISGSGNVAQYAALKVIELGSTVVSLSDSKGCIISQTGITPDQIKAIAAAKIHFKTLEEITKESASLFSGSNEVQYIAGVRPWTHCGQVDVALPSATQNEVSGEEAKALVEAGCKFVAEGSNMGSTKEAIDVFEANRSKAVWYAPGKAANCGGVAVSGLEMAQNSQRVTWAAEEVDEKLKNIMYTCFDNCYANAAKYSAEKDAENLPSLLKGANITGFIKVADAMFDQGEVF

SEQ ID NO: 64850 - protein, 337 aa, Ostreococcus tauri
MDARAEALRTIAAALATPGKGVLAADESTGTIGKRLATIGVENTLEQRVALRELLFDAPNCAAALSGVILYDETLRSTGKGGATFVEMLRANGTIPGIKVDAGVVPLPGSPEETATAGLDGLDERCKEYYDLGARFAKWRAVLKIDEARGFPSALAVAENANALARYATICQRNGLVPIVEPEILMDGAHDIETCLRVTRRVLDAVFSALRLHGAQMDGMILKPNMVTAGSAHPSANGGDDVVAEMTLRALRDVVPPAVPGILFLSGGQTEEQATERLRLMNRSSIPRAPWTLSFSYGRALQASCLKAWGGKAENVPAAQAAFFARCKANSEASIRP

SEQ ID NO: 64851 - protein, 211 aa, Gossypioides kirkii
AKGQTPLFPRILAHEAGGIVESVGEGVTDLKPGDHVLPVFTGECGNCRHCKSKESNMCDLLRINADRGVMLSDGKTRFSINGKPIYHFLGTSTFSEYTVAHVGSVAKINLAAPLDKVCVLSCGISTGLGATLNVAKPTKGSTVAIFGLGAVGLPATEGARIAGASRIIGVDLNPNRFEEAKKFGCTEFVNPKDHNKPVQEVLAEMTNGGVD

SEQ ID NO: 64852 - protein, 70 aa, Glycine max
  misc_feature (43)..(43): Xaa can be any naturally occurring amino acid
SITTGNRSGTSMVAPFTGTKSMADFCIRNTNDDITIIASNGAXVQCMHMWTPVSMKQIDTDSYLPDIDHA

SEQ ID NO: 64853 - protein, 455 aa, Ostreococcus tauri
MSSSITPLSATQLIPSFSLIAAPSFESATASVSPSACLVRNFFSDFPTLESTKVAAAASASVVFSNLLNAFIETIFFAPSTVLKASCNFYVVNARTHRLSSVIHTRTPHAPTPSTFLRARSLGRFQFSPAPARASPTPFPTSHPPPRRHPSRARISSSHRTHPPTRRRRPRARSRDATELIPRRRSLPPPPNSTPDLLLILHLEQGVPRRGLEQEQHGATRAKCGRDRRRRGGGVSRVTRGPFVHACAVRVGVLFFGVVDASSPRLGATWRRTRRSMDAVTALAARAREGVADAFERLPKHVRVVVMWMVFQFIGSMIRRAVFGKEKPAGPAEKKAVVECETEEAFAEALKEAKEAKRAVVIDFTASWCGPCKRIAPVFADMSEEYDATFLKVDVDKNSEVSGAHNVTAMPTFAFYDANGEKVDEQIRGANIAKITDMLDKLGVKKVVKEVKKDA

SEQ ID NO: 64854 - protein, 505 aa, Rhodococcus sp. RHA1
MNLPAPEELCRRAEEALIRCGAEITDAGGPLVARTPITGTELRTVTASSADDVDRAITAAHEAFLEWRTVPAPQRGAVVRRLGQLLTEHKTDLAELVTLEAGKIPSEAQGEVQEMIDICEFAVGLSRQLYGRTMASERPGHRLMETWHPLGVVGVISAFNFPVAVWSWNTAVALVCGDTVVWKPSDRTPLTAIACDALLARAARDVGAPAGIHAVVQGAGDVGERLVDDARVALVSATGSVRMGRAVGPRVAARFGKCLLELGGNNAAVVAPSADLDLAVRGIVFSAAGTAGQRCTSLRRLIVHSSVADELVQRISSAYGQLKVGNPFDDGVLVGPLVNGSAFEAMQTALDKARADGGTVVCGGERSGGSDSAYYVSPALVRMPAQTSVVQEETFAPILYVLTYDDFDQAITLHNEVPQGLSSSIFTTDQREAERFLAADGSDCGIANVNIGTSGAEIGGAFGGEKETGGGRESGSDAWKAYMRRATNTVNYSDRLPLAQGVEFT

SEQ ID NO: 64855 - protein, 595 aa, Dunaliella tertiolecta
MASVDCTLVSARGIKDVEIVGKQSPYAVLTVGPKTFKSGTANGGGSDPVWNQTFSFTNVTPDSSVKLEIFNSNVVLRDVAIGGCKAPMDKALSAGKDELTLPIITKKGKPHGEVKLILTLKPDATKQMVTSHKTRKAAGAWILPTYGNTDCWKDYEPGTLLGKGTFGTTYLATEKKTGQKCAVKVISKRKLTTPDEVDDVKKEVQIMHHLAGHPNVVGLKGVYEDKSNVCLAMEVATGGELFDSIVKRGHYSERDAAELIRTIVSVVAHCHNMGVIHRDLKPENFLLSDKSPRAQLKATDFGLSSFFQEGQVFTDIVGSAYYVAPEVLRRSYGKEADIWSCGIILYILLCGFPPFHGDSEKKIFEAIISKSVDFNTQPWPRISAPAKDCVKRMLQRDPKKRATANEIMQHDWMRENGVASDEPLEMEVVSRIKNFSGMNKLKKEALKVIAVNLPIDEISGMREMFMDIDKDKSGNITIDEFAAALHKKGQIVTEKEIEKIMKEADVDGDGTIDYEEFLAATINLGKLQREENLKTAFEHFDLDGNGEISHNELVQCLSKLGINDAHVKDIIKEVDADGNGQIDYNEFCIMMRNLD

SEQ ID NO: 64856 - protein, 248 aa, Listeria monocytogenes str. 4b F2365
MNRVALVTGSSRGLGREIAIALAKEGYDIAVNFSRNRKKAEEVQQEIEQLGRKCVIFKANVGDVEKIRDLFKAVDEEFGRLDIFINNAASGVLRPLMELEESHWDWTMNINAKALLFAGQEAAKLMQRHQSGKIISLSSIGSIRYLENYTTVGVSKAAVESLTRYLAVELAPFGIAVNAVSGGLIETDALNHFPNREELLKDAISKTPAGRMIEPNDLVNAVLFLASEKADMIRGQTILVDGGRTLLV

SEQ ID NO: 64857 - protein, 473 aa, Bacillus cereus E33L
MQQPTNEKLHRTMKSRHLFMIALGGVIGTGFFLGSGYTINQAGPGGAILSYLVGGFIMYLTMLCLGELTVAMPVSGSFQKYATKFIGPGTGFMIGWLYWLGWAVTVGLELTSIGLMMKRWFPNVDVWVWCLVFGVILYASNAISAKSYAELEFWFSSIKVVTILAFVVLGGSALLGFISYDGKEAAPLFSNFVSDGGLFPNGLAAVLLTMITVNFSFQGTELIGIAAGESENPEKTIPRAIRNTVWRIMLFFILTMTILVGLISWKEAGVIESPFVVVFDKIGIPYAADIMNFVIITALLSVANSGLYAATRILWSLANEGMAPKSFQKVNKRGIPITALVVTIAVAALSLLTSFLAEDTVYMYLLSIAGLSAVSSWIIIALSQLRFRSQYIKGGGKLEDLKYRTPLYPIVPILALITNSIVVISLAFIPEQRMALYCGIPFIIFCYIYYYINKKRQKPMKVETTNETNNQTR

SEQ ID NO: 64858 - protein, 426 aa, Magnaporthe grisea 70-15
MSTGSAKFQPAARVAGRRQDVWSIINEAATASPKQPIVNMGQGFFGYNPPDFILNAAKQALDKVDCNQYSPTKGRPRLKKAIADAYAPFWGRQLNPDTEVTITTGANEGMLSAFMAFIEPGDEVIIFEPFFDQYISNIEMPGGKIVYVPLHPPTEGATKTLSAGAWNIDFDELERAITPKTKMIVLNTPHNPVGKVFTKDELQKIADLCLKNEIIILSDEVYDRLFYTPFTRIATLSPEVERITLTVGSAGKNFYATGWRVGWLMGPAELIQHVSAAHTRICYSSVSPLQEACAVGFEQAEKEGFWDECVRDMKRRMDLFNQVWHELGIPFSEPEGGYFVMVNLSTVQMPENYPFPPHVASRPRDFKLAWFLIQELGVAAIPPTEFFTDANAHIVEDYLRFAVCKPDDVLELAKERLRGLKKFIKQ

SEQ ID NO: 64859 - protein, 543 aa, Glycine max
  misc_feature (295)..(295): Xaa can be any naturally occurring amino acid
  misc_feature (448)..(448): Xaa can be any naturally occurring amino acid
MASISHFRTSANSFLSQYEPLSLLLAPLLSLLFAHALRSFFHLLSQNGLKATLLGFLINSLKLVPGVKGYIDAEKQKVVDKLQSDGKSKREGWKTELPSTGLGTSVLEKMREEKINDAVWQGKCSGTVYIGGSESDGHFSLINEACSMFAHTNPLHLDVFKSVARFEAEVVAMTAALLGSKEKSSGRQICGNMTSGGTESILLAVKSSRDYMKSKKGITRPEMIIPESGHSAYDKAAQYFNIKLWRVPVNKNFQADVKAIRRHINKNTILIVGSAPGFPHGVIDPIEIIWQFLPXELGHLASSFGICFHVDLCLGGFVLPFARELGYHIPPFDFSVKGVSSISVDVHKYGLAPKGTSVVLYRNHEIRKHQFVAVTEWSGGLYVSPTIAGSRPGSLIAGAWAAMMSLGKEGYLKNTKAIMEGSRRIQKGIEEIAELFIVGKPDMTIGAXGSAVLDIFEVNDVMSSKGWHLNALQRPNSIHICVTLQHVPIVEDFLNDLKESVKTVKANPGPISGGLAPIYGAAGKMPDRGMVQELLVDYMDGTC

SEQ ID NO: 64860 - protein, 235 aa, Glycine max
  misc_feature (143)..(143): Xaa can be any naturally occurring amino acid
  misc_feature (180)..(180): Xaa can be any naturally occurring amino acid
MASQVCKAASRAARSLLSASRASHGRAVGAATAVSLSCKVPLFYGKNGSGSGSASSSSSSWISGALALPAAAYMFQDQEVRAAELERTFIAIKPDGVQRGRISEIISRFERKGYKLVGIKVVIPSKEFAQKHYHDLKERPFFXGLCDFLSSGPVIAMVWEGQGVISYGRKLIGATDSDFXGSGTIRGDLAVVVGRNIIHGSDGPETAKDEIKLWFKPEELVSFTSNAEKWVYGVN

SEQ ID NO: 64861 - protein, 480 aa, Geobacter metallireducens GS-15
MKEYRLFINGEWVPSSTGTMADDINPATGDVYAKVHQASRDDIEQAIASAYRARVDWGKTVPAQREAILIKAAAILEERIPEFAEVLIEEGGATFGKAMFESSFVVTLLRSAAGECRRIFGETIPSDAPGLFSMSVRRPLGVIAGISPFNFPFLLAMKKVALALAAGNTFVLKPASPTPVIGLKIAELFEAAGLPKGVLNVIPVKGSTLGNTLVEDPRIRMVTFTGSTDVGKQLAEVAGRHQKKITLEMGGKSPLIVLKDADIDYAVDAAVFGIFLHQGQVCMANSRLIVEADIYDRFCEKLTAKVKGLKMGDPHKPDTVIGPLIDAKQCAFIDSQVHDALADGARVLSGGRSEGAFYQPTIVADVTRKMRIFDEESFGPVVCVIKAANSEEALALANDSSFGLSAGLITNDLQKAFDLSLRLESGMVHINDSSIFDEPHVPFGGVKDSGVGREGGHYSMEEMTEVKWITVQMGKRQFPF

SEQ ID NO: 64862 - protein, 221 aa, Thermoplasma volcanium GSS1
MSDEWTPRTQLGKLVASGQIKTISEALKTKLPLKEYEIVDYLLPNIKDEVIDIKRAQRMTDSGRRMTYSITVVVGNEDGYIGLGIGRSKEAAPAIRKALINAKLNIMEIRRGCGSWECGCGRAHTLPFLVEGKSGSVRITLKPAPRGVGLAVGNVAKIILRMAGIEDAWGFAAGHTKTTVNYALAVYNALKETAKVRINPGIVLSTPIYSGSVINVSGHTD

SEQ ID NO: 64863 - protein, 502 aa, Solanum lycopersicum
MVLTTTSIRDSEESLHCTFASRYVQEPLPKFKMPKKSMPKEAAYQIVNDELMLDGNPRLNLASFVSTWMEPECDKLIMSSINKNYVDMDEYPVTTELQNRCVNMLAHLFHAPVGDDETAVGVGTVGSSEAIMLAGLAFKRKWQSKRKAEGKPFDKPNIVTGANVQVCWEKFARYFEVELKEVKLKEGYYVMDPAKAVEIVDENTICVAAILGSTLTGEFEDVKLLNELLTKKNKETGWETPIHVDAASGGFIAPFLWPDLEWDFRLPLVKSINVSGHKYGLVYAGVGWVIWRSKEDLPDELVFHINYLGSDQPTFTLNFSKGSYQIIAQYYQLIRLGFEGYKNVMKNCLSNAKVLTEGITKMGRFDIVSKDVGVPVVAFSLRDSSKYTVFEVSEHLRRFGWIVPAYTMPPDAEHIAVLRVVIREDFSHSLAERLVSDIEKILSELDTQPPRLPTKAVRVTAEEVRDDKGDGLHHFHMDTVETQKDIIKHWRKIAGKKTSGVC

SEQ ID NO: 64864 - protein, 502 aa, Capsicum annuum
MEIQFTNLVAFLLFLSSIILLLKKWKTQKLNLPPGPWKLPFIGSLHHLAVAGPLPHHGLKNLAKLYGPLMHLRLGEIPTVIISSPRMAKEVLKTHDLAFATRPKLVVADIVHYDSTDIAFSPYGEYWRQIRKICILELLSAKMVKFFSSIRQDELSMMVSSIRTMPNFPVNLTDKIFWFTSSVTCRSALGKICRDQDKLIIFMREIISLTGGFSIADFFPTWKMLHDVGGSKTRLLKAHRKIDEILEHVVNEHKQNRADGQKGNGEFGGEDLIDVLLRVRESGEVQISITDDNIKSILVDMFSAGSETSSTTIIWALAEMMKKPSVLAKAQAEVRQVLKEKKGFQQIDLDELKYLKLVIKETLRMHPPIPLLVPRECMKDTKIDGYNIPFKTRVIVNAWAIGRDPESWDDPESFSPERFENSSVDFLGSHHQFIPFGAGRRICPGMLFGLANVGQPLAQLLYHFDRKLPNGQSHENLDMTESPGISATRKDDLVLIATPYDP

SEQ ID NO: 64865 - protein, 162 aa, Brassica napus
MAPIAVGDVVPEGTISFFDENDQLQSASVHTLAAGKKVILFGVPGAFTPTCSMQHVPGFIEKAEELKSKGVDEIICFSVNDPFVMKAWGKTYPENKHVKFVADGSGEYTQLLGLELDLKDKGLGVRSRRFALLLDNLKVTVANVESGGEFTVSSADDILKAL

SEQ ID NO: 64866 - protein, 324 aa, Streptococcus pyogenes M49 591
MQLYTAPHILIATGGHPVFPDIEGAQYGISSDGFFALDEVPKRTAVVGAGYIAVELAGVLHALGSKTDLFIRHDRPLRSFDKAIVDVLVEEMAVGGPCLHPHSEVAKVVKNTDESLTLYLKDGQEVEVDQLIWAIGRKPNLEGFGLDKTGVTLNEKGYIKTDAYENTSVKGIYAVRDVNGKLALTPVAVAAGRRLSERLFNGKTDEKLDYQNVATVIFSHPVIGSVGLSEEAAVKQYGQEAVKTYQSRFTSMFTAITNHRQPCLMKLVTVGDTEKIVGLHGIGYGVDEMIQGFAVAIKMGATKADFDNTVAIHPTGSEEFVTMR

SEQ ID NO: 64867 - protein, 211 aa, Gossypium robinsonii
AKGQTPLFPRIFGHEAGGIVESVGEGVAHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQKVLAEMTNGGVD

SEQ ID NO: 64868 - protein, 653 aa, Oryza sativa
  misc_feature (202)..(202): Xaa can be any naturally occurring amino acid
  misc_feature (206)..(206): Xaa can be any naturally occurring amino acid
  misc_feature (216)..(216): Xaa can be any naturally occurring amino acid
IISSAEVGGGRRHHRRHDCPPFTCGHLSDVSFPFRRRGDPPECGVQSYELTCADDKATIQIDKETYSVSDINYGDSTLWVVDASFLDSRSSCLLPRWNPLLRDPRLQAKSHHIIELAPPVGVTWASFVNCSQEIRNSSWMYMPVACLSTSRSFVYVFTGQQSAYIQNLEPSCGYLATTPLGGSKLNSTSALQNVSYQDVVKXNDDXDLPFDFLSQXSGWNFKECLALSIRQTGTGSKERIANIAIIDFYFWSCFLLGDRSHNNLIYTYMVVDTVPIALLILKWTAVLCRFVLAPLAVFIFLAHKYWRNKITIDAVEKFLQMQLTLGPTRYAYTDLTAITGHFGEKLGQGGYGSVYKGVLPGYVNVAVKVLENANCNGEEFISEVSTIGRIHHVNVVRLVGFCSEELRRALVYEYMPRGSLDKYIFSSKRSFSWDKLNEIALGIARGINYLHQGCDMQILHFDIKPHNILLDDNFVPKVADFGLAKLYPRDNSFVPLNALRGTIGYIAPEMISRSFGVISSKSDVYSFGMLLLEMAGGRRNSDMHAGNSSQAYYPSWVYDRLIEQQVGVGEISAATVANMHELERKLCIIGLHCIQMKSHDRPTMSEVIEMLEGGVVGLQMPPRPFFCDDESMSPMMDSYQFSSGLTEILEEDE

SEQ ID NO: 64869 - protein, 211 aa, Gossypium raimondii
AKGQTPLFPRIFGHEAGGIVDSVGEGVTHLKPGDHVLPVFTGECGNCRHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTDGGVD

SEQ ID NO: 64870 - protein, 341 aa, Pseudomonas fluorescens Pf-5
MTQQRPIAVLGGGSFGTAVANLLAENGHRVRQWMRDPEQAEAIRVNRENPRYLKGIKIHPAVEPVTDLLATLNDSDLCFVALPSSALRSVLAPHAELLRGKLLVSLTKGIEAQTFKLMSEILQDIAPQARIGVLSGPNLAREVAEHALTATVVASEDEELCQRVQAALHGRTFRVYASADRFGVELGGALKNVYAIIAGMAVALGMGENTKSMLITRALAEMTRFAVSQGANPMTFLGLAGVGDLIVTCSSPKSRNYQVGFALGQGLSLEEAVTRLGEVAEGVNTLKVLKVKAQELGVYMPLVAGLHAILFEGRTLNQVIELLMRGEPKTDVDFISTSGFN

SEQ ID NO: 64871 - protein, 394 aa, Ostreococcus tauri
MPTRVVLVRHAQSEFNARHLIQGQLDPPLDDVGLEQLRVGAPRAASEHSDASRVYTSDLSRASTTARAIADALNVDVIADVRLRERHLGNLQGLPRAELKDAEPSAYAAWKSRDPNQTIPGGGECGREVDERLCDFFREIARDGPQKVIAVTHGGVLGRVFSGGRNGDEKRLCGMRRGVGNLAECVIDVDVDGSWRCEYATWASGRFLESTALDADDASSRAALSGAPLACPSRASRASASRSRVRVHADASDDLARKATVLTDDLKAMKTTMPTIRRVVAGNRNDLKALSLYQDALEGKVPTDYDDVSKLEKTLDDLASYVEQRAEEEQFWANREGKVTSSVVDDTNLTEDEKREVASILGNVVTWGVQGATWNALILLIGFVSLVTFVLPNQ

SEQ ID NO: 64872 - protein, 269 aa, Novosphingobium aromaticivorans DSM 12444
MTKTFLQFGCGNMGGAMLKGWLAGGLAPETFTVVDPYLEAAPHGVRLLEAAPAGEDAFDIVLLGFKPQQLPDAAQAVRPFVGPRTLLLSILAGVDLATLRRTFPEARAIVRVMPNLAAALGKSPIALFGDADEAARAETDALMAPLGQAEWLSGEDQMDLVTALAGSGPAFVYRFIDALAEGAAALGLPRDQADRLALSMVEGSAMLAAASEHSPGELARRVASPGGVTQVGIDILDAERRLARLVEDTLRGARDRSAEMTEQARARQQ

SEQ ID NO: 64873 - protein, 211 aa, Gossypium hirsutum
AKGQTSLFPRIFGHEAGGIVESVGEGVTHLKPGDHVLPVFTGECGNCRHCKSKESNMCDLLRINTNRGVMLSDGKTRFSINGKPIYHFVGTSTFSEYTVAHVGSVAKINPAAPLDKVCILSCGISTGLGATLNVAKPTKGSTVAIFGLGAVGLAAAEGASIAGASRIIGVDLNPNRFEEAKKFGCTEFVNPKDHNKPVQEVLAEMTNGGVD

SEQ ID NO: 64874 - protein, 211 aa, Gossypium hirsutum
AKGQTPLFPRIFGHEAGGIVDSVGEGVTHLKPGDHVLPVFTGECGNCCHCKSKESNMCDLLRINTDRGVMLSDGKTRFSINGKPIYHFVGTSTFSEYTVAHVGSVAKINPAAPLDKVCILSCGISTGLGATLNVAKPTKGSTVAIFGLGAVGLAAAEGARIAGASRIIGVDLNPNRFEEAKKFGCTEFVNPKDHNKPVQEVLAEMTDGGVD

SEQ ID NO: 64875 - protein, 322 aa, Brassica napus
MASRIANDVTELIGNTPLVYLNNVAEGCVGRVAAKLEMMEPCSSVKDRIGFSMISDAEEKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVNLIDEVVQVSSDESIDMARLLARKEGLLVGISSGAAAAAAIKLAKRPENAGKLFVAVFPSFGERYLSTVLFDATRKEAESMTFEA

SEQ ID NO: 64876 - protein, 451 aa, Acidobacteria bacterium Ellin345
MSSHAILPRSFTKQYPVAARAHGARIWDTQGREYIDLSGSAVVNFIGFGNDTVVQAMAEQASRLPFVHSSQFTSEIAEHFAAEVLDFAGPAFEGGAVFFTCGGSEAVETALKLARQFQVETGHPDRCEIISRQQAYHGSTLGALAVSGNLSRREIYLPMVREFEHIRIPYCYRCEFSCELGCDDCGRKYADDLRHAIEHSAGRAAAFIGEPISGATLGAVAPPPIYWPAIASICKEHGLLLIADEVMTGFGRTGRNFAMDHWNVAPDILVAGKGIGSGYAPLGAVIVSARVVDALRKGSGMLIHGFTYNAHPVSMAAGSAVLAHIREMELVQAADSEHGSIGQAFMQALHLLEEIEAVGDVRGLGLLHAVEFVRDRATREAYPAALKFSGKVAAAALKRGVLTYPMQGSIDGTRGDHILLAPPAVELDRLLEAVHLLGDAIREASDQAARS

SEQ ID NO: 64877 - protein, 233 aa, Gossypium robinsonii
KILFTSLCHTDVYYWEAKGQTPVFPRIFGHEAGGVVESVGEGVTELKPGDHVLPVFTGECGDCGHCKSEESNMCDLLRINTDRGVMLSDGKTRFSINGKPIYHFVGTSTFSEYTVVHVGCVAKVNPAAPLDKICVLSCGISTGLGATLNVAKPTKGSTVAIFGLGAVGLAAAEGARIAGASRIIGVDLNPNRFEEAKKFGCNEFVNPKDYDKPVQEVLAEMTNGGVDRSVECT

SEQ ID NO: 64878 - protein, 89 aa, Desulfovibrio vulgaris subsp. vulgaris str. Hildenborough
MAKTLYVGNLPFSASEDDVRSLFTNYGEVVSVKLIMDRETGRPRGFGFVEMNDGDAGAAIEALDGADFMGRALRVNEAQERAPRPKRAW

SEQ ID NO: 64879 - protein, 160 aa, Zea mays
MTKQPMKVYKWDLDETLILLKSLLVGSYARDFEGLKDREKSTQTRKRWENLILELCDVHFFYEERSAGPREIHQAFSVMPGASSKVFQDKLELQPMFVAQWKFAHVTFSKPEYLQDSDIVMNRFHKQRPVYGGWEQHHGLEHTSTTQKRSYLGNNQMNRI

SEQ ID NO: 64880 - protein, 545 aa, Azospirillum brasilense
MKLAEALLRALKDRGAQAMFGIPGDFALPFFKVAEETQILPLHTLSHEPAVGFAADAAARYSSTLGVAAVTYGAGAFNMVNAVAGAYAEKSPVVVISGAPGTTEGNAGLLLHHQGRTLDTQFQVFKEITVAQARLDDPAKAPAEIARVLGAARALSRPVYLEIPRNMVNAEVEPVGDDPAWPVDRDALAACADEVLAAMRSATSPVLMVCVEVRRYGLEAKVAELAQRLGVPVVTTFMGRGLLADAPTPPLGTYIGVAGDAEITRLVEESDGLFLLGAILSDTNFAVSQRKIDLRKTIHAFDRAVTLGYHTYADIPLAGLVDALLEGLPPSDRTTRGKEPHAYPTGLQADGEPIAPMDIARAVNDRVRAGQEPLLIAADMGDCLFTAMDMIDAGLMAPGYYAGMGFGVPAGIGAQCVSGGKRILTVVGDGAFQMTGWELGNCRRLGIDPIVILFNNASWEMLRTFQPESAFNDLDDWRFADMAAGMGGDGVRVRTRAELKAALDKAFATRGRFQLIEAMIPRGVLSDTLARFVQGQKRLHAAPRE

SEQ ID NO: 64881 - protein, 583 aa, Synechococcus sp. CC9311
MMGYPCLHSVLRLERVGKIYPTGEVLRDVTWEVKPGDRIGLVGVNGAGKSTQLRLIAGMEEASSGQIVKQGEPRIAYLQQEFDVDPSRTVREELFQAFGEAAIVLGKQKKVELEMGSERAAKDPDHLDALIHELGRLQTRFEGLHGYELDARIDKLLPTIGFKLEEADRLVSDYSGGWQMRLALGKILLQDPDLLLLDEPTNHLDVETIQWLEGYLIEQKAALVVISHDRTFLDRVCNQIVSTERGVSRAYLGNYTSHLEQKALEQEASQAAFERQQKEIATQQAYIDRFRASATRSTQAKSREKQLDKVERVDAPVESVSGPSFRFPPAPRSGAQVAVIDNMTHSYGENILFMEADLEIERGDRIAFVGPNGAGKSTLLRLIMGVESPDEGSARLGEHNIIASYFEQNQAEALDLNKTVIETMFEAVPDWTQTQVRSLLGSFCFSNDSVFKDVGKLSGGEKARLALALMLLSPCNLLVLDEPTNHLDIPAKQMLEDALCDYEGAALLVSHDRYFISRVANKIVEIHDGELVTYRGNYAYYQDKKAEERAEAETKRLIAEKEAKRKANNAKQKERAARKKNAA

SEQ ID NO: 64882 - protein, 963 aa, Arabidopsis thaliana
MLYIRKKMTSMIVKTTPELFKGNGVFRTDHLGENRMVSRSNRLGDGSNRFPRTGTIHCQRLSIAKTGLHRETKARAILSPVSDPAASIAQKRVFTFGKGRSEGNKGMKSLLGGKGANLAEMASIGLSVPPGLTISTEACQQYQIAGKKLPEGLWEEILEGLSFIERDIGASLADPSKPLLLSVRSGAAISMPGMMDTVLNLGLNDQVVVGLAAKSGERFAYDSFRRFLDMFGDVVMGIPHAKFEEKLERMKERKGVKNDTDLSAADLKELVEQYKSVYLEAKGQEFPSDPKKQLELAIEAVFDSWDSPRANKYRSINQITGLKGTAVNIQCMVFGNMGDTSGTGVLFTRNPSTGEKKLYGEFLVNAQGEDVVAGIRTPEDLDTMKRFMPEAYAELVENCNILERHYKDMMDIEFTVQEERLWMLQCRAGKRTGKGAVKIAVDMVGEGLVEKSSAIKMVEPQHLDQLLHPQFHDPSGYREKVVAKGLPASPGAAVGQVVFTAEEAEAWHSQGKTVILVRTETSPDDVGGMHAAEGILTARGGMTSHAAVVARGWGKCCIAGCSEIRVDENHKVLLIGDLTINEGEWISMNGSTGEVILGKQALAPPALSPDLETFMSWADAIRRLKVMANADTPEDAIAARKNGAQGIGLCRTEHMFFGADRIKAVRKMIMAVTTEQRKASLDILLPYQRSDFEGIFRAMDGLPVTIRLLDPPLHEFLPEGDLDNIVHELAEETGVKEDEVLSRIEKLSEVNPMLGFRGCRLGISYPELTEMQARAIFEAAASMQDQGVTVIPEIMVPLVGTPQELGHQVDVIRKVAKKVFAEKGHTVSYKVGTMIEIPRAALIADEIAKEAEFFSFGTNDLTQMTFGYSRDDVGKFLPIYLAKGILQHDPFEVLDQQGVGQLIKMATEKGRAARPSLKVGICGEHGGDPSSVGFFAEAGLDYVSCSPFRVPIARLAAAQVVVA

SEQ ID NO: 64883 - protein, 488 aa, Xylella fastidiosa Dixon
MSERQRRTRILATLGPATDPPGVLDALFKAGVNVVRLNFSHGDVSDQARRAAEVRAAAAHVGVEIGILADLPGPKIRIGRFIGGKVRLVAGARFDLLADSNASLGDATQVGVSYLGLPQDVVAGDVLLLDDGLMQLQVVQVQGARIVTTVLNDGVLSDRKGLNKQGGGLSLGALTDRDRELIGIVARMGIDFIAVSFCRHAEEMHEARRIARECGCDAALVSKIERAEAIVNLAEIVAASDVVMVARGDLGVEIGDAQLPGLQKKIIKEALLQNKVVITATQMLQSMVESPMPTRAEVLDVANAVIDGTDAVMLSAETATGDYPVKAVEAMARICLGAEHQFEFDTDYEMAQRNLQRADHAIAMATMFLSEHICLGGVVALTESGTTPRFLSRFRSHVPIYAFTRHEDVRRRMVLMRGVFPMRFDSRGLTPREAARATIRLLVECGCMSPGDRVVFTSGEHMETLGATNTLRLLEVGADGCVSGLWEL

SEQ ID NO: 64884 - protein, 441 aa, Candida albicans SC5314
MLSRSIKSSLKRTTALARPTAAKSALKIANASSVRSLHIKNTSSYRPTPFLTFQRYASVSVKVPDMAESITEGTLAAFNKEVGDFVSQDETIATIETDKIDVEVNAPVSGTITEFLVDVDATVEVGQEIIKMEEGDAPAGGASASEAPAKKEEAPEKAKEESAPAAAPKKEETKKEEPKKESKPAPKKEESKKSTQSTTSAPTFTNFSRNEERVKMNRMRLRIAERLKESQNTAASLTTFNEVDMSNLMDFRKKYKDEFIEKTGIKLGFMGAFSKASALALKEIPAVNAAIENNDTLVFKDYADISIAVATPKGLVTPVVRNAESLSILGIEKEISNLGKKARDGKLTLEDMTGGTFTISNGGVFGSLYGTPIINMPQTAVLGLHGVKERPVTVNGQIVSRPMMYLALTYDHRVVDGREAVIFLRTIKELIEDPRKMLLLE

SEQ ID NO: 64885 - protein, 481 aa, Xylella fastidiosa Dixon
MSFACVGLGGEERRGIARDAGIFWCVVRGITGIGGVSDGRLPVLAGVGTAWRCSQAVAVIGGRLVGWTLGVYLLPDEPGQWCFVSIKEIEMSIVRMTDLALSGKRVLIRQDLNVPIDQGLITSEQRIIASLPTIRVALERGAAVMVTSHLGRPKEGVWSEEDSLAPVAKRLSQLLGIEVPLRRDWVDGVQVAPGQLVLLENCRMNVGEAENDEALARKYAALCDVFVMDAFGTAHRAQASTHGVICCAAIAAGGPLLMAELDALSRGLKHPVKPLLAIVGGSKVSTKLELLSNLVNNVEQLITGGGIANTFLAAAGYSIGKSLYEADLIETAREIITVAKARGAEIPLPTDVVVAKQFLPGVTATVKTVDAIVADDLILDIGPQTARHYAALIETAATVVWNGPVGVFEFDAFSKGTEVLARAVAASSAFSIAGGGDTLAAIDKYGVADQISYISTGGGAFLEFLEGKTLPAVAALQARSG

SEQ ID NO: 64886 - protein, 491 aa, Candida albicans SC5314
MLRSFKSIPANGKLAQFVRYASTKKYDVVVIGGGPGGYVAAIKAAQLGLNTACIEKRGALGGTCLNVGCIPSKSLLNNSHLLHQIQHEAKERGISIQGEVGVDFPKLMAAKEKAVKQLTGGIEMLFKKNKVDYLKGAGSFVNEKTVKVTPIDGSEAQEVEADHIIVATGSEPTPFPGIEIDEERIVTSTGILSLKEVPERLAIIGGGIIGLEMASVYARLGSKVTVIEFQNAIGAGMDAEVAKQSQKLLAKQGLDFKLGTKVVKGERDGEVVKIEVEDVKSGKKSDLEADVLLVAIGRRPFTEGLNFEAIGLEKDNKGRLIIDDQFKTKHDHIRVIGDVTFGPMLAHKAEEEGIAAAEYIKKGHGHVNYANIPSVMYTHPEVAWVGLNEEQLKEQGIKYKVGKFPFIANSRAKTNMDTDGFVKFIADAETQRVLGVHIIGPNAGEMIAEAGLALEYGASTEDISRTCHAHPTLSEAFKEAALATFDKPINF

SEQ ID NO: 64887 - protein, 285 aa, Burkholderia vietnamiensis G4
MPAADAALPSSSDLTASPPIQLDVDRERRFGGIARLYGAPALAAFERAHVAVIGIGGVGSWTAEALARSAVGTLTLIDLDNVAESNTNRQIHALDGNFGKPKVDAMAERIALIDPACRVNRVEDFVEADNFDVLLGGGFDYVIDAIDSVRTKVALIAWCVAKGQPLVTVGGAGGQLDPTRIRIDDLALTIQDPLLSKVRAQLRKQHGFARGPKARFKVSAVYSDEPLIYPEAAACDLEDGAEPSAAAHVAGLNCAGFGSSVCVTASFGFAAAAHALRAIAARAGR

SEQ ID NO: 64888 - protein, 593 aa, Pisum sativum
METETETPNGSTPCPTSAPSAIPLRPSSCDGTMGRHLARRLVEIGVRDVFSVPGDFNLTLLDHLIAEPELNLVGCCNELNAGYAADGYGRAKGVGACVVTFTVGGLSILNAIAGAYSENLPVICIVGGPNSNDYGTNRILHHTIGLPDFSQELQCFQTITCFQAVVNNLDDAHELIDTAISTALKESKPVYISIGCNLPAIPHPTFARDPVPFFLAPRVSNQAGLEAAVEEAAAFLNKAVKPVIVGGPKLRVAKAQKAFMEFAEASGYPIAVMPSGKGLVPENHPHFIGTYWGAVSTSYCGEIVESADAYVFVGPIFNDYSSVGYSLLIKKEKSLIVQPNRVTIGNGLSLGWVFMADFLTALAKKVKTNTTAVENYRRIYVPPGIPLKREKDEPLRVNVLFKHIQALISGDTAVIAETGDSWFNCQKLRLPENCGYEFQMQYGSIGWSVGATLGYAQAATDKRVIACIGDGSFQVTAQDISTMIRCGQRSIIFLINNGGYTIEVEIHDGPYNVIKNWDYTGFVSAIHNGQGKCWTAKVRTEEDLTEAIATATGAEKDSLCFIEVFAHKDDTSKELLEWGSRVAAANSRPPNPQ

SEQ ID NO: 64889 - protein, 418 aa, Nicotiana tabacum
AADGYARARGVGACVVTFTVGGLSVLNAIAGAYSENLPLICIVGGPNSNDYGTNRILHHTIGLQDFSQEPRCFQTVTCYRAVVNNLEDAHELIDTAVSTALKESKPVYISIGCNLPGIPHPTFSREPVPFALSPRLSNMMGLEAAVEAAAEFLNKAVKPVLVGGPKMRVAKASDAFVELSDACGYAVAVMPSAKGLFPEHHSHFIGTYWGAVSTAFCAEIVESADAYLFAGPIFNDYSSVGYSLLLKKEKAIIVQPDRVTIGNGPAFGCVLMRDFLAALAKRLKHNPTAFENYHRIYVPEGHPLKCEPKEALRVNVLFQHIQNMLSGDSVVIAETGDSWFNCQKLKLPKGCGYEFQMQYGSIGWSVGATLGYAQAAPEKRVIACIGDGSFQVTAQDISTMLRCGQRTIIFLINNGGYT

SEQ ID NO: 64890 - protein, 242 aa, Enterococcus faecalis V583
MKINQKFYNYSIVVLALISIALVILDFSNVINISNPPFNVIDSIILITFTIDYIVRFFISKNKIKFFKENIFDLIAIIPFDAIFSFFRIARLFRIAKIARLAKLTRAIGVVGKLTRNTKSFLNTNGFLNVIYLSSVLIVISAMIYSYAENVPYIDAFWWALVTTTTVGYGDISPTTPLGRIAAIILMIVGIGFVGMLTSTITEYFNKSNESNNNDEKDEKIDMLIKKINDLEKAIRKLENKK

SEQ ID NO: 64891 - protein, 405 aa, Pisum sativum
PVYISIGCNLPAIPHPTFSRDPVPFSLAPKLSNQMGLEAAVEAAAEFLNKAVKPVLVGGPKLRVAKASDAFVELADASGYALAVMPSAKGMVPEHHPHFIGTYWGAVSTAFCAEIVESADAYLFAGPIFNDYSSVGYSLLLKKEKAIIVMPDRVVIANGPAFGCVLMNDFLKALAKRLKHNNVAYENYHRIFVPDGTPLKSASKEPLRVNVMFQHIQKMLSSETAVIAETGDSWFNCQKLKLPEGCGYEFQMQYGSIGWSVGATLGYAQAVPEKRVIACIGDGSFQVTAQDVSTMLRCGQKTIIFLINNGGYTIEVEIHDGPYNVIKNWNYTGLVDAIHNGEGKCWTTKVFCEEELVEAIAKATGPKKDSLCFIEVIVHKDDTSKELLEWGSRVSAANSRPPNPQ

SEQ ID NO: 64892 - protein, 733 aa, Cryptococcus neoformans var. neoformans JEC21
MPSYFFFSLIIFNCISRMASPSSMRDDHLTFTTSTSDSDTLPSTSHNPNTGTNSRIARNLSDVLFGKTTMSGTSLNTTANESTPLLTELPSHEEAEARNRVVKLNNASIILSESGELGDARSPQKRASITMAYAKRIKQRSKYYVPVTDWLPKYNWSLFSGDLVAGVSVACLLIPQAMSYASGLARLTPVAGLWSTAIPALIYGALGTCRQLSIGPEAALSLLIGQMIQEAVYGDPHSRPAHPEAEAAAIALITTLQIGVITSVLGLLRLGFLDVVLSRALLRGFITAVAVIIFIEQLVPMLGLTALLAQPTDPSQEPPTRPLSKLFFTINNIHSINVPTALLSFISLGFLIVVRVTKQKIAQTPGGKWVRYVPEILILVVGTTVLTNVLKWDDMGVEVLGKIKGGSSLPFGWPIYKKTMKYFNFTLPTAFVSSVVGVVDSIVAARENAAKYGYAVSPNRELVALGASNLVGSSIVGTGAIPVFGSITRSRLNGQIGSRTQMASIITSICMIFSIFFLLPYLYYLPKQSSPWLSTPMVGTFFLTLCFSIELGLVASVVFSLILVIQSTSQPRIKIIGRVPGTNEWVPIDEDESAQEEIPGVLVVRIRENLSFANTGQLKERLRRLELYGMDKSHPSDEPRRESAKALILHMGDVEQIDASATQILYELTKAYHERGVGVHFAHLRPGQVNAFGIAGITDIVGPSHFHRDLSNAMREVESMGYGTSIFARWDPS

SEQ ID NO: 64893 - protein, 203 aa, Gossypium raimondii
AKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLA

SEQ ID NO: 64894 - protein, 749 aa, Cryptococcus neoformans var. neoformans JEC21
MPSYFFFSLIIFNCISRMASPSSMRDDHLTFTTSTSDSDTLPSTSHNPNTGTNSRIARNLSDVLFGKTTMSGTSLNTTANESTPLLTELPSHEGRTPRRNFTASLDQVAEAEARNRVVKLNNASIILSESGELGDARSPQKRASITMAYAKRIKQRSKYYVPVTDWLPKYNWSLFSGDLVAGVSVACLLIPQAMSYASGLARLTPVAGLWSTAIPALIYGALGTCRQLSIGPEAALSLLIGQMIQEAVYGDPHSRPAHPEAEAAAIALITTLQIGVITSVLGLLRLGFLDVVLSRALLRGFITAVAVIIFIEQLVPMLGLTALLAQPTDPSQEPPTRPLSKLFFTINNIHSINVPTALLSFISLGFLIVVRVTKQKIAQTPGGKWVRYVPEILILVVGTTVLTNVLKWDDMGVEVLGKIKGGSSLPFGWPIYKKTMKYFNFTLPTAFVSSVVGVVDSIVAARENAAKYGYAVSPNRELVALGASNLVGSSIVGTGAIPVFGSITRSRLNGQIGSRTQMASIITSICMIFSIFFLLPYLYYLPKQSSPWLSTPMVGTFFLTLCFSIELGLVASVVFSLILVIQSTSQPRIKIIGRVPGTNEWVPIDEDESAQEEIPGVLVVRIRENLSFANTGQLKERLRRLELYGMDKSHPSDEPRRESAKALILHMGDVEQIDASATQILYELTKAYHERGVGVHFAHLRPGQVNAFGIAGITDIVGPSHFHRDLSNAMREVESMGYGTSIFARWDPS

SEQ ID NO: 64895 - protein, 341 aa, Arabidopsis thaliana
MKQASSSSSSRNSTSLTNRLKTIFKKAEELSILCAIEVCVIYYGPDGELRTWPKERETVKDMALRYKEARKRKKSRNLHEFLEKEKDKDKGKTNLKKNWYPNFDHYSPQQLSQLIQSLERTLSTLQERLRIVEAQKLQNTNLVHQSLTPSYLNQTQHLNPSKFSLFMYNHGDATLSQLPLSAPHSNQLINYQNHLMQHGFGQNMCSDNITNNNFEHPGVSNTQDYSPLLSVQASAVNNYGLNNHLMQQQDQLHGFDQNMCMVSEIINNNNGLQHPNLSNTVPHEFSSDFNQNPYGNAVGNISFSQDMFSSYDASSLLQTSSLPPLHNIPSSYCFPGNSRLL

SEQ ID NO: 64896 - protein, 230 aa, Gossypium hirsutum
LFTSLCHTDVYFWEAKGQTPVFPRIFGHEAGGVVESVGEGVTELKPGDHVLPVFTGECGDCRHCKSEESNMCDLLRINTDRGVMLSDGKTRFSINGKPIYHFVGTSTFSEYTVVHVGCVAKVNPAAPLDKICVLSCGISAGLGATLNVAKPTKGSTVAIFGLGAVGLAAAEGARIVGASRIIGVDLNPNRFEEAKKFGCNEFVNPKDYDKPVQEVLAEMTNGGVDRSVEC

SEQ ID NO: 64897 - protein, 420 aa, Zygosaccharomyces rouxii
MATHEEFIRTQVFGTVFEITNRYTDLNPVGMGAFGLVCSATDTLVGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKDHVHQFSIITDLLGSPPRDVINTICSENTLKFVTSLPHRDPVPFQERFKTVEPDAVDLLRRMLVFVPKKRITAADALVHPYLAPYHDPTDEPTAEAQFDWDFNDADLPVDTWRVMMYSEILDFHKIGGGDGQIDTNAAFDDQVAAAHAAAMAQHHHQTQQQSSGKHTNPTTSSSAATITVTVPIAITMPSLIMVIKRFTT

SEQ ID NO: 64898 - protein, 389 aa, Nocardia farcinica IFM 10152
MRALCWNGVNDLAVETVEDPRLVNPHDVIVRVRLTTTCGSDLHFIDGYLPGMRAGDVFGHEFMGEIVEVGREVRDRKVGDRVVVPSFIGCGTCFYCTRDMYSLCDTTNPNAELQQPVFGYPTGGIYGYTHPFGGYQGSHAEYVRVPFGDVNSFVVPEGITDEQALFVSDAVPTGLMGADFCDIAPGDTVAVWGSGGVGLMAGHTARLLGAGRVVVIDRIPERLALARKHFDAETIDYTAVDSVQEALREMTGGRGPDACIDAVGMEGHGTGLQQIYDRAKQLLRLETDRATPLREAILACRKGGVVAVLGIYGLTDKFPMGVVTNKGLTIRTAQQHGQRYVPRMFDHILQGDLDPSYLVTHDLSLEDGPRGYEVFKNKDEGCVRAVFRP

SEQ ID NO: 64899 - protein, 734 aa, Zea mays
MEAAPMRKASSQASLADPDDFDLTRLLNHKPRINVDRQRSFDDRSLGEISLAGAGTASRGGWGYGGGGMESYESMYSPGGGLRSYCGTPASSTRLSFEPHPLIGEAWDALRRSMVSFRGQPLGTIAAVDHSSGEVLNYDQVFVRDFVPSALAFLMNGEPEIVRNFLLKTLLLQGWEKRIDRFKLGEGAMPASFKVLKDPKRGVDKLVADFGESAIGRVAPVDSGFWWIIILRAYTKSTGDMTLAETPMCQKGIRLIMNQCLAEGFDTFPTLLCADGCCMIDRRMGVYGYPIEIQALFFMALRCALLMLKPDAEGKEIMERIVTRLTALSYHMRSYFWLDFQQLNDIYRFKTEEYSHTAVNKFNVNPESIPDWLFDFMPTRGGYFVGNVSPARMDFRWFALGNCVAILASLATPDQAAAIMDLIEERWEDLVGEMPVKICYPAIEGHEWQIVTGCDPKNTRWSYHNGGSWPVLLWLLTAACIKTGRLKIARRAIDLAEARLARDGWPEYYDGKLGRYIGKQARKLQTWSIAGYLVAKMMVEDPSHLGMISLEEEKPTKPVLRRSASWTGHFATPLTGLTEGQRRLRRSDCCATRQSEADKQPGPASGTIGNSAPPDPGLGLGLNPGRRRTPLRPTQGSDSGSAPEDDELRFARPQGSDSALASADGLRLARPRGSDPTSASEDRLDLDLGGASTSPNLGHGPTTSTGGAIIALPQADSGYEEQDRRPIWLAPPDK

SEQ ID NO: 64900 - protein, 407 aa, Zygosaccharomyces rouxii
MATHEEFIRTQVFGTVFEITNRYTDLNPVGMGAFGLVCSATDTLAGQPVAIKKIMKPFSTAVLAKRTYRELKLLKHLRHENLICLQDIFLSPLEDIYFVTELQGTDLHRLLQTRPLEKQFVQYFLYQILRGLKYVHSAGVIHRDLKPSNILINENCDLKICDFGLARIQDPQMTGYVSTRYYRAPEIMLTWQKYDVEVDIWSAGCIFSEMIEGKPLFPGKVHVHQFSIITDLLGSPPRDVIITICSEDTLKFVTSLPHRDPVPFQERFKAVEPDAVDLLGRMLVFDPKKRITAADALVHPYLAPYHDPTDEPIAEAQFDWDFNDADLPVDTWRVMMYSEILDFHKIGGSDGQIDTNAAFDDQVAAATAGPMLPLWLNSNININNSHPVNIQVQLLRHQQPRITVVYQ

SEQ ID NO: 64901 - protein, 230 aa, Gossypium hirsutum
LFTSLCHTDVYFWEAKGQTPVFPRIFGHEAGGVVESLGEGVTDLKPGDHVLPVFTGECGDCRHCKSEESNMCDLLRINTDRGVMLSDGKTRFSINGKPIYHFVGTSTFSEYTVVHVGCVAKVNPAAPLDKIFVLSCGISTGLGAILNVAKPTKGSTVAIFGLGAVGLAAAEGARIAGASRIIGVDLNPNRFEEAKKFGCNEFVNPKDYDKPVQEVLAEMTNGGVDRSVEC

SEQ ID NO: 64902 - protein, 546 aa, Rhodococcus sp. RHA1
MTTVQEPSAAESASTPDIHTTAGKLADLRNRQAEAQHPSGEAAVEKVHAKGKLTARERITALLDEGSFVELDALARHRSVNFGLADNRPVGDGVVTGYGTVDGRDVCVFSQDATVFGGSLGEIYGEKIVKVMDLALKTGRPLIGINEGAGARIQEGVVSLGLYGEIFHRNVQASGVIPQISLIMGPAAGGHVYSPALTDFVVMVDQTSQMFVTGPDVIKTVTGEDVTMEDLGGAHTHMVKSGVAHYVASGEQDALDYVRDLLSYLPSNNQAAAPRMLPTDPITGSIDDSLTAEDLELDTLIPDSANQPYDMHEVIRRILDDDEFLEVQAERAGNIVVGFGRVDGRSVGIVANQPTVFAGCLDIDASEKAARFVRTCDAFNVPIITLVDVPGFLPGTDQEYNGIIRRGAKLLYAYGEATVGKITVITRKAYGGAYDVMGSKHMGADVNLAWPTAQIAVMGASGAVGFVYRKRLLEAAKNGDDVDALRLQLQQEYEDTLVNPYVAAERGYVDAVIPPSHTRGQIVAALRLLERKMVTLPPKKHGNIPL

SEQ ID NO: 64903 - protein, 253 aa, Pseudomonas fluorescens Pf-5
MSMTFSGQVALVTGAANGIGRATAQAFAAQGLKVVVADLDTAGGEGTVALIREAGGEALFVPCNVTLEADVQSLMARTIEAYGRLDYAFNNAGIEIEKGRLAEGSMDEFDAIMGVNVKGVWLCMKYQLPLLLAQGGGAIVNTASVAGLGAAPKMSIYAASKHAVIGLTKSAAIEYAKKKIRVNAVCPAVIDTDMFRRAYEADPKKAEFAAAMHPVGRIGKVEEIASAVLYLCSDGAAFTTGHALAVDGGATAI

SEQ ID NO: 64904 - protein, 318 aa, Chlamydomonas reinhardtii
MAVTTVNRAKLASKRTTAEQAIAGIDVKGKVAVVTGGSSGIGVETCRTLALHGAKVYLGARSAEAGQAVIDSIRWAVGAGSGLQLQLLVLDLSELASVRRAAEQVLAAEAAGEAAAGVQLLILNAGVMACPLMHTQDGLELQTGVNHVAHFYLTQLLLPAIKPGADGAPARVVSVASSAHQFAQGMPMDDLNWEKRSVAGKYGPWQSYGQSKACNVLFGRELARRMSAEGRPVLAFSLHPGIIMTALQRHQSGLVKAAIRWMTAPWQKTTAQGAATSIYAATAPELTSAQSGSYLTDCAISPSSKLTSDMAVAAGLWE

SEQ ID NO: 64905 - protein, 614 aa, Nicotiana tabacum
MDGSVAKGTSCIQDSQSSSVIANTDATLGRHLARRLVEIGIQDVFSVPGDFNLTLLDHLIAEPRLKNIGCCNELNAGYAADGYARARGVGACVVTFTVGGLSVLNAIAGAYSENLPVICIVGGPNTNDYGTNRILHHTIGLPDFSQELRCFQTVTCYQAVVNNLDDAHEQIDRAISTALKESKPVYISISCNLPAIPHPTFSRDPIPFSLSPRLSNKRGLEAAVDAAVTFLSKAVKPVMIGGPKLRVAKACDAFVELADSSGYAMAVMLQPKGLVAEQHPHFIGTYWGAVGTSYCAEIVESADAYLFAGPIFNDYSSVGYSLLIKKEKSIIVQPDRVVIGNGPAFGCVLMKDFLSELAKKIKKNETAYENYRRIFVPEGTPLKSEPNEPLRVNVLFQHIQKMLSDETAVIAETGDSWFNCQKLKLPEGCGYVTNNSLSAWYPFYLQTLEEKSSCCRYEFQMQYGSIGWSVGATLGYAQSVPKKRVISCIGDGSFQVTAQDVSTMIRCEQKNIIFLINNGGYTIEVEIHDGPYNVIKNWNYTGLVDAIHNGEGNCWTMKVRTEEELTEAIATATGEKKDCLCFIEVIVHKDDTSKELLEWGSRVCSANGRPPNPQ

SEQ ID NO: 64906 - protein, 577 aa, Aspergillus parasiticus
MEGETLPLAQYLFKRLLQLGVDSIFGVPGDYNLTLLDHVVPSGLKWVGNCNELNAGYAADGYSRIKDIGAVVTTFGVGELSAINAIAGAYAEKAPVVHIVGTPMRASQESRALIHHTFNDGDYQRFDAIQEHVTVAQVSLSDHRTAPSEIDRILLQCLLHSRPVRIAIPVDMVPVLVPVAGLSSKIQIPPAVRQPQAEEAALNAVLKRIYSSKKPMILVDGETRSFGMLQRVNHFIQTIGWPTFTSGFGKGLVDETLPNVYGVCTLHQKAFVDSCDLVLVFGPHFSNTNSYNYFLKPADEKSVLFSPNSIQVNKDVFRDLPVGYFIEQLTQQLDISRIPTHKHDLVHPSLRTLPEVSPTDLVTQTGGFWKRFSPFLRTGDIILGETGTPGYGVNDFILPPQTRLFKPATWLSIGYMLPAALGASHAQRDLVASDQYHSLSNPRTILFIGDGSFQMTVQELSTIIHQKLNVIIFLINNDGYTIERCIHGRNQAYNDVAPWRYLKAAEFFGADQDGEYKASTWEVRTWADLDRVLNDSQLADGKGLRMVEVFMERLDAPDVLMGLLNNQVLRENAQSRL

SEQ ID NO: 64907 - protein, 357 aa, Geobacter metallireducens GS-15
MSTAPHRWTMTAVGEPMVKADFDAAPPSDNEVVVEVAGCGVCHTDLGFYYDGVRVNHGLPLTLGHEISGRVVATGKGAEAWQGKAVLIPAVIPCGVCDLCLSGHGTICRTQQMPGNDIQGGFATHIKVPARGLCPVDEKKLAAAGFELADISVVADAVTTPYQAVVQAEVQKGDLAIVIGIGGVGSYAVQIANAMGATVVAIDVDQAKLDNMAKYGAGLTINSRQVQGKDLKKAIQTFVKEKGLPQTCWKIFECSGTVPGQDTAFGLLTFGATLSVVGFTMDKIELRLSNLMAFHARALGNWGCLTELYPAALDLVLEKKIALAPFIEKHPLEKINEIFEAAHAHKLTRRAILVPGK

SEQ ID NO: 64908 - protein, 265 aa, Magnaporthe grisea 70-15
MADAAPRGGGFASRGGDRGGDRGRGDRGRGRGRGRGRRGGKSDEKEWQPVTKLGRLVKAGKIKSMEEIYLHSLPIKEYQIVDFFLPKLKDEVMKIKPVQKQTRAGQRTRFKAIVIIGDSEGHVGLGIKTSKEVATAIRAAIIIAKLSVIPVRRGYWGTNLGTPHSLPVKESGKCGSVTVRLIPAPRGTALVASPAVKRLLQLAGIEDAYTSSSGSTKTLENTLKATFSAVSNTYGFLTPNLWKETKLIRSPLEEFADTLRDGKRY

SEQ ID NO: 64909 - protein, 370 aa, uncultured archaeon GZfos1D1
MDISQTIFEEYADDLGPEKIIHIYEPVAKLRAIVVIDNVAAGPVIGGVRMAPNLTTTEIMRLARAMTLKNAAAGLPHGGGKAGILADPKTEGKEHLIRVFARTIEHLHDYIPGPDMCTDESCMAYIFDEIKRAVGLPRVLGGIPLDEIGATGFGVAECAEVAKEYIDLDLNGARLVVEGFGNVGKNTARFLEEKGASLVAASDTSGTVYNMDGIDVSGLIRVKEEKGSVIYHEDAEKLKTGDLLKIPGDIFVPAARPDVIDERNVSTLDTKLVIQGANIAITLGAEKALHERGVLSVPDFIANAGGVIAAAVEYRHGDEKEAFSEIKSKIRANTKKILDKTYSEGLYPRDAAEMIAKERVLSAMSYRRCI

SEQ ID NO: 64910 - protein, 497 aa, Marinobacter sp. ELB17
MKNVPLYLAGEFVQSQTDSWIDVTNPATNEVIARAPSTTPAEMRKAIDFAAETFKTWKEVPVSERARVMLRYQALLKEHHNEIAEILAQETGKTFDDAKGDVWRGIEVVEHAANVASMMMGETVENVAREVDTHSWIQPLGVCTGITPFNFPAMIPLWMFPMAIACGNTFILKPSEQDPLTPTRLAELFEQAGAPKGVLQVVHGGKEQVDTLLNDPAVKAISFVGSVPVGRYIYETGTRNMKRVQSFAGAKNHMVIMPDADKQQVLNALVGASVGAAGQRCMAISVAVFVGEARQWIPQLKEAMTKVRPGAWNDSGASYGPVISPKAKERVEALIATGEAQGAQLLLDGRNCTVDGLPNGNWVGPTLFAGVTSEMDIYNEEIFGPVLCCSEVDSLGEAIEFINRSPYGNGTSIFTGSGGAARRFQHEIEVGQVGVNIPIPVPLPFFSFTGWKGSFYGDQHAYGKQAVRFYTETKTVTSRWFSSEATSTEANFSIQLR

SEQ ID NO: 64911 - protein, 312 aa, Pseudomonas putida GB-1
MIGAPAVRIVKYAMTLQYPTIADCVGNTPLVRLQRIAGETSNTLLLKLEGNNPAGSVKDRPALSMITRAELRGQIKPGDTLIEATSGNTGIALAMAAAIKGYKMILIMPDNSTAERKAAMTAYGAELILVTKEEGMEGARDLAEKLQAEGRGLVLDQFANGDNPIAHYNSTGPEIWQQTQGSITHFVSSMGTTGTIMGCSQYLKEQNPAVQIIGLQPMEGSAIPGIRRWPEEYLPKIFDATRVDRVVDMSQQEAEDTTRRLAREEGIFCGVSSGGAVAAMLRLSREVENAVMVAIICDRGDRYLSTGLFDPS

SEQ ID NO: 64912 - protein, 354 aa, Thermobifida fusca YX
MSMARAWRGIVEEYRDRLPVTANTPVVTLLEGGTPLVPATRVSELTGCEVYLKVEGLNPTGSFKDRGMTMAISKAAEEGAKAVICASTGNTSASAAAYAVRAGMTCAVLVPRGKIAMGKLAQALVHGARLLQVDGNFDDCLELARQLSTDYPVALVNSVNPFRLQGQKTASFEIVDALGDAPDVHCLPVGNAGNITAYWMGYQEYHSDGLATRLPRMFGFQASGASPIVDGAPVTQPRTIATAIRIGNPASWRFAEKARDESGGRIDAVTDRQILAAYRLLAGQEGVFVELASAASVAGLLQAVEAGQIERGSRVVCTVTGNGLKDPDWALAGASSATTIPVDAQAAAAALGLA

SEQ ID NO: 64913 - protein, 542 aa, Mycosphaerella graminicola
MGLLQEVLAQFDAQFGQTSLWKLVGLGFLAFSTLAILLNVLSQLLFRGKSSDPPLVFHWVPFIGSTITYGIDPYKFFFSCREKYGDVFTFILLGKKTTVCLGTKGNDFILNGKLKDVNAEEIYSPLTTPVFGKDVVYDCPNSKLMEQKKFVKYGLTTSALQSYVTLIAAETRQFFDRNNPHKKFASTNGTIDLPPALAELTIYTASRSLQGKEVREGFDSSFADLYHYLDMGFTPINFMLPWAPLPQNRRRDYAQKKMSETYMSIIQKRRESKTGEHEEDMIHNLMQCKYKDGNAIPDKEIAHMMIALLMAGQHSSSATESWITLRLASRPDIQDELLQEQKDMLGVNADGSIKELTYANLSKLTLLNQVVKETLRIHAPVHSILRKVKSPMPIEGTAYVIPTTHTLLAAPGTTSRMDEHFPDCLHWEPHRWDESPSEKYKHLSPTTALGSIAEEKEDYGLVSKGAASPYLPFGAGRHRCIGEQFAYVQLQTITATMVRDFKFYNVDGSDKVVGTDYSSLFSRPLSPAVVKWERREEKEEKN

SEQ ID NO: 64914 - protein, 542 aa, Manihot esculenta
MAMNVSTTIGLLNATSFASSSSINTVKILFVTLFISIVSTIVKLQKSAANKEGSKKLPLPPGPTPWPLIGNIPEMIRYRPTFRWIHQLMKDMNTDICLIRFGRTNFVPISCPVLAREILKKNDAIFSNRPKTLSAKSMSGGYLTTIVVPYNDQWKKMRKILTSEIISPARHKWLHDKRAEEADNLVFYIHNQFKANKNVNLRTATRHYGGNVIRKMVFSKRYFGKGMPDGGPGPEEIEHIDAVFTALKYLYGFCISDFLPFLLGLDLDGQEKFVLDANKTIRDYQNPLIDERIQQWKSGERKEMEDLLDVFITLKDSDGNPLLTPDEIKNQIAEIMIATVDNPSNAIEWAMGEMLNQPEILKKATEELDRVVGKDRLVQESDIPNLDYVKACAREAFRLHPVAHFNVPHVAMEDTVIGDYFIPKGSWAVLSRYGLGRNPKTWSDPLKYDPERHMNEGEVVLTEHELRFVTFSTGRRGCVASLLGSCMTTMLLARMLQCFTWTPPANVSKIDLAETLDELTPATPISAFAKPRLAPHLYPTSP

SEQ ID NO: 64915 - protein, 467 aa, Lentisphaera araneosa HTCC2155
MSKHTVEKIGGTSMSRFGEIVDNVILGNRKENEIYNRVFVVSAYGGITNALLEHKKTGEPGVYQYFKDGDQRWEEALDKVTEQMKAVNEEMVAAGLNLEEANSYVDQRVEGIRNCLRDICRICSYGHFHLDEFLMAARELLSSVGEAHSAWNSVNILNNRGINALLIDLTGWKDNEAKPFAEKIESEFAGVDYANNICVATGYTKCKEGLMHTFDRGYSEITFSKIACVTEAREGVIHKEFHLSSGDPNLMGLEKVEIIGRTNFDVADQLADLGMEAIHPKASKEMENLSIPIRVTNAFEPEHPGTLIDTSFRSEFPRVEMVTGRDDILAIEVHDPDMVGESGYDFRIMEVFAKHKVSYTAKNTNANTITHFLPEKDVKEQFMLDLKANFQGAEVSMKEVAIVSAIGSNMNKPGFLSRSAEDLAQNQINILAVNQCMRQVNMQFVVERHDYEKALKSLHKGLVEEEK

SEQ ID NO: 64916 - protein, 339 aa, Triticum aestivum
  misc_feature (233)..(233): Xaa can be any naturally occurring amino acid
  misc_feature (277)..(277): Xaa can be any naturally occurring amino acid
  misc_feature (289)..(289): Xaa can be any naturally occurring amino acid
QHENLANAGKPTERRSAETHGSEQVKGREPLRRGTVSPRLPVPEHIRRPPYDGTDRLPDVNPDRQMHDRESIVHMRAACELAARVLQYAGTMVKPSVTTDEIDRAVHQMIIDAGAYPSPLGYGGFPKSVCTSVNECICHGIPDSRALRDGDIINIDVTVYLNGYHGDTSRTYLCGEVDEPTKQLVKVTEECMLRGISACKHGVSFKAIGERISEHVNKYGYSIDPFIGHGVGXIFHSEPIIWHTYDYEPGFMVAGQTFTIEPTLSMGSTRCEVWDDXGWTAIPVDGSLXAQFEHTVLVPVNGAEIPHKVLREGERWCVSLPFERMFTSRVQPIDEGPSH

SEQ ID NO: 64917 - protein, 392 aa, Prochlorococcus marinus str. MIT 9215
MKAMILAAGKGTRVQPITHVIPKPMIPILQKPVMEFLLELLREHNFKEIMVNVSHLAEEIENYFRDGQRFGVEIAYSFEGRIEDGELIGDALGSAGGLKKIQDFQKFFDETFVVLCGDALVDLDLTQAVKKHKQKGAIASLITKRVIKDQVSSYGVVVSDENGRIKAFQEKPSVDQALSDSINTGIYLFEPEIFNYIPSAEKFDIGADLFPKLVEMDLPFFALPMDFEWVDIGKVPDYWSAIRNVLLGKVRQVQIPGKEIKPGVFTGLNVAANWEKVNITGPVYIGGMTRIEDGATIIGPTMIGPSCCICEGAIIDNSIIFDYSKIGKGVRLVDKLVFGKYCVGKNGDHFDLQDASLDWLIADSRRSDLTEPSPQQKAMAELLGTDLINIPD

SEQ ID NO: 64918 - protein, 414 aa, Lentisphaera araneosa HTCC2155
MTTPFISIIGLNHKSAPVELRERLSFGADKLKEILTYCCDSLSEFVLISTCNRTEFIFNGEQSVLEKYLMEVGSLKESDLQDFFYNYNDYEALEHLFKVASGLDSLVVGEVQILGQVKSAFELSFEQNYATANFAHIYQQMLKCARQVRRDTEIGKGSVSVASIAVQLSKNIFDHLSGKKVLLIGAGEMCELAGVHFFEAGVDQIMVANRSLDNAEKLASKFKGKAFALDQLEDAVWNADIILSSTGSPSYVLEKDLIKGAMSKRREPMFLIDIAVPRDIDPKINNLTDVFVYNIDDLNKIAEENRKKRGRAFGRAEEIVEAKLREFREEQALSSVGPLINSFRERLHGIKDDEQKKLFKKLNHLSDSDKEAINKSLHQIVNKLLHDPIITLRDEVKRDDSSRLVKVFKDLFNL

SEQ ID NO: 64919 - protein, 122 aa, Glycine max
  misc_feature (82)..(82): Xaa can be any naturally occurring amino acid
  misc_feature (119)..(119): Xaa can be any naturally occurring amino acid
MTKQHANWSPYDNNGGTCVAIAGSDYCVIAADTRMSTGYSILTRDYSKIHKLADKAVLSSSGFQADVKALQKVLKSRHLVYXHQHNKQMSCPAMAQLLSNTLYFKRFFPYYAFNVLGGXDEQ

SEQ ID NO: 64920 - protein, 375 aa, Mycobacterium avium subsp. paratuberculosis K-10
MKTKGALIWEFNQPWSIEEIEIGDPQAHEVKIQMEAAGMCHSDHHLVTGGIPMAGFPVLGGHEGAGIVTEVGPGVEDIAPGDHVVLSFIPSCGSCPTCQAGMRNLCDLGAGLLGGEAVSDGTFRIQARGQNVYPMTLLGTFSPYMVVHRSSVVKIDPSIPFEVAALVGCGVTTGYGSAVRTADIRPGQDVAIVGVGGVGMAALQGAVNAGARYIFAIDPVEWKRDQALKFGATHVYPDIMAAMAGMAEVTYGLMAHKVVVTVGELQGADVDNYLNITQKGGTCVLTAIGSLLDTNVTLNLAMLTLMQKNLQGTIFGGGNPQYDIPQLLSMYKAGKLNLDDMITRQYRLEQINDGYQDMLDGKNIRGVIRYTDADR

SEQ ID NO: 64921 - protein, 252 aa, Listeria monocytogenes str. 4b F2365
MITLKSRREIDEMKAAGKILADTHKELKKIIKPGITSWDLEVFTEEFLRKNGATPEQKGFEGYEYAICASINDEICHGFPRKQKLNQGDIITVDMVVNYRGALADSAWTYAVGEVPDDVKHLMDVTHKALYLGIEQAQVGARVGDIGHAIQTYVESENLAVVREFIGHGVGPTLHEKPDIPHYGTAGKGPRLKEGMVITVEPMVNMGAWKAKMDDNGWTARTVDGSLSAQYEHTFAITKDGPEILTYQGEND

SEQ ID NO: 64922 - protein, 307 aa, Geobacillus kaustophilus HTA426
MKLYDSILDLIGGTPIVKLQRLPDPDGADVYMKLESFNPGGSVKDRPAWEMIRRAEAEGKIAPGKSTIIEPTSGNTGIGLAMVCAARGYRCIITMPDNATVERVKILKAYGAEVYLTPAEKRMQGAIDEANRLAGEIPDSFIPMQFENPANPDAHRHTTAVEIYEAFDGRLDAFVLTAGTGGTVTGTGEELKKRIPNLRIYVVEPYGSPVLSGGKPGPHKIPGTGPGFIPKILNRSIYDDIFLIKDEDAQQMARELAAKEGILVGASAAASAYYAIKVAKQLPKGARVLCMAPDSGERYLSSDLFAD

SEQ ID NO: 64923 - protein, 451 aa, Mycobacterium avium subsp. paratuberculosis K-10
MTTSTVVPRISGGEEEHGHLEEFRTDPIGLMQRVRDECGDVGWFQLVDKHVILLSGAQANEFFFRSADEDLDQAEAYPFMTPIFGKGVVFDASPERRKEMLHNSALRGEQMKGHASTIEGEVKKMIADWGDEGEIELLDFFAELTIYTSTACLIGLKFREQLDHRFAEYYHDLERGTDPLCYVDPYLPIESFKRRDEARVKLVALVQEIMDQRLANPPKDKADRDMLDVLVSIKDEDGKPRFSADEITGMFISLMFAGHHTSSGTSAWTLIELIRHPDVYAEVLAELEELYADGQEVSFHALRSIPKLDNVVKETLRLHPPLIILMRVAKGEFEVEGFPIHEGDYVAASPAISNRIPEDFPDPDAFKPDRYNKPEQADIVNRWTWIPFGAGRHRCVGAAFAQMQIKAIFSVLLREYDFEMAQPADSYRNDHSKMVVQLARPAKVRYRKRNA

SEQ ID NO: 64924 - protein, 288 aa, Vibrio cholerae O1 biovar eltor str. N16961
MWPAIIQQLSEQLGKDFHLVEKEKVHGGDINECFMVSDGIDRYFVKTNQREYLTKFTAEVENLRVMRESNTVQVPEYILHGTSKTHAYLVLNYLATKPLDDAERSYEFGVQLANLHRWGEQKEFGFDIDNYIGATVQPNPWHKKWALFFAEQRIGWQLQLMQEKGVNLTNINEFVEMVKTRLANHSPRPSLLHGDLWFGNVANIVNGPLCFDPACYWGDRECDIALAEWFGGFQPEFFQGYESVWPLDWGYEERKDIYNLYHVLNHYNQFGGHYLDEAQKLIEKILSY

SEQ ID NO: 64925 - protein, 490 aa, Petunia x hybrida
MGFESEKNNSVLSKLATNEEHGENSPYFDGWKAYDNDPFHPLKNPNGVIQMGLAENQLCFDLIEDWIKRNPKASICTTEGIKSFRGIANFQDYHGLPEFRRAIAKFMEKTRGGRVSFDPDRVVMAGGATGANETIIFCLADAGDAFLVPSPYYPAFNRDLRWRTGVQLIPIPCESSNSFKITTKAMKEAYENAIKANIRVKGLILTNPSNPLGTTLDRDTLKSLLNFTNERNIHLVCDEIYAATVFNTPQFVSIAEILNDEKSNFNKDLVHIVYSLSKDMGLPGFRIGIVYSYNDAVVNCARKMSSFGLVSTQTQHLLAKMLSDEEFVANFLCESSMRLGKRHKHFTNGLEQVGIKCLKSNSGLFCWMDLRHLLENSTLDSEMSLWRVIINDVRLNVSPGSSFDCQEPGWFRVCFANMDDETVEVALARIRRFVGVGVKENGEETKPVKNKEQWKKSNLRVSFSKRMYDESVLSPLSSPIPHSPLVRART

SEQ ID NO: 64926 - protein, 405 aa, Geobacillus kaustophilus HTA426
MEHLRERALLVHRQARGKLSVEVKVPVVNANDLSLIYSPGVAEPCKEIYVDQDEMYNYTVKGNFVAVVSNGTAVLGLGNIGARAALPVMEGKAALFKAFAGIDAVPLCLDTEDPEQIIQTVKLLEPAFGGINLEDIAAPACFVIEERLRQEMAIPVFHDDQHGTAIVVAAGLTNALKVVGKQLADCRVVINGAGAAGVAIAKLLLSIGVGELIVCDTKGAIYEGRSHGMNAIKEEIARQTNHRRISGTLADVIQGADVFIGVSVAGALTPAMVRTMNRGAVVFALANPVPEIMPDEAKAAGAAVVATGRSDLPNQVNNVLAFPGIFRGALDVRATQINEAMKIAAAEAIAGLIQPEELTEEYVIPNPFDRRVVEAVASAVARAAMETGVARVKEKVEEQNRVREG

SEQ ID NO: 64927 - protein, 102 aa, Triticum aestivum
SRSRTSHAMAASRVENLGLGQGLAMGILNLSIVIPQIIVSLGGGPWDQLFGGGNAPSFWVAAAASFVGGLVAILGLPRARLGPKKKTTQLDDDNIQTPPCLV

SEQ ID NO: 64928 - protein, 354 aa, Oryza sativa Indica Group
MSASAAPTHIRFSSAALPSAAALRRPRRRCATPVRCSLAAAPGLRAPPELIDSILSKVKGTDRGVLLPKDGHQEVADVALQLAKYCIDDPVKSPLIFGEWEVVYCSVPTSPGGLYRTPLGRLIFKTDEMAQVVQAPDVVKNKVSFSVFGFDGAVSLKGKLNVLDGKWIQVIFEPPEVKTNEHGYGFLVNPAMKLLLLRAMPMRVLTVGKKRSRGAQLIVEEYKEKLGYYCDIEDTLIKSNPKLTSDVKVQVEAEDMAMMLQLKPEDFVVVLDENGKDVTSEQVADLVGDAGNTGSSRLTFCIGGPYGFGLQVRERADATIRLSSMVLNHQVALIVLMEQLYRAWTIIKGQKYHH

SEQ ID NO: 64929 - protein, 534 aa, Symbiotaphrina kochii
MAAAVDASFTSPAANAQYPLTSDDGSIGLIASRLIQGLSFWNVVGTIFLMMVIYDQLSYIRNKGSIAGPLMKIPFMGPFLQSMNPKFEGYKAKWDSGALSCVSVFHKFVVIASTRDMARKIFNSPTFVRPCVVDVATKLLRPTNWVFLDGKAHVDYRKGLNGLFTRKALELYLPGQEEVYDKYLAKFVAITKTNNGKPIPFMPEFRELNCAISCRTFVGHYISDEAVKKIADDYYKITEALELVNFPIIIPFTRTWYGKKAADMVLEEFAKCAAKGKVRMNAGGSITCIMDGWIKSMIESKIYQERIAKGESVDPSEKPAMIIREFTDYEISQTIFTFLFASQDASSSATTWLFQLLADRPDVLARVREENLAVRDGDRDKRVTMDILDNMTYTRAVVKETLRYRPPVLMVPYVAKKDFPISDSYTVPKGSMVIPTTYPALHDPEAYPNPETFNPDRWITGDAESQTKNWLVFGTGPHYCLGQIYAVNNLMALIGKASLHLDWDHTVTPKSEDIKVFATIFPQDDCLLAFQNRP

SEQ ID NO: 64930 - protein, 535 aa, Symbiotaphrina buchneri
MAAAMNASFTSPAANAQYSASAHDGLAGLAMAQVLEGLTVWNAIGTVLIMLVLYDQLSYIRNKGRIAGPFFKIPFMGPFLQSVNPKFEEYKAKWDSGALSCVSVFHKFVVIASDRDMARKVLNSPAYVKPCVVDVAHKLLRPTNWVFLDGKAHVDYRKGLNGLFTRKALELYLPGQEEVYDKYFARFLEVSQKENKGNPTPFMAEFREINCAISCRTFVGHYLSDAAVKKIADDYYKITAALELVNFPVIIPYTKTWYGKKAADMVLDEFAKCAAKSKIRMNAGGEITCIMDGWIKSMIDCRKYQERIAKGETVDASEKPAMMLREFTDFEISQTIFTFLFASQDASSSATTWLFQLLADRPDVLAKVREENLAVREGDRNKRLTMDILDKMNYTRAVVKETLRYRPPVLMVPYLVKKTFPITDSYAVPKGSMIIPTTYPALHDPEAYPSPDTFDPERWITGDAENQTKNWLVFGTGPHYCLGQTYAQLNLMAMIGKASLHLDWTHTVTPDSEKIKVFATIFPQDDCLLTFSPRA

SEQ ID NO: 64931 - protein, 309 aa, uncultured marine proteobacterium ANT32C12
MLELPMTGKITKNIKKNKSMNKIGFIGLGVMGYPMAGHLSKEFSNICIFNRSQEKVTKWLNQYSGTAFDTPEELSSQCNVIALCVGRDEDVREMMSGKKGILNSVNPGTIIIDHTTTSATLSKEMNELALQKDVIFLDAPISGGQAGAESGQLSVMVGGDKASYESVKPILDNYSKFTKYMGPSGSGQLTKMVNQICIAGLVQALAEGVNFSEKVGLNTSDVMEVITKGAAQSWQMENRWETMLKDEYDHGFAVDWMRKDLDIVSEQAGQVGANIEITEMVNKFYKDIQDLDGGRWDTSSLLKRIKDST

SEQ ID NO: 64932 - protein, 541 aa, Manihot esculenta
MAMNVSTTATTTASFASTSSMNNTAKILLITLFISIVSTVIKLQKRASYKKASKNFPLPPGPTPWPLIGNIPEMIRYRPTFRWIHQLMKDMNTDICLIRFGKTNVVPISCPVIAREILKKHDAVFSNRPKILCAKTMSGGYLTTIVVPYNDQWKKMRKVLTSEIISPARHKWLHDKRAEEADQLVFYINNQYKSNKNVNVRIAARHYGGNVIRKMMFSKRYFGKGMPDGGPGPEEIMHVDAIFTALKYLYGFCISDYLPFLEGLDLDGQEKIVLNANKTIRDLQNPLIEERIQQWRSGERKEMEDLLDVFITLQDSDGKPLLNPDEIKNQIAEIMIATIDNPANAVEWAMGELINQPELLAKATEELDRVVGKDRLVQESDIPNLNYVKACAREAFRLHPVAYFNVPHVAMEDAVIGDYFIPKGSWAILSRYGLGRNPKTWPDPLKYDPERHLNEGEVVLTEHDLRFVTFSTGRRGCVAALLGTTMITMMLARMLQCFTWTPPPNVTRIDLSENIDELTPATPITGFAKPRLAPHLYPTSP

SEQ ID NO: 64933 - protein, 358 aa, uncultured archaeon GZfos1D1
MRCPKCNSALDAEYDYKSIQRTIRKDEFMRECPGHWKYWPFMPVGDLSRIVTMGEGGTPLVDLTRLMPQAKKFLVKYEAANPTGSFKDRGSSLEITKAVTWGRKRAVIASTGNMGSSVAAFAAFAKIRCKIIIPDFVNTAKIVQMKAYGAEVELTSGDYADAMNIAENQVRSDPESFLAGDYPWRCEGTKTVGFEIADQMYWRVPDAVIAPIGNGTLIWSVWKAFKELMITGITDALPLMVGVQAEKCDPVVRAWEERTDTIVPIENPRTVASAIACGAPIDGLLALKAIRESGGICIRVTDEEILRARDELGSNGVFVEPSGAVSFAGARKTGDLLDQKTVVCIATGHGLKDMYGIE

SEQ ID NO: 64934 - protein, 310 aa, Triticum aestivum
  misc_feature (119)..(119): Xaa can be any naturally occurring amino acid
  misc_feature (146)..(146): Xaa can be any naturally occurring amino acid
  misc_feature (296)..(296): Xaa can be any naturally occurring amino acid
MALTRIGLAGLAVMGQNLALNIAEKGFPISVYNRTTSKVDETVQRAKLEGNLPLYGFHDPASFVNSIQKPRVVIMLVKAGAPVDQTIATLAAHLEQGDCIVDGGNEWYENTERREKAMXEERGLLYLGMGVSGGEEGARHGPSMMXPGGSLEAYQYIEDILLKVSAQVPDSGPCVTYIGKGGSGNFVKMVHNGIEYGDMQLIAEAYDVLKSVGKLTNGELQQVFAEWNKGELLSFLVEITADIFSIKDDQGEGYLVDKVLDKTGMKGTGKWTVQQAAELSVAAPTIEASLGSRFLXGLKDERVAASKIFR

SEQ ID NO: 64935 - protein, 418 aa, Oryza sativa Japonica Group
MDQLTSSTVFWLTTAVAFLLINTVILRALQKRKSSPAAAAAAAPPPVVQGVGLVRFVRAMARDGPLEAIREQQAKLGSVFTASAPLGLFKVTFLIGSEVSSHFYVASYSEISMGRLYEFTVPIFGPGVLYGVDLETRKEQIRFNWDILKPRSLKASVGAMAEEVEMGRSGYGRSEARTGAGTDADRESVPAGKGVARESVPGKLCELFGELDNGLHLISGLLPYLPIPAHRRRDRARQRLGEIITEVIRLRRNSSRGAAGTDENNDDMLQCLINSRYKDGCAMTDAEIAGLVVALMFAGKHTSSGVSIWTGVHLLSNPNHLAAVVAEQDRLMASCPGRTDDYHRLDYDTVQEMRSLHCCVKEALRLHPPVAAVRQAYKHFTVQTKEDKEYTIPGGHMVVSTILVNHYLPHIYKGPSCV

SEQ ID NO: 64936 - protein, 313 aa, Brucella suis 1330
MSHGEAPLKIFVFGSVNVDVSARMAALPRPGQTVNASGYGIGLGGKGANQAVAVAKLGGAIRFVGAVGHDAFGELALKQMREFGLDTGSVRVIDDVDTGMAIIQVEETGQNTIAVCAGANARWSSADIDAYGADIAKARITLLQREVPHEANLAVAKAVRAAGGTVLLDPAPVGDASQMADLIALSDIISPNETEAAEITGIEPTDLASAEAAGRKLLERGPKIVILKLGSRGALLVTADEVKHFTPFKVKVVDTVAAGDSFNGGFAVAFSQARPLHDCVRYGSAAGAIAVTRVGAGAAAPTAREVEELIGRA

SEQ ID NO: 64937 - protein, 332 aa, Brucella suis 1330
MLSKHAVSCAIPSQRTHQETTMARKIIIDTDPGQDDAVAILLALASPELDILGITAVAGNGPLARTEVNARTVCEVAKKPDTKVFAGSIRPLVRPLVTAENVHGKTGLDGYDLPAPTMPLQAQHGVDFIIETLMKEEPGTVTLCPIGPLTNIASALIREPKIAGRVKEIVLMGGGYFEGGNITPSAEFNIYVDPHAASVVFSSGIKITMLPLDVTHKVLTTEKRIAAIRNIGSHVGEVVAAWLEFFERYDEAKYGTDGAPLHDPNVIAYLIKPELYSGRACNVEIEINSELTIGETVVDWWEVTDRPKNAFFIKDVDADGFFSLLTERLATL

SEQ ID NO: 64938 - protein, 422 aa, uncultured marine gamma proteobacterium EBAC31A08
MVLKILEIFGHLIFELKPRYNIFMKEIIKEYTNYMVPFYAPADFVVKKASGSHVWDLNNKKYIDFTAGIAVTNLGHSNKDLIKILKKQSEELWHLSNLYINEPSVTLARKLCKNSFADKVFFCNSGAESIEAAVKIARKFCSSTVNKNKNEVISFSTSFHGRTMLGIALAKAKHLTDGFAPLPRGIKNHPYNDITNLEKVFSDKTAAVILELVQWQSGITKADKKFIAKIKKLAKKHKALVIIDEVQSGIGRTGTLFAYEQFNITPDILCFAKGISNGFPLGGILTSDKVSKHMSAGSHGTTFGGGPIACAIGNEVIDTISKKSFLNKVLKKEVRFINLLNKINEKHKCFEKITSAGLWVGVEVSKDSKIQIDDLIKKSHHNGLMILKANASTVRFSPSLIIENELVDEGLKIFEKSIISLL

SEQ ID NO: 64939 - protein, 388 aa, Oryza sativa
MASATLLKSSFLPKKSEWGATRQAAAPKPVTVSMVVRAGAYDDELVKTAKTIASPGRGILAMDESNATCGKRLASIGLENTEANRQAYRTLLVTAPGLGQYISGAILFEETLYQSTVDGKKIVDILTEQKIVPGIKVDKGLVPLAGSNNESWCQGRDGLASREAAYYQQGARFAKWRTVVSIPNGPSELAVKEAAWGLARYAAISQDNGLVPIVEPEILLDGEHGIDRTFEVAQKVWAETFFYMAENNVMFEGILLKPSMVTPGAECKDRATPEQVSDYTLKLLHRRIPPAVPAIMFLSGGQSEVEATQNLNAMNQGPNPWHVSFSYARALQNTCLKTWGGQPENVKAAQDRLLLRAKANSLAQLGKYTSDGEAAEAKEGMFVKNYVY

SEQ ID NO: 64940 - protein, 429 aa, Triticum aestivum
  misc_feature (302)..(302): Xaa can be any naturally occurring amino acid
MLPQQSQAAAMMQQAAAMQSMYAMPPPPHHHHLLGAAPPQQIEPILTGNLPPGFDTSTCRSVYVGNIHVQVTEALLREVFQSAGSVDGCKLIRKEKSSYGFVDYYERGSAALAILTLNGKQIFGQPIRVNWAYASGQREDTTDHFHIFVGDLSPEVTDSALFAFFSAYSPNCSDARVMWDQKTGRSRGYGFVSFRNQQDAQSAINDLNGQWLGNRQIRCNWATKGANSGEDQLTSDSKSIADVNNNFTENAKQKSNEDAPENNPLYRTVYVGNLAHEVTQDVLHRFFHALGAGAIEEVRVQXGKGFGFVKYSNHAETALAIQTGNGRILGGKPVKCSWGNKPTPPGTTSAPLPPPAAPSHPAAADLVAYQRAIAMSKMASTQALMQAQHLRHAAMGMGVGASQAMYDGTFQNVGASQQQQQQQQQLMYY

SEQ ID NO: 64941 - protein, 358 aa, Oryza sativa
MSAYCGKYKDELIKNAAYIGTPGKGILAADESTGTIGKRFASINVENVEDNRRAFRELLFCTPGALQYISGVILFDETLYQKTKDGKPFVDILKEAGALPGIKVDKGTIEVAGTDKETTTQGHDDLGKQCAKYYEAGARFAKWRAVLKIGPNQPSQLAIDLNAQGLACYAIICQENGLVPIVEPEILVDGPHDIDRCAYVSEVVLAACYKALNEHHVLLEGTLLKPNMVTPGSDAKKVAPEVIAEYTVRTLQRTVPPAVPAIVFLSGGQSEEEATLNLNAMNKLSAKKPWSLSFSFGRALQQSTLKAWAGKTENVEKARAAFLVRCKANSEATLGTYKGDAVLGEGAAESLHVKDYKY

SEQ ID NO: 64942 - protein, 703 aa, Oryza sativa Japonica Group
MGSYAYKYCMCFTRKFRSPAADPPPDVRAAFLAAGGGDGGLRRFLAQAQGETPAEVDRILALLSGGGGGGGGGGIAARLVGPRPGPAPSLDDFFGFLFNADLNPPIATQVHQDMSAPFSHYYIYTGHNSYLTGNQLNSDSSDIPIIKALQRGVRVIELDMWPNSAKNNIDILHGGTLTAPVQIIKCLKSIKEYAFCASPYPLVITLEDHLTPDLQAKVAEMLVKTFGNLLYIPSSDPINEFPSPESLMKKIIISTKPPEEYKKFLKSKDNQNINGGLANLAEEGSLRRIDSNAEESDGKDELDDQDEDSSDEDDPKFQQETACEYRELITIHAGKPKGHLKDALKVDPDKVRRLSLSETQLAKATASHGADVIRFTQKNILRVYPKGTRINSSNYDPMNAWTHGAQMVAFNMQGHDKALRLMQGFFRANGGCGYVKKPDFLLRTGPNGEVFDPNASMPVKKTLKVKVYMGDGWRMDFSKTHFDTFSPPDFYTRVGIAGVRADCVMKKTRTIEDQWVPMWDEEFTFPLTVPELAVLRIEVHEYDMSEKHDFGGQTCLPVSELKQGIRAVPLHDRRGTREKLPYHMVVVLKSIPRGDLVEYFFCETSQPVTRESSLSILAYSFPGFEDVNVCYLKQPFQKILYHIQQNLGIETIKKCQIRNKSVSKIGTDTVSKDHPKNLVPFTEECLAVMEAFGEVSLLDIIDF

SEQ ID NO: 64943 - protein, 310 aa, Arabidopsis thaliana
MKQISSGEVWRWNKEVEMNSIRDCLKHCSSIAIDTEFPGCLKETPMDASEEIRYRDMKFNVDNTHLIQLGFTLFDRRGFAKTWEINLSDFDEHKCFKNDKSIAFLKSNGLNLDKIREEGIGIDEFFRDFSQILTEKDGKITWVNFQGSYDNAYLVKGLTGGKPLPETKEEFHETVQQLLGKFVFDVKKIAESCSGLSSQFGLQRIADVLQMKRVGKAHHAGSDSELTARVFTKLTFDLLNSRKQSVRRVDHQQFQLEQQQHQQFMMTRCYIPIPMPIPRPRPVMFAAHHQNPYFGGGYFRMPVQGMNYVL

SEQ ID NO: 64944 - protein, 361 aa, Zea mays
MSAFVGKYTDELIKTAKCLATPGKGILASDESTGTIGKRLSSINLENVESNRQALRELLFTAPGVFDYLSGVILFEETLYQKTSDGKPFVDVLIAGGVVPGIKVDKGTVEIAGTDGETTTQGLDSLGARCAKYYEAGARFAKWRAVLKVGPAGQGQPSELAVRQNVEGLARYALICQENGLVPIVEPEILTDGGHDIGTCAAATERVLAALYKSLSDHKVLLEATLLKTNMVTPGSDSPKVSAEVIAEYTVAALRRTVPPAVPGVVFLSGGQSEEEATQNLDAMNKLEVLKPWTLSFSFGRALQQSTLKKWVGKKENVAAAQATFVIRCKANSEAALGKYAGSGAGDAAASESLYVKGYKY

SEQ ID NO: 64945 - protein, 139 aa, Streptococcus pyogenes M49 591
MIQQLKELLAGRPVDIPIYDYKKHTRSNTTFRQDPQDVIIVEGILVLEDERLRDLMDIKLFVDTDDDIRIIRRIKRDMMERGRSLESIIDQYTSVVKPMYHQFIEPSKRYADIVIPEGVSNVVAIDVINSKIASILGEV

SEQ ID NO: 64946 - protein, 193 aa, Triticum aestivum
  misc_feature (158)..(158): Xaa can be any naturally occurring amino acid
VVVVVAVTAASCRIRHEVQRQWTFWYDIQTKPKPGAAWGTSLKKGYTFDTVEEFWCLYDQIFRPSKLVGSADFHLFKAGVEPKWEDPECANGGKWTVISSRKTNLDTMWLETCMALIGEQFDESQEICGVVASVRQRQDKLSLWTKTASNEAVQVDIXGKKWKEVIDYNDKMVYSFHDDSRSQKPSRGGRYTV

SEQ ID NO: 64947 - protein, 317 aa, Bacteroides thetaiotaomicron VPI-5482
MMAKIANKLTDLVGNTPLMELSGYSGKYGLNQNIIAKLEAFNPAGSVKDRVALSMIEDAEARGALKPGATIIEPTSGNTGVGLAMVATIKGYHLILTMPETMSLERRNLLKALGAQIVLTDGLGGMAASIAKAQELRDSIPGSVILQQFENPSNAAVHERTTGEEIWRDTDGEVAVFVAGVGTGGTICGVARALKKHNPDVHIVAVEPASSPILAGGQAASHRIQGIGANFIPKLYDASVVDEVIGVPDDEAIRAGRELAATEGLLAGISSGAAVYAARQLAQRPEFRNKKIVALLPDTGERYLSTELFAFDAYPLD

SEQ ID NO: 64948 - protein, 353 aa, Bacteroides thetaiotaomicron VPI-5482
MDFKIAVLAGDGIGPEISVQGVDVMSAVCEKFGHKVSYEYAICGADAIDKVGDPFPEETYEVCKNADAVLFSAVGDPKFDNDPTAKVRPEQGLLAMRKKLGLFANIRPVQTFKCLIHKSPLRAELVENADFICIRELTGGMYFGEKYQDNDKAYDTNYYTRPEIERILKVAFEYAMKRRKHLTVVDKANVLASSRLWRQIAQEMAPNYPEVTTDYMFVDNAAMKMIQEPAFFDVMVTENTFGDILTDEGSVISGSMGLLPSASTGESTPVFEPIHGSWPQAKGLNIANPLAQILSVAMLFEYFDCKEEGALIRKAVDASLDENVRTPEIQVADGAKYGTKEVGQWIVDYIKKA

SEQ ID NO: 64949 - protein, 283 aa, Methanosarcina barkeri str. Fusaro
MKIIGGPASQLLASRTARALGIEPVLSEFNRFPDGELYLRIAEETENEHVTLIQSTPTDSDLVSLLQLIDACEGAKELDVVIPYMGYARQDKKFKPGEPISARAIARCIRADRVFTINIHEKSVLEHFHGPAENLDAAKLVGEYIAGLNLENPLLLAPDSGAEGLIKHVSSGLGFDYDHLEKTRLSGDTVVIKTKNLDVTGRNVVLVDDMIATGGTMAESIKMLRSQGAADVYIACVHPVLARNAVLRLFNAGVKDILGTDTLERAESRLSVAPLIADAIKGL

SEQ ID NO: 64950 - protein, 204 aa, Desulfovibrio vulgaris subsp. vulgaris str. Hildenborough
MGVLVGKKAPFFEGGKTFSAVLGNGEVVDDFDFAKVTEGKYAVVFFYPLDFTFVCPSELIAFDHRLEAFRQRNVEVIGVSIDSQFTHAAWRNTPVDKGGIGPVGYPLVADIQHELARAYDVESEGGVAFRGSFLIDRAGVVQHQVVNNLPLGRDIDEMLRVVDALQFTEKHGEVCPAGWNKGKKGMKPTADGVASYLAESAANL

SEQ ID NO: 64951 - protein, 409 aa, Helicobacter pylori J99
MSLIRVNGEAFKLSLESLEEDPFETKETLETLETLIKQTSVVLLAAGESKRFSRAIKKQWLRSHHTPLWLSVYESFKEALDFKEVILVVSELDYVYIQRHYPKIKLVKGGASRQESVRNALKVIDSTYTITSDVARGLANMEALKSLFLTLQQTSHYCIAPYLPCYDTAIYYNEALDREAIKLIQTPQLSHTKTLQSALNQGGFKDESSAILQAFPNSVSYIEGSKDLHKLTTSGDLKFFTPFFNPAKDTFIGMGFDTHAFIKDKPMVLGGVVLDCEFGLKAHSDGDALLHAVIDAILGAIKGGDIGEWFPDNDPKYKNASSKELLKIVLDFSQSIGFELLEMGATIFSEIPKITPYKPAILENLSQLLGLEKSQISLKATTMEKMGFIGKQEGLLVQAHVSMRYKQKL

SEQ ID NO: 64952 - protein, 475 aa, Helicobacter pylori J99
MEHQNTTQKQGELKRDMKMRHLLMIAFGGAIGTGLFVGTGGNIASAGPLGTLIAYCFGGLVVYCIMLSLGELASVYPTTGSFGDYAAKFIGPGTGYMVFWMYWLGWVITVALEYIAIGMLMQRWFVNIPIHYWVISCIALVFLLNFFSVKIFAEGEFFFSLIKVLAVIAFISIGVIGIIYQIYLHGFSSIFDNFHFGDKGFFPNGSEAVFSAMLAVIFAFTGTEVIGVAVGETKNASEVMPKAIKATLWRIVFFFLGSVFVISVFLPMSDSSIAQSPFVSVLERINLPFIGMGIPYVADIMNAVIITAMFSTANSGLYGASRMIYGLSKQKMFFKVFSQLNRQGTPTYAMFFSLSFSLIGLLVQIYAKENVVEALINVISFTVIIVWVSVSISQYSFRKQYLKAGHSLEDLPYKAPFLPFLQLIGITGCIIGVIGSAMDKDQRIGMILTIVFAVVCYIGYYFTQKANENNKKDLI

SEQ ID NO: 64953 - protein, 333 aa, Marinobacter sp. ELB17
MLTWPHQNTAWASHLAQTEPVFMAIAHAVLRFESVLISCEDPEQAQRLQEQLNHYVKTAGVAFCALVLVAPSDGSWARDHGPLAVFTHQGSRLVDFSFNAWGNKFPWDKDNALNNRLLTAGAFDGSTLKSVEFILEGGAIDTDGEGTLLTTSECLLSPSRNPDYSRSAMEKLFGQLLGIRRVLWLNHGYLAGDDTDSHIDTLARFCSPDHICYVACPDESDEHYGALGAMAEGLRDFRQANGESYRLTPLPWPDAIRDEKGQRLPATYANFLIINGAVLLPVYDVPQDAAAIATLQNLFPDREIIAIPCRPLLRQGGSLHCMTMQLPAGVMTK

SEQ ID NO: 64954 - protein, 200 aa, Helicobacter pylori J99
MCGAQFFRARVLEFFTSLFESMKVLKLLPNFLTILRIVLSLFLLFLLLNTHTYFSFLTPFHINMISSLVFLFAALTDLLDGYIARSYKAKSRFGEIFDPLADKILILSAFLGLVYLDRVNAWVPFVILGREFFISGLRVLAANEKKDIPVNALGKYKTVSQVVAIGALLANLTYSYVLVAIAVFLTLYSGIDYTIKYYKS

SEQ ID NO: 64955 - protein, 399 aa, Zea mays
MPPCCSPTTSAVTAAAASPGASRSGGLLRRSRPAPAAVNCKKIDSLRSINGAPPCIPVSNRSLLTPVTLPVFRDPNMRNDTRLRIFSGTANPSLSQEIASYLGLELGKITIKRFADGEIYVQLQESVRGCDVFLVQPSCPPANENLMELLIMIDACRRASAKNITAVIPYFGYARADRKSQGRESIAAKLVANMITEAGANRVLVCDLHSSQAMGYFDIPVDHVYGQPVILDYLASKTICSDDLVVVSPDVGGVARARAFAKKLSDAPLAIVDKRRQGHNVAEVMNLIGDVRGKVAVMMDDMIDTAGTISKGAELLHQEGAREVYACCTHGVFSPPAIERLSSGLFQEVIITNTIPLKEEKSFPQLTILSVANLLGETIWRVHDDCSVGHEPYSSLDID

SEQ ID NO: 64956 - protein, 124 aa, Streptococcus pyogenes M49 591
MTKVRKAIIPAAGLGTRFLPATKALAKEMLPIVDKPTIQFIVEEALKSGIEEILIVTGKSKRSIEDHFDSNFELEYNLQAKGKIELLKLVDETTSINLHFIRQSHPRGLGDAVLQAKTFVAMNL

SEQ ID NO: 64957 - protein, 520 aa, Coccidioides immitis RS
MTKVDQKVALIVIDGWGVPGPQSPPEGDAIAAAETPVMSSFADPKAKTAQGYTELDASSLAVGLPEGLMGNSEVGHLNIGAGRVVWQDVVRIDQTLKKGELNKVQSIVNTFNRAKTGNGRLHLLGLVSDGGVHSHINHLVGLLKVAKEMEIPKVFIHFFGDGRDTDPKSGAGYMQQLLDSMKEVGIGELATVVGRYFAMDRDKRWDRIEVAMKGIVLGDGEASDDAVKAINERYEKGETDEFLKPIIFGGDERRVKDDDTLFFFNYRSDRVREITQLLGDYDRSPKPDFPYPKNIAITTMTQYKTDYTFPIAFPPQHMGNVLAEWLSVKGLKQCHIAETEKYAHVTFFFNGGIEKQFEGEDRDLIPSPRVATYDLDPKMSAAPVGEKMAERIAEKKYDLVMNNFAPPDMVGHTGVYEAAIQGVAATDKAIGRIFESCKENGYILFITADHGNAEEMKNGDGSPKTSHTTNKVPFVMANAPEGWSLKEKDGILGDVAPTILDAMGIEQPKEMSGSSLLIRN

SEQ ID NO: 64958 - protein, 360 aa, Lentisphaera araneosa HTCC2155
MKKNLSELRSEIDRLDRSIVAMINERYTYVRQVGDWKHANSSEIYVPEREKALLEKLETINEGPLKNETLHAIYREIMSGAIALESPVKIAFLGPENTFSHQAALSKFGRSVSYMAKNSIADVFEAVDRAKVDYGVVPIENSTEGAVTYTLDMFNQAEVSICAEINLAAHQNLMARCAKEQVRVIYSHPQALAQCRIYLHNNFPLVPQVEVRSTAEAAKRAALDDHAAAVASGLAADANGLNILDGSIEDNSRNVTRFLVIARQNPKPTGDDKTSIVFALKDKVGALMECLAAFGTQGVNMSMIESRPAKTHQGEYLFFVDFNGHRTDENVLNLIEELKKHCLYVKVLGSFPCGLSIAAD

SEQ ID NO: 64959 - protein, 476 aa, Gonyaulax polyedra
QSTPHAPMSAHSWAADVLSGGPPRAPSTAGAGCEVPRESCCESSDSKGCPCLEASVAFRRAWQAAQARPADAAAAPQAAAVAERVERCGSSEASYGLGRCPSTANLQGLCLPRPVGPSLARESDTVAHSELLCDSLLQAHEPAEVEHQDAAAAGPAKSTRPNSRAPLGEITNTRVATAAGDEPKHAKPCPPTPPDHDPQLVKEYTSDVMRSMLQREEHFMPRPNYMQDQPQINAKMRSILNDWLFEVHRLYGLRRETLFLTVSITDRYLSHVPVSRQRLQLVGVSALLIAAKFEEIEPPELADLVYVTADSYTKQEIVDTEMAMLSVLSFEVAAPTAANFMRHFQAHGRILAALHFESQHPELAHAGGLPPPAVGACDEARGDLAWYLLELALLDIRAVRHAPSHLAAAALLLANRLSGQRPAWPASLARLSGYVEKELEACACELGQLLEAARRAFLQAMRSKYRHTEMLYRHPA

SEQ ID NO: 64960 - protein, 247 aa, Glycine max
MKFNIANPTTGCQKKLEIDDDLKLRAFWDKRISQEVIGDALGEEFKGYVFKITGGCDKQGFPMKQGVLTPGRVRLLLHRGTPCFRGYGRRNGERRRKSVRGCIVSPDLSVLNLIIVKKGENDLPGLTDVEKPRMRGPKRASKIRKLFNLSKEDDVRKYVNTYRRTFTTKAGKKVSKAPKIQRLVTPLTLQRKRARIADKKKRIAKAKSEAAEYQKLLASRLKEQRDRRSESLAKRRSKLSSAAKAAV

SEQ ID NO: 64961 - protein, 502 aa, Rhodococcus sp. RHA1
MAIQDKGSGEPHLGGRPTGLFRTKSIEQSIRDTDEPETKLRKDLTAWDLTVFGVAVVIGAGIFTLTARTAGNVAGPSVSAAFVIAAIACGLAALCYAEFASTVPVAGSAYTFSYATFGELIAWIIGWDLILEFALAASVVAKGWSLYLGEVIGNHTPVAQIGSVTFDWGAVLIVAIITVVLATGTKLSSRVSLVITSIKVAVVLVVVVVGAFYIDTDNYSPYIPPSEAGSTGEGIHQSLFSYVTGAGGSTFGWYGLLAAASLVFFAFIGFDIVATTAEETKDPQKALPRGILGSLLIVTILYVAVTLVLTGMVDYHELAGDSSNLATAFGIHGITWAKNLISFGALAGLTTVVMVLMLGQTRVLFAMSRDGLMPRRLAPTGKHGTPVRITVLVGVVVAVLAGIFPIGTLEEMVNIGTLFAFVLVSVGVIVLRRTRPDLPRGFRVPLVPWVPVLAVLACLWLMVNLSVETWIRFIVWMALGVIIYFAYSRRHSMMERRSRGEV

SEQ ID NO: 64962 - protein, 224 aa, Arabidopsis thaliana
MWGWFLVCGEQNLRQRQQYEKQLALSEIDYSRKMLLEKLKEYKGKDFEVLRETTTFAGERVDYENDLLLPPYPVHPPLSLGLDNNNGYLSHLPSKKKSDANGFGSGHVRNEAEAKSPNGGSGGSSHGVIRFLGSVAKIVLPIIGVISLLSASGYGPEMRKRGASLNLFGLLPHRATRGKRTPNQCPPGKVLVIEDGEARCLVKERVEIPFDSVVAKRDVTYGYG

SEQ ID NO: 64963 - protein, 489 aa, Listeria monocytogenes str. 4b F2365
MGKATGFMEYDRIPSPGRDPKSRTRDWNEYSLPMPVADLTLQAARCMDCGVPFCSVGMEIKNGVSGCPLHNLIPEWNDAVYRGDWYEALQLLLKTNNFPEFTGRICPAPCEGGCTVAISEPAVGIKSIEKAIIDRGFEEGWIKPAPPKKRTGKRIAVIGSGPAGLACADQLNKAGHSVTVIEKSDRIGGLLMYGIPTMKLEKEQVTRRVNLMAEEGIEFVTGVAAGTDVTFAELREEYDSIVLATGAGNARDIPLAGRDAVGIHFAVPYLSQSTRDNLDNGGVQTLSAKGKNVVIIGGGDTGADCVATALRQGAKSIYQFGIQDKLPELRDGENPWPQYPRVFKMDYAHEEAEAVYGRDPREYLINTTSFEKDEAGNLIGLHTVEVEENKAERKYTPVEGSEKYFEVDMVLIAIGFAGTTEDIFTNFGVGKTDRHTIDAAKGFYRTSEEGVFACGDARHGQSLVVTAIAEGREAAREVDFYLMGETFLP

SEQ ID NO: 64964 - protein, 282 aa, Rhodopirellula baltica SH 1
MSIFNALASRYRGRRPHKRSNERVLFSTLRCFCPPQLPLPCFQPQGRTMPLLSKPLWKHVFGLAIAGGLVFAVAGCGEPMASTQANDAPVTKSSDTKSGDTEKTAKTETASTSKKTTPLLTHNRYELKMDSSPFNKLTEAEAYVILHKGTEPPGDGGYTLTKDPGTYICKRCNTPLYHAKDKFISHCGWPSFDDEIEGAVKRQRDADGRRIEIVCANCDGHLGHVFHGERLTPKNERHCVNSISMKFIPEGKEMPKPIKASDVKKAEKATESKAAKKETAAE

SEQ ID NO: 64965 - protein, 505 aa, Arabidopsis thaliana
MFFSKDLPSPTSVFTAYASMAGYMMMIRSMAHELIPAPLQDFIYRTLRSLFFRSSSSTLTLTIDDDNMGMNNEIYRAAQTYLSTKISPDAVRLRISKGHKDKHVNLYLSDGEIVNDVYEDVQLVWRFVTDGGDKKGGGGGVGGRGGGGGRRGGMDDDGKSEYFELSFDKKHKDLILNSYVPYIESKAKEIRDERRILMLHSLNSLRWESVILEHPSTFETMAMEDDLKRDVIEDLDRFIRRKEFYKRVGKAWKRGYLLYGPPGTGKSSLVAAMANYLKFDVYDLQLASVMRDSDLRRLLLATRNRSILVIEDIDCAVDLPNRIEQPVEGKNRGESQGPLTLSGLLNFIDGLWSSCGDERIIIFTTNHKDRLDPALLRPGRMDMHIYMGHCSFQGFKTLASNYLGLSDAAMPHRLFPEIERLIDGEVMTPAQVAEELMKSEDADVALEGLVNVLEKMRLKSKESNPVMMKQKESRLEMEEMRLKSDTEGSPRKNSKRFKKLVLFWT

SEQ ID NO: 64966 - protein, 1013 aa, Ostreococcus tauri
MAPSRARARLEDAYERASVPARAANVDGSDVLGAGNFGTARLMRRRRTGELVAVKFIERGAHVDENVKRELVNHRGLTHPNVVGFIECAVTDKHLAIVLEYASGGELFDRVLKSPGGHFAEAEGRYFFQQLISGVAYCHAKGVAHRDLKLENALLDGGAVPRLKICDFGYSKNSFIDSDPKSTVGTPAYIAPEVLERKPYDGKTADVWSCGVTLFVMLCGKYPFEDRRRPRDFRSTIVKIRNCEYEIPRNVVLSPGCVDLIKRIFVVDPQRRIDIPGIQAHPWFVTDLPLELVDANGINDAAPRTSMTVEDILAVVEEAKVPHGGEQHHRELEDDHHDMVTSGEFDDDDRAASLLRADYKAQSRALSLISKTSTGHPIQIMKRKNPPRLELDLDVNPRRKLERHERIDRLCRRLVHVDQSVVRASLEVFPAVLVNVRRAQDAEDASLRRKRHRTRDARLSRLCRLDDLIACALHVVRLERAQANANFLGLHSGLQEMRRMPSALVMRLHEIEAVKFGEFTLKSGIVSPIYVDLRVIVSYPDVLSSVAECMWDVLKANGATFDNMCGVPYTALPIATCMSLAHDCPMVMRRKEVKAYGTKKQIEGAFEAGQTCLCVEDLVTSGASVMETVEPLERVGLKVKDVVVLIDREQGGEARLASHGLRLHSVLPLSRVLRTLEANGKMRCSSRLRDHSRVSEFSRTQHRHWSLRNPFPGRRLSCGSSRWICTNILETLSHFIAANQTMPAAGEQAKKPTRMSYTARSELTDNACAKQLFNLMETKKTNLCVAADVNTAKELLELAEVLGPEICMLKTHCDLYPDFTESFGEQLMAIAEKHNFMIFEDRKFADIGNTVVGQYSSGVHKIADWSHITNAHIVPGSGIIDGLKSVGLSKGRGLLLLAEMSSKGTMAKGEYTEAAIGMAAQHPDFVMGFISTNPKAWKAEWSKGLINMTPGVQLQQGGDAMGQQYNTPHNVIVENGSDVIIVGRGIYRAADPAAAAKEYRAAGWEAYQTSISA

SEQ ID NO: 64967 - protein, 125 aa, Triticum aestivum
PISSQRDTTIHLSPPTSLSLAKMSTVTRAYLDQRLAAANRCSKEAAMAGAKAAAVATVAAAVPTLASVRMLPWAKAHLNPTGQALIISTVAGMAYFIVADKTILSMARKHSFDDAPDHLKNTSFH

SEQ ID NO: 64968 - protein, 617 aa, Oryza sativa Japonica Group
MHRFLVTALLFSLLNYGAVMATESDEADFFRNCPPSRCSSDGPDIKFPFRLESSSSSCGAPGMQLSCSGQDTLLLHHVLGLSKVTGIDYIYGVINIVPLAESWSQCALQKIISANYSTSVYKQYGFQYASLVSCSEEFIWDSTDSIFGPISCLSNASQSLYLVAPYAFVSILPLYCKVVSTEIMIPYTSNQGRKDYNASASTEFNESAKRITTFSEITFTWSALISLMFASDCERQQRLCGFSSQRRTAFCKPHGSKSPAKVIIVAVSVPTIVVLTLVVASALYLSLKTKNDDEIQLKVEMFLKTYGTSKPTRYTFSEVKRITRRFKHKLGTGGFGSVYKGELSKGVPVAVKMLENSKGAGEEFINEVATIGRIHHVNVVRLLGFCSEGTRHALIYEFMPNNSLEKYIFSRDYISSQEVLVPDKMLKIALGIAQGIEYLHQGCSQRILHFDIKPHNILLDHSFSPKISDFGLAKLCARDQSIVTLTAARGTMGYIAPELYSRNFGAVSYKSDVFSFGMLVLEMLSGKRNSDPSINSQNEVFVPEWIYETIVSAQESEFAKDMTQEEKEKLRKLAIVALWCVQWNPANRPSMRKVVNMLTGSLQNLKNPPRPFVSSLS

SEQ ID NO: 64969 - protein, 741 aa, Haloarcula marismortui ATCC 43049
MNEVQLEVAKAYPNDSGRGIARLDPDTLLHLKLSPGDIIEIEGSDTTAAKVWRADRQDWNTDTVRIDGFTRQNADVGIGERVTIRKAEAEKADKLVLAPPEEASVQFGSDAAGMVKRQILKRPVVERDIVPVMSSTNHPFMRSPGQAIPLIAVETEPEGVCLITEDTEVELREEPISGFEKTGGGITYEDIGGLQNEIQRVREMVELPMKHPQIFKKLGIEPPQGVLLHGPPGTGKTLLAKAVANETSASFFSIAGPEIISKYYGESEQQLREIFEDASEESPSIIFIDELDSIAPKREDVTGEVERRVVAQLLTMMDGLESRGQVIVIAATNRVDSVDPALRRPGRFDREIEIGVPDEVGREEILQIHTRGMPLSDDVNLAKLATDTHGFVGADIESLTKEAAMKALRRYLPEIDLDEEDIPPSLIDRMIIKRDDFKGALNEVSPSAMREVLVELPKMSWDNVGGLSGPKEQVQEAVEWPMNSPEKFERMGVTPPSGVLLYGPPGTGKTLMAKAVANETDANFISVRGPQLLSKWVGESEKAIRQTFRKARQVAPTIIFFDELDSLAPGRGGEMGSNVSERVVNQLLTELDGLEEMEDVMVIGATNRPDMIDPALIRSGRFDRLVMIGEPDIEGREQILKIHTDDTPLSPDVSLRELAEVSDGFVGSDLESIAREAAIEALREDDNAEEVEMRHFRQAMDSVRPTITDDIREYYEQMEEEFRGGSSPQRQAGTGGRIGFQ

SEQ ID NO: 64970 - protein, 312 aa, Lentinula edodes
MTESLRFLGSLTGHKGWVTAIATSSENPDMILTASRDKTIIVWQLTRDDDSYGYPKRILQGHNHFVSDVVISSDGQFALSSSWDHTLRLWDLNTGLTTRRFVGHTSDVLSVSFSADNRQIVSGSRDKTIKLWNTLGECKYDIKDDGHSEWVSCVRFSPNVMNPVIVSSGWDKVVKVWELSKFKLKTNHYGHTGYINTVSVSPDGSLAASGGKDGITMLWDLNEGKHLYSLEAGDIVNALVFSPNRYWLCAATASCVKIFDLESKSIVDELKPAYAEEGGRQPECVSIAWSADGQTLFAGFTDNCLRVWTVTS

SEQ ID NO: 64971 - protein, 246 aa, Robiginitalea biformata HTCC2501
MKQKIVIVTGATSGLGYATAKKFCQAGHICYVLGRNPEKTRKTCKELGPQARELVLDLSRLEDIPGAVRQVQEAAGRIDVLVNNAGINMKKPLLEVSDAEFNQILQTNLHSVFSISREAGKVMKEQGQGNIVNISSMAAQYGLPYVVAYSASKTAIEGLTRAMAVELAPMGIRVNCVAPGFIKTPMTAKALDSDPPRKDRVFARTPMGEMGLPEDIADTVFYLASEEARFITGVVLPVDGGNSIGF

SEQ ID NO: 64972 - protein, 568 aa, Xanthomonas campestris pv. campestris str. 8004
MTHSVEDIKSTSRRLRGSLEQSLADPVTGALREDDQTLIKYHGSYQQDDRDIRDERRRQKLEPAYQFMIRTRTPGGVISPSQWLALDGIATRYANHSLRITTRQAFQFHGVIKRELKATMQAINATLIDTLAACGDVNRNVQVAANPLLSQAHATLYADAARVSEHLLPNTRAYYEIWLDEERVSGSGAEDEPIYGDRYLPRKFKIGFAAPPHNDVDVFANDLGFIAILREGQLLGYNVSIGGGMGASHGDAETWPRVANVIGFVTGDQLLDIATAVVTTQRDLGNRAVRKRARFKYTIDDHGLDTIVAEIERRAGFSLQPAQPFAFAHNGDRYGWVEGEQGDWHLTLSLPAGRIADTDTAAHLSGLRAIAQLQMGEFRMTPNQNLVIAGVPAEQRAQIDQLVAQYGLDAGNLAPTALARGAMACVALPTCGLAMAEAERYLPDFSAALQPLLERHGLAQTPIVLRLSGCPNGCSRPYLAEIALVGKAPGRYNLMLGGDRRGQRLNTLYRENINEADILAALEPLLARYAAERDRHTDEGFGDFLHRSGLIALPPYPTHRHLDLELLA

SEQ ID NO: 64973 - protein, 217 aa, Shewanella sp. MR-4
MNQSLLAPFGTAIERVEAGLEALRQGQGVLVVDDEDRENEGDLIFAAESLTNAQMAMLIRECSGIVCLCLPDEKVKALELPPMVENNSSQYGTAFTVSIEAKVGVTTGVSAADRVTTIKAAIADNAKPSDLARPGHVYPLRAQPGGVLTRRGHTEGTIDLMQLAGLKPAGVLCEVTNPDGTMARLPEIIAFGAAHNMPVLTIEDIVVYRKSLLANVG

SEQ ID NO: 64974 - protein, 196 aa, Enterococcus faecalis V583
MSQFPQLDLENAKGPKAVIKTNRGDITVQLFPEQAPKTVKNFVELAKKGYYDGVIFHRVIPDFMIQGGDPTGTGMGGESIYGEAFEDEFSRDVFNLRGALSMANAGPNTNGSQFFVVTNQNVPAQMMSQLEDAGFPEEIIEAYKQGGTPWLDFRHTVFGHVVDGMDVVDEIGGVQRDAQDRPTFDVVMDTVEIIGE

SEQ ID NO: 64975 - protein, 538 aa, Arabidopsis thaliana
MADEKNGGRLSDASDYSSEDEGTEDYRRGGYHTVRVGDTFKNGSYVIQSKLGWGHFSTVWLAWDTLNSRYVALKIQKSAQHYTEAAMDEIKILKQIAEGDAEDKKCVVKLLDHFKHAGPNGQHVCMVFEYLGDNLLSVIKYSDYRGVPLHMVKEICFHILVGLDYLHRELSIIHTDIKPENILLCSTIDPEADARKSGIPLVLPTVKDKAVPERPVEKEKPKSYTYSADLTKNQKKKIRKKAKKVEGSEENERDSSNSEARPNGNATVERLEESSERVKDAENVSQKSRGNRRGSRSTRQKLLADVDRKCKLVDFGNACWTYKQFTSDIQTRQYRCPEVVLGSKYSTSADMWSFACICFELATGDVLFDPHSGENFERDEDHLALMMELLGMMPRKIALGGRHSRDFFNRQGELRHIRRLRFWPLSKVLTDKYDFSEEDAIAMQDFITPILQFVPEKRPTAAQCLTHPWLNPVPKSLKPSSSPQNPKEEEEEASDEDKDKEKVEREAMEAGVGNIAIDGSERKTSAREGRQSARDLRT

SEQ ID NO: 64976 - protein, 491 aa, Aspergillus nidulans FGSC A4
MGQGHSTAEAGTGVSSERKDAKKDYYELLDVEQNASPEENFGNVEAATNLFAEIQIAYEVLSDPHERSWYDSHRDAFLGGDAGGEAADYSHNARMTSSADILNLFSKFSPRMDFTDAPCGFYGGLRETFAQLAQEEEMACRWEGVDSIDYPSFGTRHDGSQVVRDFYAVWGSFSTRKSFAWKDVYRYSEAPDRRVRRLMEKENKRLREAAIREFNEAVRSLVAFAKKRDPRYKIYKDSLSQKREALRQSAASQAAKSRAANQATLREHVLQDWARSEEGPEEEEADSEEVETEHIECIVCRKTFKSQNQFHAHERSKKHIKAVKQLRREMRMEDDELCLGNAVVDGREAQTAEDAPVAVTDFYEEENEAVQHSVSPAASLPDQASHNSMYGLQNMISHEDEADYVPSNVLEQRLAQEDLQAQISELSEKLLATDLDKTNLSLKKMGKAKQKRAKKAKVATQSSQLHECTICNASFASRNKLFSHIKSHSQR

SEQ ID NO: 64977 - protein, 533 aa, Zea mays
MMASTASATAAAAVAFGAAAKPRGPAAALRARVPAGGRRRSGMVVRCDAGVEAQAQAVAKAASIAALEQFKISADRYMKERSSVAVIGLSVHTAPVEMREKLAVAEELWPRAIQELTSLNHIEEAAVLSTCNRMEIYVVALSWNRGIREVVDWMSKKSGIPASELKEHLFMLRDSDATRHLFEVSAGLDSLVLGEGQILAQVKQVVRSGQNSGGLGKNIDRMFKDAITAGKRVRSETNISSGAVSVSSAAVELALMKLPKSEALSARMLLIGAGKMGKLVIKHLIAKGCKKVVVVNRSVERVDAIREEMKGIEIVYRPLSEMYEAAAEADVLFTSTASETPLFTKEHAEALPTISDAMGGARLFVDISVPRNVSACVSEIDSTRVYNVDDLKEVVEANKEDRLRKAMEAQTIIAEELKRFEAWRDSLETVPTIKKLRSYADRIRASELEKCLQKIGDDALTKKTRRAIEELSTGIVNKLLHGPLQHLRCDGGNSRTLDETLDNMHALNRMFGLDTEKAIVEQKIKAKVEKIQN

SEQ ID NO: 64978 - protein, 83 aa, Zea mays
MGGGRAQVNKAHKSRFASKASRHTHKIDKVRSGKSETSHRAAVKGARAARIQQSKAIRDKKRAALLKEKRSSTGPSSAPRVIF

SEQ ID NO: 64979 - protein, 245 aa, Brucella suis 1330
MKFEFENRTLVLTGANGGIGRAIAELFHASGANLVLTDLDREGLDAFAASLGSPERIATIKADASSADDAEKTVALAMERFGGIDFLVPSAGIYQAKPFAEMSDADWYRTISINLDGVFYLCKRALPALKEDSSIVTLASLAAYRGAYVNAHYGATKGAMVSMTRALSRELAPKTRVNGVAPGIIETPMTSELLKTRMDETMTQTPLKRLGKPSEIASVIAFLCSPAASFVTGETIQVNGGIYMA

SEQ ID NO: 64980 - protein, 495 aa, Triticum aestivum
  misc_feature (106)..(106): Xaa can be any naturally occurring amino acid
HYRTSLYKKAGWYRSGIPGISSTHASAENSIPKETAYQMITDELMLDGNPRLDLASFVTTWMEPECNKLIMDSINKNYVDMDEYPVTTELQNRCVNMIAHLFNAPXNEDEKAIGVSTVGSSEAIMLAGLAFKRKWANKRKEEGKPYDKPNIVTGANVQVCWEKFARYFEVELKEVKLTEGYYVMDPLKAVEMVDENTICVAAILGSTLTGEYEDVKLLNDLLVGKNKETGWNVPIHVDAASGGFIAPFLHPELEWDFRLPLVKSINVSGHKYGLVYPGVGWVVWRSKDDLPEELIFHINYLGTDQPTFTLNFSKGASQIIAQYYQLIRLGFEGYKHIMENCQANAAVLREGMEATGRFSIVSKEDGVPLVAASLKDSTKFSVFDVSENLRKFGWIVPAYTMAPDAEHVAVLRVVIREDFSRSLAQRLLADINKVLHELDAHAAHAIKVTAPTATQNGNGVDGDDTVTQKSVLDTEKKFVAACMSLVKKNKKTGVC

SEQ ID NO: 64981 - protein, 250 aa, Brucella suis 1330
MELLKEKLVLVTGAGRGLGAAISSGAAEQGARVILVDIDGTAAKAQADALTAKGFVAEGHALDVTDRDAVAALADDILSRFGGLDVLVNNAGVAGRAAFDQPEAVEVWDRVIGVNLEGAFNVSHALVPALKAAKGNVVHLCSVAGFVSGGSTAGYVVSKGAIRSLTQVMARDLAPHGIRVNAVAPGIMMSEMAVAQLNRPGGTDWFMNRVMMKRIGETSEVVDPVVFLASPMASYITGTILPVDGGFLAA

SEQ ID NO: 64982 - protein, 401 aa, Coccidioides immitis RS
MASQPQNGQRPQVQPCRYKTGKTLGAGSYSVVKECVHIDTGRYYAAKVINKRLMAGREHMVRNEIAVLKKVSMGHRNILTLVDYFETMNNLYLVTDLALGGELFDRICRKGSYYESDAADLIRATLSAVAYLHDHGIVHRDLKPENLLFRTPEDNADLLIADFGLSRIMDEEQFHVLTTTCGTPGYMAPEIFKKTGHGKPVDIWAIGVITYFLLCGYTPFDRDSNLEEMQAILEADYSFTPVAYWRNVSQSAREFIKRCLTIDPHARITAHEALQHPWISPPADPLNPNVPVRMGSGEDLLPVVKKNFNARRTLHKAIDTVRAINKLREGGGLMMEGAMSVDPKPERVIGDRVLQEDDEDRMEIDSRGNARGQTEEQIREQERKVKEVVTGLWSQTAARRR

SEQ ID NO: 64983 - protein, 78 aa, Pseudomonas fluorescens Pf-5
MSTIEERVKKIVAEQLGVKEEEVVNTASFVEDLGADSLDTVELVMALEEEFETEIPDEEAEKITTVQAAIDYVTSHQA

SEQ ID NO: 64984 - protein, 115 aa, Zea mays
GVGALVKFPPEGAPKASPTLRVGICGDPGGEPLSGPFFPKAGLDTVSSPPFRVPIVRLAPARGFVWGSPLVGTRIPCCWGMGGSPGLFPAPAMGPFLAPGLKKAPIPSPFFFPGR

SEQ ID NO: 64985 - protein, 343 aa, Neisseria meningitidis FAM18
MGIKVAINGYGRIGRQVLRAIYDYQIQDQLQIVAVNASGSLETNAHLTKFDTVHGRFEADVSHDGGNLIVNGDKIPFFSTRNPAELPWKELGVDLVMECTGAFTSKEKAKIHLESGAKKVLISAPGGDDVDATVVYGVNDSVLTADMTVVSNASCTTNCLSPVAKVLSESVGIVKGAMTTIHALTNDQTVTDVRHKDLRRARSGVENMIPTKTGAAKAVGLVLPELKGRLDGLAIRVPTVNVSLVDLSFQAARDTTVEEINALMKAASEAGALKGVLGYNTLPLVSMDFNHTTEASHFDATLTKVVDGNMIKVFAWYDNEWGFSCQMLNTARRMFGLEVRPLK

SEQ ID NO: 64986 - protein, 331 aa, Triticum aestivum
  misc_feature (126)..(126): Xaa can be any naturally occurring amino acid
  misc_feature (140)..(140): Xaa can be any naturally occurring amino acid
  misc_feature (173)..(173): Xaa can be any naturally occurring amino acid
  misc_feature (242)..(242): Xaa can be any naturally occurring amino acid
  misc_feature (247)..(247): Xaa can be any naturally occurring amino acid
  misc_feature (271)..(271): Xaa can be any naturally occurring amino acid
  misc_feature (275)..(275): Xaa can be any naturally occurring amino acid
  misc_feature (279)..(279): Xaa can be any naturally occurring amino acid
  misc_feature (289)..(290): Xaa can be any naturally occurring amino acid
  misc_feature (296)..(296): Xaa can be any naturally occurring amino acid
  misc_feature (298)..(298): Xaa can be any naturally occurring amino acid
  misc_feature (309)..(309): Xaa can be any naturally occurring amino acid
MSDNLMEKVNALGERLKITGSEVSKQMQAGMSSMSFKMKELFQAQTPADKIVEDATAETLEGPDWAANLEICDLINTEKVNSVDLIRGIKKRIMLKEARVQFLALFLLETIVKNCEKAFSEVAAEXILDEMVRLIDDPQXVVNNRNKALTLIEAWGESGDELRYLPVYEQTYXSLKSRGIRFPGRDNESLAPIFTPPRSVAEAEVAANFSQQIFEDVHVHTYTAEETKEVSDVARNSMELLXTVLSXSPQAGCFCKDDFDNILVQQCYHLXHTIXEFIXTVGDNEPCSXXAFSVNXEXRKVLPKYEEMXNPWRPGLQHGPYNCKRHERDVG

SEQ ID NO: 64987 - protein, 658 aa, Neisseria meningitidis FAM18
MNEFSLAPIVVVLLVSVITVILCRKFNIPSMLGYLLVGFLAGPGMLSLIPKSHATDYLGEIGIVFLMFSIGLEFSLPKLRAMRRLVFGLGGLQVGVTMLSVMGILMLTGVPFNWAFAVSGALAMSSTAIVSRILSEKTELGQPHGQMAMGVLLMQDIAVVPLMILIPALAGGGDGNIWAALGLAFAKMLLTLGLLFFVGSKIMSRWFRMVAKRKSSELFMINVLLVTLGVAYLTELEGLSMALGAFVAGMLLSETEYRFQVEDDIRPFRDILLGFFFITVGMKLDIQALIGGWRQVLMLLAMLLVLKALVVFAIAFKMKHSVGDSLKTALYLAQGGEFGFVMLAIAGQLDMVSPEWEQAATAAVLLSMIIAPFLLGGSDALVGRLVKSSWDMKSLDLHSMLVETMSKSDHVLIVGFGRGGQTVGRVLAQEDIPYFALDLDIARVQVARSAGEPVSFGDAKRREVLEAAGLGRAKMVVLTLNNMHETQHVLDNVLSMYPNMPVYVRATNDDYVKTFTDIGAEEAVSDTKETGLVLAGYAMLGNGASYRHVYQTMANIRHSRYAALEGLFVGSDDEAGFGENGETVRHAFPLAAEAYAVGKTVGTLPMAAYGIKLLFVRRRTGRIENPDASFTLEGGDVLVVAGKKEEIISFENWSLQGI

SEQ ID NO: 64988 - protein, 345 aa, Zea mays
MRQPRSGPGKRRGRGPRIPAATLQKQKTALANVDQITGAKIPKSFVFSRGKLPSTLRHLQQDLRKVMLPYTALNLKEKKRNNLKDFVNVAGPMGVTHFLILSNPQSLPHLRFAKSPQGPTFTFQIEEYSLAADIANSQKRPRCPPGIFKNSPLVVLGGLTGLGNPFRSLVEYFQHMFPSVDPTTVKLATCQRILLLKHDKEKDVIEFRHYSIKLQPVGVSRRIRKLMQNNQVPDLGEFEDVSEFVKKAGYGSESEADDEAAMVSLPSDIDKLNRASRKSAVRLQEIGPRMTMRLVKVEAGLCSGDVLYPWPVEKEVVGKKGTETGEVEGQEDDSEATDESEDEMV

SEQ ID NO: 64989 - protein, 529 aa, Debaryomyces hansenii CBS767
MVNPADVPIEVSKVFDTILVLDFGSQYSHLITRRLREFNVYAEMLPCTQKISELTWKPKGIILSGGPYSVYEDGSPHVDHDIFKLNVPILGICYGMQELAWINGKGVARGDKREYGPATLNVEDSSCSLFKGVDHSQVWMSHGDKLHALPTGFKVVATSDNSPFAAISNEKENIFGIQFHPEVTHTKQGKVLLRNFAIDICQASNNWTMENFIDTEIARIQKLVGPTAEVIGAVSGGVDSTVGAKIMKEAIGDRFHAIYVDNGLMRLNETEQVYKTLTEGLGINLTVVDATDLFLGKLQGVTDPEKKRKIIGNNFIHVFEAEAAKIKPASGQEIEYLLQGTLYPDVIESISFKGPSQTIKTHHNVGGLLEDMKLKLIEPLRELFKDEVRHLGEIMGVPHDLVWRHPFPGPGLAIRVLGEVTREQLKIAREADNIFIEEIRKAGLYKDISQAFAALLPVKSVGVMGDQRTYEQVIALRAIETTDFMTADWFVFEAAFLKKTASRIVNEVDGVARVTYDITSKPPATVEWE

SEQ ID NO: 64990 - protein, 495 aa, Bradyrhizobium sp. BTAi1
MIARKNVCVIGAGVSGLAAAKAFKARGHDVTIIERSADLGGVWEPARSYPDVQTQSPKELYRYTDKAMPDAYPEWPKGPQVYAYLADYARSNDLTRLTRLNTTVRSMQRRADGKPGWTLDLETGDGARREDFDFVAVCTGQFNEPQTLSLPGEDQFKAAGGAIMHSSKYNDATLAKGRNIVVLGGSKSATDIAVNAVRSGARSVTIVFREPVWRIPYFIGGLINFKRILYIRAQEQMFASWGIGPLSRLAHMLAKPFVWANWRGLESLLKAQLKLGKCNMVPKERIEDGVNCSVPIATPDFYPMVADGRIKAVLGTFDHYEPNTIVASGGERIAADVAILAIGYKLGVPFLSDTDRAKLVDPDGQYRLYRLIANPDLPDMGFVGFNSSFCTVLCADMAAHWLVRYADRQLARQPSDREMRDNIEMMLRFKRVERPAAGVYGGLCVAPYHFKHFDELLADIGATRRKRSALAEMFTPPDADAYGDFLASAPVYQAG

SEQ ID NO: 64991 - protein, 416 aa, Helicobacter pylori J99
MENSTLYIVIAGLWLAVGFGIFLKKLDMPVIIGYICTGTVLAAFFKINDFNLLSDIGEFGIVFLMFMIGIEFNFDKLKSIKQEVLVFGLLQVVLCALIAFLLGYFVLGLSPIFSLVLGMGLSLSSTAIVLKFFEDSKQLSTPMGKSAVGILIFQDIAAIPMLLILTILGSKDSHVNLLILKTLISAGIILILLLLPGKKGANLILEQAKDTRLPEIFIGTVLVIVCSAAGLSHFFGFSMSLGAFIVGMAISKSRYKINVQEEFAQLKNLFLALFFITIGMQINVSFFMEKFFVVIFLLILVMSFKTFIIYALLRFFRDAKTAIKTALSLAQIGEFSFVIFLNSGSHQLFNLQEKKGILGFLHQKNILNIAQNDIHQLLILMVVFSMLATPFILKYLESIAQFILHQKSQENEPAKK

SEQ ID NO: 64992 - protein, 348 aa, Oryza sativa Indica Group
MLDPPLGATLSVVAVKLAVAGLTSATATLTTDQRGRFWGKLHGNYIVGQPIWAAAHVQWATLLTLAKTQRSRGKQSLEQVKKRAPLIRGTVSPPLPVPGHITQPPYVGKKDASEIASEIQMHDKVSIIHMKAACELAARVLEYAGTLVKPSVTTDEIDKAVHKMIIDAGAYPSPLGYGGFPKSVCTSVNECICHGIPDSRELQDGDIINIDVTVYLNGYHGDTSKTFLCGEVDEASKRLVKVTEECMLRAISACKHGTSLKKIGRRISEHAERHGFGVVDRFVGHGVGRIFHSEPMIYHQQPALSMGSIDCDMWDDGWTAVTTDGSLAAQFEHTILITKTGAEILTKC

SEQ ID NO: 64993 - protein, 359 aa, Aspergillus nidulans FGSC A4
MSSQTPTAQNLSFVLEGIHRVKFEDRPIPKLKSPHDVIVNVKYTGICGSDVHYWDHGAIGQFVVKEPMVLGHESSGIVTQIGSAVTSLKVGDHVAMEPGIPCRRCEPCKAGKYNLCEKMAFAATPPYDGTLAKYYTLPEDFCYKLPESISLPEGALMEPLGVAVHIVRQANVTPGQTVVVFGAGPVGLLCCAVAKAFGAIRIIAVDIQKPRLDFAKKFAATATFEPSKAPATENATRMIAENDLGRGADVAIDASGVEPSVHTGIHVLRPGGTYVQGGMGRSEMNFPIMAACTKELNIKGSFRYGSGDYKLAVQLVASGQINVKELITGIVKFEDAEQAFKDVKTGKGIKTLIAGPGAA

SEQ ID NO: 64994 - protein, 519 aa, Saccharomyces cerevisiae
MLSRTRAAAPNSRIFTRSLLRLYSQAPLRVPITLPNGFTYEQPTGLFTNGEFVASKQKKTFDVINPSNEEKITTVYKAMEDDVDEAVAALKKLLKRSVYCRAGVRAKALFNLADLVEKHQETLAAIESMDNGKSLFCARGDVALVSKYLRSCGGWADKIYGNVIDTGKNHFTYSIKEPLGVCGQIIPWNFPLLMWSWKIGPALATGNTVVLKPAETTPLSALFASQLCQEAGIPAGVVNILPGSGRVVGERLSAHPDVKKIAFTGSTATGRHIMKVAADTVKKVTLELGGKSPNIVFADADLDKAVKNIAFGIFYNSGEVCCAGSRIYIQDTVYEEVLQKLKDYTESLKVGDPFDEEVFQGAQTSDKQLHKILDYVDVAKSEGARLVTGGARHGSKGYFVKPTVFADVKEDMRIVKEEVFGPIVTVSKFSTVDEVIAMANDSQYGLAAGIHTNDINKAVDVSKRVKAGTVWINTYNNFHQNVPFGGFGQSGIGREMGEAALSNYTQTKSVRIAIDKPIR

SEQ ID NO: 64995 - protein, 404 aa, Marinobacter sp. ELB17
MQNYHKSTKLDNVCYDIRGVVLREARRLEEEGHRVLKLNIGNPASFELDVPEEIQQDVIYNMHLAQGYVESKGLFSARKAVMHYCQQRGIDKVDIDDIYLGNGVSELIVMSMQAMLNTGDEVLIPAPDYPLWTAAVALSSGKPVHYHCDEQQGWFPDIDDIRRKITKRTRAIVLINPNNPTGAVYSTEVLHQVIELARAHNLIILSDEIYDKILYDGVTHVSTASLADDVLFFTYNGLSKNYRAAGYRSGWMIISGAKHKATDLVEGIEMLSNMRLCANVPAQLAIQTALGGYQSINDLVIPGGRLFEQRQAAWELLNDIPGVSCVKPQGALYLFPKLDPKRYPIVNDEKLVLDLLIQEKILLVQGSAFNVKDRQHLRVVFLPRKDTLADAVGRLGRFLEQYKQ

SEQ ID NO: 64996 - protein, 198 aa, Prochlorococcus marinus str. MIT 9215
MFLVIDNYDSFTYNLVQYLGELSVEHEITKELIVKRNDEITLEEIIKLNPSGILLSPGPGNPDQSGICLPILKKLSKNIPILGVCLGHQALAQAFGGKVIVGKELMHGKTSKIFHNQKGLFKDIETPFVATRYHSLIVDSSSLPSCFDITATLEDSTIMAISHKEYKHLHGVQFHPESVLTQFGHKLISNFLKMAEQK

SEQ ID NO: 64997 - protein, 176 aa, Triticum aestivum
  misc_feature (163)..(163): Xaa can be any naturally occurring amino acid
  misc_feature (170)..(170): Xaa can be any naturally occurring amino acid
MGPTLMASSATSVAPFQGLKSTAGLPVSRRSNGASLGSVSNGGRIRCMQVWPIEGMGGWGSLSYLPPLTHKTLLKQVDYLIRSKWVPCLEFSKVGFIFREHNASPGYYDGRYWTMWKLPMFGCTDATQVINEVEEVNKEYPDAYVRIIGFDNMRQVQCVSFIXAFKPPGXEESGKA

SEQ ID NO: 64998 - protein, 511 aa, Triticum aestivum
MESLLAALPAGGGGAVAAAAAAVGGLAAAAALAAKAGVVGTGRTNAPPAVPGLPLIGNLHQLKEKKPHKTFAKWSDIYGPIYTIKTGASSVAVLNSSEVAKEAMVAKYSSISTRKLPKALSVLTRDKTMVAISDYGDFHKMVKRLVMSAMLGSSAQRQFRDTRDMMMDNMLSTFHTLVTDDPHSPLNFREVFKDELFRLSLIQSLGEDVGSVYVKEFGREISKDEIYQITVVDMMMCAIDVDWRDFFPYLSWIPNKGFETRVRTTESRRTAVMQALIHQQKKRIARGEARASYLDFLLAEKALTDEQLMMLVWEAVIEAADTTLVTTEWAMYELAKNPEKQDRLYQEIRDVCGDETVTEDHLPRLPYLNAVFHETLRFHSPVPLVPPRFVHENTKLAGYDVPAGTELVINLYGCNMNKKDWEEPEEWRPERFVDGRFEAADMYKTMAFGAGRRSCAGSLQATTISCAAMARFVQDFAWRLKEGDEDKVDTVQLTSYKLHPLHVHLSPRGRK

SEQ ID NO: 64999 - protein, 416 aa, Alkalilimnicola ehrlichei MLHE-1
MALIVQKYGGTSVGTTERIKNVARRVQASRERGDDVVVVVSAMSGETNRLLALAEEIGPNPPAREVDVLVSTGEQVTIALLTMALESIGTPARCYTGPQVRILTDSAHSRARILDIDAKQINDDLRLGRVVVVAGFQGVDESGAITTLGRGGSDTTAVAIAAALKADECQIYTDVDGVYTTDPRVVPKARRLERITVEEMLELASLGSKVLQIRSVEFAGKYKVPLRVLSSFKEGPGTLITYEENPMEEPLISGIAFNRDEAKLTVLGAPDVPGIAASILGPISDAGIEVDMIIQNVSTSGATDFTFTVHKRDYEQALKILQDNKDKLGAREIYGDPKIVKLSLVGVGMRSHAGVASTMFKALSAEGINIQMISTSEIKISVVVDEKYLELGVRTLHTAFGLDDENAQVEVEGDNA

SEQ ID NO: 65000 - protein, 306 aa, Pseudomonas fluorescens Pf-5
MPRLLHTGQVIVDLVMAVERLPASGGDVLAQSAGFEAGGGFNVMAAAARNGLPVVYLGRHGQGRFGDLARAAMQGEGIQMSLEPGRGADTGLCVALTEASAERTFISHIGAEGELSAEDLARVRVEAGDYLYVSGYSLLQECKARALLDWLLALPRSIPLMFDPGPLAGSVDSPLMAALLPRIDIWSSNRAEALQLTGTSQIAQALAQLESWLSPAALLVLRDGPRGCWVSRQGQAVQVPGFKVEAVDSNGAGDAHAGVLVAGLAAGLEPLMAARRANAAAAIAVTRRGPATAPGSAEVDALLARG

SEQ ID NO: 65001 - protein, 374 aa, Bacteroides thetaiotaomicron VPI-5482
MTFKELNITEPILKAIEEKGYTVPTPIQEKAIPVALAKKDILGCAQTGTGKTASFAIPIIQHLHLNKGEGKRSEIKALILTPTRELALQISECIEDYSKYTRIRHGVIFGGVNQRPQVDMLHKGIDILVATPGRLLDLMNQGHIRLDNIQYFVLDEADRMLDMGFIHDIKRILPKLPKEKQTLFFSATMPDTIIALTNSLLKNPVKIYVTPKSSTVDSIKQLVYFVEKKEKSLLLISILQKSEDRSVLIFSRTKHNADKIVKILGKAGIGSQAIHGNKSQAARQSALGNFKSGKTRVMVATDIASRGIDINELPLVINYDLPDVPETYVHRIGRTGRAGNAGMALTFCSQEERKQINDIQKLTGKKLNRADFTI

SEQ ID NO: 65002 - protein, 184 aa, Acidobacteria bacterium Ellin345
MIHPWHDISPGEHIPQECNAVIEIPFGSSVKYELDKQSGMIKLDRMLYSAAYYPANYGFIPQTLAEDDDPLDILVFCQEPVVPLTIIQARTIGLMTMIDSGKADQKIIAVASKDPEFNSYNEADEMPPHRLQMLRRFFQDYKVLEGKEVEVDEIQHASAAYPIIEDALARYSKQRRKGFSKNSL

SEQ ID NO: 65003 - protein, 285 aa, Methanosarcina barkeri str. Fusaro
MNIEEWEEYRYVESGINSFIDQMDESSLKKMAEHVCNTGGKRIRPIILLLSSEICSGSYQQSLNAALAIELMHSASLIHDDLLDQGLVRRNLPSAPEKFGPSRALLCGDYLIAKCFEFISPYGEKVVRDFGKAGMDMAEGEVLDLRLDKDNFGENNYFECIYKKTASLFAISASIGAYTGGADEVLAERFNFFGNCLGTAYQIVDDILEFLEVVEGKESKFTSETLPHVYMKNMSKEEAIEKSTDAVKLRVNAAKDALLTFNECPAREKLFQITDYITVDMLEII

SEQ ID NO: 65004 - protein, 318 aa, Neisseria meningitidis FAM18
MMGFLIGLSRNLTRFTALVILLASAVAFIGPASFAWVKGDVQVLVLGIIMLGMGMTLGREDYRILAQRPLDVFIGAAAQYTVMPLLAIGIAKLFDLSPGLTLGLVLVGTCPGGVSSNIMSFLAKGDVAFSVGMTTVSTVLAPAVTPLWMTCLVGQTVDMDGWGMFRFMLLVTLLPVVLGSAANILLHGKHWFENVRAVMPGVAVLAFACIVGGVASVHGHRFAESALVMVLAIAVHNIAGYVSGYYAAALFGMDTAKKRTLAIEVGVQNAGLATGLSAKFFPGNPESAVAAAVACVWHSVSGTVLGNLFALWDKRRDA

SEQ ID NO: 65005 - protein, 502 aa, Desulfovibrio vulgaris subsp. vulgaris str. Hildenborough
MSEQFELEKTLSPMQVWALALGSIVGWGCFVLPGDMFLPQAGPVGTLTGFLIGAFLLSFVAVCYSYMVKYVPVAGGAFAYAYVGFGPTAAFICGWALVLGYIAIVCIDIAALALIFRFLFPGVFEFGPLYSIAGWQVYTGEVMLMTFGTLAFGWMNYRGVSFAGKLQVVLAYMLTIGIVALFAGTASLESAHMSNLMPMFAEHRTPLSCVLIIFAISPFLFVGFDTVPQAAEEFAFDPARSRRIMILAIFMGVILYSLVALSVAIVMPYPEMLAKMEALRASGGTAWATGDAATMAFGKFGAIVLACAVLGAVCTGINGFYIATSRLLLSMARGRILPSWFGDIHPKYRTPYKAILFTIAIVLLTPFAGRSVVVWIVDMSSVGTGIGYLFTCLAARRVLLGTPGVGNKSLSILCCNIGTLTSVMCIVLLLVPGSPAYISEASRWCMVAWVVMGFFFYYSNKSVWAQLPEMTIRSSILGSCDIPVFFKGNTSGVKAAAEAASK

SEQ ID NO: 65006 - protein, 832 aa, Oryza sativa Japonica Group
MSQASLSPSSSGDEEEEDEGVEGYRKGGYHAVRPGDPVRRRPLRRPAEARVGELLHRLARLRRPHPGFDLVCHFLLRGNSLIRYWKMLDKFFWLVMAGSFKCCDKKFVALKIQKSAPEFAQAAFHEIEFLSEITKRDPSNCKCIIQLIDHFKHAGPNGQHICLVFEFLGDSLLKLVQYNRYNGIGFGPVREICRSILIGLDYLHRELGIIHSDLKLENILLISTIDPSKDPIRSGLKPNLERPEGNPNGEVMLNPIEKKLKMRARRVLAKLAEKKKSAAEYARAERSLDGIDMTCKIVDFGNACWADKQFTDFIQTRQYRAPEVILGSGYSFPVDMWSFACIAFELATGEMLFTPKEGQGYSEDEDHLALMMEILGKIPKKIATMGTKSKEYFDRHGDLKRIRRLKFSSIERVLVDKYKISESDAREFAEFLCPLFDFAPEKRPTAAQCLQHKWLQYSDGKNYGTLNISDVKNASVTCSPGTTASSDSKSIDVTRNIGDKPDSYAERADAKCNTSKKSIINSNSENSNVQPNTASVGNRNSKIDDVNSNTGSITNKDSKNTVIKPSIGSFVNRNAETVDVKPNIGSITSRGDSSSDTKSNIGSVASKDAKTIDAKPSTSSITSQDSKIGDGRSNIDGIANRDAKTADVKHNIRSVVNTYLRNFDVKHNTGNIVDGGVKHSDLKPGTVSAANVDSKSISAKPSTGSFENSDAKSISAKTSTGSFDNSDARNIMKANTGIVANNDIKDTDVQTNTESVTSGDDLNDIDRKPNIGRVAASIQRLESSIGKVQSGKYRGCSGVSMGLVGVGRTQVPPAPTLDPPLMAFIPVLRKGY

SEQ ID NO: 65007 - protein, 377 aa, uncultured archaeon GZfos22D9
MEDIFRFADELGPAKVIHVYEPSVGLKAVLVVDNVARGPAIGGLRIAPDVSPEECFRLARAMTLKNAAADLPHGGGKSVIYGDPKMPTKEKEKLIRALASSLREIQEYIFAPDMGTDEECMAWVKDEIGRVVGLPSDFGGIPLDEIGATGWGLSHATEVALEYCDFDMEGAQVVVQGFGAVGKHTARFLTEKGAMLVGVADSRGTIYNPQGLDVLALIELKKAGKSVADYPDGKKLDRDAVINIECDIWIPAARPDVIDKNNVNLLKTKLVIEGANIPITEGAEKHLHEKGVLYVPDFIANAGGVICAAMEYQGADQSAAFHAIEEKLCRNTRLVLDEAASRGILPREAAVDLAVQRLKKSMSYRRWSLFSSAPGFV

SEQ ID NO: 65008 - protein, 163 aa, Enterococcus faecalis V583
MKKEYFIAASADVYGNVQLAKDSNIWFQSVLRGDSNTITIGEGSNIQDGTIIHVDEDAPTIVGKYVTVGHQCMLHGCKIGDGALIGMGSTILNNAIIGENSLIGAGSLVTEGKIIPPNVLAFGRPAKVIRPLTAAEIASNHTNALHYIQRAEEFRQQKYPKLT

SEQ ID NO: 65009 - protein, 294 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKKHMDSSPEFSKDPRLVKMFLYQILRGIAYCHSHRVLHRDLKPQNLLIDRRTNALKLADFGLARAFGIPVRTFTHEVVTLWYRAPEILLGTRHYSTPVDVWSVGCIFAEMVTQRPLFPGDSEIDELFKIFRVMGTPNEDTWPGVTTLPDFKSAFPKWPSKDLATIVPNLDGAGLDLLDKTSRLDPSKRITARNALEHEYFKDIGYVP

SEQ ID NO: 65010 - protein, 134 aa, Metarhizium anisopliae
MYNLNPLTKNNWRASLVPHRGNSSSNSSDSPYSGGVFFLAIHFPTDYPFKPPKVSFTTPIYHPNINSNGSICLDILRDQWSPALTISKVLLSICSMLTDPNPDDPLVPEIAHVYKTDRPRYEATAREWTRKYAV

SEQ ID NO: 65011 - protein, 402 aa, Prochlorococcus marinus str. MIT 9215
MSKLSLSSLDKTHLEGKKVLVRVDFNVPLNEDGQITDDTRIRAAIPTIEYLINHSAKVILAAHFGRPKGQVNEKMRLTPVAARLSELLGQNVALTNSCIGDEAIAQSNSLSNGDVLLLENVRFFGEEEKNDLEFAKKLASHADMYINDAFGAAHRAHASTQGVTNYLSPSVAGFLLEKELKYLQGAIDSPKRPLAAIVGGSKVSSKIGVLDSLLDKCDKIMIGGGMIFTFYKARGLDVGKSLVEEDKLKLAKDLEAKAKAKGVELLLPTDVVLADEFSPDANSKISRIDSISGNWMGLDIGPDSIKVFQNALAECKTIIWNGPMGVFEFDKFAEGTNAIATTLADLSAFSEVCTIIGGGDSVAAVEKAGLAEKMSHISTGGGASLELLEGKTLPGVAALNDA

SEQ ID NO: 65012 - protein, 400 aa, Mycobacterium avium 104
MSELLESIQSRAEQGAITDAEIFAAHVGGKLSVSLTSPLDTQRALSIAYTPGVAQVSRAIAADHRQAAHYTWANRLVAVVSDGSAVLGLGDIGPAASLPVMEGKCALFQAYGGLNAIPIVLDTKDPDEIVETLVRLRPTFGAVNLEDISAPRCFEIERRLIEALDCPVMHDDQHGTAIVVLAALMGAGKLLGRDMSSLKVVVSGAGAAGVACTNLLMAMGVSDITVLDSRGILHAGRDDMNDVKAALARRTNPAGLTGSLAEAIRGADVFLGLSGGVVPEEMIAAMAPGGIVFALSNPDPEIHPQIAAKYATVVATGRSDFPNQINNVLAFPGVFRGALEAGARRITEKMMVAAAEAIFSVVSDDLAPDRIVPSPLDTRVGDAVATAVALATEVSDAPAG

SEQ ID NO: 65013 - protein, 382 aa, Oryza sativa
MAITVSIYLVKMPIYLETRGTSRISLVVHHIRRRTHSSSSSRLRFQRGGGAEQRRGMAAAQGSGVPAALALSSGHTMPSVGLGVWRMDSPAIRDLIHSALRIGYRHFDCAADYQNEAEVGDALAEAFQTGLVKREDLFITTKLWNSDHGHVVEACKDSLKKLRLDYLDLYLIHFPVATRHTGVGTTASALGDDGVLDIDTTISLETTWHAMEDLVSMGLVRSIGISNYDIFLTRDCLAYAKIKPAVNQIETHPYFQRDCLVKFCQKHGILVTAHTPLGGSTANTEWFGSVSCLDDPVIKLTSMPVQSLAEKYGKTPAQLVLRWGLQRNTVVIPKTSKEERLQENFAVFDFAISDEDMEKMRSIDRKYRTNQPAKFWGIDLFA

SEQ ID NO: 65014 - protein, 520 aa, Glycine max
NIGGKLQTDASNGNTRVYMNGREITKIELRMLKLANVQCPRDTHFWVYEDGSYEEEGQNNIKGNIWGKASTRFICSLLSLPVPPTNPPGVKDNSTNYSTRSVPEYLEHGRVQKLLLFGMEGSGTATLFKQAKFLYGNKFSAEESQNIKLMIQSNMYKYLSILLEGREQFEEEALAERESTSLEGEGSGQETAADEKKPSIYSINQRFKHFSDWLLDIMATGDLEAFFPAATREYAPMVDEIWRDPAVQETYKRRKELHNLPNVAKYFLDRAIEISSNEYEPSDKDILYAEGVTQSNGLAFMEFSFDDRSPMSEIYSENSNYPPPLTKYQLIRVNSKGLHDGCKWLEMFEDVRAIIFCVSLSDYDQMWPTSTGQLRNKLLASKDLFESLVKHPCFKDTPFVLLLNKYDVFEDKINKVPLSICEWFGDFCPVRPHHNNHALAHQAYYYVAMRFKELYYSLTGQKLFVGQTRGRDRTSVDEAFKYIREIIKWDDEKDEDVYEINPEESFYSTEMSSSPFIRQE

SEQ ID NO: 65015 - protein, 461 aa, Shewanella oneidensis MR-1
MRNLLDFDFDSAHIWHPYTSMTRALPVFGVHSAQGCELELVDGRKLIDGTSSWWACVHGYGHPAILTAMEQQLHQLSHVMFGGITHEPAIELCKKLLAMTCEPLTKVFLCDSGSIAVEVAIKMALQYWQGQDLPLAQKAQKQRILTVKKGYHGDTFAAMSVCDPEGGMHTMFGEAVIKQCFVDAPQTPFGESLHQDDLAPMQRILREQHQDIAAVIIEPIMQGAGGMRFYSSEYLRGLRALCDEYNVLLILDEIATGFGRTGKLFAYEHTDITPDILCLGKALTGGYISLAATLCTDNVAQGISQSPAGVFMHGPTFMGNPLACAAACASLDLINQQEWPAQVAAIEQQMQRELADAIDIPSVKAVRVLGAVGVLEMHQAVNTAALQQQFVDLGVWVRPFANLIYIMPPYVISSAQLSQLTQAMKQVAATITPPNITPPNTTPELASQGWHTDQNISISHG

SEQ ID NO: 65016 - protein, 892 aa, Arabidopsis thaliana
MDSPCWLLLLLLGAFAIIGCVQAQDQQEFISLDCGLPMTEPSSYTESVTGLRFSSDAEFIQTGESGKIQASMENDYLKPYTRLRYFPEERRNCYSLSVDKNRKYLIRARFIYGNYDGRNSNPIFELHLGPNLWATIDLQKFVNGTMEEILHTPTSNSLNVCLVKTGTTTPLISALELRPLGNNSYLTDGSLNLFVRIYLNKTDGFLRYPDDIYDRRWHNYFMVDDWTQIFTTLEVTNDNNYEPPKKALAAAATPSNASAPLTISWPPDNPGDQYYLYSHFSEIQDLQTNDTREFDILWDGAVVEEGFIPPKLGVTTIHNLSPVTCKGENCIYQLIKTSRSTLPSLLNALEIYTVIQFPRNQLHLLILTSLSSTSVVAVKNIEAAYKLSRIRWQGDPCVPQKYAWDGLNCSNNTDVSKPPRVLSLNLSSSGLTGIIAAAIQNLTHLEKLDLSNNTLTGVVPEFLAQMKSLVIINLSGNNLSGPLPQGLRREGLELLVQGNPRLCLSGSCTEKNSKKKFPVVIVASVASVAIIVAVLVIIFVLSKKKSSTVGALQPPLSMPMVHDNSPEPSIETKKRRFTYSEVIKMTNNFQRVVGEGGFGVVCHGTINGSEQVAVKVLSQSSSQGYKHFKAEVDLLLRVHHTNLVSLVGYCDERDHLALIYEFLPKGDLRQHLSGKSGGSFINWGNRLRIALEAALGLEYLHSGCTPPIVHRDIKTTNILLDEQLKAKLADFGLSRSFPIGGETHISTVVAGTPGYLDPEYYQTTRLGEKSDVYSFGIVLLEIITNQPVIDQSRSKSHISQWVGFELTRGDITKIMDPNLNGDYESRSVWRVLELAMSCANPSSVNRPNMSQVANELKECLVSENLRENMNMDSQNSLKVSMSFDTELFPRAR

SEQ ID NO: 65017 - protein, 655 aa, Pseudomonas putida KT2440
MVEWALFPQWGKLPRLHTPITTRLMPTTFQEIPRERPVTPLLDRADTPAGLRRLAEADLETLADELRQELLYTVGQTGGHFGAGLGVIELTIALHYVFDTPDDRLVWDVGHQAYPHKILTGRRNRMLSLRQKDGIAAFPRRSESEYDTFGVGHSSTSISAALGMAIAARLQNSARKSIAVIGDGALTAGMAFEALNHAQEVNADMLVILNDNDMSISRNVGGLSNYLAKILSSRTYASMREGSKKVLSRLPGAWEIARRTEEYAKGMLVPGTLFEELGWNYIGPIDGHDLPTMIATLRNMRDLKGPQFLHVVTKKGKGFAPAEIDPIGYHAITKLEPADKPAAPKKASGPKYSAVFGQWLCDMAAADNRLVGITPAMKEGSDLVDFSERYPERYFDVAIAEQHAVTLAAGMACEGSKPVVAIYSTFLQRAYDQLIHDVAVQNLDVLFAIDRAGLVGEDGPTHAGSYDLSYLRCIPGMLVMTPSDENELRKMLSTGHLYNGPAAVRYPRGTGPNAPISGDLQPLEIGKGVVRRQGEKVALLVFGVQLAEAMQVAEQINATVVDMRFVKPLDEALVLELAGSHELLVTIEENAIMGGAGAAVGEFLASQAVLKPLLHLGLPDIYVEHAKPAQMLAECGLDAAGIEASVKARMARLGL

SEQ ID NO: 65018 - protein, 293 aa, Nicotiana tabacum
MDQYEKVEKIGEGTYGVVYKARDRVTNETIALKKIRLEQEDEGVPSTAIREISLLKEMQHANIVRLQDVVHSEKRLYLVFEYLDLDLKNTWITTPEFSEDPRLVKMFLYQILRGIAYCHSHRVLHRDLKPQNLLIDRRTNALKLADFGLARAFGIPVRTFTHEVVTLWYRAPEILLGSRHYSTPVDVWSVGCIFAEMVTQRPLFPGDSEIDELSRFRVMGTPNEDTWPGVTTLPDFKSAFPKWPSKDLATIVPNLDGAGLDLLDKIVRLDPSKRITARNALEHEYFKDIGYVP

SEQ ID NO: 65019 - protein, 148 aa, Zea mays
MASTAISSVIVGTSFLRRQTSPISLRSLPLANTQTLFGLKSGTARGGRVTAMATYKVKFITPEGEQEVECDDDVYVLDAAEEAGIDLPYSCRAGSCSSCAGKVVSGFVDQSDQSFLDDDQIAAGFVLTCAAYPTSDVTIETHREDDIV

SEQ ID NO: 65020 - protein, 306 aa, Physcomitrella patens subsp. patens
MVSIWETERPPSVQDYYLVCYFALAFPVARFLLDCFLYQVLVAFCLHIMFFEMKLKGLKNGAREAGEKKIPKFTESAWKLTYYLATEVFVIFITYKEAWFGNTSAFWHGWPYQTVKFQLTLFYTFQCGFYIYSVAALLFWETRRKDFDVMMTHHIVTIGLIAYSYITGCRSFRAGSIVLALHDVSDVFMEAAKLCKYSGSEVGASVSFGLFVLSWVLLRLIYFPFWIIWSTSYEVINYVDLSQFYVSFQYYVFNMLLITLLVIHCYWWVLILRMVIKQLRNSGKVGEDVRSGPSHIHIMFLLSKQL

SEQ ID NO: 65021 - protein, 364 aa, Oryza sativa Indica Group
MGAKKHTLQVLPWLLLFAQHTAASACDCANTTDGADRQGAMKLKLIAIASILAAGAAGVLVPVIGRSMAALRPDGDIFFAVKAFAAGVILATGMVHILPAAFDALTSPCLKRSGGDRNPFPFAGLVSMSAAVATMVVDSLAAGYYHRSQFRKARPVDNINIHKHAGDESTEHAQHINAHTHGAHTHSHGDIVVHGSPEEGSVAESIRHKVVSQVLELGILVHSVIIGVSLGASVRPSTIRPLVGALSFHQFFEGVGLGGCIVQANFKVRSTVIMAIFFSLTAPVGIVLGIAISSSYNVHSSTAFVVEGVFNSASAGILIYMSLVDLLATDFNNPKLQINTKLQLMAYLALFLGAGLMSMLAIWA

SEQ ID NO: 65022 - protein, 599 aa, Bradyrhizobium sp. BTAi1
MRATDISAPDYFHKVVDCQWACPAHTPVPEYIRLIAEGRYSDAYMINWKSNVFPGILGRTCDRPCEPACRRGRVEESPVAICRLKRVAADFKDDVQQRMPRPAPKNSRRIALVGGGPASLTVARDLAPLGYHCTVFDADPRPGGMMRSQIPKFRLPDSVIDEETGYVLSLGVDYKAGHRIDSLKKLLAENYDAIFIGSGAPRGRELNIPGRKEAAANIHLGIDWLSGVSFGHTDKIGKRVIVLGGGNTAMDCCRTARRLGGEDVKVIVRSGFEEMKASPWEKEDALHEDIPILNYLVPVAFTHDNGKLTGVTFQKVKAVYDDKGDRLLVPSGEPDVTYDCDDVLVAVGQENAFPWIEADCGIEFDKRHMPKVDPTTFVSTNPKVFFGGDAAFGPKNIIWAVAQGHEAALSIHRLLSGEDITERPLPEVHISSQKMGIHEWSYDNDVSPEKRYKVPHRDKVVALKDIRTEVELGYDVKLALGEAHRCLNCDVQTVFSNTLCIECDACADICPMDCITFTDNGEEADLRSRLRAPSVHPDQSLYVSSDLKTGRVMVKDEDVCLHCGLCAERCPTGAWDMQKYFIETTHAGHACPSKRRSAA

SEQ ID NO: 65023 - protein, 334 aa, Streptococcus pyogenes M49 591
MYQALYRKYRSQTFDEMVGQSVISTTLKQAVESGKISHAYLFSGPRGTGKTSAAKIFAKAMNCPNQVDGEPCNQCDICRDITNGSLEDVIEIDAASNNGVDEIRDIRDKSTYAPSRATYKVYIIDEVHMLSTGAFNALLKTLEEPTENVVFILATTELHKIPATILSRVQRFEFKAIKQKAIREHLAWVLDKEGIAYEVDALNLIARRAEGGMRDALSILDQALSLSPDNQVTIAIAEEITGSISILALGDYVRYVSQEQATQALAALETIYDSGKSMSRFATDLLTYLRDLLVVKAGGDNQRQSAVFDTNLSLSIDRIFQMITVVTSHLPEIK

SEQ ID NO: 65024 - protein, 315 aa, Zea mays
THAHTHFSKNPSRSHRRLLLPHHIPFPFARPAPPPSSRPLASSPPRTHARARARSLSRPAAAYTPTSSGPLASPLSAPTSTVPLLSARRSRRRGLAALLVVDALRRSVLESLAALKRPALALLLAGVLLAAASAGGPHAAALAASGGRVGGSAFSSRSSSPPSYGYSAPAPRGGYTAAPYYSPSPFVSFGPALGIGFGGSGFLVTLMGFAAFLYLAWTRTRRRRTVPPRGATEGRPAMARRWGCRWGSTGLGRRQRVRPCRWTWAGWAEAGEEDPDASTTDDADARGRRAAAGRPARARQWGCRRGSPDRGGDRG

SEQ ID NO: 65025 - protein, 503 aa, Plantago major
MGELSGIENGNKAIGEEAIPVWKFVLVASLAAGIQFGWALQLSLLTPYIQMLGLPHGAASFIWLCGPVSGLLVQPLAGYFSDRCKSRFGRRRPFIMSGACLVAAAVILIGFAADIGHSAGDDMTKKTKPRAVVVFVVGFWILDVANNMLQGPCRAFLADLSAGDEKKMTHAMSFFAFFMGIGNVLGYAAGSYNNLHRLLPFTRTDACEIFCANLKTCFLIHICLLMCLTITALSVVKEPLVNVVDDERKGGSLMVFVELFGALKNLSKPMWILMLVTCLNWIAWFPFLLYDTDWMGREVYGGKVNQSVYDMGVRAGAIGLMLNSVVLGITSILLYFFSKGAKAAKTWWLGVNIVLAVGLAGTVWVSYHAKSVRQLGASGEALPPSFEVKASALAIFAILGIPLAVTFSVPFALAAIYCSRNTNTGGAGQGLSLGVMNLSIVIPQIIVSLSSGPLDKAFGGGNLPAFIMGAVGAVFSGVLAFILLPAPKVDNGVNPFAVGGGGH

SEQ ID NO: 65026 - protein, 430 aa, Prochlorococcus marinus str. MIT 9215
MKETIDFLIDTIEARQVLDSRGNPTVEAEVFLECGASGIAIVPSGASTGAHEAHELRDGGSKYMGKGVLSAVNKIHETISPALCGLSALDQTAVDKLMTEIDGTLNKSNLGANSILAVSLATARASANALDIPLYRYLGDPLSNLLPVPLMNVINGGAHAPNSLDFQEFMLVPHGVNNFSESLRMGTEIFHSLKSLLDQKGLSTAVGDEGGFAPNLSSSEEAGDLLLEAIQKAGFKPGEQVSLALDAASTEFYNDGIYKYEGKSLNSSEMISYLSRLVSNYPIVSIEDGLAEDDWEGWSELNKELGDKVQLVGDDLFVTNTERLRKGIMEKSANSILIKVNQIGTLTETLEAIELAKMSGFTSVISHRSGETEDTTIADLSVATRSGQIKTGSLSRSERIAKYNRLLKIEEELGNQARFAGALGLGPKNI

SEQ ID NO: 65027 - protein, 765 aa, Bartonella henselae str. Houston-1
MKKNEQDQKTHQTVYNISEREALDFHSRGRPGKLEIVATKSMATQYDLALAYSPGVAVPVKAIAQNPELAYDYTTKGNLVAVISNGTAILGLGNLGALASKPVMEGKAVLFKRFADIDSIDLEIDTNDPENFINLVRHLEPSFGGINLEDIKAPECFMIESRLREVMNIPVFHDDQHGTAIIVAAGVLNALYLTGRDMENTRLVCNGAGSAGIACIELIKAMGFRSENIILCDTKGVVYEGRKEGMNQWKSVHAVRTDKRTLAEAMEGADVFFGVSAKGAITPEMVKSMAPRPIIFAMANPDPEITPEEVMQVRKDAIIATGRSDYPNQINNVLCFPYIFRGALDVRATVINEDMKIAAARAIADLAHEEVPDSVAEAYRGKRLKFGPNYIIPVPFDPRLFTVVSIAVAKAAMKSGVAQRHIDDLEAYERDLNARRDPISSMMRGVYNHVRQSPKQIVFAEGEEEQVMRAAVSYVHQKLGQAILIGREEQVRENAAIAGIDLEREGISVMNAKLSCRLDAYANYLYKKMQRQGWLLRDCHRRINNDRNYFAACMVALGDADAMVTGVTRNYETALIDIRRVIDEKPRERLIGISMAICRGRTVFIADTAVYENPNAEEFAHIAEQTASFVRGLGYQPRVAFVAFSTFGYMKGQVTRHIQDAVNILRERRADFEFDGEISADVALNVKLMQQYPFMGLTEPANILVMPGYHASSIASKMLQELGEATIIGPILIGLERSVQIVPFSGSDTDVVNIATLAAYHAEKL

SEQ ID NO: 65028 - protein, 112 aa, Triticum aestivum
  misc_feature (48)..(48): Xaa can be any naturally occurring amino acid
  misc_feature (64)..(64): Xaa can be any naturally occurring amino acid
  misc_feature (79)..(79): Xaa can be any naturally occurring amino acid
  misc_feature (89)..(89): Xaa can be any naturally occurring amino acid
  misc_feature (95)..(95): Xaa can be any naturally occurring amino acid
MDANRRQGGIQQLLAAEQEAQQIVNAARAAKSARLRQAKEEAEREIAXEYRAQMEAGFQRKVAXESSGDSWVRTSKLSXERDNGENPTXKPAGAXLPQIHPRSSGEFTTVKN

SEQ ID NO: 65029 - protein, 429 aa, Rhodopseudomonas palustris CGA009
MTVEVSKLPSGLTIVTDTMPHLETAALGVWTGVGGRDEKPDEHGISHLLEHMAFKGTTRRTSREIAEEIEAVGGDLNAGTSTETTAYYARVMKADVPLALDVLSDILANPSFEAEELEREKSVIVQEIGAAQDTPDDVVFEYLNELCYPEQPIGRSLLGTAKTLKSFSREKLQSYLSTHYRGPDMVVAAAGAVDHARIVEEVSHRFASFDGTPAPKPQPAMFGAGGSRVVHRDLEQAHLTLALEGLPQSAPTLFSLQVFTNILGGGMSSRLFQEVREKRGLCYSIYTFHAPYSDTGFFGLYTGTDPADAPEMMEVIVDVINDAVDTLTDAEISRAKAQMKAGLLMALESCSSRAEQLARHILAYGRPLPVDELVGRIDAVTIDTAREAGRTLLARSRPAVVALGSGRGLDRAVSFAEGLTQSKAKTSYH

SEQ ID NO: 65030 - protein, 485 aa, Oceanicola granulosus HTCC2516
MRDATPTASHYVDGAYLEDAEGAAIEVIYPATGARIATVHSASGQVVEAALAAATRAQPAWAALPGVERGRVLRRAADILRARNRELSELETLDTGKPLSETLVADATSAADALEYFGGLAAAITGEHIPLADGDFVYTRREALGVCVGIGAWNYPTQIAAWKAAPALACGNTMVFKPSETTPLCALKLAEILTEAGAPPGVFNVVNGLGDVGAALVADGRVAKVSLTGSVPTGRKVYAAAAQGMKHATMELGGKSPLVIFDDADLESAISAAINGNFYSTGQICSNGTRVFVQSGIKEAFLERLAERTANATLGDPLDEATTLGPMVSAAQLEIVLDYVARGRAEGARLVTGGARVEREGFWIEPTVFADVTDDMTIAREEIFGPVMTVLDFETEDEALARANATEYGLAAGVFTADLTRAHRMAAGFEAGTTWINTYNLTPVEAPFGGSKMSGVGRENSAAAIAHWSELKSVYVSLNPTEAPF

SEQ ID NO: 65031 - protein, 401 aa, Bartonella henselae str. Houston-1
MNSTTIQPLYECFARRNLHFEQGNAVWLISDKGERYLDFTSGIAVNVLGYAHPKLIDTLKRQAEKLWHVSNLFQSPEQEALAAQLCVNSFADKVFFCNSGAEAVECAFKTARHYHYASGHPTRFEIITFEDAFHGRTLATLAATGQEKYLQGFGPKADGFIQIPLCDEIALRNAINKNTAAILIEPIQGEGGIRTVSHEYLRLLRKICDENGLLLILDEIQTGIGRTGKLFAYEWSGITPDILTLAKGLGGGFPLGACLATEKAAKSMTPGTHGSTFGGNLLGMAVGKTVLDIILEPGLLDHVQQMGYKLKSGLSNILNDYPDIICAINGVGLMLGIQCVVPSQVVVSALESEYLLSVSANNNVVRFLPPLIIKEEEVNESLHRIEKAIASLSQTNKKQLV

SEQ ID NO: 65032 - protein, 480 aa, Triticum aestivum
MASTAAPPAALVARRAASASVAAPLRGAGLAAGCQPARSLAFAAGADPRLAVHVASRCRAASAARGTRAVATMAKKSVGDLTAADLEGKRVLVRADLNVPLDDNQNITDDTRIRAAIPTIKYLLSNGAKVILTSHLGRPKGVTPKFSLAPLVPRLSELLGIEVKKAEDVIGPEVEKLVADLANGAVLLLENVRFYKEEEKNDPEFAKKLASLADLFVNDAFGTAHRAHASTEGVTKFLKPSVAGFLLQKELDYLDGAVSNPKRPFAAIVGGSKVSSKIGVIESLLEKCDILLLGGGMIFTFYKAQGLSVGSSLVEEDKLELATSLLAKAKAKGVSLLLPSDVIIADKFAPDANSQTVPASAIPDGWMGLDIGPDSVKTFNDALDTTQTIIWNGPMGVFEFDKFAVGTESIAKKLAELSKKGVTTIIGGGDSVAAVEKVGVADVMSHISTGGGASLELLEGKELPGVVALDEGVMTRSVTV

SEQ ID NO: 65033 - protein, 387 aa, Xylella fastidiosa Dixon
MNFHEYQAKQLFAEYGIPVPAGRIASSADEAVTAAKSLGNGPWMVKAQIHAGGRGKAGGVKFCKTTDEVKQAAATMLGTKMATYQSAGVALPVNLVLVTEAGEITKELYLSVLVDRGTRSITYIASSEGGVDIEHVAAETPEKIQTLNVDFVEGLQPYQGRDIGFHLGLEAKQVNQLSKIMISLYQLFNDKDLSLIELNPLAILSNGDLYALDGKINSDDNATFRHKELAAMRDKTQEDETEVLASENDLNYVTMDGNIGCMVNGAGLAMATMDVIKLNGGEPANFLDVGGGATKERVTTAFKLILSSNKVKAIFVNIFGGIVRCDMIAEGIIAAVKEVGVKVPVIVRLEGTNVDAGKQLLATSGLAIIPADDINDGAKKAVAAVTA

SEQ ID NO: 65034 - protein, 521 aa, Pycnoporus cinnabarinus
MISMGFRLFSLFVAIAAISGTLAAIGPKADLVISDAVVNPDGTPRAAVVVNGAFPGPLISGKKGDHFQLNVINKLTNHTMLKTTSIHWHGLFQEHTNWADGPAFVNQCPIASGHSFLYDFHVPDQAGTYWYHSHLSTQYCDGLRGPLVVYDPHDPQAHLYDVDNDDTVITLADWYHVAAKLGPQFPRGANSTLINGLGRAATDSTSDLTVIAVEHGKRYRFRLVSISCDPNHTFSIDGHNMTIIEVEGVNSKPLTVDSIQIFAAQRYSFVLNANQPVDNYWIRANPSGGTVGFEGGINSAILRYKGAPDAEPTNPTAPTSVIPLVETNLHPLKPMQVPGRSGIGNVDYAKTLNFNFNGTNFFINNATFTPPTVPVLLQILSGAHNAQDLLPAGSVYTLPPHSAIEITMPATTLAPGSPHPFHLHGHVFAVVRSAGSTEYNYHGPIFRDVVSTGLPGDSVTIRFMTDNPGPWFLHCHIDFHLEAGFAIVFAEDVNGIKYANPVPPSWAELCPIYDKLPESDH

SEQ ID NO: 65035 - protein, 341 aa, Solibacter usitatus Ellin6076
MKALVKSKSQPGLWLEEIPEPAIGINDVLIRVLRTGICGTDVHIYKWDEWARETIHVPMAIGHEFVGRIEAVGSNVADFFPGDIVSGEGHVVCGRCRNCFAGRRHLCAKTMGVGVNRPGAFAEYIALPMTNIWRHHEGIDLDVAAIFDPFGNAVHTALSFPVLGEDVLITGAGPIGIMAAAVARHAAARYTVITDLNPYRLELAAKLGVTRAVNVREQKLGDVQKELGMTEGFDVGLEMSGNPAGFRDMLANMSHGAKIAMLGIPAGEMAIDWRTVIFNMLTIKGIYGREMYETWYKMSVMLQSGLDISPVITHRYHYTDFEKGFEVMSSGNSGKVILSWD

SEQ ID NO: 65036 - protein, 365 aa, Ipomoea batatas
MVGGGDFLAVQTHGGQYVQYDIFGNLFEVTSKYAPPITPIGRGAYGIVCSALNAETNEMVAIKKIADAFDNYMDAKRTLREIKLLRHLEHENVIAIKDVIPPPLRREFNDVYIATELMDTDLHQIIRSNQGLSEEHCQYFLYQILRGLKYIHSANVIHRDLKPSNLLLNSNCDLKICDFGLARTNLDNEFMTEYVVTRWYRAPELLLNSSDYTAAIDVWSVGCIFMELMNRKPLFQGKDHVHQMRLITELLGTPTDSDLGSIQNENARRYIRQLPLRPRQQLANGFPHVHPLAIDLMDKMLTFNPSKRITVEEALAHPYLAQLHDKSDEPICPVPFTDFEKQAYGEEQIKDMIYQEALAMNPGYA

SEQ ID NO: 65037 - protein, 507 aa, Bradyrhizobium sp. BTAi1
MTPLHPHQPPHQKPDACAFVIFGVTGDLTHRLVLPSLYNLAAGNLLPDRFCIVGIARKGMSSEQLRVNLMEGLRKYATRPVEDEIAQRLLQCVTAIEADPKEPDSFDQLKERLEKLEAARETHGNRLFYLATPPAAFAPIAQQLGRVGLLKEDGKAWRRLVVEKPFGTDLASAKKLNDQLLELVTEHQIYRIDHYLGKETVQNILVLRFANGMFEPIWNRHHIDHVQITVEEKLGVGTRGSFYDATGALRDMVPNHLFQLLSLVAMEPPARFDAHTVRSEKAEVLSAIQPLSEQEALLNSVRGQYKAGLVGDTELPDYRNTKDVSADSATETYAALKLTIDNWRWAGVPFYLRTGKALGAKRTEVAIKFRQAPFAMFSCTPIDTLAENYLVIGIEPTQSITLQFNTKIPGPTIRTDGVQMKFNYKDYFQAEPATGYETLIYDCMIGDNILFQRADSVEAGWKAVEPFIEAWKKAGRDGLHTYEAGSEGPKAAADLLARDGRSWRKLA

SEQ ID NO: 65038 - protein, 215 aa, Propionibacterium acnes KPA171202
MSGTQRRGGGAGGERRGRDNRRGQNDRNRNQNEYLERVVAINRVAKVVQGGRRFSFTALVVVGDGEGSVGVGYGKAKEVPAAIAKAVEEAKKHFFKVPLVGRTITHPVIGEKAAGVVMLRPASPGTGVIAGGSARAVLECAGVHDVLAKSLGSSNAINVVHATVDALQQLEEPEEVARRRGKSVEDIAPAAMLRARKEADEAAAAARMEEKAGVN

SEQ ID NO: 65039 - protein, 282 aa, Chlamydomonas reinhardtii
MQLCKVQRASAARSSRASRSQRVEVVCASSAKFFVGGNWKCNGSVANVAKLVDELNAGTIPRGVDVVVAPPFIYIDYVMQHLDRDKYQLSAQNAWIGGNGAFTGEVSAEQLTDFGVPWVILGHSERRSLFGESNEVVAKKTSHALAAGLGVIACIGETLEQRNSGSVFKVLDAQMDALVDEVKDWTKVVLAYEPVWAIGTGVVASPEQAQEVHAYLRQYCAKKLGAAVADKLRIIYGGSVSDTNCKDLSKQEDIDGFLVGGASLKGAAFVTICNAAGPKAKP

SEQ ID NO: 65040 - protein, 550 aa, Prochlorococcus marinus str. MIT 9215
MKIINGFHLKNLRGDILGGITAAVVALPLALAFGNAALGPGGAIYGLYGAVVVGFLAALFGGTPAQVSGPTGPMSVTVAGVVAGLAAVGVPRDLSAGQILPLVMAAVVIGGLLQILFGVLKLGKFITLVPYSVVSGFMSGIGVIIIALQIGPLLGISTRGGVVESLSTVFSNFQPNGAAIGVAIMTLGIVFLTPRKISQWVPSPLLSLLIVTPISILIFGDGAIERIGEIPRGVPSLNFPSFNQYFPIIFKAGLVLAVLGAIDSLLTSLVADNISQTKHNSDKELIGQGIGNAVAGLFSGLPGAGATMRTVINVKSGGSTPISGMVHSIVLLIVLVGAGPLAEQIPTALLAGILIKVGLDIIDWGFLRRAHKLSLKTSVVMYGVLLMTVFWDLIWAVLVGVFIANMLTIDSITETQLEGMDEDNPLSKDDQAKNELPADEKALLDRCSGEVMLFRLKGPLSFGAAKGISERMMLVRNYKVLILDITDVPRLGVTATLAIEDMMQEAKNNSRKAFVAGANEKVKDRLAKFGVEGIIETRKEALETALNEIA

SEQ ID NO: 65041 - protein, 158 aa, Picea abies
VAWSRDGSRLACSTMDGTIAIFDVPRAKFLYNLEGHYMPVRSLVFSPTDSRILFSASDDKHIHMYDVDNKSLICAMSGHASWVLSIDVSPDGLAVATGSSDRTVRLWDLSMRSSVQTMTNHTDQVWGVAFRPTGSPGSRAGRLASVSDDKSISLYDFT

SEQ ID NO: 65042 - protein, 591 aa, Nicotiana tabacum
MESALKEQRGGESVLDLSPRATPAGGVEDVYGEDCATEDQLITPWTIAVSSGYNLLRDPRYNKGLAFTERERDAHYLRGLLPPVISTQELQEKKIMQSLRQYDVPLHKYVAMMELEERNERLFYKLLIDNVEELLPIVYTPTVGEACQKYGSIFKRPQGLYISLKEKGRILEVLKNWPERSIQVIVVTDGERILGLGDLGCQGMGIPVGKLALYTALGGVRPSACLPITIDVGTNNEQLLKDEFYIGLRQKRATGQEYYDFLHEFMSAVKQNYGEKILVQFEDFANHNAFELLAKYGTTHLVFNDDIQGTASVVLAGLIASLKLLGGSLADHTFLFLGAGEAGTGIAELIALEISKKTKYPVEETRKKIWLVDSKGLIVSGRKETLQSFKKPWAHEHEPVNNLLDAVKAIKPTVLIGTSGVGRTFTKEVIEAMASTNERPLIMALSNPTSQAECTAEEAYTWSEGRAVFASGSPFPSFEYNGKLNIPGQANNCYIFPGFGFGLVMSGTIRVHDDMLLAASEALAAQVTEEHFAKGMIYPPFADIRKISAHIAASVAAKAYELVVATRLPRPANLVKYAESCMYTPNYRSYR

SEQ ID NO: 65043 - protein, 176 aa, Arabidopsis thaliana
MACEVDTDLSKAGDSTGFNPPLPKKPKINAEKTDLDAMVLPGLCPAGDRMLRYGKLSDPEYVRQRQVFDDQFEDSEGFDVEWDSFDYKFFAMKFEWAGEGDLDYTRSNLELRTLLIDAAMRDHDDDYDTKLEFVDYVSANVMPCKGYMFYITFWAKDLSSPNPEPKLYQAKMRKFF

SEQ ID NO: 65044 - protein, 472 aa, Oceanobacter sp. RED65
MAKRLNNDFQFLDVGRGDPAKKDINTRKSQFVEIYEPFDQTQAADQSHRCLACGNPYCEWKCPVHNFIPNWLKLASEGNIMEAVELSHQTNTLPEVCGRVCPQDRLCEGACTLNDGFGAVTIGNVEKYITDTAFAMGWRPDMSKVTMTDKKVAIIGAGPAGLGAADVLVRNGVKPVVFDKYPEIGGLLTFGIPEFKLEKSVMARRREVFEGMGVEFRLNTEVGKDVEFADIEKEYDAVFLGMGTYNYMKGGFPGEDLPGVYDALDFLIANVNHNQGWEKNTEDFIDMKGKRVVVLGGGDTAMDCNRSSIRQGATSVTCAYRRDEENMPGSKREVVNAREEGVNFLFNRQPVAIVGDGKVEGVKVITTQLGEPDENGRRRPEPIEGSEEVLPADAVLVAFGFRPSPAPWFEKFGIELNSWDGVVAPEEQEFKFQTANEKIFAGGDMVRGSDLVVTAIWEGRQAAEGILDFLDV

SEQ ID NO: 65045 - protein, 728 aa, Oryza sativa
  misc_feature (80)..(80): Xaa can be any naturally occurring amino acid
MEPWTRCSCCLTESGSLPSACFTNSRKSRPLPKSHQRLHPKSIHESLPHSNCLPPPSKSNLSSPLRRFRHALSTPRSILXPPIRSNPQLGSTNCKGLGVDWSMGLRSPNSMLWLALLVWAALLCGSCHGRFVVEKNSLKVTSPSDMKGTYECAIGNFGVPQYGGTMVGVVAYPKANKKACKSFDDFDISYKAKPGSLPTFLLVDRGDCFFTKKAWNAQNAGAAAILVADDKTEPLITMDTPEESGNTDYLENITIPSALITKSFGDKLKKAIDNGDMVNVNLDWRESLPHPDERVEYEFWTNSNDECGPKCDSQIDFVKSFKGAAQVLEKKGYTQFTPHYITWYCPDSFILSKQCKSQCINHGRYCAPDPEQDFSKGYDGKDVVVQNLRQVCVYKVAKEHGKPWLWWDYVTDFAIRCPMKEKKYTKECADGVIKSLGLDHKAIDKCIGDPDADKENPVLKAEQDAQIGKGSRGDVTILPTLVINNRQYRGKLDKGAVLKAICAGFRETTEPAVCLSEDIQTNECLENNGGCWQDKAANISACKDTFRGRVCECPVVKGVKFVGDGYTHCEASGSGHCEINNGGCWKDSRHGRTYSACTNDGCKCPDGFKGDGVHKCEDIDECKERTACQCKECKCKNTWGSYECGCSGGLLYMKEHDTCISKNAATEVGWNFLWVIFFGLVVAGIAGYAVYKYRIRRYMDSEIRAIMAQYMPLDNQGDVPNHSHHIEL

SEQ ID NO: 65046 - protein, 126 aa, Debaryomyces hansenii CBS767
MSAPNPKAFPLADSALTQQILDVVQQSQNLRQLKKGANEATKTLNRGISEFIIMAADTEPIEILLHLPLLCEDKNVPYVFVPSKTALGRACGVSRPVIAASVTTNEASAMKNQIYGIKDKIETLLI

SEQ ID NO: 65047 - protein, 282 aa, uncultured archaeon GZfos23H9
MNAKEEEERKRGMKEEAEAVDTSMRRVKHKVMVMSGKGGVGKTTVAANLAFALAMSGLDVGLMDADIHGPDIPKILGIEDKRPETSGEKMSPILVTPRLKAMSIGFLLPDRDSPIIWRGPMKMNAIRQFLSDVDWGELDYMIVDLPPGTGDEPLSVAQLIKDVDGAIIVTTPQDLALLDSRKAVNFSGVLKVPVIGIIENMSGFVCPYCGKETNIFKYGGGERAAAELGVPFLGRVPLDAQMVEAADSGTPFVMQKESKVKDAFGQIVENVQAFVEGKEEKK

SEQ ID NO: 65048 - protein, 214 aa, Aspergillus nidulans FGSC A4
MSQHTASTSPDASSTTQVAGHPSSATSRAAELASLKVKLRGALRQFPDFPSPGILFEDILPIFSDHSTHEALVRCLELHILETLADEKPDVIVGLEARGFLMGPSLALKLGAGFVPVRKRGKLPGPCETQGYEKEYGQDFFQMQSDAIKPGQKVIVIDDIIATGGSAYAAGELIKKMGGNVLGFVFLLELEFLHGRDKLSAPVHTLLTGQETKA

SEQ ID NO: 65049 - protein, 139 aa, Zea mays
MESAVNPKAYPLADAQLTIGIIDIIQQAANYKQLKKGANEATKTLNRGISEFVVMAADTEPLEILLHLPLLAEDKNVPYVFVPSKQALGRACGVTRPVIACSVTSNEGSQLKQQIQGLKVLRVRLVAMTGRDETRRFLK

SEQ ID NO: 65050 - protein, 282 aa, Mycobacterium avium 104
MSKVPTIELNDGARIPQLGFGVYQIKPDETAAAVRAALDIGYRHIDTAEMYGNEREVAQGIRDAGLDRSEVFVTSKLNNGFHEPDAARRAFDATLKALGSDYVDLFLIHWPLPTLYGGDFVSTWRVLEEFARDGRARSIGVSNFQVPHLERLATETDTVPAVNQVEVHPYFTNEKVRGYAREHGIAIEAWSPIAQGDVLGDAVINRIADGLGRTAAPVVLRWHIQRGDIVFPKTVNPDRMKSNFELFDFELDERAMEAISALDRGESGRRGPNPDTFDYIPR

SEQ ID NO: 65051 - protein, 318 aa, Prochlorococcus marinus str. MIT 9215
MQNKYLIKASKKLWFWFWNQLMNGFAPSDSHGNYKRPKGIKINSEYNINNENGQICLLIGNSCPWCQRTLLVHEIKLLSETVKIIFLKADIEHGEWIFNKNFKGCTRLSSLYKKANKKKFFRATLPLLISSVKDEVNILSNESSQIIRLLNSIKSDSGYETLSIEDCNQEFLDFINNSINDGVYKCGFARNQVAYEKASQNLFAALNEVENLLQKNKGDWIFGEQLTYADIYLFPTLIRWELIYSKLFKCTEQELSSFEKIIEWRFKFFKLSNVYRTCFDNDWKKDYYKALFPLNPNQLIPVLPSLKEIMRLESKKHK

SEQ ID NO: 65052 - protein, 229 aa, Betula pendula
LEFLMADAVAQGADCVITIGGIQSNHCRATAVTAKYLNLDCYLILRTSKVLVDQDPGLTGNLLVERLVGAHIDLISKEEYAKIGSESLTNLLKEKLLNEGRRPYVIPVGGSNSLGTWGYIEAIREIEQQLQTGTGEIKFDDIVVACGSGGTIAGLSLGSWLSTLKAKVHAFSVCDDPDYFYDFIQGLLNGLEAGVDSRDIVNIHNAKGLGYAINTSEELKFVKEVAAAT

SEQ ID NO: 65053 - protein, 95 aa, Glycine max
MAFLWNKTSIASHFRSHSQKTEGLASFPRRRFHVEPGAREKALLAEDATLKPFKSYKKSVKQLRKIGNALTVVVVAGCCYEVYVRAFTREEAQKL

SEQ ID NO: 65054 - protein, 210 aa, Chlamydomonas reinhardtii
APLTTARPVPLDLPDYMDKPGEPHVVATPDRFHPTGSALTPPESSGLTSLQQHFAFFDLNKDGIITPWECVNGALLPPLNTLACIPVAAAVQLPLSWLTSDSWLPDPLLRVQVKNAHKVIHGSNSRAWDRSGRFTPARFEALLSKYDADRKGGLNAWEVAQMVRGQANLGDLLGTMASAGEWAMTWALLCDSSGVLRREDMRGMYDGTAF

SEQ ID NO: 65055 - protein, 1248 aa, Coccidioides immitis RS
MIAEEKGISRVEADEEAAIGIDSHVQAAKHQSRTHLSFRKVQPVDVHVKELVVRVDTVPPIWQSSPSLLWDRLRRKTKGDPLKTVLDGVTAAMPSGSLTAIIGGSGSGKTSLLNVMAGRMNTGRVKISGSATFNGHDNINSVRSAYVMQQDVLIPTLTVRETLQYSADLRLPPPTTHDERQNVVNNVILELGLKECADTRIGTTTHKGCSGGEKRRTSIGVQMLSNPSVLFCDEPTTGLDATSAFQVIKTLKALARDGRTVIVSIHAPRSEIWGLFDQVILLSRGSVLYSGPVDMALSHFEECGHSIPAFVNPAEFLIDLAAYDNRSEESEFFSRERIEKLQRAWRESPNNRLLDEKASSQNRGIASEKAYQSITPQKGASFGQQFRVLTARTMKMTVRDPMGMTASLFEAIGMAVMNGWVYLRLDRSLAGIRSRQGSLYTASSLNGYLILLYEVFRLTTDIQLFDRERNEGVVGVPAFLLSRRAARLFLEDLPVPCLFSVIFYFMVGYRLAAPEFFIFLALNILTQYLAVSFASVCISLSRNFPGASLVGNLSFTLQTMACGFFVQANQIPVYVRWIKWMTYTFYVFGALCANEFIGPSGPPEGQFYDCPFSDDPSDPYCKEYTGRFILETLGLPSNWIWRPMVALVGFITLFFGAAYLILQFRKVDMDIAQSRSSEGDLSAGKEKFVARLPDKSHHVSIRLDNYALEIQKRRIGKRGIESRRLRILRPISAEFRPGQLNVIMGPSGSGKTSLLCSIARRLHGSIGTRYHLSGQMLYNSSVPSENVIRAVSSFVTQDDDALMPSLTVRESLQFAAGLRLPSWMSKEEKNRRAEDILLKMGLKDCADNLIGSDLIKGISGGEKRRVTIAIQILTDPKVLLLDEPTSGLDAFTATSIIDALNGLAAEGRTLILTIHQARSDLFHYFSNILLLARGGHLVYAGKGSEMLPHFKQLGYPCPEATNPADFVLDLITIDLQEKGREDASRERVQRLISGWEQKPVELTRQTSVISTPAELGSLKRKMSPFHLMYPLVLRRSAINLRRQPHLLVARTMQVIGIAIILTLFFAPLKKNYESVQSRMGFIQQLAAMYFVGMLQCIAIYPYERDVFYREESDNCYSVEAFILQYTSLELPFEIASSLIFGVVAAFAVRLESSVKMLFILAFNCFCIVFTCTDAQRLPNGNCPIETGEQVLMLYNQDDKNPAINVMALGLVAIGYRLVAYLLLKAMRSHGISKSIWIGLSKSSKKPQA

SEQ ID NO: 65056 - protein, 480 aa, Chlamydomonas reinhardtii
MTAADAGQQGAEQPSVSEATRVRVEAAKQYIENMYNSQRQAMAERHARRSAVVQELQREGLPEDQKRQILSELEKRESDFTRLQRQRMTAEDFEALSIIGRGAFGEVRIVREKTTGKIMAMKKLKKAEMLKRGQVEHVKAERNVLAEVQNPYIVKLYYSFQDEDHLYLAMEYLPGGDTMTLLMRKDILSEEETRFYMAETILAIESIHKAGYIHRDIKPDNLLLTRDGHVKLSDFGLCKPVDVQALPTLAEGEDCPDTLQAGSGANRPLGLMPSTSLRPQAEQLAHWQKNRRQLAFSTVGTPDYIAPEVLLKKGYGMECDWWSLGAIMFEMLVGYPPFYSDEPLTTCRKIVNWRMFLRFPDEARLSPAARDLICRLMCDVEERIGTRGGVEEIKSHPFFAGVDWVHLHQTQAPFVPRVDHDLDTQNFENFDEEMHHHHGGLDRSGSGRSNKWLAQADPNFIGYTYKSWEAVTPGEQGVKA

SEQ ID NO: 65057 - protein, 474 aa, Saccharomyces cerevisiae
MASAVYFCDHNGKPLLSRRYRDDIPLSAIDKFPILLSDLEEQSNLIPPCLNHNGLEYLFIQHNDLYVVAIVTSLSANAAAIFTFLHKLVEVLSDYLKTVEEESIRDNFVIIYELLDEVMDYGIPQITETKMLKQYITQKSFKLVKSAKKKRNATRPPVALTNSVSWRPEGITHKKNEAFLDIVESINMLMTQKGQVLRSEIIGDVKVNSKLSGIPHLKLGIKDKGIFSKYLDDDTNIPSASATTSDNNTETDKKPSITSSSATNKKKVNIELEDLKFHQCVRLSKFENEKIITFIPPDGKFDLMNYRLSTTIKPLIWCDVNVQVHSNSRIEIHCKAKAQIKRKSTATNVEILIPVPDDADTPTFKYSHGSLKYVPEKSAILWKIRSFPGGKEYSMSAELGLPSISNNEDGNRTMPKSNAEILKGPVQIKFQIRYFTTSGMQVRYLKINEKLQYKSYPWVRYITQSGDDYTIRLT

SEQ ID NO: 65058 - protein, 340 aa, Bartonella henselae str. Houston-1
MHAVSMTIIGAGSYGTALAIVLARNGHHVLLWGYNPQHIRELQEYRCNQAFLPDVQFPDNLCPEDSLETAIKASRNILIAVPSHVFHQVLYNIRPYLDQHSRIIWATKGLEHGTGRLLQEVAREILGDKIPLAVFSGPTFAKELAIGLPTAITIAASDTEFSEELQQLFHFDKSFRVYKNSDMIGVQLGGAVKNVIAIGAGISDGMGFGANARIALITRGLAEISRLGIAMGAELSTFMGMTGLGDLVLTCTDNQSRNRRFGMLLGQGVDIEEAKKQIDQIVEGYLNTKEVHMLAQRIRVEMPITEQIYHVLYCGKSVSEAANALLSRQLKDEMYDTVRF

SEQ ID NO: 65059 - protein, 547 aa, Zea mays
MATVQDNGVLHLHPYAVAAAAAALISAYMVWFWALTRRLSGPRMWPLVGSLPSVVLNRARVHDWIVDNLRSKGEAATYQTCILPLPFLARRQGLVTVTCNPRNLEHILRARFDNYPKGPMWQAAFHDLLGQGIFNSDGETWLLQRKTAALEFTTRTLRQAMARWANRIIKYRLWSILADHCEAAASVDLQDLLLRLTFDNICGLTFGKDPETLSPGLQENPFANAFDSATEATLQRFLFPSFLWRVKKALGVGSERSLRESLAIVDQYMTEAIAARKANPSDDLLSRFMKKRDGSGRAFPEDVLQWVALNFVLAGRDTSSVALSWFFWMLMLRRDVERKVVLEIVSVLRETRGDDCGRWTEEPLDFDELDRLVYLKAALAETLRLYPSVPQDSKYVVEDDVLPDGTVVPAGSAVTYSIYSVGRMESIWGKDCSEFRPERWLSADGTRFEPAKDAYRFVAFNGGPRTCLGKDLAYLQMKSIASAVLLRHSVELVPGHKVEQKMSLTLFMKNGLRVHVKPRDLAGYVVAPEEAPQLGAFVISTTTAAAA

SEQ ID NO: 65060 - protein, 172 aa, Triticum aestivum
MMLRAAGKRLIGAAGARPAALAGDSSTGAAALGAVAARRGYHERVVDHYSNPRNVGAFDKDDADVGTGLVGAPACGDVMKMQIRVDQASGRIVDACFKTFGCGSAIASSSVATEWVKGKQMEEVIAIKNTEIAKHLSLPPVKLHCSMLAEDAIKAAVKDYEAKKTKAAKAEE

SEQ ID NO: 65061 - protein, 395 aa, Gibberella zeae PH-1
MGERRKLGDVAMDILLFAGMMTAGLYVARNFLNPILSNIADPDKEKHEQARRQAKAHLERMNRNKRDGLDYGDDSSDSRRGPRPEELVLNEYENLVALEMVPPEDISVGFDDIGGLDTIIEELKESIIYPLTMPHLYSHAAPLLSAPSGVLLYGPPGCGKTMLAKAVAHESGASFINLHISTLTEKWYGDSNKIVRAVFSLARKMQPAIIFIDEIDAVLGTRRSGEHEASGMVKAEFMTLWDGLTSSNSSGMPARIMVLGATNRINDIDEAILRRMPKKFPVTLPGTEQRRRILQLVLQDTKTDPEHFNLDYVSRITAGLSGSDIKEACRDAAMVPVREYMRQHRESGKAMSTVDPKQFRGIRSDDFLGREGGQIKMQSTRQTSGVEELIAEDQD

SEQ ID NO: 65062 - protein, 518 aa, Arabidopsis thaliana
MELISTINLLTIVLLLFVVSKIWKACWILLLRPLMLSKRFKKQGISGPKYKILYGNLSEIKKMKKEADLCVLDPNSNDIFPRVFPQYHQWMSQYGDTFLFWTGTKPTIYISNHELAKQVLSSKFGFTIIPVKRPEVFILFGKGLSFIQGDDWIRHRRILNPAFSMDRLKAMTQPMGDCTLRIFEEWRKQRRNGEVLIKIEISKEFHKLTADIIATTAFGSSYAEGIELCRSQTELEKYYISSLTNVFIPGTQYLPTPTNLKLWELHKKVKNSIKRIIDSRLKSKCKTYGYGDDLLGVMLTAAKSNEYERKMRMDEIIEECKNFYYAGQGTTSILLTWTTMLLSLHQGWQEKLREEVFNECGKDKIPDTDTFSKLKLMNMVLMESLRLYGPVIKISREATQDMKVGHLEIPKGTSIIIPLLKMHRDKAIWGEDAEQFNPLRFENGISQATIHPNALLPFSIGPRACIAKNFAMVEAKTVLTMILQQFQLSLSPEYKHTPVDHFDLFPQYGLPVMLHPLG

SEQ ID NO: 65063 - protein, 212 aa, Haloarcula marismortui ATCC 43049
MSANNGWEPRTRLGKQVVEGEIDSMQEALNSGLPLKESEVVDQLVPDLEDEVLDINMVQRMTDSGRRVKFRCVVAVGNRDGLIGYAEGRDDQVGGAIQKAIDIAKLNIIDVSRGCGSWECGCGRPHTVALRTEGKAGSVEVELQPAPRGLGLAGGETVRKVLELAGIEDIWTRSSGNTRTTVNFAKATFNALQNTAEARVPERTFEKREVIE

SEQ ID NO: 65064 - protein, 629 aa, Lactobacillus sakei subsp. sakei 23K
MQTLTATNLTKTYGEKTLFKDISFLIREGDRIGLVGINGTGKTTLLNALTGTDSYDSGQIETPNQYAMSYLAQKPVFDTNLSIMAAIFAGQNPVFKTIQNYERVLAAYTADPTNPKLQTQYEQADAQMTQQDAWTVDTDIKTILTQLHLTDLDQPINTLSGGQQKRVGLAQALIESPDLLILDEPTNHLDFDSIEWLEKRLAQYKGALLIVTHDRYFLDRVANQIFELDAGQLYTYTGNYEQFLTQKADRIEREQQAAHKQQQLYKQELTWMRAGAKARTTKQQARINRFNDLKGNLTTGPDTSEVDIQMGQSRLGKKVLGLKDANLTLDAHPILKDFSLLVQANDRIGITGVNGAGKSSLLNVLAERIPLDSGELIVGETVNLGYYTQQNEDLDLDKRVIAYLQEAGEEVVGKNGDRISVTQLLEQFLFDRLTHGTLIKKLSGGEKRRLYLLKLLMQQPNVLLLDEPTNDLDIGTLTILENYLENFNGTVITVSHDRYFLDQVADKLLVLDGHGNITTEVGLFSDYLAKQKTATTKATAPKPTPEVTVETVKEPAAKHKLTYNEQKEYAHIETDLEKLDEQIETIKTEMNQNGADYGKLAEWQAELDRLNQELDEKMARWDYLSEYAD

SEQ ID NO: 65065 - protein, 178 aa, Brassica napus
  misc_feature (27)..(27): Xaa can be any naturally occurring amino acid
EIIRRTRFASVLDTDQPRTIPCHDQVXFWFGDLNYRLNMSDSEVRKLVSQKRWDELKNSDQLIRELRRGHVFDGWREGPIKFPPTYKYEFDSDRYAGENVREGEKKRAPAWCDRILWLGKGIRQECYKRSEIRMSDHRPVTSIFNVGVEVFNQRKLQRALHVNNAAACAVHPEPSFLF

SEQ ID NO: 65066 - protein, 105 aa, Zea mays
  misc_feature (98)..(98): Xaa can be any naturally occurring amino acid
GDFNQFKQLTSGPLHDREFETATVAYVLKSKGNSADGSWLWCTTEDSVYDAVKSMTHHNVGALVVVKPGQNKSIAGIVTDRDYLRKIILQRRSSTPTXVDDLMTE

SEQ ID NO: 65067 - protein, 175 aa, Zea mays
  misc_feature (36)..(36): Xaa can be any naturally occurring amino acid
  misc_feature (78)..(78): Xaa can be any naturally occurring amino acid
  misc_feature (114)..(114): Xaa can be any naturally occurring amino acid
  misc_feature (123)..(123): Xaa can be any naturally occurring amino acid
  misc_feature (141)..(141): Xaa can be any naturally occurring amino acid
  misc_feature (165)..(165): Xaa can be any naturally occurring amino acid
MVKICCIGAGYVSGPTMAAIALKCPDIEVVVADISXPRIEAWNSDTLPIYEAGLDDAVKQSTVQGTSSSGTEVDKHVXEDDTMLCLGGTPPPRPVGLGAGKAADLTYCESAARXIADVSKSDXRLAVEKSTVPVKTAEGIXKILTHNSKGINYQILSNPEFPVRXGTAIEDLFKH

SEQ ID NO: 65068 - protein, 424 aa, Chlamydomonas reinhardtii
MGCGSSVPVEAVDQGDQQKQQQQQGGAAAKNGSAADKAATDAETQKAKTTRARRLSYISNDANGAAVNAPPGSAAPAAANPGGKSGNTRARRLSYVTNDPNASPGNLKLNGEGEGGDEQDMEGGDEPAVQGQLAPEEQERRTLRVNVACMSRAGREPGFKKTNQDNCFAFEKYITEDQSLFGAMDGHGPHGHLVSGYVKQHLPIILVNHLTLEKDVKKALSQGFCEVDRSLGNSRIDCEFSGSTAVVSYLKGKTLTTAWVGDSRGVMGRETKKGWEAVDLTNDHKPTAPEEKARILKANGRVERLVDEMGQPMGPYRVWLQYAWIPGLAMSRALGDVLAHQVGVTSEPDHSTMELTPQDKFIVLASDGVWEFISSKEAVDIVAQYESAEEACRQLVDEAYQRWLTEEEGVVDDITAVVVRFVHP

SEQ ID NO: 65069 - protein, 559 aa, Bartonella henselae str. Houston-1
MRYKSMGDSLSIRNEKAFEAALQALRRHAIKDGVYDIRRHFIEDEQRFSNFSLNLDDFLFDFSKCGVTFKTLQLLDDLAVAADVLGRRDAMFSGKAINTTEKRSVLHIALRLPADEVFMLDGTDLVHDIQGVLADMERFSDMVRDGSYKGNSGEKIIDIVNIGIGGSDLGPAMVTYALKPYHDGPNCHFVSNADSAHISDTLSVLNPATTLFVIASKTFTTAETIANAQVARQWIMSHLGKEAVCKHFIAVSSALDKVAEFGIDSSRTFRFWDWVGGRYSIWSAIGLVVMLAIGGQNFRQFLEGAQHMDRHFKTAPLRKNIPIRFALLGFWHRVVCGYASRAVIPYAQRLARFPAYLQQLDMESNGKQVSLDGKTLTFSSGPVVWGDSGTNGQHAFFQLLHQGTDVIPVEFILFIKGHEQNLHPMYDMLVANCLAQSKALMKGRSVEDARRMLLKSGIDERESENLALHKSFAGNRPNMMLVQDLLTPFALGRLIALYEHRIFVEGILMNINSFDQWGVELGKELANELLPILRGENKTNNRDSSTLGLLAHIQARRGE

SEQ ID NO: 65070 - protein, 834 aa, Bartonella henselae str. Houston-1
MNRGFNESEILSTKSVKLAAAFDHKNDAIHAAAELLVQVGAVDKSYLASMLKREAVTNTWLGNGIAIPHGMVENRDLIIRDAVAVIQIPAGVDWCDGNKARLVIAIAACQDCYREICKKLTLLLFDKERLEELSTTADKQQIVTMLFSQDTKRERAFIGDLSVRQEWTLDYPSGLHARPASLWVDFAKKAQGSIRVRHGQYTVEMKNLVGLLQLGAKNGDVLIFSTDASEGVQLLKEAISVVKKVSISEKCVMRETEAQTKAFHGWYPRSMQKGISGVGASPGLALGKIFILRHDDISITDQPISFASGKACLENALTKTKQKMASIINDITVRVGADSAAIFSAQMVLLEDENLIAQVCRFMAEGHGVAWSWDKAVRQFAGMFSKVDNPLLAARAVNLVDVGRRVLGEINPSYRSFFLNDIPRGVILVTDDLSPSDVAQLDCTKVQGLATAWGGPLSHTAILARTLSIPMVVAAGVDVLAIEPDIQAIIDGDNGFIYPDPTSEDVKEAEKRISIVVKKRDNGICVCRLPVQTTDGQRIRIMANVNYANQVPVALNLGAEGIGLMRTEFLFLESPHIPDEDAQFNVYRAMTAAVGDKPLIIRALDIGGDKQVQHLHLSKEDNPFLGVRGTRLLLRRRDLLVPQLRALYRAAKEGGDLWILFPMVMSVSEIVAMKKIAEEIRNDIGAPKLKFGIMIEVPAAAIMADVLSAHVDFFSIGTNDLTQYTMAVDRQNPYLVSEADSLDPAVLRMIYHTIQGAAKHRCWVSVCGGMAGDPFAAMILTGLGIHELSMISCDISSVKACLQAHSFEDMKVLAKKALQCETARAVRALSNDVR

SEQ ID NO: 65071 - protein, 217 aa, Burkholderia pseudomallei K96243
MKSSHPDSPQPDDGAAPECVTLVATATLPTRYGTFTSYAFRVAGGDAEHLALVMGDVAEQPSVLTRLHSECLTGDVFGSYRCDCGEQLDLSLRYIAAEGRGVLLYLRGHEGRGIGLSNKIRAYALQEQGRDTVEANLDLGLPDDAREYDSAAAILRILKVTSVRLMSNNPKKFDTLARHGIPVCERVALAVPVREENERYIRTKQLKFGHYYFDENE

SEQ ID NO: 65072 - protein, 326 aa, Arabidopsis thaliana
MEEADQLCLAAKSGDLKKVQTLIYSGADVTHFDNDGLTPLMHAAKIGNAEIVTALLESGAPWNALSPSNLSAGDFAMEAGHQETFDLLLKTGIQSELILGTIARNQTKNEYSNQEYLQDRVSFSEDKLMDSESKGVMMAWEKPLMEAHAKAICLNGGHILNVGFGMGLVDTAIQRYNPVKHTIIEAHPEVYKRMIESGWGEKENVKIVFGRWQDVLDKLDDNSFDGIFFDTYGEYYEDLREFHQHLPRLLKPDGVYSYFNGFCGSNAFFHVVYCNLVTLEIENLGFSTQLIPLPVKDCLGDEVWEGVKQKYWQLDTYYLPVCQFSD

SEQ ID NO: 65073 - protein, 428 aa, Panicum miliaceum
MAALSRAASCLTRRPQMQPSRLQAARAMASSLFGHVEPAPKDPILGVTEAYLADPSPDKVNVGVGAYRDDNGKPLVLDCVREAERRIAGNLNMEYLPMGGSVKMIEESLKLAYGEDSELIKDKRIAAVQALSGTGACRLFADFQKRFLPDSQIYIPTPTWSNHHNIWRDAQVPQKAYTYYHPESRGLDFAGLMNDIKNAPDGSFFMLHACAHNPTGVDPTEEQWREISHQFKVKKHFPFFDMAYQGFASGDPERDAKAIRIFLEDGHQIGCAQSYAKNMGLYGQRVGCLSILCEDEMQAVAVKSQLQQIARPMYSNPPVHGALVVSIILNDPELKSLWLKEVKGMADRIIGMRTALKENLEKLGSSLSWEHITNQIGMFCYSGMTPEQVDRLTNEFHIYMTRNGRISMAGVTTRNVGYLANAIHEVTK

SEQ ID NO: 65074 - protein, 144 aa, Brassica napus
  misc_feature (12)..(12): Xaa can be any naturally occurring amino acid
  misc_feature (30)..(30): Xaa can be any naturally occurring amino acid
  misc_feature (46)..(47): Xaa can be any naturally occurring amino acid
  misc_feature (57)..(57): Xaa can be any naturally occurring amino acid
  misc_feature (63)..(63): Xaa can be any naturally occurring amino acid
  misc_feature (65)..(65): Xaa can be any naturally occurring amino acid
  misc_feature (75)..(75): Xaa can be any naturally occurring amino acid
  misc_feature (88)..(88): Xaa can be any naturally occurring amino acid
  misc_feature (96)..(96): Xaa can be any naturally occurring amino acid
  misc_feature (109)..(110): Xaa can be any naturally occurring amino acid
  misc_feature (121)..(121): Xaa can be any naturally occurring amino acid
  misc_feature (128)..(128): Xaa can be any naturally occurring amino acid
NGSSMLSSAAVXTSPAQATMVAPFTGLKSXSAFPGARKGNNDITSXXSNGGKVICMXVWPPVXKXKFETLSYLPXLTEGELGKEVDYXLLRNKWIXPCGEFEIEHGFVXXGAWKHPPDTNXGRYWTMXEFLRDGLCSRGSQKQN

SEQ ID NO: 65075 - protein, 409 aa, Panicum miliaceum
MASQVASVFAGIAQAPEDPILGVTVAFNKDPSPVKINLGVGAYRTEEGKPLVLNVVRRAEQMLINDPSRVKEYLPITGLAEYNKLSAKLIFGADSPAIQENRVATVQCLSGTGSLRVGGEFLAKHYHERTIYIPVPTWGNHPKVFTLAGLTVRSYRYYDPATRGLDFNGLLEDLSSAPLGSIVLLHACAHNPTGVDPTIDQWEQIRQLMRSKSLLPFFDSAYQGFASGSLDKDAQPVRMFIADGGELLMAQSYAKNMGMYGERVGALSIVCGSADVAARVESQLKLVIRPMYSSPPLHGPSVVATILKDSEMFHEWTVELKAMADRIISMRQQLFDALKSRGTPGDWSHIIKQIGMFTFTGLNSEQVAFMRQEYHIYMTSDGRISMAGLNMKNVPHLADAIHAAVTQLK

SEQ ID NO: 65076 - protein, 437 aa, Bacillus clausii KSM-K16
MQKLIDHVHTLSPYKWYGQVRHAAGLTIESAGPRAFIGELCYIWASPDQKGTKVRAEVVGFKDDRILLMPLDDTRRIAPGSYVEGTGKPLNVACGPSLIGQIVNGVGEPFLQSAALGDTDANYSTDNSPPNPLERPRISEIMSVGVRAIDGLLTMGKGQRVGIFAGSGVGKSTLMSMIAKQSDADVNVIALIGERGREVKEFVERDLGEEGLKKSVVVVATSDQPALLRVKGAQTATAIAEYFRDKGKNVNLMMDSVTRFAMAQREIGLAIGEPPTTKGYPPSVFAMMPKLLERSGTNQSGSITGLYTVLVDGDDMNEPIADAVRGILDGHFVLDRQLANRGQYPAVNVLKSVSRLMKDLVENDHLHAAKLFRQRLADYEQSEDLISLGAYKQGSSKDIDAAIHDHPAMLDFLKQEVEESDSFAETKTKLIQLFKQE

SEQ ID NO: 65077 - protein, 142 aa, Frankia sp. EAN1pec
MTDQPTTDADEKVVRSDTEWRQLLDPQRYAILRQAATEAPFSGTYTYDKTSGTYRCGACGAPLFTSDTKYDSGSGWPSFYQPVTADAVTLITDRSHGMTRTEVRCARCDSHLGHVFDDGPAPTGQRYCMNSLALDLDNTDAS

SEQ ID NO: 65078 - protein, 302 aa, Gloeobacter violaceus PCC 7421
RIGRNFLRCWLGRKQSDFEVVAINDTSDPNTNAHLLKYDSMLGQFSGEVSADENSLTANGHTIKCFSDRNPLNLPWKDWGVDLVIESTGVFTSRDGASKHLAAGAKKVLITAPGKNDDGTFVMGVNDHNYDPEKHTIISNASCTTNCLAPVAKVLHENFKIVKGTMTTIHSYTGDQRLLDASHRDWRRARAAALSIVPTSTGAAKAIGLVLPELKGKLDGLAFRVPTPNVSVVDLVVEVEKPTLVEQVNHVLKEASENELKGILAFSEIPLVSIDYRITDVSSIVDAQLTMVLKDNLVKVIS

SEQ ID NO: 65079 - protein, 505 aa, Wolinella succinogenes DSM 1740
MDNHVNAHEEQEQAGFEQFGFKENLLRGIHEAGFKVPSPIQVEAIPLVLGGHDLIAQAQTGTGKTAAFGLPIIQNLKNDGSIEALIITPTRELAVQISDEIFKLGRNCRTKTVSVYGGQAIRRQVELLEKAPQVIIATPGRLLDHLRNDRLKNFNPTTIVLDESDEMLDMGFLDDIEEIFTYLPASRQTLLFSATMPAPIKNLAQKILHNPKMVKVTTNETTNSDISQRYYIINEYEREDAIVRLIDSEAPSKTIIFTRMKKEADDLSNRLIAKGYQAGALHGDMEQRERQAAVNAFKQGAIDILVATDVAARGLDISNVSHVFNYHIPLNPESYVHRIGRTGRAGKKGIAITLATPLEFKEIRRISETTKATIELYEIPTIAETLKQTDSKLIQNLLNHSITDDALRIYEQIRGEIDTTQLACKLLSMLMKKSSIMGPNKIGLSKEDLMQLKNRLSGDDRRDRNSRGGKGGSRGGSRNSGGYRRDSRDGNRSSEGNYSRRKRRD

SEQ ID NO: 65080 - protein, 263 aa, Glycine max
LTSIPDELIKNAKYIATPGKGILAADESTGTIGKRLSSINVENIEANRQALRELLFTAPDALQYLSGVILFEETLYQKTSDGKPFVEVLQENNVIPGIKVDKGVVELAGTNGETTTQGFDSLGARCQQYYKAGARFAKWRAVLKIGPTEPSELSIQQNAQGLARYAIICQENGLVPIVEPEILTDGAHDIAKCAAVTETVLAAVYKALNEQHVLLEGTLLKPNMVTPGSDSPKVTLNIFKIIHPYVWIHSIVEYLLVFEIKLE

SEQ ID NO: 65081 - protein, 255 aa, Oryza sativa
  misc_feature (215)..(215): Xaa can be any naturally occurring amino acid
  misc_feature (226)..(226): Xaa can be any naturally occurring amino acid
MAAAGSIGVYKAVFAALGALMLGTLVYTCVTDGSPFRLELLTPWLVATLIDFYVNVTAISTWVIYKEVNWISSFFWVVLLYCFGSIATCAYVVVKLFEIKTSGPSQDPLDLLFLRQGNLSQRKSSFVIIGRIIFSFLGAMMAAVVIYTVITDGLPFRKDLLTPWMAATLLDFYINVFAISVWVAHKESNWISTAIWICLLICFGSITTCGYIVIXFFPVSYQDPIXTCANDTRNKSLNAKQGRLSSHIPSRSVQA

SEQ ID NO: 65082 - protein, 359 aa, Xanthobacter autotrophicus Py2
MGQKGGRDRRTSEGSHDVLRPGSSHGASQGGSTLVLAVAEPETRAPEGRVQELEEPATAAFPPRSRDLSFLRAVIDRRLGLLVPPAASHPAVLHAAMRHILLSPGKRLRPLLTLAAAIQLNASEHAVLDFGCALEMIHASSLIVDDLPCMDDAAMRRAQPTTHVQYGEDVAVLASIGLLSRAFGVAAAAPGVSERARLEAVAILSMAVGSLGLCGGQYDDLRPSPGRSLSATEDVNRRKTGVLFSAAVEIAGHVAAADETQMGHLKALAGHVGRAYQILDDILDASASSASLGKDVGKDAHKATVIASLGAPRARKLLSEHLAGALATSQELGPNTEGQEPLRDFMTAAFGELMGPLAP

SEQ ID NO: 65083 - protein, 543 aa, Gibberella zeae PH-1
MPRRETGSKRHKPNQTKPKRRAKISVLSLTSARTQATGSARKTFPMNLMRLKKLWQPHQDSCLRCRLPKDHPSLPDVNCIRIHRYFELEINWLWYIHIDIDVEGKVNNKPGYKPSNKLSCWKIHRPVLYRSQPNINTHPLQAHNLGTAPHTKLHFPLPHSRALKHNCDFKLPQTTKHNPPSKTDIPTDIMPPKKWDEEESEDSSSSAAPAVGAAAIAARRKFDDEEDEGDVLDSWDADDSEAEREKERKATEAKQKAAAAAAAAKKPKGLRIAQHQAERAQQKAEAEESDEYEETEGEKRERLRRTEQEADLAHAADMFGDIGISANRSKARPATVVVDANDPTKTVDISKLPLFQPKTKLQFETLRTSIAPLISANAKSAHYSLFLQDFTKALAKDMNSEQIKKLASSMTALGNEKMREEKAADKGGKKSKAAKTKTSLVTGRANVADTTTYDDNDDFGDNTRRRPLAPGSDPPLPASTCTLPPPSNCLPTRHAVDAKMTIKSRGVASQPSRLLEGRSRGVWRRCSVRERQHACKSGQCPKD

SEQ ID NO: 65084 - protein, 118 aa, Arabidopsis thaliana
MIKPDGVSGNYTEEIKTIVVEAGFNIVKEMLTQLDKETASAFYEEHSSRSFFPHLVTYMTSGPVLVMVLEKRNAVSDWRDLIGPTDAEKAKISHPHRFDLLPNTILDFANSNHQSIMW

SEQ ID NO: 65085 - protein, 487 aa, Yarrowia lipolytica CLIB122
MSRPVSDQHVAHKKITKVCCLGAGYVGSPTSAVIAHKSGDLQVTIADISTERISRWINATNEKELPIYEPGLFDVLECRGRNLHFTADIDKAIEEADLIFVSVNTPTKKKGMGAGFAADLGYVESATRRIAKVATSDKIVVEKSTVPCRTAQSMRKILEANGKPGVHFDILSNPEFLAEGTAIKDLLSPDRVLIGSLDNDRGKSAAASLAEIYANWVPRERIITTNVWSSELSKLVANALLAQRISSINAVSAICEATGADVDEVAYACGLDTRIGPKFLKASVGFGGSCFQKDILNLVYLSESLHLPEVAAYWKQVVDMNEYQKSRFTKRVIQSLFNTLTGKKIALFGFAFKKDTGDTRESAAIALAKNFVQEQCQVSIYDPKVEEQQIWLDLSEPGVDSSLTEAKKYVTIAKDAFEAAKDADAIVIATEWDAFKDTELDYEKIYEQMNKPAFIFDGRLILDSKKLEKMGFKVEVIGKTRSELSFE

SEQ ID NO: 65086 - protein, 255 aa, Gibberella zeae PH-1
MPAPTALKQAESAPLANDISLPVEGADEEFLLDAPGAEDADANVLVPVEDSNDMQIDEEGRPRFAPARDIDPVTRVETRKIPIPPHRMTPLKQSWTSIYPPLVEHLKLQCRMNIKRKTVELRSSKHTTESGALQKGEDFVKAFTLGFDVDDAIALLRLDDLYIQSFEIKDVRTMHGDSQARAIGRIAGKDGKTKFAIENASRTRIVLADSKIHILGGFKNIHLARESVVSLILGKPPGKVYGNLRTVAARMKERF

SEQ ID NO: 65087 - protein, 438 aa, Gibberella zeae PH-1
MAIKKVFARSVYDSRGNPTVEVDVVTETGLHRAIVPSGASTGQHEACELRDGDKSKWNGKGVTKAVENVNTVIAPALIEKNLDVKDQSAVDAFLNELDGTTNKTKLGANAILGVSLAVAKAGAAEKGVPLYAHVSDLAGTKKPYVLPVPFMNVLNGGSHAGGRLAFQEFMIVPTDAPTFSEALRQGAEVYQALKGLAKKRYGQSAGNVGDEGGVAPDIQTAEEALELITDAIEQAGYTGQMKIAMDVASSEFYKESEKKYDLDFKNPESDPTKWITYEELANMYSELCKKYPIVSIEDPFAEDDWEAWSYFSKTQDIQVVGDDLTVTNPLRIKKAIELKSCNALLLKVNQIGTLTESIQAAKDSYADGWGVMVSHRSGETEDVTIADIAVGLRAGEIKTGAPARSERLAKLNQILRIEEELGDQAIYPGKDFRKSVNL

SEQ ID NO: 65088 - protein, 355 aa, Aspergillus oryzae
MKTYNIASIPADGIGPEVISAGVTVLNALAEKLNTFKLDFTHYDWSSETYKTTGKYIPDGGLEDLKRHDAILFGAVGAPDVPDHISLWGLRLSICQPLQQYANVRPTRVLRGTQSPLRNCPPGKLDWVIVRENSEGEYAGQGGRSHRGFPWEVATETAIFSRHGVERIMRFAFETAAKRPRKLLTVVTKSNAQRNGMVLWDEVATEVGKEFPEVQVDKMLVDAMTTRMVLKPETLDTIVASNLHADILSDLAAALAGSIGIAPTSNLDPTRQHPSMFEPIHGSAFDITGKGIANPVATFWTAAEMLAWLGEETAAQKLMECVENVCERGILTADLGGKATTKEVTEAMVGEIQRL

SEQ ID NO: 65089 - protein, 459 aa, Frankia sp. EAN1pec
MVRGIDTGHEKQAAGERTTGDESGVDPRTDPRADTGPVLARTIGTGDAVVIGLGAMLGAGVFAAFAPAARAAGAALLFALATAAIVAYCNATSSARLAALYPQAGGTYVYGRRRLGDFWGYLAGASFITGKTASCAAMALTVGAYTWPGHERLVAGTATAALTAVNYSGMRRAAWLTRLIVVVVLTVLVVVVVVCVTSGAAEPVRLSPTGRDGPAGPASPSLWPGLPQAAGLLFFAFAGYARIATLGEEVRDPRRTIRRAIPTALGITLVVYAAVAVALLLVLPVAALGASAAPLTDAVRAAGMPGLAPVVRVGAAVGALGSLLALILGVSRTTLAMARDGHLPTPLAAVHPRFGVPHRAELTVGAAVTALVLTTDLRGAIGFSSFGVLLYYAVANAAAWTLSPTEGRPVRAVPVVGLLGCLLLAFSLPGTSVLGGSAVLAAAAVVYAARHAGGHPARQ

SEQ ID NO: 65090 - protein, 444 aa, Candida albicans SC5314
MAQTPQSIDFEKIKESSDGTLKGMLTQGFNEIVVNNPYFAAGGGLMLLGTGLALARSGVVKGSGFIYRQLLVDLEIPSKDKSYLWFLEWMSQYKHRTSRHLSVETNVITHDNGAITTNFSLVPGPGKHLIRYKGAYMLVNRERSGKLLDMTSGTPFETVTLTTLYRDRKLFNDLLSEAKSLALKAREGKTVIFTSWGPEWRPFGQPRSKRLLGSVILDEGIAENIVNDVKDFLTSGEWYHKRGIPYRRGYLLYGPPGSGKTSFIQALAGELDYNICILNLSENNLTDDRLNHLMNHIPNRSILLLEDVDAAFNKREQTNDQGFNNGVTFSGLLNALDGVASAEECITFMTTNHPEKLDPALLRPGRVDYKVMIDNATEHQVKRMFLRFYENEEELCEKFLAKYRKLNMQHVSTAQLQGLFVYNKRDPEAAIAMIETLQNPNTVF

SEQ ID NO: 65091 - protein, 572 aa, Oryza sativa
CAIVPQANDEEIQAHETYLLHDAGRGAGDTSDHPAAIARPQDVTTFHIVGVVDTDGARVRLLFRDSDLYFVAFKTGSCWFRFNDEHIPTFLTPTVPIAYTSGYMNIAQVRVGYHCLYDIFNVISRYTPESAQEKTNERQRILQCAALMLSESQRFGHVQLLVKRQIHKMMSKKITAKQNKKIHSWGSIARYCISHECKEDVLHHLSTLIVLFNPDQNKYENYKIVGRRKLLSRAAAAAAEAAARAAEAAARPSQAAAAEAEEEEEDDDDDEDEYPWQCQTRAGQELLILLYDKRLPPPVTPMVVTQQKNHKKTQAEEVDEKKNQENPNTDATIGAPSGGENHQNRSLISCDGINLYESDLDSLRGPHWVTDAILGYALAKFSRAYSDDGLLLVQPTNAALLNNKHYVAAEADHLLLASRRLVLIPVNDNLDFNQAGDGKHWSLLVIHKTSNDGVIQFIHHDSVRSGDNSYNLHAAQKLANVLRGVLPTAGDVINAETPQQTNGNDCAIHVLAAVQVICRWWRANANKSGPADWIRKLDKRISEGNITQMRASLLQVDLISHLHIHLSWSSDP

SEQ ID NO: 65092 - protein, 377 aa, Manihot esculenta
MATLTSMATLRNLFTKKSFASNELAMRRFFTPQAAAAEAPSFAQRVRDLPKNLPATKIRTEVSHLIGRTPLVFLNKVNEGCGAYIAVKQEMMQPTASIKDRPAFSMFNDAEKKNLISPGKTVLIEPTSGNMGISMAFMAAMKGYKMILTMPSYTSLERRVTMRAFGAELILTDPTKGMGGTVKKAYDLLETTPNAYMLQQFSNPANSKIHFETTGPEIWEDTLGQVDIFVMGIGSGGTVTGVGQYLKSQNPNVKIYGVEPAESNVLNGGKPGPHQITGNGVGFKPDILDMDVMEKVLEVSSEDAIKMARRLALEEGLMVGISSGANTVAALRLARMPENKGKLIVTVHPSFGERYLTSVLFEQLRNEAANMQPVPVD

SEQ ID NO: 65093 - protein, 491 aa, Aspergillus oryzae
MATEYKLPFELNDPSLLHFDSFVGNSWVQAKNPGTDIPWASCPTNSAEDVPSAVETAHAAFEQYKKSNPRQRAQWLLKWDTLIREAKPDLAKILTHETGKPLAESYGEIDYATGFTWWFAGEAERIHGSISVPSAPNRRVFTVKQPIGVAAALVPWNFPIAMVLRKAGAAFAAGCTMIVKPSPETPLTALVLAHLAQKAGFPAGVFNVLTTDLENTPSLSEALCKHPLVKKVTFTGSTRVGKLIASHCAHGLKKLTLELGGNCPFLVFDDANLDQALDQLMALKWRHAGQACITANRVYVQAGIYDRFAQLLKERTQKLVVGHGAKEGTTMGPVTTPRSIDKALSQVEDARRLGADVILGGNKVTDTKGYFFEPTILTGMTKDMLVSREETFAPIAALYKFETEEEAVQLANDTSMGLASYAFTKNIDRMWRLLENLDAGMIGMNTGNSSAAESPFGGIKESGYGKESGKEVAVNEYLVTKTGTLTIEGQY

SEQ ID NO: 65094 - protein, 372 aa, Candida albicans SC5314
MKKSTGPTQTRQVVFNISQNFKVLKILGEGAYGIVALAVHLPTETKVAIKKIEPFERPLFCLRTLREIKLLTKFKNHDNIVRLYDVQKPMNYDSFNEVYLIQEYMPSDLHNIIHTHLLSDQHVQYFIYQILKGLKMIHSARVIHRDLKPSNILVNEKCDLKICDFGLARLDTKHYNFDEAPRISMLTEYVATRWYRAPEIMLSASNYSTAIDLWSVGCILAELLTYRALFPGSDYINQLKLIFEVLGTPTDEDLQIIKSERAQKFIRSLPTKVKIDLSEFINNHPYRNIKHRGRDQVNPLAIDLLEKLLVFDPAKRITVQEALEHPYLNSYHEQLDEPVTSPIPIEEFDFDIDKKNLDTNDLKKQIFEIVMS

SEQ ID NO: 65095 - protein, 428 aa, Frankia sp. EAN1pec
MDASDLVTRDRAVVWHPYASVRDQAPLFAVASAAGVRLTLTDGRELLDGMSSWWAAIHGYRHPVLDQAARDQLDRMSHVMFGGLTHEPAVALAELLVRVTPPGLERVFFCDSGSVAVEVAIKMALQYQAGRGRPGRTRLLTIRRGYHGDTSGAMSVCDPDTGMHHLFTGLLARHLFAPAPAPGFDEPVTDDDLADVERLLAAHEGEIAAVVLEPVVQGAGAMRFYAPGWLARVRELCDRHRVLLVADEIATGFGRTGELFGCDHAGITPDIMCVGKAMTGGYLTMGATLCTTEVADGVCASEAGAFMHGPTFMANPLAAAVSRASVELLLASPWRERVRVVHDALAAGLAPAADLPGVADVRTLGAIGVIETHRPVDMAVIQPLLVELGVWVRPFGRLVYAMPPFVMEPADVATLTAAMVAAVAATTG

SEQ ID NO: 65096 - protein, 128 aa, Triticum aestivum
  misc_feature (115)..(115): Xaa can be any naturally occurring amino acid
MSQETVNPKAYPLADSQLTITILDLVQQAANYKQLKKGANEATKTLNRGISEFVVMAADTEPLEILLHLPLLAEDKNVPYVFVPSKQALGRACGVTKPVIACSVTSNEGSQLKQXFQSLKDAIEKLLI

SEQ ID NO: 65097 - protein, 148 aa, Physcomitrella patens subsp. patens
RRIPTTTASGSGDPHINGSVIVILAILSLVFILSGLLHLLARCMARQRHPPARYHSPLVSALHGQLQHLFHLHDAGVEQAFIDTLPVFTFGSIRGLKDSTDCAVCLTEFGDDDRLRLLPKCKHAFHLDCIDTWLLSNSTCPVCRRSLL

SEQ ID NO: 65098 - protein, 428 aa, Synechocystis sp. PCC 6803
MAGSLFADASKRLEKALKYVAISDDAGERLKYPKTSLSVSIPVRMDDGSLKIFPGYRVRYDDTRGPGKGGVRYHPNVTMDEVQSLAFWMTFKCALLNLPFGGAKGGITLNPKELSRAELERLSRGYIEAIADFIGPDIDILAPDVYTNEMMMGWMMDQYSIIRRKISPAVVTGKPVTMGGSQGRNTATGTGAFYIMQGMLPKFDQYPENTTVAVQGFGNAGMVVAECLYQDGYKVVAISDSQGGIYNEQGIDIPAVIDYKQRHRTLAGMYCDQAICDLGENQQISNAELLALDVDVLIPAALENQITRDNADQVRARYIFEVANGPTTTAADDILASKGIYVFPDILVNAGGVTVSYFEWVQNRSGLYWSAKEVNDRLKEKMVEEAEHVWNITQELDVNVRTAAYIHALNRLSEAMDAKGTRDYYQDS

SEQ ID NO: 65099 - protein, 386 aa, Bacillus clausii KSM-K16
MNIHEYQGKEILRSYGVAVPNGKVAFSVDEAVEAAKELGSSVSVVKAQIHAGGRGKAGGVKVAKNLDEVRTYAEEILGKTLVTHQTGPAGKEVKRLLIEEGCDIKSEYYIGLVVDRATSSVVLMASEEGGTEIEEVAEKTPEKIFKEVIDPAVGLQGFQARRIAFNINIPKELVGQAVKFMMGLYQVFVDKDASIAEINPLVTTGDGKVMALDAKFNFDSNALYRHKDILELRDLEEEDVKEIEASKHDLNYIALDGNIGCMVNGAGLAMATMDIIKHYNGDPANFLDVGGGATAEKVTEAFKLILSDENVKGIFVNIFGGIMKCDIIADGVIAATKEVGLEIPLVVRLEGTNVELGKKMLKESGLNITAADSMADGAQKIVSLVN

SEQ ID NO: 65100 - protein, 449 aa, Gibberella zeae PH-1
MRQASSDDRTLPVPNTYSEHKRGEKGGKGKMSKYIKPAGESGRTGFHPIHFSKISFRSTSRASLLCNFLWPFVPAAIAVRYAMPDNHVTIFALAYIAMIPCANMIGFAGQELSRKLPHVWGVLIEITIGSIVEIILFMVLLSKNMFYVIKAAILGSILATMLLCLGFCFFVGGMLEDEQVFSEAISEAGSGLLLTAGVVLALPTVFEYGVGNGETLTNQDLEHKTLQISRIVSILLIVAYLVYVFFQARTHHGIYDAVFEQDEHNDRDKHKDQAKAKLTLTECIIALVIAVGLVAWTAVILVMQIEFVIERGHVSDAFMGLILVPLVEKLAEHLTAIDEAWDNQINLAMSHVLGATLQTALFNAPLVVIVSWGLHKTLDLNFAVFDLVMLILAILTVGRFLQDQKSNYLEGFLLIILYVAIATAAWYYPDPANHGAGGGSAEGSSEGGH

SEQ ID NO: 65101 - protein, 213 aa, Oryza sativa Indica Group
MEKRHMYLMPEQIGGGEENGDNGTDSIERPGGAGGQAARRGVAARRRGGAGKAADLAYWESAARMIADASRSSKVVVEKSTVPVKTAEAIEKILAHNAHVVEFQALKDVYAQWVPVDRIITTNLWSAELSKLAVNAFLVQRVSSVNAISALCEATGTDFMEVATGAAQRLGAGSTAAADATSCAATASERSSLQEQSRNMPEPDSAAALSRPR

SEQ ID NO: 65102 - protein, 264 aa, Moritella sp. PE36
MDGIHGKVIIVTGASEGIGRALAIKLSRAGAKLMLAARNLERLQQVADELDGDVGIYACDVSDQAQCKALVAATLEQYGGLDILVNNAGITMWGRLDEMEDLAIYERMMQVNYLGAVYLTHAALPALKASKGSIATVASIAGLTGVPYRTGYAASKHAVIGFFDSLRIELKDDGIDITVICPDFVVTETHKRAIGTDGKPLGATPMQESKLMTAEQCAQLCLHAISHRQRLLITSLRGRLGRWFKLLVPSLIDRIADRAIRNRH

SEQ ID NO: 65103 - protein, 74 aa, Physcomitrella patens subsp. patens
MYEDPEDQFLDEPARRLLAARRRSYISYGALNRNRSPCPARSGRSYYTPNCNSNAGPARPYTRGCLRITRCQRV

SEQ ID NO: 65104 - protein, 422 aa, Wolinella succinogenes DSM 1740
MIYIDNIVAQEVMDSRGNPTVKATVTLSDGNSASAIVPSGASTGKREALELRDGDSRYLGKGVLQACENVNTKLSEELIGLSPFDQSEIDAIIQELDGTENFANIGANAALGVSMAVARSAAKSLNIPLYRYLGGANALTLPVPMLNIINGGSHADNTVDFQEYMIMPLGFENFSESLRASAEVYHHLKKILKDSKHITSIGDEGGFAPNLKTNEEPIQIIIQAIEKAGYRPGEEIALALDVASSEFVNEQGLYHLEGEGRTLSSEELVGYYESLIAKYPIVSIEDGLSEDDWKGWKYLTERLGGKVQLVGDDLFVTNAKILQEGISQGIANAILIKPNQIGTVSQTMQTVRLAQRNHYRCVMSHRSGESEDSFIADFAVALNTGEIKTGSTARSERIAKYNRLLAIESELCRSEYLGRSLF

SEQ ID NO: 65105 - protein, 7488 aa, Saccharopolyspora spinosa
MNSSHCWTTNDTSLAQSSDFRSPTSQGSEMTNEEKLRGYLKKATNDLLIARARLRELESGEQEPIAIVGMACRYPGGVTSPEELWELANSGGDGISGFPDNRGWDIGGLFDDYPGERGTSYAREGGFLHDAADFDAGFFGISPREALAMDPQQRLLLETSWEAIERAGIDPASLRGSESGVFVGVIYHDYGTSKTVEFPEDVEGYLATGNAGGVMSGRLAYTFGLEGPAVTIDTACSSSLVALHLAGQALRSGECDLALAGGVTVMATPGTFVEFSRQGALSADGRCKSFSDSADGTSWSEGVGILVVERLSDAQRKGHHVLAVVRGTAVNSDGASNGLTAPSGPSQQRVIRQALTAAGLAGVDVDVVEAHGTGTTLGDPIEAQALLATYGQGRPADRPLLLGSVKSNFGHTQAAAGVAGIIKMVMAMRRGVVPQSLHAEVPSSKVDWDSGAVVLATERVPWPDAGRLRRAGVSSFGISGTNAHVIVEQAPESPVAAPVTDTVIRPWVLSGRSPEALRAQAERLLSFVEDSPEIGAASVGRALALARAPFNHRAVVVGTRLADFRAGLASPNLLTGIADGGAKTAFVFAGQGSQRVGMGRELHARFPVFAEAFDAVAAQLELDLLSADEETLGRTEFTQPALFALEVALFRLLESWGVIPDFVAGHSIGEIAAAHVAGVLSLEDACVLVSARGRLMQALPAGGVMVAVQASEADLPPLPDGVSLAAVNGPRSMVIAGTEAAVSQVDGFKSRRLNVSHAFHSALMEPMLEEFRAVIADLSFGQPSIPAVSTVTGAVVTEEWGDPEYWIRHVRETVRFADGVHALESAGAGVFVELGPDGVLSAMIHENLADAVAIPLLREDRGEEETAVTALARIWTVGGTPDWAAVFADTPAVPVELPTYAFQRERYWPKTAVRPGNAAALGLGEIDHPMVGAAVELPGADGHVFTGSLSVRSHPWLADHVVAGTVLLPGTALLELALRAGEEVGCGRVEELTLETPVVLAEDIAVAVQVVVDAPDESGRRALSVYARQSDALDQLWTRHASGALAGAGRPAAEEGGSWPPAGAEPVDITGLYDRLAEAGFDYGPAFRGLRAVWRCGEDFFAEISLGEDERADAAAFGLHPALLDAALHVSGLDGETGRLPFSWTGVTPHAAGVPAARVRLTPLGADRLALEVSDQLGQPVLSVESLILRPVDVGVSGSPAVKVGRDSLFRLDWVPLDADAGIPGEPVIVLGEDQGAPGVTSFSDLAELTAAVDDGMAVPGTVYVPLETELADVPGAVRAATAEVLGLMRTWLADVRFSGSRMAFVTQGALPVGDLLDVVAASVWGLVRTAQSEHPNRFTLIDFDGEAESLAVLPMAAASGEPQAVVRDGEIRVGRLARIPAGYSAPHWDLDGTVLITGGTGSLGGLLARHLVAEREVRNLVLLSRSGSEAAGAVELVAELTELGAEVRVVACDAADRDALAEVLASIPAEHPLTAVIHAAGVLDDGVLDALTPERLDTVLRSKADAAWHLHELTRDLDLAAFILFSSAAGVFGNAGQGSYAAANTFLDGLAQYRRGLRLPALSLAWGAWMPSGGMTAGLAESDIRRMDRAGFPPLSHDQGLALFDLAAAESGVVVAMRLDARVVRRQPQIPPVLRGLVHAPLRRSAAADVARPGTLLDRLARADVSETRATAVLDLVRGQAAAVLGHSSATAIDIGQAFGEVGFDSLTAVELRNRLTAETGLSLPSTLIFDYPTPGLLAEFLLAEITGSEPAVPTPVRASAPATDDPIVIVGMACRFPGGVTSPEDLWDLVATGQDGVTGFPTDRGWDLEGLYNPDPDNWGTSYTRAGGFLHEAAEFDPHFFGISPREALATDPQQRLLLETSWEAFERAGIDPTSLRGSRGGVFVGSIYHDYTLSSLVQFPRDVEGYLGIGSAGSVVSGRLAYQFGFEGPAVTVDTACSSSLVALHLAAQALRSGECDLALAGGVTVMSTPGAFISFSRQRALSPDGRCKSFAEAADGTGWSEGSGVLVVERLSDARRLGHEVLAVVCGSAVNSDGASNGLTAPNGPSQQRVIRQALAASGLSTSDVDVVDAHGTGTRLGDPIEAQALLATYGQERDVPLLLGSVKSNIGHTQAAAGVAGIIKMVMAMRHGVVPRTLHVDQPSSHVDWAGGAVELVTESVSWPQAGRPRRAGVSSFGISGTNAHVIIEAAPATEPAEVAETVSTVVPWVLSGKSPQAVREQAARLVSFVDGQHPFDVGFSLATKRAVFEHRAAVGDLDGLRSLAEGVPAAGVFEGFTRDAVRTAFVFAGQGSQRVGMGQELYARFPVFAEAFDAVSDRLGNPVLDNEELLGQTEFTQPALFALEVALFRLLESWGVIPDFVAGHSIGEIAAAHVAGVLSLEDACVLVSARGRLMQALPAGGVMVAVQASEADLPPLPDGVSLAAVNGPHSLVIAGTEAAVSSVDGFRTRRLNVSHAFHSALMDPMLDDFRRVIEGLSFGRPTISAVSTVTGALVTDEWSDPEYWVRHVRETVRFADGVHALEAAGVTTFVELGPDGVLSAMVQENLADATAVPLLRKDRGEEAAIVAALGELYVHGINPDWPVLFAGGRRVELPTYAFQHERFWPKPKLAAGDASALGLRSAEHPLLGATVELPGSGGFLLTTRLSAALYPWLADHAVADTVLLPGTAFLELVIRAADEAGCGRVEELTLEAPLVLPGQEPVAVQVVVDAPDESGLRAVAVHSATDDGWTRHASGVLASAGRPAAFDLTVWPPEGAEPVTLDGFYERFAEAGFAYGPAFQGLASVWQRGEEIFAEVDPGVVDTSGFGLHPALLDAAVQSAVLAGLAETGGGRLPFLWSGVSLYANGASALRVRVSRSGEDAVSLEVSDQLGQPVASVESLTLRPVDLAGLSSTQTGPDALFRLDWTPMPAGAPGTAAVLGELTLPGSESYEDLAALGAAIDAGLPVPESVLIPVTSDPIEVPAAARAVTSEVLSLVQAWLADPRFADACAVFVTRNAVAGGEPVDVAAAPVWGLVRSAQTENPGRFGLVDLDSEDASLEALPGAVALAEPQAVVRGGEIRVGRLARAVADGLTLSAGDVPWRLDLGVKGTLENLVVVPAPELAGVLGAGQVRVGVRAAGVNFRDVLTVLGMYPGDNRLVGLEGAGVVLEVGPGVTGFVPGDRVFGIFEGGLGSLVVSDQRLLVKVPAGWSFEDAATVPVVFMTAYYGLKDLAGLRPGESVLVHAGAGGVGMAAIQLARWWGAEVFATASPSKWDSLRELGVPDDHIASSRTVEFEQRFGEVTGGRGVDVVLNSLAGEFVDASLRLLAPGGRFLEMGKTDVRAVSDVAYRAFDLFEAGLDRMQAMLADLVELFHAGAVRPLPLRSWDVRRVVEAFRFMSQARHVGKIVLTVPVPWDRDGTVLITGGTGGLGRLVARHLVVEHGVRSLLLLSRRGLDAEGVAELVAELSGQGAEVRVVACDAADRDALAVVLASERLTAVIHTAGVLDDGIVSALTPERFDTVLRPKVDAAWNLHELTKDHDLAAFVLFSSAAGVLGGAGQANYAAANTFLDALAEHRRRLGLPGLSLAWGAWEQSGGMTAGLDEADLQRMARSGMPPLPNAQGLALFDTALRSDHPAVVPTSLDLNVLRDLSEIPPILRGVVRGPVRRSAAATGTIGSASLRDRLSKLDQQDRRTAMVDLVRAQAAVVLGHSGSEMVDAGLAFTDLGFDSLTTVELRNRLNTATGLRLPATVIFDYPSPMVLADHLIGELFSTQMLATPVTMAVSDDPIVIVGMACRFPGEVTSPEDLWRLVSTGGDGIGEFPENRGWDLDFLFDDDPDRQGTSYARHGGFLYQAPDFDSGFFGISPREALAMDPQQRLLLETSWEAFERAGIDPTSLRGSRGGVYVGAIHYDYFASPLTQFSQNVEGYRATGNTSSVVSGRLAYQFGLEGPAVTVDTACSSSLVALHLAGQALRSGECDLALVGGVTVMSTPGAFVDFSRQRALSPDGRCKSFAEAADGTGWSEGVGVLVVERLSDARRWGHEVLAVVCGSAVNSDGASNGLTAPNGPSQQRVIRQALAVSGLSVSDVDVVEAHGTGTRLGDPIEAQALLATYGQERDVPLLLGSVKSNIGHTQAAAGVAGIIKMVMAMRHGVVPRTLHVDRPSSHVDWAGGAVELVTESVSWPRAGRPRRAGVSSFGISGTNAHVIIEVPPAAEPADVTEPADVTEPADVADVEAVEAVEAVSTVVPWVLSGRSPRAVWEQAGRLVSFVDGHDLLDVGFSLATTRAVFEHRAVVVGDRRALVAGLEALAGGGDGPELVVGVAGMAGKVVFVFPGQGSQWVGMAGGLLGSSRVFADSMAECAAVLSEFTDWWLFDVLDDEVALARVDVLQPVLWAVMVSLAALWRSFGVVPDAVVGHSQGEIAAACVAGALSLRDGARVVALRSRALRALAGGGGMVAVSLPVAEVAGYARRYGVSVAAVNSASSVVVSGEVPALEGLAEELGAAGVRVRRVPVDYGSHSGQVDSIRERVLRDLAGVTAVAARVPLYSTVTGEVLDTAGMDAAYWYRNLRETVRFQQATETLLGEGFGVFVEVSPHPVLTPAITDTVGERTLVVGSLRRDQGGLDRFLRSVAELHVRGVPVDWVPVFPGACRVGLPTYPFQRDRYWPEAVAGAGAGDVTAAGLGVVDHPLLGAGVELPGTDGYVFTGRLSLRTHPWLADHAVAGAVLFPGTGYVELAVRAGDQTGCDHLEELTLEKPLVFPGTGGVRIQVAVESPDESGRRVFGVYSRADDETETVWVCHATGVLRTGTPTTLPQPEPGVWPPPGAEPIDLDGFYQRLADADFGYGPAFQGLRAAWHCGDEIAAETALPDTIDPHGFTLHPALLDAALHPAVFTGFDEPVNRMPFSWNGISLHATGATHLRVRLRRTGTDTISLTLADPAGAPVASIDALTLRPADGAARRVWGAQESLFRLEWTPALAAAVAPAGSVAVLGDLALPGAESVRTLADLVAVPETVVIPLVATAGSTVPEAVRELTTQVLDLIHIWLSDSRFAGVRAVFVTAGAVRGVSDLAASGVWGLVRSAQVEHPGRFGLVDVDGDTVSAGAIAVAVGSGEPQAVVRGGEVLAARLARVPAGDGLVPAVGVPWRLDAGGRGTVLITGGTGGLGALLARHLVVEHGVRRLLLVSRRGGGAELVAELAAYGAEVGVVACDVADLDALAGVLGSVPVEHPLTAVVHAAGVLDDGVIESLTPERLDVVLRPKVDAAWNLHELTRDCDLSAFVMFSSVAGVFGGAGQGNYAAANTFLDALAEYRQSLGLPGQSLAWGMWDQRSGMTGHLGEADLRRMARSGMPPMSTEQGLALFDTATGLADAAVVVTPLDFRALRSQPEIPSVFTGLVRPAFRRSVAHAGGPGAETLRDQLVVLDAASRRAAVLDVVCGQAAVVLGHADGGVVGVEQRFTELGFDSLTAVELRNRLNTSTGLRLPPTLVFDYPTPTALADRLLDELLGDGDQGRVPTRTSASPSDDPIVIVGMACRFPGGVESPEDLWRLLVAGAEARGEFPVDRGWDLDGLYDPDPGHVGTTYARHGGFLYDAAEFDAGFFGISPREAMAMDPQQRLLLETSWQAFERAGIDVASIKGSNAGVFVGATHTGYAEALTRMPAATELQGHIGTGNTASVMSGRLAYTFGLEGPAVTVDTACSSSLVALHLAVQALSSGECDLALVGGVTVMATPALFVEFSRQRGLAPDGRSKAFADAADGVGWSEGVGMLVVERLAKARSLGHEVLAVVRGTAVNQDGASNGLTAPNGPSQQRVIRQALATAALSTQDVDAVEAHGTGTTLGDPIEAQALLATYGRDRVEGQPLWLGSVKSNIGHTQSAAGVAGVIKMVMALRNGVLPETLHVDTPSTNVDWDSGDVRLLTETVDWPEVGRARRGGVSSFGISGTNAHAILEQAPAAAPVTATPVPRPVVLPWVVSGKTPAAVRAQAARLAAYLRETTGVTAADVAISLAAHRSVLEHRAVLVGENYEELLNAVTELGQGGRSANLVEGTAHGRNRTAFLFAGQGSQRAGMGKELYARFPVFAEAFDAVSAALGSPVADDEESLALTGFTQPALFALEVSLFRLVESWGIVPDFVAGHSIGEIAAAHVSGVLSLEDAGVLVRERGRLMQALPAGGVMVAVEATEDELSPLPEGVSLAAVNGPRSVVIAGTEAAVSQVDGFRSRRLKVSHAFHSALMEPMLDEFREVVTGLSFGAPSIAAVSTVTGGIVSEEWRDPEYWVRQVRETVRFADGVRALEAAGVTAVVELGPDGALSALVQENLVGTAAIPLVRKDRGEEKSAVSALAELFVLGVEPDWAKLIAAGRRVELPTYAFQRERYWPTAVTGSGNAASLGLGATDHPLLGAGVELPESGGFLFTSRLSLTSHPWLVEHTIGGVVLLPGTAFLELAVHAGYEVGCGHVDELVLEVPLVLPHDGSVQIQVVLGGSDEAGARTVSVYSRGEDVQWTRHARGVVSAEVQPAVEEVPWPPVGAEPIGLDGFYQQLADAGFDYGPLFQGLKSVWRRGEGIFAEVDPGVVDTSGFGLHPALLDAAVHAAAFAGIGGPRADVLSTPGAASPEGGQLPFSFNGVSLHATGATSLRVRLSVSGPATVSLEVADQTGQPVVSVRALTLRPVDTGALSVANRDALFRLEWLTVSAGTPGSLAVLGELAVPGTPVFATLSELDIVPETLLIPIASGPGEIPDAVREVTGRVLDLVQTWLAAPQFARSRAFFVTRGAIAEGSAAEGAVDLAAASVWGLVRSAQTENPGRFGLVDLDSEDASLEALPGAVASGEPQVLVRAGEIRGGRLVRVPSSAVLTVPVPWDRDGTVLITGGTGGLGRLVARHLVVEHGVRSLLLLSRRGLDAEGVAELVAELSGQGAEVRVVACDAADRDALAVVLASERLTAVIHTAGVLDDGIVSALTPERFDTVLRPKVDAAWNLHELTKDHDLAAFVLFSSAAGVLGGAGQANYAAANTFLDALAEHRRRLGLPGLSLAWGAWEQSGGMTAGLDEADLQRMARSGMPPLPNAQGLALFDTALRSDHPAVVPTSLDLNVLHGLGEVPHLLRDVVRKPVRGTTRRSIPASGENVADRLAGLVGAERDQAILDLVRVEIAAVLGHNGVEGIEPGNALQELGFDSLTSVELRNRLNLATGLTLLPTLAFDHPTIGELAAHLATELAESAGAAPAAEVTALVEDGAPDIVSSLYREAHDAGQFRLASELLMSVARLRPTFSDAAELERKPKPVRLVGGDSGTHLVCFTPIVPLTGANLYYPLAAALPGGLTVSALASPGFVEGEKLPVDASVLVSLQAETVAEHVGEAPFVLAGLSSGGIVAHTTAKRLADCGKPPRAVILFDTYAMHDVSVLETGPHFMTAMFERAAGVVPIDSTRLSAYEWTCGLFGHWDPEPMPVPTLLIRASEPMSPDLTGKNWRTNLDGVSTIVDVPGNHYSLMEEFAASTAQVVHDWLRTLD

SEQ ID NO: 65106 - protein, 122 aa, Arabidopsis thaliana
  misc_feature (55)..(55): Xaa can be any naturally occurring amino acid
  misc_feature (106)..(106): Xaa can be any naturally occurring amino acid
  misc_feature (108)..(108): Xaa can be any naturally occurring amino acid
RTHIISSSFLSSATILPSPRHSTMGAPFNKLNSSPAFPTTHKANNDITSITSNYXRVNCMHVWPPILKKKSETLSYLPDLTDSELANEVDYLILNKWIPCVEFYLXTXFVYREHCNSPLFYY

SEQ ID NO: 65107 - protein, 570 aa, Lactococcus lactis
MGSSHHHHHHSSGLVPRGSHMASMYTVGDYLLDRLHELGIEEIFGVPGDYNLQFLDQIISREDMKWIGNANELNASYMADGYARTKKAAAFLTTFGVGELSAINGLAGSYAENLPVVEIVGSPTSKVQNDGKFVHHTLADGDFKHFMKMHEPVTAARTLLTAENATYEIDRVLSQLLKERKPVYINLPVDVAAAKAEKPALSLEKESSTTNTTEQVILSKIEESLKNAQKPVVIAGHEVISFGLEKTVTQFVSETKLPITTLNFGKSAVDESLPSFLGIYNGKLSEISLKNFVESADFILMLGVKLTDSSTGAFTHHLDENKMISLNIDEGIIFNKVVEDFDFRAVVSSLSELKGIEYEGQYIDKQYEEFIPSSAPLSQDRLWQAVESLTQSNETIVAEQGTSFFGASTIFLKSNSRFIGQPLWGSIGYTFPAALGSQIADKESRHLLFIGDGSLQLTVQELGLSIREKLNPICFIINNDGYTVEREIHGPTQSYNDIPMWNYSKLPETFGATEDRVVSKIVRTENEFVSVMKEAQADVNRMYWIELVLEKEDAPKLLKKMGKLFAEQNK

SEQ ID NO: 65108 - protein, 698 aa, Xanthomonas oryzae pv. oryzae KACC10331
MSYLVLARKWRPKRFAELVGQEHVVRALSNALDSGRVHHAFLFTGTRGVGKTTIARIFAKSLNCETGTSADPCGQCPACLDIDAGRYIDLLEIDAASNTGVDDVREVIENAQYMPSRGKFKVYLIDEVHMLSKAAFNALLKTLEEPPEHVKFLLATTDPQKLPVTVLSRCLQFNLKRLDEDQIQGQMTRILAAEQIESDLSAIVQLSKAADGSLRDGLSLLDQAIAYAGGALREDVVRTMLGTVDRTQVGAMLQSLADGDGARLMQVVAALAEFSPDWSGVLEALAEALHRVQVQQLVPSVAFVGDGIDPTPFAAQLRPEVVQLWYQMALNGRRDLYLAPSPRAGFEMAVLRMLAFRPAAAVPAGGSDDGRGTTAGGGARSAAAGGQAAAPALAAPVTAAPPMVAATAAVTDTMPVAAAEASLPASATQATPTPAAAPAPAPVVMLPPQESSSPSRASAASARIDDTPPWAVDDAPVRTQATTASDTMAVLAPEAAMASPSSAPVELAQPVAIASDAAEDAPVSVATSSPAALVEPSSFAEPAVVTPPATAVSAADSAADASALLDDGCIADAEQWLELVTRSGLNGPSRQLAANAAFIGHRDGVLRLALAPGFEYLHSERSIANLAQALAPVLGNTPRIVIETGSADVETLHERANRQKGERQSAAETAFMNDPTVQLLIQQQGARIVPDSIRPYDE

SEQ ID NO: 65109 - protein, 291 aa, Rhodopseudomonas palustris CGA009
MKIRKAVFPVAGLGTRVLPATKAMPKEMLTIVDRPLIQYVVDEAREAGIEHFVFVTGRNKGMIEDHFDRQFELDVTLEKRNKKSEMEILARDQPEAGAMSFTRQQAPHGLGHAVWCARDIVGNEPFAVVLPDELVLNTPGCLKQMIQAAEKLGDKANVIAVEEVPADKTHQYGICGVGKRDGKMFEIDGMVEKPAPGTAPSNLSISGRYILQPEIFQILATQERGAGGEIQLTDAMIGLSKTQKFYGVEFEGERHDCGSKAGFLRANIAFAMQRDDLRAGLIEDMKRYLEK

SEQ ID NO: 65110 - protein, 292 aa, Vibrio vulnificus YJ016
MSIKIKTTQQIERMRMAGKLAAEILEMIEPYIKEGVTTDELNQICHDYALEKGAYSAPLDYHGFPKSICTSINHIVCHGIPASKDEIGSNGQMKPAILKNGDIVNVDITVIVPDDEKADLSVRPQGFHGDTSKMFLVGDVSPANKRLCMVAQEALYIGMRQVKPGATVGDIGTAIEKYIKDNNKNNPRNKFSIVKDFCGHGIGDEFHEEPQVVHYRNSDRRVLKEGMCFTIEPMINAGKFGCTVDAEDDWTVYTGDGKNSAQWEHTILVTKEGCEVLTLRSEESIPRLMKNI

SEQ ID NO: 65111 - protein, 459 aa, Staphylococcus epidermidis RP62A
MTIIRDKFNNSKAFFNTHKTKNLKFRKQQLKLLSKNIKNHENELLDALYKDLGKSKVEAYATEISMLLKSIKLMRKELKNWSKTKQTDTPLYLFPTKSYIKKEPYGTVLIIGPFNYPVQLVFEPLIGAIAAGNTAIVKPSELTPHVAIVIKDIIEDTFDEAYVSVVEGGIEETQALLSLPFDYMFFTGSEKVGKIVYEAAARKLIPVTLELGGKSPVIVDDTANIKVASERISFGKFTNAGQTCVAPDYILVQRKVKNDLIKALKKTIIEFYGENIEKSPDFGRIVNQKHFNRLNDLIQIHKDNVVFGGNSSKEDLYIEPTLLDNITNDNKIMKEEIFGPILPIITYDNFDEVLEIIQSKSKPLSLYLFSEDENMTHRVVEELSFGGGAINDTLMHLANPNLPFGGVGSSGIGQYHGKYSFDTFSHMKSYTFKSTRLESSLFFPPYKGKFKYIKTFFKN

SEQ ID NO: 65112 - protein, 160 aa, Bartonella henselae str. Houston-1
MHVSIFAVGRMKKGAEQALVHHYLDRFSKSCSAVGFHFKILQEISESRAPTACQRMEEEGRRLIEFLPEKCRLIVLDERGKTVSSFAFAEQLGFYRDEGVRDVIIALGGPDGHNEQIRNRADFLLSFGFMTWPHQIARILLTEQLYRAVTIASNHPYHRF

SEQ ID NO: 65113 - protein, 484 aa, Rhodopseudomonas palustris CGA009
MGKVTGFLEIERHDRVYAPVTDRVKNYNEFVVPLSEKDLRDQAARCMNCGIPYCHGTGSAQPGATGCPVNNQIPDWNDLVYNGYWQEAARTLHSTNNFPEFTGRICPAPCEASCTLNIDDNPVTIKTIECAIVDTAFDNGWVTPEIAAVKTGQSVAVVGAGPAGLACAQQLARAGHDVHVYEKFAKAGGLLRYGIPDFKMEKTLIDRRVAQMEAEGVTFHYGAPVGGSAPGAVDPAELLKQYDAVALTGGAEAPRDLPIPGRELGGIHFAMDFLTQQNRRVSGEAVNGTDILAAGKNVVVIGGGDTGSDCIGTSIRQGAKSVTQIEIMPAPPERENKALTWPNWPMKMRTSSSQAEGAAREFAVMTQSFEGEGGVVKKLNCVRVDAKFQPIPGTEFTLEADLVLLAMGFVSPVKEGLLTQLGVALDPRGNVAADLSHFTTSVDKVFAAGDMRRGQSLVVWAIREGRLCAQAIDRFLMGATTLPR

SEQ ID NO: 65114 - protein, 1194 aa, Aspergillus oryzae
MESNHRSDDHNTGRRVRSTGAASTVVPEEALVLGNPNTTLSSFAQLAALRLDVERVLTSVSDRNSQFILAQSTRSTATSNKHEMSGDGVWSGCSTISTEAWKMCAATVALGPSKKEEGHCKFLVIDDLSQHDEYKGLSFVREKPNFRFYAGTPLTTETNINIGCLFILDTKPHDGLTDTDKQTMKTVSMLIMDYLRVSRQASEGRRAARLSRGLSCFVEGSSSFVDTSHPSYAGSFAAVPGTPQSSCLRANHLSVGSLNSFELPSRRSQSSDARSISSMSEGRGDSGLSPLPDWWSGNRGNQRLDEVHGNSWAFKRAANLLRESLELGDDGGVIFLEAGNTPMLDIESGSDCSTENSSPAPVLAISTNDEPFAPGPGSSNLYPASNFDSSFLHQLLRRYSKGKLWSFHRDGLVSSSDDEKPSRSRSRATKTSELGRGTGKKWKSLENSMLNLYFPNATQVLFVPLWNAANSQWFSGCFCWNTVETRVFNSSVELSSVLGFGSSIMAEYSRVESLISDRQKGDFIGSISSAIDRYLFHRHELRSPLHGILAAAEFLSGTKLDDFQGSLLETIDACGRTLLDTMNQVLDYSKIVSLEKSWRQIKRDKTVPSDYRALDRLSAHLDTYVSTDLALLTEEVVEGVCLGHAYGQKSTISSDQPVVVSPMEDPGDKGSLSHPRPEVDVVVNIAQNDWVYQTQPGALRRIIMNVFGNAMKYTDSGRVSVRLEVTEAEGRCRRSGMEELVTLVVSDTGKGISEEFLRGRLYTPFAQEDTLAVGTGLGLSIVRSLVKSLNGRINVNSTPGEGTTVKVTLPLLRPDVEDIAEDPLTPRSPSAKEKDSPTESRLLRDNHAGRRVAIAGVEPDEIAGHPWWSIISRYLTEWYGLELVSWSSQGPVDIVLSEGATSAADLKKQFATKVPALLLLCDKSVDRATKLKECSSLASIVNIIRPPCGPHKLARSIRKCFDSHANSIPTTKSIVLPERPKFIPDGKGGFESEFSDDVADLTPDATSSSGASSLLGSAHSPTHSEIPEILPTIMSPSSSVRDPSPSEIKEPESKPQRLARVLVVDDNAINLNLMLTFMKKRNLSTLDSAENGKVAVDAVERLQQGYDLIFMDISMPVMNGFEATRAIRAIEKERDCCTPATIIALTGLSSSRDESEALTSGVDLFLTKPVSFKEVSRLLEEWAENGLGNRCLSS

SEQ ID NO: 65115 - protein, 529 aa, Yarrowia lipolytica CLIB122
MSEPDYLKLILKSRVYDVCKETPVTSAHGLSEKLGCKVLLKREDLQPVFSFKLRGAYNMISQLSDEEKWKGVIACSAGNHAQGVAFSANYLNIPATIVMPLATPSIKHSNVSRLGGKVVLHGDDFDSAKAHCKQLCEKYGLTDIPPFDHPHVIAGQGTIGMEILRQASDNLKAVFICVGGGGLIAGVGAYIKRIQPDVKIIAVETYDACALKQSLIKGERVTLPEVGLFADGAAVKLCGEETFRLCRKYVDGVVLVNTDEICAAIKDVFEATRSVVEPAGALSVAGLKKYCSDPSAIWWSPESDSAKANGIPTNVAISETDEYLSILSGANMNFDRLRFVAERAMLGEGTEVFMVVTIPDIPGAFEKLHEIILPRAVTEFSYRKKSTAENEDANIFVSFSVKNRQEEIADVLEKLQAAGMSGVDVSDNELAKTHARYLVGGQPDVPNERLFRFEFPERPNALKNFLGGVQTKWNITLFHYRNNGSDIGKILTALDVPESDNEALKEFLEKLKYPFVEETDNVVYKQFMK

SEQ ID NO: 65116 - protein, 496 aa, Burkholderia pseudomallei K96243
MTAFDSSLVPSGDILIGGEWRRGRGATTPSFYPADGSLNTEIHMADAADAREAVQAADAAWRRADWAGLKPHQRADVLYRIADLIHAHREALAQLQRRDNGKPINETRALVASAANTFRYFAACAQTLDEALTPSRGDYLSMSVHEPLGVVAAITPWNSPIASDAQKLGPALAAGNAVVLKPAEVTPLASLALARLCEQAGVPRGVISVLPGKGSVIGDALVRDPLVKKVSFTGGTEVGRGIARLAAEKLMPLSLELGGKSPTIVFDDAELDHAVNGVLYGIFSSSGESCIAGSRLFVQRSIYGAFVARLVEAARKLRVGDPASERTQMGPLITARHRDTVERYVALGRDEGARVLCGGERPTGEGRDAGFFYLPTILDGLSNHARICREEIFGPVLVALPFDDEAALVADANDSVFGLAAGIWTRDYKRAWRVARALDAGTVWINTYKQFSISTPFSGRKESGMGREKGSLGIREYMQQKSLYWGLNDSPLPWAN

SEQ ID NO: 65117 - protein, 176 aa, Triticum aestivum
MATAEGKNKIIKLKSSDGKEFEVEQAVAMESQMIRHMIEDEYTDNGLLLRNVNSKILSKVIEYCNKHVQAKAADTSDFGGGARPLGATSAVPAASAEDLKNWDANFVKVDTATIFDLALAANHLNIRGLLDLTCQTVADMMTGKTPEEIRKIFNINEKLRPGEEEKIRRENQWAFE

SEQ ID NO: 65118 - protein, 1123 aa, Arabidopsis thaliana
MAYRFLEEATDSSSSSSSSKLESSPVDAVLFVGMSLVLGIASRHLLRGTRVPYTVALLVIGIALGSLEYGAKHNLGKIGHGIRIWNEIDPELLLAVFLPALLFESSFSMEVHQIKRCLGQMVLLAVPGVLISTACLGSLVKVTFPYEWDWKTSLLLGGLLSATDPVAVVALLKELGASKKLSTIIEGESLMNDGTAIVVFQLFLKMAMGQNSDWSSIIKFLLKVALGAVGIGLAFGIASVIWLKFIFNDTVIEITLTIAVSYFAYYTAQEFYAAFARTAFKGDSQKSLHHFWEMVAYIANTLIFILSGVVIAEGILDSDKIAYQGNSWRFLFLLYVYIQLSRVVVVGVLYPLLCRFGYGLDWKESIILVWSGLRGAVALALSLSVKQSSGNSHISKETGTLFLFFTGGIVFLTLIVNGSTTQFVLRLLRMDILPAPKKRILEYTKYEMLNKALRAFQDLGDDEELGPADWPTVESYISSLKGSEGELVHHPHNGSKIGSLDPKSLKDIRMRFLNGVQATYWEMLDEGRISEVTANILMQSVDEALDQVSTTLCDWRGLKPHVNFPNYYNFLHSKVVPRKLVTYFAVERLESACYISAAFLRAHTIARQQLYDFLGESNIGSIVINESEKEGEEAKKFLEKVRSSFPQVLRVVKTKQVTYSVLNHLLGYIENLEKVGLLEEKEIAHLHDAVQTGLKKLLRNPPIVKLPKLSDMITSHPLSVALPPAFCEPLKHSKKEPMKLRGVTLYKEGSKPTGVWLIFDGIVKWKSKILSNNHSLHPTFSHGSTLGLYEVLTGKPYLCDLITDSMVLCFFIDSEKILSLQSDSTIDDFLWQESALVLLKLLRPQIFESVAMQELRALVSTESSKLTTYVTGESIEIDCNSIGLLLEGFVKPVGIKEELISSPAALSPSNGNQSFHNSSEASGIMRVSFSQQATQYIVETRARAIIFNIGAFGADRTLHRRPSSLTPPRSSSSDQLQRSFRKEHRGLMSWPENIYAKQQQEINKTTLSLSERAMQLSIFGSMVNVYRRSVSFGGIYNNKLQDNLLYKKLPLNPAQGLVSAKSESSIVTKKQLETRKHACQLPLKGESSTRQNTMVESSDEEDEDEGIVVRIDSPSKIVFRNDL

SEQ ID NO: 65119 - protein, 637 aa, Debaryomyces hansenii CBS767
MLKANNFNTRIAKTTKLGKIQIRSNSNGVNNSNSSIHTHTIKTPVGIKAAIASLKPKTTRLSIEGPIECDLQGFALLNAPGFNKGSAFSKEERQAFGLEGLLPSRINSLDEQVERAYRQFSYLKTPLAKNDFCTSMRIQNKVLYYELVRRHIREMIPIIYTPTEGDAIAAYSHRFRKPEGCFLDITEPDMIDKRLSAFGEDKDIDYIVVSDGEGILGIGDQGVGGVRIAIAKLGLMTLCGGVHPGRVLPIVLDVGTNNQELLHDELYMGNKFPRVRGKEYWDFIDKFINAVKQRFPNAVLHYEDFGVSTGRKMLQKYRESLPSFNDDIQGTGAVVMASMTAALQFSDRNLLDSKVLIYGAGSAGLGIADQIVNHMVSHGATEEQAVASIHCMDRRGLLLKSFDEMSDAQTKYADVDSEWEGVDTRNLVEVIRHVKPTVLVGCSTQAGAFTEQVIKEMYNHNKQPIVFPLSNPTRLHEAFPIDIMKWTDNKALIATGSPFEPVNGFAISENNNCFTFPGIGLGAVLSRCTTISDTMVSAAVDQLALLSPKMENPKNGLLPRLEQIDEVSAKVATAVILQSLKEGTARVESEEKPDGGFVEVPKDFNKCLKWVQSQMWKPIYRPLVKVKHVPEVHTYQH

SEQ ID NO: 65120 - protein, 276 aa, Oryza sativa Japonica Group
MAFRLSNSLLGILNAVTFLLSVPVLGGGIWLATRADGTECERYFSAPVIAFGVFLLLVSLAGLVGACCRVNCLLWFYLVAMFVLIVVLFCFTVFAFVVTNKGAGEAVSGRGYKEYRLGDYSNWLQKRMENSKNWNRIRSCLQDSKVCKKLQDKNWDRTQFFKADLSPLESGCCKPPSSCNFLYVSGTNWTKVPTNSSDPDCNTWVDDGTQLCYNCQSCKAGAVATLKRDWKRVAVVCIVFLVFIVIVYSLGCCAFRNNRRDNRGAYRGAAWKGGYA

SEQ ID NO: 65121 - protein, 476 aa, Saccharopolyspora spinosa
MPAQAAVIDGKLVEGPETLDVLDPSTGTLLDRTLRGTGEHVDAAVAAARAASREWAHTPYSERSAILRRIGELIRRDRGEFALLESQDTGKPLAQACADTDVAARYFEYYANTMEAFFGHSLPPNGDFVAYTRHVPFGVTGHIIPWNYPLQIGCRTIAPAIAVGNCAVVKPAEEAPLSVLKVARTALEAGLPAGVLNVVPGLGAQAGAALAGHAGIDHLSFTGSVPVGAAVAHAAAENVIPVVLELGGKSPNIVFPDADLDAAIPVIVKSMLQNAGQTCSAGSRLLVHEEVRDEVLARIDEALRGVRIGPGPQDLDLGPLISAKQRDRVTQMVQRAADSGARQLGGPGQVELPEGGFYFPPTVFTDVDPAQEIAQEEVFGPVLAAMSFGTVDEAIQLANGTQYGLIAAAWTRNLDVAHVMAEEIRAGQVYLNTYGGGGGVEYTFGGFGKSGYGREKGFEALKGFCQTKTIVTKVTR

SEQ ID NO: 65122 - protein, 306 aa, Sporothrix schenckii
MDGKRQLNSFQQLEKLGEGTYATVFKGRNRHTGEFVALKEIHLDSEEGTPSTAIREISLMKELKHENIVALHDVIHTESKLMLVFEYMDGDLKKYMDTNGERGALKPMLIKSFMYQLLKGIDFCHQNRVLHRDLKPQNLLINGKGQLKLGDFGLARAFGIPVNTFSNEVVTLWYRAPDVLLGSRTYNTSIDIWSVGCIMAEMYTGRPLFPGTTNEDQMLRIFRIMGTPTEHNWPGISQFPEYKATAPRYATQDLRQILPQIDATGIDLLQRLLQLRPELRISAHDALQHPWFHDILQYQHCQQAAG

SEQ ID NO: 65123 - protein, 586 aa, Lactobacillus sakei subsp. sakei 23K
MKKTKIVSTLGPASNSVEIITKLIEAGANVFRFNFSHGDHEEHLSRMNMVREAEKATGKTVGIMLDTKGAEIRTTVQQGKKFELHTGEVVRISMDDTLEGTPEKIAVTYPGLYDDTHVGGHVLIDDGLVDLKIIEKDEANKELVTEVQNDGMVGSRKGVNAPGVSINLPGITEKDASDIRFGLDNDINFIAASFVRKPQDVLDIRELLEEKHMEHVQIFPKIESQEGIDNIDDIMKVSDGLMIARGDMGVEIPFENVPFVQKNLIKKCNAIGKPVITATQMLDSMQENPRPTRAEVNDVANAVIDGTDATMLSGESANGDYPVEAVATMARIDERTEKSLTDRDAYALKAYSKTNLTESIGQAVAHTARNLGIKTIVAATESGSTARMISKYRPQADILAVTFDERTRRGLTVNYGVYPVMAKKPANTDDMFNLATQTAQEHGFAKEGDLILITAGVPVGERGTTNVMKIQLIGSKLTQGQGVGDETIVGKAVVASNAKEAAEKAVDGGILVVKATDKDYLPAIEKSSAIVVENGGLTSHAAVVGIAMGIPVVVGAKDATEAIKDGEVVTVDSRRGIVYRGATNAL

SEQ ID NO: 65124 - protein, 261 aa, Escherichia coli
SIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 65125 - protein, 424 aa, Oryza sativa
MQLLGAPPPVLPSGSAAPTNTPATAAAEEEEEESLLEGHKAAREWAQVHGQHEGRTWAVGSGAAATLGQSNGRDAPARAEDGSFGLVLLLFVPHLLLHARLWLLSPTFASQPQQFSQVTSAAESRRVELDLDATTSFFGVYDGHGGAEVAMYCAKRFHTMLLEDVDYINNLPNAITSVCFRLDDDLQRSNEWRESLNPCANRNCLTNICANLHHFTEDYVPPSYEGSTACVVIIRGNQIIVGNVGDSRCVLSKNGQAISLSFDHKPHHEAERERIQRAGGHVFLQRILGMLATSRAIGDFAYKQNRNMPPSQQMVTCVPDIRVENITDDTEFLVIASDGVWDGMRNNNVVQFVRQELRPGEENLRETCEKLVGHCLHSNDNATAILVKFKPIEEDPDEVASARDEHQHNPEGGDEKLDINNDND

SEQ ID NO: 65126 - protein, 263 aa, Escherichia coli
ASSIKTPEDIEKMRVAGRLAAEVLEMIEPYVKPGVSTGELDRICNDYIVNEQHAVSACLGYHGYPKSVCISINEVVCHGIPDDAKLLKDGDIVNIDVTVIKDGFHGDTSKMFIVGKPTIMGERLCRITQESLYLALRMVKPGINLREIGAAIQKFVEAEGFSVVREYCGHGIGRGFHEEPQVLHYDSRETNVVLKPGMTFTIEPMVNAGKKEIRTMKDGWTVKTKDRSLSAQYEHTIVVTDNGCEILTLRKDDTIPAIISHDE

SEQ ID NO: 65127 - protein, 982 aa, Chlamydomonas reinhardtii
MAARDHGFEGHWVYMPACQPLPSKFEWSRDMSPAQADLLAQLPFTLAVPQYGVAVVHAGLVPGVPLKQQKLWACYKMRNLVPHPHGDGGGGGGGGGSTSGSGGADPATATSASTSTSTSAGTLTATASSTVTGHAPGARYTAVEKAKEGGQAWAPLWPGAEPPAQHVFFGHDAKRRLQLAPHATGLDTGCVYGGELTAAVLPPLGELVASSPGFVAAMRHGRPLTREDLRVQLVSVPAARVYSAPDGHADTAAAGAATAAAAAMARKASPAWCLSAALLLVALGIASAGPALVPDSVKPDPKGDGYIVSFTLNVTVAYGAPSCFARSIVLTSGYFEPAIVINQGDTLRINLINNIPASFPTVSDGISIHYHGLRMSGPAAWLDGVSYIGLCPVAPGSSYQYEFKVNDPPGTYLWHDHAAGFKGDGLEGPLIVLPPRAGPPVLPQPGAAPAWPPAAQPDLWSYDGDETLFLGDWYHATTSSMLFRLNQPFDNAKVTNDSGAWNWVGNPQAVLVNGAGFYGDCSLYPVAGGGPTPPACAPSAFTVAAGRSAQQPWASNNNPGCTHTQVTVQPGKTYRLRLVNAALLVYMTVCFEGHNVTLIAADAVPVAPVSTQCVDVNSGQRIDVLLKADQPAANYWISVVPQYRTGAPAGYAVLHYAAAGVNASTFPATTAPQPVSITPWSDSMNAKVVLAPELLVPSTDPKVARYRRPGQASLAPPAAASKLVYVNLSQPLFNENGQLRWALDNVAMPRTPPCQPLLSSLRKDPKYLTKQAVPASQLNGTGVGPNVLVGTAGKSRTTPVYYEGLSPVPVYPSVGLHIVELAGGAVVDLIVNNNPANSFNGDLRPVDGPTRIAMEQHPFHLHGHRFWVLGRGTGGNYNASAHAAGLNTANPSYRDTVTIAAGGWAYLRFVADNPGIWPFHCHILPHIFMGQQLYFVEDIKNLAPPPSKTPKCPSACRYNFAPYTKSWLRAKYGMSGWELPPL

SEQ ID NO: 65128 - protein, 383 aa, Mycobacterium avium 104
MKVVIEADGGSRGNPGPAGYGAVVWTPDRGTVLAENKQAIGRATNNVAEYRGLIAGLDDALKLGATEAEVYLDSKLLVEQMSGRWKVKHPDLIELHAQARGLAARFDRISYSWIPRERNSHADRLANEAMDAAAAATGTAEKPEPAEKPGRAEQSDPTAVDAGKTAAAPSPAAPGWTGARGTPTRLLLLRHGQTELSVQRRYSGRGNPALTETGRRQADAAARYLAARGGISAVFASPLQRAYDTAAVAAKALGLDVTVDDDLIETDFGAWEGLTFGEAAERDPGLHRRWLRDTSTAPPGGESFDSVAERVSRVRQKIIAAQQGSTVLVVSHVTPIKMLLREALDAGPGILYRLHLDLASLSIAEFYSDGAASVRLVNQTGYL

SEQ ID NO: 65129 - protein, 538 aa, Arabidopsis thaliana
MADEKNGGRLSDASDYSSEDEGTEDYRRGGYHTVRVGDTFKNGSYVIQSKLGWGHFSTVWLAWDTLNSRYVALKIQKSAQHYTEAAMDEIKILKQIAEGDAEDKKCVVKLLDHFKHAGPNGQHVCMVFEYLGDNLLSVIKYSDYRGVPLHMVKEICFHILVGLDYLHRELSIIHTDIKPENILLCSTIDPEADARKSGIPLVLPTVKDKAVPERPVGKEKPKSYTYSADLTKNQKKKIRKKAKKVEGSEENERDSSNSEARPNGNATVERLEESSERVKDAENVSQKSRGNRRGSRSTRQKLLADVDRKCKLVDFGNACWTYKQFTSDIQTRQYRCPEVVLGSKYSTSADMWSFACICFELATGDVLFDPHSGENFERDEDHLALMMELLGMMPRKIALGGRHSRDFFNRQGELRHIRRLRFWPLSKVLTDKYDFSEEDAIAMQDFITPILQFVPEKRPTAAQCLTHPWLNPVPKSLKPSSSPQNPKEEEEEASDEDKDKEKVEREAMEAGVGNIAIDGSERKTSAREGRQSARDLRT

SEQ ID NO: 65130 - protein, 176 aa, Bartonella henselae str. Houston-1
MNIKEIAVGKNPPEDVNVIVEVSLGGQPIKYEMDKKSGALFVDRFLYTSMVYPGNYGFVPHTLSEDGDPIDVLICNTRPLLPGCVINVYPIGALIMEDDGGKDEKIIAIPTPKLTQRYNNIHDYTDLPEITLKQIEHFFEHYKDLEPGKWAKIEGWRDKSFAHELIKQAIERNKEL

SEQ ID NO: 65131 - protein, 468 aa, Burkholderia pseudomallei K96243
MSTLETAIAGAPAADTAAGAATPGAIIARIERLPANAMQIRARVLIGTATFFDGFDVITIAATLPLLIHKWGLSPNQIGMLIASGAIGQLLGAFLFPALAQKHGRVRAIAWSSAVIGVTSIACGFASTFETFVLLRIVQGLGLGGELPVAATYINEITRAHGRGRFVLLYEIVFPIGLLASMAFGAWLVPRFGWEVMYFIGGMPLLLALVLTRLVPESPRWLASRGRLDEAGRALHAFEASVKEPLPPVAHAGEFDTLVLSHPKRRMVDLFGPAYLKRTLAVATLWATCGFIQYGLSTWLPTIYKNFYHAPLQLALNLAVIGSVMGVAGSLVSALAVDVVGRKPVIVWSFVLCALSLVFAGVYHASSVYVVAAFCSLALGLMASGFITSYVYTPEQYPTSIRAAGCGLGSAWLKIASFVAPMVVPRAIVGGDLSPAFYLLAAVPLIAALTVHSVGIETKGQVLEKLEA

SEQ ID NO: 65132 - protein, 337 aa, Chlamydomonas reinhardtii
MRSALCGGHGVATRMARAVVAPQAPARLTSSRQIWNMAKGFGLGFASTKPLHNRPPLKQGKVSPKSPVPAHIRRPPYADKGNFPPWADRSQVHNEEGKRKMRASGRLAAQVLEYAGSLVRPGITTDEIDKAVHAMIIENGAYPSPLNYGKFPKSVCTSVNECVCHGIPDDRALEEGDILNIDVTVYLDGYHGDTSRMFYVGEVDPAAKKLCEVTQEALLEAIKKCAPGVPYNAIGKTIQTIADKHKYGVIRDYVGHGVGAAFHSHPTIFHYKNTQPGVMQLGETFTIEPMIVQGGIKCDTWRDNWTVVTKDRGLCAQFEHTILITETGADILTRVDA

SEQ ID NO: 65133 - protein, 248 aa, Rickettsia conorii str. Malish 7
MIKRRKKMIDLTGKTSLITGASGGIGGAIARLLHKLGSHVIISGSNEEKLQSLGKVVKDNYTIEVCNLADKEECRNLISKASKLDILVCNAGITSDTLAIRMKDEDFDKVIDINLKANFILNREAIKKMIQNRYGRIINISSIVGISGNPGQANYCASKAGLIGMTKSLSYEVATRGITVNTVAPGFIKSDMTDKLNEKQREAIVQKIPLGTYGMPEDVAHAVAFLASDQASYITGQTIHVNGGMLMV

SEQ ID NO: 65134 - protein, 299 aa, Yarrowia lipolytica CLIB122
MTAVRVRLCGGLATHNLFIRHYSRKPISLKLPDLDFSTPKKQINFCDKCPPPDRDTPYTRLFPAEHEDAIDYKKSMPAAFHLRHLLISTGSHKWPKAIEKDEGTLAGLIAEKRHEFPLRSKMAKAGILISNTTLPSEPGVSDVSSAYLFPDNLFIPEIPHPKTQEFLDTLLEQNDEIRAIKLKENFGARDNSADLWLVCGHAERDARCGDIGPLILGEMDEIKQEYARDTSRDSPRDIHTALISHIGGHAFAGNVLLFSGQTGSSSWFGRVRPEHIQGLVKEWNDGRIVKELYRGSFAD

SEQ ID NO: 65135 - protein, 299 aa, Bartonella henselae str. Houston-1
MKVRKIRKAVFPVAGLGTRFLPATKTIPKEMLTVVDKPVIQYVVDEAREAGIEHFIFVTGRNKAVIEDYFDTQVELYTTLAERGKRGELDHLQALQLPPGTTSFTRQQQPLGLGHALWCARELVGEEPFALLLPDMLIQAKKSCLSEMVNLYEKTAGGNIVAVQECDPGEAHKYGIVGKGKQIANGFEITKMVEKPKKGTAPSNLYINGRYILQPEIFNILSDQERGSGNEIQLTDAMMRLLNEQDFFGFQLEGRTFDCGSKAGFIEANVAFSLARADMHSQVSASLKNLLEIIKIEKL

SEQ ID NO: 65136 - protein, 112 aa, Arabidopsis lyrata subsp. petraea
LVEKFGIDPNNAFAFWDWVGGRYSVCSAVGVLPLSLQYGFSVVEKFLKGASSVDQHFQSTPIEKNIPVLLGLLSVWNVSFLGYPARAILPYSQALEKFAPHIQQVSMESNGK

SEQ ID NO: 65137 - protein, 494 aa, Aspergillus oryzae
MTYDPENAMGEARADAPVEAEKEHEATQTTVKESTLGYDNSSDPSRRDSYRPTKLQSNLTIVSCYIANFSDGFQNSLANPTNVIFKKLLGTDGYPSEMQTRISNSLLIGAILGVLALGYTSDMFSRRAGLLFTSGLVAIGTLMSTLALQVHPTYNMLWYFVIVRGIAGFGVGGEYPPSAAAGIEESDDFKRKYRGPLFVSFTTLMATSAAPIQMIVYLICLIASNDNLPVTFHAIYSIATILPVIIMVLRFFMTDSTLFHYSNFKRQKRPLKFYLLLLKRYRWRLFTTSLAFFLYDFINFPNSIMSSTIINSLVKDHNIRTTAIWQVILGALPVPGVIVGAWLTNAIGRRYTGILGFAGYMVLGFVIGGTFPHLSKNMPAFVVLYGLLQALGHMGPGATIGLISTESFPTAMRGMGYSIATAFGRTGAAVGTQCFTPLQERAGKQSTFYLAGGIAILGMIVYWFLPESSELNLEEEDRDLSVFLAENGFPMEKA

SEQ ID NO: 65138 - protein, 429 aa, Oryza sativa Indica Group
MALHVLASMGDLWRRYAPHNLMILSQLCYTLMYFITEAAFNKGLNPFIYVTYRHLVVAVFLAPFAYYQEKKLRPRMTLMLFLEIFVLSLLGVSLTLNMYFASLMYTSPTFVTSVVNTVASITFVIAIVVRCPTFSRISRRTHAESDRLYCSLSAWLTLARDQINLDAVRMEIVDVRSIRGLAKIAGTVVSFAGVTTMTLYKGTAISSPWKAPISIHGGGGGGGVHESWLKGSFLAVASCICWSIWYILQASSLKRYPAQLSLTAWMCTVGGIQSAVFTAFMQHKPEDWRIGFGLKFWCIVYSGFACNGFTVFAQLWCTEKKGPVFVTMFNPLSTIMVAILAYFMFGENLYVGSIIGGVVVILGLYMLLWGKDKDQEYNANKQQESDLDCEKQARITEFSAAQNDQEEPRRMKKFSTASYHKSTTLQRVV

SEQ ID NO: 65139 - protein, 315 aa, Oryza sativa Indica Group
MDAPPAFRSSSPSSSNASVPMVVITVVGILAAFALLASYYAFVTKCQALRGLWSRGATPWHGHGGGGARRRAAREASVIRTVATEERGLGMPFIRMLPVVRFTAAACGGAGGEGGGGGVGARISVSECAVCLSEFVERERVRLLPNCSHAFHIDCIDTWLQGNARCPFCRSDVTLPFTPPAAAAPVRPTSATHPDDDEDAESARRHHHHHHHHHHNHNHRPDDELINSIVIEVRGEHESWVSHRGGAAAAPPATKRTPQRWRKPESVGDEAIDTRKKYDEEFAVQPMRRSLSMDSSCHKQLYVSVQEFLTQQRQV

SEQ ID NO: 65140 - protein, 355 aa, Medicago truncatula
MNSETETPSSTTSFWCYSCTRFIHILNQNNVVCPHCQNGFVEEIHAGQSPAVSLFADGIQSSRRQTSRRRRRNAGGSRSPFNPVIVLRGPREDTTAGVGADAGGGDSEGNTSSFELYYEDSNGTDLRPLPPSMSELLLGSGFDRLLEQFSQIEINGFGRSENPPASKAAIESIPTVEITDSEMESEIHCAVCKEQFELGSEARKMPCNHLYHSDCILPWLSMRNSCPVCRHELPSDQNASESRISGQIDEEAVGLTIWRLPGGGFAVGRFAGGRRAGEIQLPIVYTEMDGNNSNEDSRRISLTVGSNRVRERRGIRRIFRNFLSFFGNVNLNRSFSGSLFRRSSRRRSRTWVTEE

SEQ ID NO: 65141 - protein, 133 aa, Triticum aestivum
  misc_feature (97)..(97): Xaa can be any naturally occurring amino acid
MAAPSPAVAAVSSSAPSSGLLPPRRAAPCSAVPLPSMRSTAPGVRMATVARAVGDVAAEGNTFLIAGAVAVALVGTAFPIFFSRKDTCPECDGAGFXVRKSGSTLRANAARKDQAQIVCANCNGLGKLGQIDK

SEQ ID NO: 65142 - protein, 177 aa, Musa x paradisiaca
FGSVYRGELPDSGAIAVKRLESIRQGEKQFRMEVSTIGTIHHVNLVRLRGFCCEGDKRLLVYDYMPMGSLDSVLFADGREALDWKKRYRIALGISRGLAYLHEKCRECIMHCDIKPENILLDMDMCPKIADFGMAKLLGREFSRVLTTVRGTIGYLAPEWITGSAITPKADIYSFGV

SEQ ID NO: 65143 - protein, 312 aa, Xanthomonas axonopodis pv. citri str. 306
MTKKIPLLIDTDPGVDDALALLMAFNDNRHEVVGLTIAAGNVGLEHTVRNALKVCEIAGRPDVPVYAGCPQPLLHPSVDAAHVHGLDGFGDVGLAPAKRTAEAEHAALAILRLSHEHAGKLLLVALGPLTNLALALTLDPTLPQRVARLVVMGGALTGHGNITAAAEFNIGFDPEAAHIVFRGFPQFDVADWEATIAHGLLHRDVEHWLAADSARARFYEDISRKTRLWSEDSRGEYWYAADALAMAFALHPEGAQRLEQRPVHIELSGAHTRGMTLVDWNRQGGAPDNANLLLAYDIQQFYRLVGAALAAN

SEQ ID NO: 65144 - protein, 177 aa, Musa x paradisiaca
FGSVYQGEMPDSGAIAVKRLESIRQGEKQFRMEVSTIGTIHHVNLVRLRGFCCEGDKRLLVYDYMPMGSLDSVLFADGREALDWKKRYGIAQGIARGLAYLHEKCRECIMHCDIKPENILLDMDMCPKIADFGMAKLLGREFSRVLTTVRGTFGYLAPEWITGSAITPKADVYSYGV

SEQ ID NO: 65145 - protein, 364 aa, Desulfitobacterium hafniense Y51
MFKAFQSKDGRRDSVNFLPGPVKLRREVQEALGRPPRSHRSEEFLAVMARIKEQLAQWLKVHYVQILLGSGTLANDVVGAYLRTALGQKKGLVLSNGEFGNRLLDQARRAGLNFEDYSIPWGKGFDYEDIEKHLSKGEGSIQWLWAVHLETSTGVLNDLPRLKALCHRQRIPLAVDCVSSIGAVPVDLSGVYLATGVSGKALCSYPGLSFVFYNQALEGGRLPRYMDLGLYQQSEGVPFTQSSNLIYALEQALHYAAERELCINQRQGEWLRAKLQELGFQVLALPEDAAPNILTLVLPREVPSLECGELLEEEGYVLSYRSAYLFQRNWVQICLMGEYEPEQIYAFPEMLAECMKKCGLRKGK

SEQ ID NO: 65146 - protein, 177 aa, Musa x paradisiaca
FGSVYRGEMPDSGAIAVKRLESMRQGEKQFRMEVSTIGTIHHVNLVRLRGFCCEGDKRLLVYDYMPMGSLDSVLFADGREALDWKKRYGIALGIARGLAYLHEKCRECIMHCDIKPENILLDMDMCPKIADFGMAKLLGREFSRVLTTVRGTFGYLAPEWITGSAITPKADVYSFGV

SEQ ID NO: 65147 - protein, 348 aa, Corynebacterium glutamicum ATCC 13032
MVGGKGTRLRPLTVNTPKPMLPTAGHPFLTHLLARIKAAGITHVVLGTSFKAEVFEEYFGDGSEMGLEIEYVVEDQPLGTGGGIRNVYDKLRHDTAIVFNGDVLSGADLNSILDTHREKDADLTMHLVRVANPRAFGCVPTDEDGRVSEFLEKTEDPPTDQINAGCYVFKKELIEQIPAGRAVSVERETFPQLLEEGKRVFGHVDASYWRDMGTPSDFVRGSADLVRGIAYSPLLEGKTGESLVDASAGVRDGVLLLGGTVVGRGTEIGAGCRVDNTVIFDGVTIEPGAVIENSIISSGARIGANAHISGCIIGEGAQVGARCELNAGMRVFPGVVIPDSGIRFSSDQ

SEQ ID NO: 65148 - protein, 349 aa, Flaveria brownii
EFYIGLRQRRATGQEYAELMNEFMSAVKQNYGEKVLIQFEDFANHNAFDLLEKYRTTHLVFNDDIQGTASVVLAGLISALKLVGGSLADHKFLFLGAGEAGTGIAELIALEISKQTNIPLEESRKKVWLVDSKGLIVRSRLDSLQHFKKPWAHDHEPVDKFLDAIKTIRPTVLIGSSGTGQTFTKEVVETMSSLNEKPIILALSNPTSQSECTAEQAYTWSEGRAIFASGSPFGPVEYNGKLYMSGQANNAYIFPGFGLGLIISGAIRVHDDMLLAASEALAEQVTEEHFDNGLIYPPFTNIRKISAHIAAKVAAKAYELGLASRLPQPENLVAYAESCMYSPKYRSYR

SEQ ID NO: 65149 - protein, 518 aa, Bartonella henselae str. Houston-1
MSISHSDTVLIIDFGSQVTQLIARRVRAMGVYCEVVPFQLALEGMQRIKPKAVILSGSPYSVIDEGSPRAPMEIFEMDIPVLGICYGQQIMCVQLGGKVASGHEREFGRAFLEVQENSALFEGVWEKGSCYQVWMSHGDRVTALPEGFRVIGTSKGAPYAAIADEKRRLYAVQFHPEVVHTLDGTKLLQNFVLKISNLKGNWSMASYREQTIAKIRQKVGKSRVICGLSGGVDSSVVAVLLHEAIGDQLTCILVDHGLMRKNEAQEVLTLFRDHYNIKLIHVNAANMFLNALEGEIDPEKKRKTIGRLFIEVFEEETKKIGGAEFLAQGTLYPDVIESISAIGKSVTIKSHHNVGGLPERMNMKLVEPLRELFKDEVRSLGKELGLPEQFIGRHPFPGPGLAIRCPGAVTREKLEILREADAIYLDEIRKAGLYDEIWQAFAILLPVQTVGVMGDGRTYEFVCALRAVTSVDGMSADFYPYDMEFLSKTAARIINEVRGINRVVYDVTSKPPGTIEWE

SEQ ID NO: 65150 - protein, 434 aa, Yarrowia lipolytica CLIB122
MSYVEEADKVSPEEQVQDIYIRFNEDNEKDYAFTVRASQKVSTLYRVFEVLPLSLRPSIFYEHKPLGFAISRQPGFLTTGGAFLFHERAHEDQWIERVDDDARIGEIAWDSQLFVPIWKEKNARKWAIMALFLVWLYTDLPDMVSPTPGIQLTTQLIRASYYVGDLVGVKFPEDDGSLDVPVWAWAFFAFHVLKCLTLYLVLWSGTMNPLSLNPFKARKMGAEGTRRLNQDVLQSIGWTGARRVTDDVWRREYREWVISSSGGIVEANDKGKLKELKEAGVWLEAGEGFSVKKTGYSKPVANITVSDDLTEMAPQYGISIDEDIENPTSAPAPDKNTLAVLEPSEAIKALDAFYENKFITKIPPSDLWFATLSAPTLQEMEDQEDQQKAGELLKKFLQRGPMYSDLTPLVRLRERWVTKGFVHRLKKPVVKKNE

SEQ ID NO: 65151 - protein, 212 aa, Triticum aestivum
MASKSAVTAGGQPKEKEEPSSMADVYNHELTPLQKHVAFFDRNKDGVIHPSETYEGFRAIGCGVALSAFSAVFINGLLGPKTIPENMKVGAFKFPIYVKNIHKGKHGSDSGVYDANGRFVPEKFEEIFKKHAHTRPDALTGKELNELLQANREPNDLKGRVGGFTEWKVLYSLCKDKEGFLHKETVRAVYDGSLFVKLEQERKQAKESAKKK

SEQ ID NO: 65152 - protein, 438 aa, Synechococcus elongatus PCC 6301
MHLAVVGLSHRTAPVAVREKLSIPEQQVEAAIQQLKSYPHIEEVAILSTCNRLEIYCVTRATEPGVREITQFLSEHSHLPLGELRPHLFVLLHQDAVMHLMRVAAGLDSLVLGEGQILSQVKTMYKLGQQYEGVGRILNRLLKQAVTAGKRVRTETSIGTGAVSISSAAVELAQLKVIARDDRSDGNLAGQRVLILGAGKMSRLLVQHLIAKGADTIQILNRTLGRAEELAKQYGGDLQIQVGLLSGLMNAIVEADIVFTSTSATDPILDRAKLEMVLAPEQRLMLIDIAVPRNVAADVVELTSVESYNVDDLREVVAQNQESRRKLAEEAEALLEEEVDAFDNWWQSLDTVPTINCLRDKIEMIREQELEKALSRLGTEFGDKHQAVVEALTRGIVNKILHDPMVQLRSQQDIEARRRAVDALQMLFNLDPQGQLSS

SEQ ID NO: 65153 - protein, 112 aa, Arabidopsis lyrata subsp. lyrata
LVEKFGIDPNNAFAFWDWVGGRYSVCSAVGVLPLSLQYGFSVVEKFLKGASSIDQHFQSTPFEKNMPVLLGLLSVWNVSFLGYPARAILPYSQALEKFAPHIQQVSMESNGK

SEQ ID NO: 65154 - protein, 123 aa, Synechocystis sp. PCC 6803
MATWYCMQGCGACCNLTPEDRPELAEYLAPEELTLYHSLVGADGWCVNYNHGDRLCQIYEDRPSFCRVKPDNFARMFGIAPAEFDEFASHCCEEQIEGVYGPRSGELKSYRQGLPKFEVDSHF

SEQ ID NO: 65155 - protein, 390 aa, Physcomitrella patens subsp. patens
MAIGGGDFLRRLQKEEVAQQRLSRISRRPKYTKFSQQELGSWKPLPTPRCIVFLFVFLGVACLPVGFYTLHASWSIVELVFRYDVFCIMNYATAVNPLLTNQDKSDFMQDFDKRKNCTVTMNVEKLMRQPIYVYYELGNYFQNHRRYMNSKSEQQLRGFSSSSSSSSSSHSDLDCCKPKDVANGHSIVPCGLVAWSLFNDTFDISTNGFYSDNGTVFINQTWISWRSDREERFNGTVFPSNFINNNRSTVADVPQIGGAALNYSKPLSMDENLVVWMRTAALPTVRKLYGRIETDLRPGTQLMVRIENLYNTYGFGGSKKLVLSTTSWIGGRNDFLGLSYLVVGCVSIFVGFVFGIAYWRRPRPLGDRLHLSWVKNNLTPSAAASFVTDD

SEQ ID NO: 65156 - protein, 367 aa, Pseudomonas putida KT2440
MADMSEQELKALRVRIDSLDEKILELISDRARCAEEVARVKTASLKEGEKPVFYRPEREAAVLKRVMERNKGPLGNEEMARLFREIMSSCLALEEPLKIAYLGPEGTFTQAAAMKHFGHAVISRPMAAIDEVFREVAAGAVNFGVVPVENSTEGAVSHTLDSFLEHDMVICGEVELRIHHHLLVGENTKTDSITRIYSHAQSLAQCRKWLDAHYPNVERVAVSSNAEAAKRVKGEWNSAAIAGDMAANLYGLTRLAEKIEDRPDNSTRFLMIGNQEVPPTGDDKTSIIVSMSNKPGALHELLVPFYQNGIDLTRIETRPSRSGKWTYVFFIDFVGHHRDPLIKAVLEQISQEAVALKVLGSYPKAVL

SEQ ID NO: 65157 - protein, 236 aa, Coccidioides immitis RS
MADEDFSKASAEADREMTRLWRTWRTVFEMLLDRGYEVTEEEVNVPLAEFRTKYSDALGFPDRNKMRISARPSQTMIEKYTPLASPAKPNPVPECGTIYVEFCADAQGVGTKQVRAFNHFVDEQNYHTGIFITQSPISPSAIRLLTGIPGRFCEHFLEQELLVNITHHELVPKHVLLSAEEKKRLLQRYRLKESQLPRIQIGDPVAKYLGLRRGQVVKIIRKSETAGRYASYRWVT

SEQ ID NO: 65158 - protein, 407 aa, Solibacter usitatus Ellin6076
MPKATHLECSLCATKFDAGAAANLCACGGPLLVRYDLATIRHRWLRREVSNGPATMWRYAPVLPPSDASVVTLGEGWTPLVRTKRLGARIGADSLWVKDEGLNPTASFKARGLSCAVSMCVELGIKKVAIPSAGNAASAMAAYAAAAGIEAHIFMPRDVPQANYLECKAYGAHVTLIDGLISDCGRMVAEQGPKEGWFDVSTLKEPYRIEGKKTMGYEVAEQMGWELPEAIFYPTGGGVGMIGMWKAFDEMERLGWIGGRRPKMIAVQAEGCQPVVRAFEAGEQRSKFFEGAHTVASGLRVPKPLGDFLVLNAVRESGGTAIAVCDEDMLTAGVHLASDEGIYAAPEGAACVCAAQRLLKSGFLKSTDRMVIYNTGSGLKYPEAYSTRFPRTAASEQDKLGGLITPR

SEQ ID NO: 65159 - protein, 215 aa, Bacillus clausii KSM-K16
MIKVAPSILAGDFSRMGETVQACDNAGADWIHVDVMDGQFVPPITFGHQMVEAIRPYTDLPLDVHLMVEQPEKQIAFFQQAGADCLSVHVEASAHLHRTVAAIKEAGMKAGIVLNPGTPAYAAEPVLADVDYVLQMTVNPGFGGQSFIPGALANIKKLRAMIDERQLPVDIQVDGGINPTTAQQCVQAGATILVAGSAVFKEADLAKAIAQIRGQ

SEQ ID NO: 65160 - protein, 362 aa, Kluyveromyces lactis NRRL Y-1140
MSKNIVVLPGDHVGKEVTDEAIKVLNAIAEVRPEIKFNFQHHLIGGAAIDATGTPLPDEALEASKKADAVLLGAVGGPKWGTGAVRPEQGLLKIRKELGLYANLRPCNFASDSLLDLSPLKPEYAKGTDFVVVRELVGGIYFGERKEDEGDGVAWDSEKYSVPEVQRITRMAAFLALQQNPPLPIWSLDKANVLASSRLWRKTVEETIKTEFPQLTVQHQLIDSAAMILVKSPTKLNGVVITNNMFGDIISDEASVIPGSLGLLPSASLASLPDTNKAFGLYEPCHGSAPDLPANKVNPIATILSAAMMLKLSLDLVEEGRALEEAVRNVLDAGVRTGDLGGSNSTTEVGDAIAKAVKEILA

SEQ ID NO: 65161 - protein, 480 aa, Pseudomonas putida KT2440
MELIPVILSGGVGSRLWPVSREAHPKPFMTLPDGQNLIQKTFLRAADLNGVVEILTVTNRELLFKTEDEYRTINKQNLSQGYILEPFGRNTAAAVAAAALQLLESHGPQVHMLVLAADHLIQNEAAFSEAVSKAVQLAGEGWLVTFGIKPQYPETGFGYIEAAAGGVLEGGLRVERFVEKPDAKTAEAYVAAGNYFWNAGMFCFQVGTVIEQFRAYAPDVLEAVERTLEASRRSTSKGYSCLALDAECFASVPDISIDYALMERSSKVATIPCDIGWSDIGSWNAVSELTLPDEHGNRFDGEVMAYGASNNYVSTEDRLAALVGVQDLLVVDTPDALLIAHKDHAQDVKHIVKRLKNDGHTAHLLHQTVHRPWGTYTTLEDGERFKIKRIVVKPKASLSLQMHHHRSEHWIVVSGMAVVVNDDQELMLNTNESTFIRAGHKHRLQNPGVIDLVLIEVQSGDYLGEDDIVRFEDNYGRCDA

SEQ ID NO: 65162 - protein, 816 aa, Oryza sativa Japonica Group
MALLIFVVLLFALSIPASSATIDTISIGTALAKNDKLVSENRRYALGFFETQRKASQKTSKWYLGIWFNQVPKLNPAWVANRDKPIDDPTSVELTIFHDGNLAILNQSTKSIVWSTQANITANNTVATLLNSGNLILTNLSNSLEVFWQSFDYPTDTFFPGAKLGWDKVTGLNRQIISWKNSIDPATGSYCKELDPSGVDQYLLLPLNSSTPYWSTGAWNGDYFSSILEMKSHTIFNSSFVDNDQEKYFRYDLLDERTVSRQILDIGGQEKMFLWLQDSKDWTLIYAQPKAPCDVYAICGPFTVCIDNELPHCNCIKGFTVTSLEDWELEDRTDGCSRNTPIDCINNKTTTHSTDMFYSMPCVRLPPNAHNVESVKSSSECMQVCLTNCSCTAYSFINGGCSIWHNELLNIRKDQCSENSNTDGEALYLRLATKEFYSAGVDSRGMVIGLAIFASFALLCLLPLILLLVRRSKTKFSGDRLKDSQFCNGIISFEYIDLQRATTNFMERLGGGSFGSVFRGSLSDSTTIAVKRLDHACQIPQGDKQFRAEVSSIGTIQHINLVKLIGFCCEGGRRLLVYEHMSNRSLDLQLFQSNTTISWNTRYQIAIGIARGLSYLHESCQDCIIHCDIKPENILLDDLFIPKIADFGMAKLLGRDFSRVLTTVRGTAGYLAPEWISGVPITPKVDVYSYGMVLLEIISGRRNSYTSSPCVGDHDDYFPVLVVRKLLDGDICGLVDYRLHGDINIKEAETACKVACWCIQDNEFNRPTMDEVVHILEGLVEIDIPPMPRLLEAIVAGSSNPTCTSSSFFGSIRESL

SEQ ID NO: 65163 - protein, 260 aa, Mycobacterium sp. KMS
MTAGDRRVAIVTAAAAGIGKAIALRWCREGGCCVMADTDGEGLDAAVHELAESGAAVCGVAGDVCLSDVANSVVERALTEFGRLDTLFNVVGGSLARNVEEISEEQWRSQIDMNLGSVFQMSKPVIPLLRQGGGGSIVNVASTAGILAENRCSAYSASKGGVVLLTKNMALDFARDNIRVNAIAPGGTRTPRIERFLAEHPEHASMMVDLCAMQRFAGPEEIAAPAVFLASPEASYITGAVLPVDGGMTAGVTFRAFEAV

SEQ ID NO: 65164 - protein, 445 aa, Solibacter usitatus Ellin6076
MSHGILKVVDPVSLAVNPQKIAVLGLGYVGCVTAACLARIGHRVTGVDRDQFKVDSVLGGRAPFFEPGLEELVGDGVATGRLSATVSLADAVADADVALICVGTPSEKNGNLGLDQLRRVSQELAELLPGRTKRLIVAVRSTVYPGTCEEIVLPAFGGSPLVAVVSNPEFLREGAAVRDFMEPSLLVVGGSSPEAVRQVAGIYSGLAVEPSIVALRTAEMIKYACNAFHAVKISFANEIGALAGELGIDGAEVMETLCRDHSLNISPAYLKPGFAFGGSCLPKDLRALVYRASRLDLKLPMLESVLPSNNAQLDRAIAVALDLPGERIGVFGLAFKENTDDLRESPVVLLLETLIGKGRKVRVHDPHIQLGEIYGSNQRYIMNAIPHIGNLLDDRLDGMLEWADHILVAQKPSPAVQARLIASGKPLIDLVGALRRDLGRATVSV

SEQ ID NO: 65165 - protein, 665 aa, Zea mays; identical to SEQ ID NO: 1541

SEQ ID NO: 65166 - protein, 428 aa, Chlamydophila pneumoniae CWL029
MFEAVIADIQAREILDSRGYPTLHVKVTTSTGSVGEARVPSGASTGKKEALEFRDTDSPRYQGKGVLQAVKNVKEILFPLVKGCSVYEQSLIDSLMMDSDGSPNKETLGANAILGVSLATAHAAAATLRRPLYRYLGGCFACSLPCPMMNLINGGMHADNGLEFQEFMIRPIGASSIKEAVNMGADVFHTLKKLLHERGLSTGVGDEGGFAPNLASNEEALELLLLAIEKAGFTPGKDISLALDCAASSFYNVKTGTYDGRHYEEQIAILSNLCDRYPIDSIEDGLAEEDYDGWALLTEVLGEKVQIVGDDLFVTNPELILEGISNGLANSVLIKPNQIGTLTETVYAIKLAQMAGYTTIISHRSGETTDTTIADLAVAFNAGQIKTGSLSRSERVAKYNRLMEIEEELGSEAIFTDSNVFSYEDSEE

SEQ ID NO: 65167 - protein, 469 aa, Xylella fastidiosa Ann-1
MSLENVEKLVKDKKIEFVDLRFVDMRGVQQHVTFPVNILEPSLFKDGKMFDGSSIAGWKGINESDMVLLPDASTAYLDPFYADPTLVMTCDILDPATMQSYVRDPRGIAKRAEIYLNSLGIADQAFFGPEPEFFIFDSVRFSNDMGHAFFQIASEEAAWNTGAEFEGGNSGYRPTVKGGYFPVPPTDSLHDLRAEMVKTLEQVGIETEVHHHEVATAGQCEIGTKFDSLVKKADQLMTMKYILKNVAYRNGKTVTFMPKPIVGDNGSGMHVHQSLSKGGVNLFSGDDHAGLSQLALYYIGGIFKHAHAINAFSNSGTNSYKRLVPGFEAPVMLAYSARNRSASCRIPWVSSPKARRIEMRFPDPLQSGYLTFTALMMAGLDGIKNKIHPGPPNDKDLYHLAPEEEKLIPQVCSSLDQALEALDKDRDFLKAGGVMSDDFINGYIALKMQEVTQFRAATHPLEYQMYYAN

SEQ ID NO: 65168 - protein, 387 aa, Desulfitobacterium hafniense Y51
MNQYLSPIAANLPPSGIRKFFDLVSTMKNVISLGVGEPDFVTPWTVRESGIFSLEQGQTMYTSNSGLLELRQALSWNMEKKLGLEYNPNDEILITVGASEAVDLAMRALLGPGDALLLTDPAYVSYGPCATLAGAEVHYVPTREEEDFRVRVEDLERVYTPNAKVLVLSYPNNPTGAIMTWEDYQPIAKFVQDHDLIVVADEIYSDLSYGGSHTAFASLPNMRNRTLHISGFSKSYAMTGWRIGYVAGHHDFIQAMTRIHQYTMLCAPITAQLAALEAVRSAEQAMQDMVATYDRRRRLMVHGFRKMGLSCFEPLGAFYTFPSIKATGLTSEEFANELLQEEKVAVVPGTAFGPSGEGHIRCSYAYSTEQIQEALTRMERFVSKRIK

SEQ ID NO: 65169 - protein, 350 aa, Synechococcus elongatus PCC 6301
MTDQPCPRGIPRKFAEDESMDASLLLRQITTGYWGSQALYVAAKLGIADQLVNGPRSCEDLAIVVGAKPEVLYRLLRALASLGIFTEVSDRQFALTPAAELLRSGTAGSLRNLVMMFGEEHYVAWGELLHSIQTGENAFEHHYGAPVFAYYAQHPASADIFNGAMSDMSRPDTAAVLSSYDFQGIRCLVDVGGGHGQLLSQILAAYPDLTGILYDQPAVVAGADSVLADVSDRCEVVGGDFFASVPAGGDAYLLKHIIHDWDDADSLKILANCRQVMQPGDRLLLLEQVVRAGNEPNLAKWLDLNMLVMTQGGRERTQAEFATLLADAGFQLSQIHGTASEVCIIEGRAI

SEQ ID NO: 65170 - protein, 390 aa, Oryza sativa Indica Group
MAAAVRLLLRRRLSTATAPPPTPGSILNPSSPSTPLTSRQKSRLAISLLKSTPSPPPDQILSICRAAALSPDSHLDRVALSLAASKLSSAPDSVRDLASSLLTPHHAPHAIALFGQAGLLPDAVSTFKSSPSTRSLNALLFACLVSGNHAEAARVFQTFPDAYSVKPNTDTFNAIIKSFAESGTTRSFYSVLDEMCKKGVKPNATTFTTAIAGFYKEERFDDVGKVIELMKKHGCGESLPVFNVRVQGLCKLGRSGDAKALLNEMVKKGTKPSWLTYNHLIHGFCKEGDLEEAKRLYKEMAKKGLVGDSSFYYMLIYYLCKGGDFDTAVGVYNEIAARNWVPCFSTMKMLVNGLAGSSRVDEAKGIIEKMKEKFPDKAEGWKEVEDALPQ

SEQ ID NO: 65171 - protein, 308 aa, Pseudomonas syringae pv. syringae B728a
MSKIAVIGSNMVDLITYIERMPAQGETLEAPRFAMGCGGKGANQAAAAALLGADVLMLSKVGDDAFADTTLANFQRLGIDTRFVERVPGVSSGVAPIFVQENSHNSILIVKGANAHLSPADIDRAEAQLRDCALIVLQLEVELATVYHAIAFAHRHAIPVLLNPAPALAGLSREHLAQLDFLIPNESELALISGQPVTCAEEAAQAARQLVALGVRHVIVTLGEQGALYVGAEGEWQVPGVKVQARDTTGAGDAFIGCFARHWSQDGNIRQAMHQAVAYSACSVTGLGTQSSYPDASTFARFLDASAN

SEQ ID NO: 65172 - protein, 343 aa, Glycine max
  misc_feature (115)..(115): Xaa can be any naturally occurring amino acid
MDHSADAHRTDLMTITRFVLNEQSKHPESRGDFTILLSHIVLGCKFVCSAVSKAGLAKLIGLAGETNVQGEEQKKLDVLSNEVFIKALISSGRTCILVSEEDEEAIIVEPSKRGXVYCVCFDPLDGSSNIDCGVSIGTIFGVYALKDVHEPTIEDVLLPGKNMVAAGYCMYGSSCTLVLSTGAGVNGFTLDPSLGEFILTHPNIKIPKKGKIYSVNEGNAKNWDRPTATYVEKCKFPEDGSSPKSLRYIGSMVADVHRTLLYGGIFLYPADKKSPNGKLRVLYEVFPMSFLMEQAGGQSFTGKERALDLVPTKLHERSPIFLGSYDDVEEIKALYAAAEGEQE

SEQ ID NO: 65173 - protein, 497 aa, Kluyveromyces lactis NRRL Y-1140
MTMTLLRGVSVFSRRVPVAGGFGYLKRADISNVVLQGRTYASAKVALAEDLTLETHTDNQAAAIEQANERAVSNPDVLDSGIHSLQHAYRESGEYGTRPIYLDMQATTPTDPRVLDTMLKFYTGLYGNPHSNTHSYGWETNKEIEQARKYIADVIKADPKEIIFTSGATESNNMALKGVSRFYKKTRNHIITTRTEHKCVLEAARAMKNEGYEITFLNVDEQGLINLEELEAAIRPETCLVSVMAVNNEIGVMQPLKEIGELCRKRKVFFHTDAAQAYGKIPIDVNEMKIDLMSISSHKIYGPKGIGAIYVRRKPRVRLDPLISGGGQERGLRSGTLAPPLVAGFGEAARLMMKEYENDSNHIKRLSDKLMNALLSIDHTILNGSADHRYPGCVNISFAYVEGESLLMALRDIALSSGSACTSASLEPSYVLHALGKDDALAHSSIRFGIGRFTTDEEIDYVIKAITERVDFLRELSPLWEMVKEGIDLNSIEWSGH

SEQ ID NO: 65174 - protein, 459 aa, Synechococcus elongatus PCC 6301
MTAVVLPAAAETLAALQATFDRGDTRTLAFRLARLQDLAKLVADNEAELLQALASDLRKPALEAYASEIYFVRDQIKLTCKHLRRWMQPEKQSISLMQQPGQAYRQAEPLGVVLIIGPWNYPFQLLITPLIGAIAAGNCAVLKPSELAPATSSLIQRLISDRFDPDYIRVLEGDASVSQALITQPFDHIFFTGGTAIGRKVMAAAAENLTPVTLELGGKSPCIVDTDIDLDVAARRIAWGKFFNAGQTCIAPDYLLVQRTVAEPFIEALIDNIQQFYGEDPQQSADYARIVSDRHWQRLNSLLVDGTIRHGGQVDRSDRYIAPTLITDVNWRDPILQEEIFGPLLPILIYDQLDEAIAQIRAQPKPLALYLFSRDRQVQERVLAETSAGSVCLNDTILQVGVPDAAFGGVGPSGMGGYHGKASFETFSHYKLVLKRPFWLDLALRYPPYGDKINLFRKL

SEQ ID NO: 65175 - protein, 199 aa, Lactobacillus sakei subsp. sakei 23K
MEVHEVEMVMSAVAASQYPTDQLPEIALSGRSNVGKSSLINKLINRKSYARTSSKPGKTQTLNFYRVENELYFVDVPGYGYAKVSKKQREKFGQIIEAYLTNRDNLRGLISLIDGRHEPTDDDIAMYVFAKYYDIPVLVVATKMDKISTGKWNRQEKIIKEALDFNPVDKFVCFSALTGAGKDTVWEWIEQQCDIGGRR

SEQ ID NO: 65176 - protein, 449 aa, Triticum aestivum
MYRAKRAALSPKVKRRVGKYELGRTIGEGTFAKVRFAKNTETMEPVAIKILDKEKVQKLRLVEQIRREICTMKLIKHPNVVRLHEVMGSKARIFIVLEYITGGELFDTIYTNGRLKEEEARKYFQQLINAVDYCHSRGVYHRDLKLENLLLDAAGNLKVSDFGLSALTEQVKADGLLHTTCGTPNYVAPEVIEDRGYDGAAADIWSCGVILFILLAGFLPFEDENIIALYKKISEAQFTCPSWFSTGAKKLITRILDPNPATRITIPQILEDPWFKKGFKPPVFDDKYETSFDDVYAAFGDSEDQHVKEETEHKPTSMNAFELISLNQGLNLDNLFEAKEEHKRETRFTSQCPPKEIISKIAEAARPLGFDIQKKNYKMRMENPKAGRKGNLNVATEVFQVAPSLHVVELKKAKGDTLEFQMFYRSLSTQLKDVVWKCGGEVEDNGTAA

SEQ ID NO: 65177 - protein, 513 aa, Physcomitrella patens subsp. patens
MSTLEIEARDVIKIVLQFCKENSLQQTFQTLQNECQVSLNTVDSLETFTADINNGRWDAVLPQAAQLKLPRKKLEDLYEQIVLEMIELRELDTARAILRQTQAMGFMKQEQPERYLKLEHLLVRTYFDPREAYQESSKEKRRAQIAQALSVEVTVVPPSRLMALIGQALKWQQHQGLLPPGTQFDLFKGAAAVKADEEEIYPTVLDHTIKFGKQSHPECARFSPDGQFLVSSSVDGFIEVWDYLTGKLKKDLQYQGADTFMMHDEAVLSIAFSKDSEMLASGSQDGKIKVWRIRTGQCLRRFERAHGQGVTSVSFSRDGAQVLSSSFDGTARLHGLKSGKTLKEFRGHTSYVNDAIFTSDGTRVITASSDGSVKVWDLKTTDCLQTFKPPPPLRGGDATVNSVHLMPKNPEHIVVCNRASAIYVMTLQGQVVKSLSSGKREGGDFVGATVSPKGDWIYCVGEDRNIYCFSHHSGKLEHLMTAHDKDIIGVTHHPHRNLLVTYSNDNTMKLWKP

SEQ ID NO: 65178 - protein, 389 aa, Synechocystis sp. PCC 6803
MVMETAFSRMDLVQSPVIPVVGQWIVDSPGTISLGQGVAFYPPPNEVAVAVRESLEQTPLHQYQPVAGIPSLISALTEKLRRDNDINLSSDQAVVVTAGANMGFLNAVLAITEVGDEIILNTPYYFNHEMAVRIAGCQPVLVPTDDQYQLQLDLIAQAIAPRTRAVVTISPNNPTGAIYPEADLRAVNQLCQERGIYHIHDEAYDYFAYDQTPIFSPEAMGDSGGHTISLYSFSKAYGMAGWRVGYMVIPLELLLAVKKIQDTNLICPVVVSQYAALACLRVGKNYSAQFLPEMAACRQQLLETLGQLSDYCRLVVPQGAFYCLLEVNSPLTDLELVKRLIDEFKVAVLPGSTFGVDSGCYLRIAYGALRQATASVAIARLEQGLKSIC

SEQ ID NO: 65179 - protein, 444 aa, Mesembryanthemum crystallinum
MVTIKCVKARQIYDSRGNPTVEADIHLDDGTYARAAVPSGASTGVYEALELRDGGKDYMGKGVYKAVKNVNEIIGPALVGKDPTQQTAIDNFMVQQLDGTVNEWGWCKQKLGANAILAVSLAVCKAGAQVKKIPLYQHIAEIAGNKNMVLPVPAFNVINGGSHAGNKLAMQEFMILPTGASSFKEAMKMGSEVYHNLKSVIKKKYGQDATNVGDEGGFAPNIQENKEGLELLKTAIEKAGYTGKVVIGMDVAASEFYKEDKSYDLNFKEENNDGSQRISGEALKDLYKSFVAEYPIVSIEDPFDQDDWEHYAKMTAECGEKVQIVGDDLLVTNPKRVKKAIDENSCNALLLKVNQIGSVTESIEAVKMSKKAGWGVMASHRSGETEDTFIADLSVGLSTGQIKTGAPCRSERLAKYNQLLRIEEELGDKAVYAGANFRRPVEPY

SEQ ID NO: 65180 - protein, 671 aa, Oryza sativa
MKKKKSSHLGGPTCHTPTLSWAPDVWWYIPGPVFTSIRFSSLPWPGSKRGAAMEKRRRLVVAGDGEGDGGEASGSAARGLVESLPEALLVEVVVRLELEAACSAASSCRALRAAAAAAFSAVTSLDLSMFPPTNAILNRILAGNGALRCLAVNCSLLDDSAVGAIAKGSLRELSLLKCSSFSSYLFVAVGERCKNLRSFVLEMAASDDDEHFGICRKSIAHIVKGCGYLENLSLKFFPLLGPGSVDFESLVPIPSTIKVLLLQPVSNWQAKRLFPISTSLKTSISNTLESLSLVLDIITDELVAFITGSLHNLVELCLEDNPMKEPDLHNDLTNVGLQALGLCHNLAHLSLTRGKQNCSSTFRRVTDFGIMMLADGCKQLKTIRLAGFSKVRDAGYAALLQSCKDLKKFEVSTGYLSDLTCLDLDEAAPKITEVRLLCCSLLTSETAISLSSCTKLEVLDLSGCRSIADSGLASISQLSKLTLLDLAGADITDAGLSALGNGRCPMSSLCLRGCKRISNNGIASLLCGSGTINKTLISLDIGNVPRISGRAVTLIAKNCEQISSLCLRNCLLINDSSLETLGSMRHNLGKSSLRMLDLSYCSRLSRNFLGLFEPPFFRGLRWLGVGKNMLERRGCSPTVAELLERKPGLTVCGNACEMGCRNQCHPDIRRQ

SEQ ID NO: 65181 - protein, 509 aa, Chlamydomonas reinhardtii
GQPVDKDVVPCYDPSTMQLLGHLPAMSASEVRSRIARCKAAQKEWRTSSFAQRRKLLRILLKFIIENVETICRVSARDSGKPMLDAILGEVVVTCEKIHWLSREGEAVLRPERRSAGILSFYKSARVEFHPVGVVGAIVPWNYPFHNVLNPLTAALFAGDGLVIKVSEHASWSTGYYGRMISAALAAAGAPADLVQIVTGYGEAGSALVTGGVDKVIFVGSTQVGKMVMRAAADTLTPVVLELGGKDAVIVTEDADLDNLVQVVLKAAFLNCGQNCAGGERFFVHEKIYDKFLERLTPLVAGLRQGNPLGDAPVDCGAMCMPGLAEKVHGLVTEAVSRGARLLAGGVLVPSGERGGQFYPPTLLADVRPGMKIWEEEVFGPVMSVIKWSTDDEVVALANDCDFGLGSNVFAGSQARARSIASRLEAGMSSINDFATTYMCQSLPFGGVKHSGFDRFAGVEGLRGLCVPKAVAEDRFPLLMRSSIPPAWQLPLPPHAVAFGVSLVTMFYG

SEQ ID NO: 65182 - protein, 139 aa, Brassica napus
  misc_feature (134)..(134): Xaa can be any naturally occurring amino acid
MEAKEASQYSSIIVPSVQEMVKEKLTTTVPLRYVRSDLDKGDIDGDLRTEIPIIDMNLLCSLTSMDAEIHKLDLACKEWGFFQLVNHGMEIGFLDKLKTEIQDFSNLPMEEKKKLWQQPNDVEGFGHAFVVSEXQKLDW

SEQ ID NO: 65183 - protein, 224 aa, Oryza sativa Japonica Group
MSERTIPPPVSSHGEDFAEVVVVRHGETSANALCIIQGQTDIELNEAGRQQAVMVARRLAKEAKPVAVYSSDLKRAAETAQTIATACNVSNLVLSPALRERHMGDLHGLKFEDAVRSKPDAYKAFSSEDRSQEIPGGGESLDQLSERCVSYLNTIAGKHKGERVIVVSHGASIEELCRHADPTSSVRRRIPNTSICVFNISGSTGHWILERFGDVAHLNEDDFP

SEQ ID NO: 65184 - protein, 185 aa, Thermoanaerobacter tengcongensis MB4
MIIKEYKGIKPQIDEEAYIAETAEIIGDVEIKKNVNIWYGAVLRGDVDKIVVEEGTNIQDNCVVHVTDGHPCYIGKYCTIGHGAIVHACKVGNNVLIGMGAIILDDAEIGDNCIIGAGALVTGGKKIPPGSLVIGSPAKVVRQLTEEEIESIHKSYEHYVELAKLHFSEFGQLTVYNKSNIIENS

SEQ ID NO: 65185 - protein, 173 aa, Thermoanaerobacter tengcongensis MB4
MTLDDIKEMIREIPDFPKKGIRFKDITPVLKDAKAFNYSIEMLAKALEGRKFDLIAAPEARGFLFGAPLAFRLGVGFVPVRKPGKLPAETLSYEYELEYGLDSLEIHKDAVVKGQRVVIVDDLLATGGTVYASAKLVESLGGVVDSILFLTELTFLDGRKKLDGYDIISLIKF

SEQ ID NO: 65186 - protein, 234 aa, Salmonella typhimurium LT2
MNDIAHNLAYIRDKISAAATRCGRSSEEVTLLAVSKTKPASDIAEAIAAGQRAFGENYVQEGVEKIRHFQEAKVEGLHWHFIGPLQSNKSRLVAEHFDWCHTIDRLRIASRLSEQRPDNLPALNVLIQINISDENSKSGIPLAELDELAAAVATLPRLRLRGLMAIPAPESDYVRQFEVARQMAVAFAGLKARYPDVDTLSLGMSDDMEAAIAAGSTMVRIGTAIFGARDYTKN

SEQ ID NO: 65187 - protein, 569 aa, Azoarcus sp. BH72
MAYNLGVPPGWRKATRNLPALSPPVIVTDTFTPPQRLPVWSSLEQHAARLRATRVRTLFDTDAGRFQRLSRSVCGLTVDFSKQRLDAAALADLLELASAAGLQDGIAGLFGAAQMNFTEGRAALHMALRGSCPAPGGEDVTRYFREARSFARALREGGIKGATGKSINHVINLGIGGSDLGPRMVFEALAHTHRPVKVDFVANIDPRDLDEALAGVDPERTLFIVSSKSFGTAETLSNATAARAWLASTLPARVADNALAVHFAAVSNATASAAAFGIPPERVFPLPEWVGGRYSVWSAIGLPLLIAFGEAGFDAFLAGGRDLDQHFLKAPLADNLPVLMGLVGLWNTDFLGLETLAVLPYAHGLRNFAMWLQQLEMESNGKRTLRNGEASAVQTSPVVWGGVGTVGQHAFHQLFYQGTRTIPMDFIVPVGDDDPRQRGLVDNAFAQAAALMNGRDLATATAALAAKGMTPDEVERLAPHLVCPGNQPSTTILLPQLDAYHLGALLALYEHKVFVQGWIWGINSFDQYGVELGKEMARALAQGGSAECDASTAGLMAAAAAIRASNRAR

SEQ ID NO: 65188 - protein, 403 aa, Vibrio vulnificus YJ016
MFDVQAIRQQFPALAQQVNQNELVYLDSAATTQKPQCVIDTITQYYSSQNANVHRGSHSLTASATSQFEAARDCVAHFIGAQSSKEIIWTRGATEALNLIAQTYARSTLQVGDEILVSEMEHHANIVPWQMVAEQTGANVVKIPMTADCQLDIESFKTLMNERVKIVAVAQTTNVTATRQPIESIIELAHQHGAIVVVDGAQGIVHEPVDMRTLDADFYVFSGHKLYAPAGIGVLYGKLALLEAMPPWHGGGKMVEKVSFEKTTFSALPGKFEAGTPNVAGAIALAKAIEWYQGFARDEVESHLHQLQSATYRALREMEDIRVIGYQNNASVITFVMDGVHHQDIATLLDQQGIAVRAGHHCAHPLMDALGVKGTVRVSFAIYNTMQDVKKLIAALEKAVDML

SEQ ID NO: 65189 - protein, 432 aa, Rickettsia conorii str. Malish 7
MNITFIGSGYVGLVSGIIMGYLGHNVTCLDNDEVKISKLNKQILPIYEAKLDEYLKQALESDRLKFTNIYNNELQNADAIFITVGTPSKGLGEADLKYVYDAIDKVFEHINKDCLIVIKSTVPPGSCSNIIAYLKSRGFSFNVASNPEFLREGSAVEDFLYPDRIVIGVNNKESEAILRKIYAPLQGVKFVVTDLVTSELIKYASNSFLATKIAFINEMADLCEKIGGNIKDLSKGVGLDQRIGQNFLNAGPGFGGSCFPKDILALNNLVENHHIDCRILKAVIKSNKQRPSNMVDKIATLLDGDLKGKNIAILGLTYKAGTDDVRASPAIAIVKILLNKDVYVKAFDPIGLENAKKNLEHKNLLYLDSAVDACKSVDIIVIATEWSEFKELNWQEIYDLVKSPIIIDFRNILDNETMKKIGFRYYAVGSKI

SEQ ID NO: 65190 - protein, 358 aa, Aspergillus oryzae
MAPSISDFPHSVASTQPSVCKVGINGFGRIGRNVLRASLNRTDLQIVAINHTCNTVQDLIYLIRYDSCMGKLSDDISIHALSDTLITINGRQIVLTSERDLQKLNWSAVGVDYVVECTGKFTKRDLALQHVTYGHAKRVVISAPSSDSPTYVYGVNSDNYRADEDRRVVSCASCTTNCVTPVLKVLHQQFGIVQGLLTTVHAATQSQQVLDGYSKKNRRLGRSVFDNIIPTTTGAAKAIATVLPELTGKVTGVSIRVPAPNVSMIDLTVTTEQPTSLAEIMAAFRRAAKTSLAGVLYVSDEELVSSDYKGNPNSAVVDAPACTELNPQFFKIMAWYDNEWGYSNRLLDLTAHVALQEQ

SEQ ID NO: 65191 - protein, 235 aa, Oryza sativa Japonica Group
MAGDGELKLLGMWTSAFVLRVRFVLNLKSLPYEFVEENLGDKSDLLLASNPVNKTVPVLLHAGRPVNESQVILQYIDEAWPDRPPAVLPSDPYERAVARFWAAYVDDKVRLAWLGILFRSETEEERAAAVAQADAALETLEGALRECSGGKPFFGGDGVGLVDVVLGGYLGWFTAIKKLIGRRMIDPARTPALAAWEDLFRATDAARGVLPDDADKMLEFRQTALALGASKKITL

SEQ ID NO: 65192 - protein, 297 aa, Gibberella zeae PH-1
MADLNLQAVHDELVSVAYEAGAMILAANPAELDTDTKLNSVDIVTEADKGVEKMVSTRLSSSFPNVSFMGEETYKPGMKLGPEPTFVVDPIDGTTNFVHSFPSACISLGLAIDRKPVVGVIYNPWLDTLYTAIKGHGAFLTHGRGKEPQRLPLARSPRPIEGLGTSLVAIEWGAQRDGPNFDVKVEAFRKLTASRETGGSMVHSLRSMGSAALNIAAVAAGQLDLYWEGGCWAWDVCAGWAILNEAGGRMVHGNPGNWDPEVESRVYLAVRGAPSGQKELVEEFWAVLGDNKLDYSI

SEQ ID NO: 65193 - protein, 444 aa, Gibberella zeae PH-1
MSEAEAPKPVEALQPEAEAAPTTQPTEEKPEETTQTSEDKSEEKKEILKTTAKHDENPRNNRKFDPSVREVTDDPEAIRKQVEFYFGDWNFPQDKFMWESCGGTENKPMKVKTIHSFKRMRTFQPYSAVIAALKDSKFLDLSGEEGEEELKRKTPYQPLNTSKSKVEAATVYVKGFGDETPNTQFDLESFFAQFGEVKGIKLRRTNEGLFKGSVFVTFADEEEANKFLKAEPAPKWNDHDLKIMSKRAYCDEKNELIKQGKIEPNHTQPKKFYEGRESGKARGRGRGGNDSGSRDNDNWKQRRDNDQKNGFKDRRGGRGGRGGRGRGRGRGGRDGGRDRDQTKDGAKHNSNDTMPRIQSTADESSDNKKRSRDEAPAGEPAAKKSIGNREDTPVGDLIPQVKTEPGIKNEPGIKTEFEVKTEPQVKSEPDIKTEWVKVKTEPSI

SEQ ID NO: 65194 - protein, 350 aa, Streptomyces sp. CL190
MRSEHPTTTVLQSREQGSAAGATAVAHPNIALIKYWGKRDERLILPCTTSLSMTLDVFPTTTEVRLDPAAEHDTAALNGEVATGETLRRISAFLSLVREVAGSDQRAVVDTRNTVPTGAGLASSASGFAALAVAAAAAYGLELDDRGLSRLARRGSGSASRSIFGGFAVWHAGPDGTATEADLGSYAEPVPAADLDPALVIAVVNAGPKPVSSREAMRRTVDTSPLYRPWADSSKDDLDEMRSALLRGDLEAVGEIAERNALGMHATMLAARPAVRYLSPATVTVLDSVLQLRKDGVLAYATMDAGPNVKVLCRRADAERVADVVRAAASGGQVLVAGPGDGARLLSEGA

SEQ ID NO: 65195 - protein, 738 aa, Gibberella zeae PH-1
MAGIVAVTWKFSSEREQWAHRPEPGQWYASRHWSKQLKQWDAEDHEDNLELKTIIWGSLMFCGETETLIPFLNPRASDKCWKRILEMNRSIRQSSESFESCLPSQSIHGLTSDLVPPASIKFQEPKPQLLASRAFRLAGLAVGLGLSALTAYQRNQAQQMSSHAERHGHLDATAGREVVYCHACANEWYRDEDGLTCPECRGEITEIIDPENDPRDLDHHSSASTSPELHPYDSDPDEADIDEHTNQGFVFRRNIREGSGHHHHHDPAYAPTIESFVNMLNQFGARTPDGRSFSHGPGEHGEHQGHGEHERQGHEGQAGEGEHAHPNFARVQRATFTGPFGSGRTTITMISTPMHTTHTVPPGAPGLQTFQEYAQSLSRRPDGPRGLRVTAISLTMGANQPSSIFSDLLRDTGPPPGHEHVGEDGMGGGPPPGFGRGLQDLLNLLTPGNAVHGDAVYSQEALDRIITRLMEANPQSNAAPPATDEALRNLERKPVNKQMLGSEGKAECTICIDEMKEGDMATFLPCSHWFHEECVTLWLKEHNTCPICRTPIEKNDRGASNNSGNNNSSGSNQSQGPASGPSSDRSNPFAAHMPNAYNTDWEPFDWTSQPHSHSRPAQYSRPPSQSQSRLNEVLRNISTQREERDREHGRDRATTSGYSYDTSRLQRRSSHSPTSPRARAPSEHGARMRQRSPSQSSRRSTADSDQQSRTSGHGPISWLRGQFSRGPGTGSPRDGSRQ

SEQ ID NO: 65196 - protein, 361 aa, Bacillus clausii KSM-K16
MNKLLVLEDGTVLRGEGFGADVEMSGEVVFNTGMTGYQEIMSDPSYCGQIVMLTYPLIGNYGINRDDFESLQPAIAGLIVREIEHEPSHWRKQESLHDLLAAKGIPGIAGIDTRMLTRKIRAHGTRRGRICDLDVDVEQVARGLRESKPLTDQVARVSTNTAYHVPGKGMRVALIDCGMKHGILQSLIDRHCDVVVVPYNTGADEIKRLGVDGVLVSNGPGDPENVPETVETVKQLLGDIPLFGICLGHQLLALACGATTSKMTFGHRGSNHPVRELATGRIDITAQNHGYTVDAGSLEGTALKLTHVAVNDGSVEGLRHKEGHAFSVQYHPEASPGPHDASHLFDTFIHMMTEKKGKVYA

SEQ ID NO: 65197 - protein, 333 aa, Zea mays
  misc_feature (305)..(305): Xaa can be any naturally occurring amino acid
MDHAADAHRTDLMTITRHVLNEQSRNPESRGDFTILLSHIVLGCKFVASAVNKAGLAQLIGLAGETNVQGEEQKKLDVLSNEVFVKALVSSGRTCVLVSEEDEEATFVDPKLRGRYCVCFDPLDGSSNIDCGVSIGTIFGIYIIKDKDNVTLEDVLQPGKNMLAAGYCMYGSSCTLVLSTGTGVNGFTLDPSLGEFILTHPDIKIPKKGKIYSVNEGNAKNWDAPVAKFVEKCKYPKDGSPPRSLRYIGSMVADVHRTLLYGGVFLYPADEKNPNGKLRILYEVFPMSFLMEQAGGQSFTGKERXPIFLGSYDDVEEIKALYAEQAKSSSASS

SEQ ID NO: 65198 - protein, 541 aa, Galega orientalis
MAFEMTSVVSKLQNLSTSDHASVVSMNLFVALLCACIVIGHLLEENRWMNESITTLLIGVCTGVVILLFSGGKSSHILVFSEDLFFIYLLPPIIFNAGFQVKKKQFFKNFMIIMSFGAIGTLISCCIITFGATQAFKRMDIGPLEIGDYLAIGAIFAATDSVCTLQVLSQDETPLLYSLVFGEGVVNDATSVVLFNAIQSFDLNRLNPSIAMQFLGNFFYLFIASTLLGVLTGLLSAYIIKKLYIGRHSTDREVALMMLMAYLSYMLAELAYLSGILTVFFCGIVMSHYTWHNVTQSSRVTTKHSFATLSFVCEIFIFLYVGMDAMDIDKWKFVSDSRGTSIATSAILLGLILLGRAAFVFPLSFLSNLTKKSQHQKISFRQQVIIWWAGLMRGAVSMALAYKQFTRSGHTQLRSNAIMITSTITVVLFSTVLFGLLTKPLIRLLLPHPKHTSSMTTTEPSTPKSVIVPLLGDHRDSEADLEGHEIHRPNSLRALLSTPTHTVHRLWRKFDDSFMRPVFGGRGFVPVEPGSPSERNGHQSP

SEQ ID NO: 65199 - protein, 261 aa, Oryza sativa Japonica Group
SHEEYARQEMSSPTFKLDSNAPTVSWADPKNNDSVSTSQVKSVYVKNLPKNVTQAQLKRLFEHHGEIEKVVLPPSRGGHDNRYGFVHFKDRSMAMRALQNTERYELDGQVLDCSLAKPPAADKKDDRVPLPSSNGAPLLPSYPPLGYGIMSVPGAYGAAPASTAQPMLYAPRAPPGAAMVPMMLPDGRLVYVVQQPGGQLPLASPPPQQAGHRSGSGGRHGGSGSRYGGGGGSSGSSRPGAKRQRGDDNSSSRHKGRRRPY

SEQ ID NO: 65200 - protein, 286 aa, Vibrio vulnificus YJ016
MRINRTLCFSGDFGIITMRELDTPASDSYNQRFGGTRRLYGNSEVEILRAAHVCVIGIGGVGSWAVEALARTGIGELTLIDMDDVCVTNINRQIHAMTGTVGQSKIEVMAERVKLINPECKVNLIDDFITPDNQHEYLSKEFDYVLDAIDSVKAKASLLAYCRSNKIKVITVGGAGGQVDPTQIQVADLTKTIQDPLAKKIKDTLRRHHNFPKNPARKFGIDCVFSTEQLKYPQADGSVCNVKSTAEGPKRMDCASGFGAATVVTATFGFVAVARIVEKLIQKHKN

SEQ ID NO: 65201 - protein, 604 aa, Zea mays
MSGHLDRFARPCFEGRSSHDECRDHKSDFEVSEDEKKTRMGSLKKKAIDASTKIRHSLKKNRRKSGSRVLSVSIEDVRDLEELQAVEAFRQALLLDELLPARHDDYHMMLRFLKARKFDIDKAKQMWMDMLHWRREYGTDTILEDFEYTELDAVLQYYPHGYHGVDKEGRPVYIERLGKVDPSKLMNVTTMDRYVRYHVKEFERSFLIKFPACSVAAKRHIDSSTTILDVQGVGLKNFSKTARELIQRLQKIDNDNYPETLYQMFIVNAGPGFRLLWNTVKSFLDPKTTAKIHIVQSGEVHCARQIVTISNGEEKIITYAKPKHHSMRGSDTSTAESGSEADDAISPKALRSYIQHPKLTPVREEVKIVRATSFSTRLPEYDVPVVDKAVDATWRREQPRKIPFMPQDADSSVKTMSRPSDSSWDKIVATLMACLMAIVMLVRSVKDLVTRRLPYKGGSEEIHSTLYPDPIQKEEFRPPSPIPGFAEADLFAVVLQRLGELEEKVQMLQEKPSEMPCEKEELLNAAVRRVDALEAELIVTKKALHEALIRQEELLAYIDRKEIAKAQHNWLVGWVALAEPIIWPAVDSKQGHGSCWKSVGVMER

SEQ ID NO: 65202 - protein, 308 aa, Oceanobacter sp. RED65
MEPVSIDFNPESLMALNVIIAIMMFGVSLELSPKDFKRVLVKPKAPIIGLIIQFIILPLVTCMVTWWLKVDPLLAMGMILVASCPGGTFSNIMTWMAKGNVAVSVSMTGVSSLAASFMTPFNFALYAWLNPYTRDLLTEISIDPISLLLLVTMVLGLPLVFGMIAGQKFPSLSRKVEKPLRISAMLVMLILAGIAFAKNTDQFLEYFDLFFILVVAHNGLALLLGYFGAYLAGLPESHRRAISLEVGIQNGALALLIIFTFFPQASGMLLIAAFWGVWHLVSGLLLSTIWSRVSTEKSESDSRTAEVS

SEQ ID NO: 65203 - protein, 477 aa, Methanosarcina acetivorans C2A
MWEEGGSILDYGEPETLEKWRNSEKTEKSEDPMRKQETELDFFEQEIGLLDVVGPRAREIIGQDCKVMSACVSRPYPLVVDRAKGSVIKDIDGKEYIDFIAGIAVMNSGHSNPEVNAAISAQLEKMVHCGYGDFFAEPPLKLAKKLRELSGYSKVFYCNSGTEAVEAAMKLALWKTKRPNFIAFYNAFHGRTLGALSLTCSKVRQKEHFPTMRTVHTHYAYCYRCPLNLEYPSCGVECAKQIENLIFRKELSPEDTAAVFIEPVQGEGGYIVPPQEFHKEVKRICTDNDVLLIADEVQTGCFRTGPFLAMENFEVRADITCLAKALGAGLPIGAMLADSTLMDWPPGVHSNTFGGNLLSSASALASLEFLEKENMENRVREMGTHIRQRLRELQENCPCIGDVRGLGLMIGAEIVKSDKSIDPIRRDRIVREAFKEGVLLLPCGDSVIRFSPPLVMTDEEADLGLDKFEKALRRAAK

SEQ ID NO: 65204 - protein, 503 aa, Methanosarcina acetivorans C2A
MVLYSLFQGDFVVQEYKLHIGGESRDSATGETFDNINPATLENLATVQVAGSEDVDRAVEAAEEGFRVWSEVPAPRRAEVLFRTARILQERKEDLARLMTEEMGKVLPETRGDVQEAIDIAIYAAGEGRRMFGETTTSELKDKFCMTVLRPIGVVGMITPWNFPLAIPGWKIMPALIAGNAIVFKPASDTPLLAIKLVEILMEAGLPPGVVNLVTGPGGSTGKAIVQHPRIKAISFTGSLETGKWIMEECAKTMKRVSLELGGKNPVIIMDDADLELALEGVLWGAFGTTGQRCTATSRLILHEKIKDEFTARLLAKTKLLRVGNGLLPETDIGPIINKAQLEKIERYVRIGMEEGATLLLGGKAIDPGLPGYFFEPTVFTDVRPDMRIAQEEIFGPVLSIITVSGLEEAIEVANNTRYGLSSAIYTENVGKAFRAVKKIEAGITYVNAPTIGAEVHLPFGGVKGTGNGFREAGTEAIKEFTEIKAVYIDYSGRLQRAQIDME

SEQ ID NO: 65205 - protein, 247 aa, Arabidopsis thaliana
MATTSLVTGLKVVLPVMFCLMLATLVYTIITDGLPLPDRQDVFTPWFVTTILDFYINLVPIAVWIVYKESTWSGSILWTILLIIFGSLTTCVYLFLQLLKLTNQEASEDPMYYLLLRDSIKDGVGLRDKNSLVVTARFVFGALGCVMLGALVYTCFTYGSPFHMELLYPWMVVLLVNFYIDVAVLSVWVVYKESSLIIGILWVALLIGLGSVGTSAVIVVQLFRLSPLDPLYLVLVNNSNRKVKSKG

SEQ ID NO: 65206 - protein, 532 aa, Synechococcus elongatus PCC 6301
MLDASISPVVLVILDGWGYRNATEGNAIRTAETPIMDALWEAYPSTLIHTSGKDVGLPDGQMGNSEVGHLNLGAGRIVPQELVRITDAVEDGSILENPALLQACSAVRQHGSKLHLIGLCSDGGVHAHLDHLGGLLKLAAAQGIQDVYIHAITDGRDTNPTEGVNCITKIERLIATAGVGQIVTICGRYFAMDRDRRWDRVRKAYELLTIDGEGCGQTATEVLQETYAKGVSDEFVEPTRLAPGAIAPGDGVIFFNFRPDRARQLTYAFVEAEFEGFERDLIQPLTFVTFTQYDANLNVPVAFEPQNLTNILGEVVANHGLRQFRTAETEKYPHVTYFFNGGIEEPFPGEDRELIPSPMVATYDRAPKMSAQAVTDAAIAAIDKGIYSLVVINYANPDMVGHTGKMGATVEAIETVDRCLGRLVSAINRAGGTALITADHGNAEYMWDENGEPWTAHTTNLVPFIVVEGERRKLPGFGTEIPLREDGRLSDIAPTILQLLGLPQPVEMTGRSMIEPAAYEVKQGRTPVKVGV

SEQ ID NO: 65207 - protein, 265 aa, Lactobacillus sakei subsp. sakei 23K
MEQEALYQLSRSLQKWVLEAAAETRKKMTQPLEIMTKSSRNDLVTNVDCANQAFFAEQIKAEYPMAQLVGEEGANVGAGDWHNGLTFFVDPIDGTMNFVKQQENFAIMIGVYEDGQALFGIIYDVMADQLFWGGPQLGIFRNEQALEQAADQPLSEGLICVNTRMLVTNERQLQQVFVQSSGVRIYGSAGITFAQLLRGNAQAYISKLAPWDIAAGRVLAETLGFQILNFDGQPISMVAKEGMIIAPKQAMQEIIAIMAHSKTAE

SEQ ID NO: 65208 - protein, 259 aa, Oryza sativa Indica Group
MAVVASRCTGLLLPDLGASLAGFRRRRSTPASSLSLRPRRARRRLGSLSCIAPPDSAEPQTDEPAAKDDSTEDKAEASSASQDAGNPTFPNKDLSRRIALASTIGAVGLFAYQRLDFGGVSLKDLAANATPYEEALSNGKPTVVEFYADWCEVCRELAPDVYKVEQQYKDRVNFVMLNVDNTKWEQELDEFGVEGIPHFAFLDKEGNEEGNVVGRLPKQYFLDNVVALASVVMLRPIDKSATRLLYSLKSLGDRNFEPL

SEQ ID NO: 65209 - protein, 468 aa, Lactobacillus sakei subsp. sakei 23K
MVVGDFAIELETVVIGSGPGGYVAAIRAAEMGQKVTVIERENIGGICLNVGCIPSKALISAGHRLQEAKNSEVFGVSTTGATLDFAKTQDWKQHQVVEKLTGGISMLFKKHKIDVLDGSAFLVDEHSLRVIKEESAQTYSFKNLIIATGSRPIEIKGFKFNKRVIDSTGGLNLTEVPKELVVIGGGYIGSELAGAYANLGAHVTILEGTDSILPNFEKDMVQLVTKNFKTKGVDVITGAMAKESIETDQNVTVKYEVGGKEEQLVADYVMVTVGRRPNTDDMGLEQAGIKMADRGLIEVDQQGQTNIKGIYAIGDIVSGAALAHKASYEAKIAAEAIAGKKVIVDYKAMPAVCYTDPELATTGLTVAEAKEKGYNAKGFKFPFAANGRALSLAETDGFVRLVTNTDDNTLLGAQVAGVGASDLISELTLAIESGMNAEDLALTIHPHPTLSEAIMDDAELALGLPIHI

SEQ ID NO: 65210 - protein, 276 aa, Zea mays
CLEHNTEYISVFTSALLQRSLSVVSSTYYNSSTLVLTMWLAMACLLRDQHEQWKHKYGNPCRSVKIFRCQLPRNNAFYSAQPPTLVGAATPLCPRAPVCHWCGTWKGDKICSSCKKSRYCSEKHQALHWGTGHKNDCLQIISSSAASNSVLPTVGKVPANTSWPEFEIKIDYEGIFDSDSGDENNSKLLVMQRHGKPDAMMQSWMDQFEADSDNKCWTSFQERVSRAPNQVLRYCREPNAKPLWALSSGCPSNADIPSCSYCKDPLCYEFQVGQSS

SEQ ID NO: 65211 - protein, 355 aa, Sclerotinia sclerotiorum
MASRAPNPSSGSRKISFNVSEQYDIQDVVGEGAYGVVCSALHKPSGQKVAIKKITPFDHSMFCLRTLREMKLLRYFNHENIISILDIQKPRNYESFTEVYPIQELMETDMHRVIRTQDLSDDHCQYFIYQTLRALKAMHSANVLHRDLKPSNLLLNANCDLKVCDFGLARSAASQEDNSGFMTEYVATRWYRAPEIMLTFKEYTKAIDVWSVGCILAEMLSGKPLFPGKDYHHQLTLILDVLGTPTMEDYYGIKSRRAREYIRSLPFKKKVPFKTMFPKTSDLALDLLEKLLAFNPVKRITVEEALKHPYLEPYHDPEDEPTANPIPEEFFDFDKNKDNLTKEQLKQLIYHEIMR

SEQ ID NO: 65212 - protein, 540 aa, Lactobacillus sakei subsp. sakei 23K
MAYQFKLPDIGEGIAEGEIQKWAVAEGDTIAEDDTLLEVQNDKSVEEIPSPVSGKIVKILVGEGEVATVGQVLVEIDAPGVEGNDAPTAETTTPAAEQPAAPAASEGVYQFKLPDIGEGIAEGEIQKWAVAEGDTIAEDDTLLEVQNDKSVEEIPSPVSGKIVKILVGEGEVATVGQVLVEIDAPGHNTATASAPVATTPAPQAAETPVATNNSSDTSVVAISDPNRKVLAMPSVRQFARENNVDISQVPATGKHGRTTKEDIQNFMQNGTALVASTTTTDTKSAPVTTATPEPAVAVKPYESATPELETREKMSPTRKAIAKAMVTSKHIAPHVTLFDEVEVSKLMTHRKKFKDVAAKKDIKLTFLPYIVKALVTVLRDFPTLNASIDDTTSEIVYKHYINVGIATDTDHGLYVPNIKDADSKSIFAIAKEIGENTQKALDNKLKPAEMSGGSMTISNIGSIGGGWFTPVVNYPEVAILGVGRIGTEPIVNEDGELAVGKVLKLSLSFDHRLIDGGTAQRAMNELKELLADPELLLMEG

SEQ ID NO: 65213 - protein, 392 aa, Alkaliphilus metalliredigens QYMF
MKRDWMKLDQAYLLPTYGRMPVVVADARGATITDVEGKCYLDLFAGLAVNVLGHGHPALMEELEEQSKRFLHISNFFYNIPAIELAEKMIERTFPGKIFFTNSGAESTEAMIKYIHKYSKGNNGKGVVVFENSFHGRTLGALKLTRMNNVQQDFPTIKFPVHEIPTEDIQALESCFKTHQPAAFLFEPISGSGGVHVISTEFMERAQALCEAHGVLFCVDEIQTGIGRTGRLFAYEYSDVKPDLLLFAKGVGGGLPLGGIIVAEKISHYFKPGDHGTTFAPNPLSSSLGRRTLEVIDNVFLQQVREKGEYMIKKLEALKVTFPHSIGDIRGRGLMIGVEILKGSQTLKQNFLEREMLVNMTSGNILRLIPPLVIEKEEIDRFISVFEEIMTR

SEQ ID NO: 65214 - protein, 339 aa, Fremyella diplosiphon Fd33
MAKHHIKLNGIKVRNPKLQRVAFTIFSLSVLLPSQVVSAAFTIPLRSKQGMVVSAHPLASDAGISMLRKGGNAVDAAVATTFAISVVEPFSAGIGGGGFLLMHSEKTGEMKALDFRERAPIKATRNLYLDAQGKVRPNASINGYLAVATPGTVAGMYEVHRRYGKLPWREVIKPAIALAKDGFILNPLVTYRSLPAYENRKPVILSNPAAREIFTRNGEYYQPGERLVQRDLAKTLEAIAQNPQSFYTGNIAQAIAADMAKNGGLITLADLKAYKPIWRTPICGNFHQAKICSMPPPSSGGVHLLQILNIIGDSNLKSWGWHHPDALHLMVEAMKIAYA

SEQ ID NO: 65215 - protein, 406 aa, Alkaliphilus metalliredigens QYMF
MNIVVQKYGGSSIGSTEKIKKVADKIIRTKKAGKDVVVIVSAMGKNTDELVNLAKSISGKPDPREMDVLLTTGEQVSISLLSMALIEKGYKAISFTGSQLNIQTTSSHQKARIMDIDVTKVTEALKEGKIVVVAGFQGVTEDNDFTTLGRGGSDTSAVALAAKLEGTCEIYTDVDGIYAMDPRRLKNAKKIPRISYDEMMEMASNGAGVMHYRAVELAHKYDIPLYVASTFSDEPGTIIDNGGGKTMEEAVVTGMASSLEDIQITVLNLPSPTKSLYRLFGQLGEKGINVDMISQMLTEDNLMHVSFTAPKDDLWLVEKVLREWQQQDPTIQWEINEDIAKISAVGLGMRSHAGVAAKVFELMSDNNIEVKMVTTSEIRITWVVVREKEQQVIDLIGHHFGLEMSL

SEQ ID NO: 65216 - protein, 346 aa, Staphylococcus aureus subsp. aureus N315
MARKLHRELNNRHIQLIAIGGAIGTGLFLGSGQTISLTGPSLLFTYMIIGVVLFAFMRALGELLLSNTRFNSFVDIANEYLGPFGGFVIGWTYWLCWIVSSMSDLTAMGQYFAFWYPQVPNWITVLFIVLILISFNLLGARLFGELEFWFSIIKVVTIIAMVIVGLVLIFFSFKTHYGHASFTNLISHGGMFPGGTFGFLMSFQIAVYSFIGIELIGVTAGETKDPEKTLPKAINNVPIRILLFYIGGLLVIMSVIPWNDIDPNSSPFVKLFTLIGVPFAAGVVNFVVLTAAASATNSGIYSNSRILFGLSQQGLGPKVLNWRALFINVSFINCITYSSLVKLHFP

SEQ ID NO: 65217 - protein, 554 aa, Pseudomonas putida KT2440
MAFYRTPHDVTALPAWKALQQHREAMRGFSMSEAFAADAKRFDQFSLSACGLFLDYSKNLITEQSRDLLVNLANEVGLQDAIKSMFSGEIINASEGRPVLHTALRRPVGDKLSVNGVNVMPEVHKVLNQITELVGRIHDGLWRGYSEKPITDVVNIGIGGSFLGPELVSEALLPYAQRGVRCHYLANIDGSEFHELSANLRAETTLFIVSSKSFNTLETLKNAMAARTWYLAQGGSEAELYRHFIAVSSNKAAAVAFGIREENIFPMWDWVGGRYSLWSAIGLPIALAIGTANFKELLSGAYTMDQHFQTAPFDKNMPVLLALLGVWYGNFWDANSHAILPYDHYLRNITKHLQQLDMESNGKSVLQDGTPVKTDTGPVIWGGVGCNGQHAYHQLLHQGTQLIPADFIVPVVSFNPVADHHQWLYANCLSQSQALMLGKTREEAEAELRAKGLNEADIEKLAPHKVIPGNRPSNTLVVERISPRRLGALVAMYEHKVFVQSVIWGINAFDQWGVELGKELGKSVYQRLVGSLEDSAEDGSTQGLINYFRGKHRG

SEQ ID NO: 65218 - protein, 408 aa, Xanthomonas axonopodis pv. citri str. 306
MSTAADSPLSLAHYYLPVYRPRQVVLERGQGSRVWDDAGREYLDLSSGIAVSGLGHNDPDLVAALTEQAGKLWHTSNVFFSAPPLKLAEELVSASRFAHKVFLCNSGTEANEAAIKLVRKWASSQGRPADKRVIVTFRGSFHGRTLASVTATAQPKYQEGYEPLPGGFRYVDFNDVAALEAAMAGGDVAAVMVEPIQGEGGVMPAAPGFLSRVRALCDQHDALLVLDEIQCGMGRTGTLFAHWQEQVTPDIVTLAKALGGGFPIGAMLAGPKVAQTMQFGAHGTTFGGNPLAAAVARVALRKLASPQIADNVVRQSAALRAGLEALNAEFGLFAQIRGRGLMLGAVLAPEHAGQAGAILDLAAKHGLLLLQAGPDVLRFVPALNLTDAELADGLARLRLATAEYVAQP

SEQ ID NO: 65219 - protein, 528 aa, Synechococcus sp. RS9917
MSSIQSDGQRKPAIVILDFGSQYSELIARRVRETEVYSVVLGYSTSAEELRELAPKGIILSGGPSSVYAEGAPLCDPALWSLGIPVLGVCYGMQLMVQQLGGRVEAATGKAEYGKAPLVVDDPTDLLTNVDDGSTMWMSHGDSVEALPPGFVGLAHTANTPMAAVADHQRQLYGVQFHPEVVHSTCGMALIRNFVYHICGCDPDWTTAAFIDEAVRLVREQVGEKRVLLALSGGVDSSTLAFLLKKAIGDQLTCMFIDQGFMRKGEPEFLMDFFDRKFNIHVEYIHARKRFLDKLAGITDPEEKRKIIGTEFIRVFEEESKRLGPFDYLAQGTLYPDVIESAGTNIDPKTGERVAVKIKSHHNVGGLPKDLQFKLVEPLRKLFKDEVRKVGRSLGLPEEIVRRHPFPGPGLAIRILGEVTDEKLDCLRDADLIVREEIKEAGLYHEIWQAFAVLLPVRSVGVMGDKRTYAWPIVLRCVSSEDGMTADWSRLPPELLERISNRIVNEVKGVNRVVLDITSKPPGTIEWE

SEQ ID NO: 65220 - protein, 363 aa, Zea mays
MAAVDLTPRTPKKAYGGDGGAYYEWSPADLPMLSVASIGAAKLSLAAGGLSLPSYSDSAKVAYVLQGAGTCGLVLPEATKEKVVAVKEGDALALPFGAVTWWHNGPAAQADLTVLFLGDTSKGHKRGQFTNFQLTGSAGIFTGLSTEFVSRAWDLPEPDAARLVSSQPASGIVKLPASAAALPAPSPQDRAGVALNCLEAPLDVDIPGGGRVVVLNTANLPLVREVGLGADLVRIDAHSMCSPGFSCDSAYQVTYIVRGSGRVQVVGPDGRRVLETRIEGGSLFIVPRFHVVSKIADASGMEWFSIITTPNPVFSHLAGKTSVWKAISPEVLQASFNTTPEMEKLFRSKRLDSEIFFAPPSSN

SEQ ID NO: 65221 - protein, 413 aa, Thermoanaerobacter tengcongensis MB4
MAVNPLKAVQEQIKNACELLNLEESVYEILKEPLRVMEVSIPVQMDDGTVKVFKGYRSQHNDALGPAKGGIRFHPDVTLDEVKALSMWMTFKCGVVGLPYGGGKGGVAVNPQELSPTELERLSRGYIRAISSIIGPEKDIPAPDVGTNAQVMAWMVDEYNKIVGYNSPAVITGKPLIYGGSKGRVDATGYGVALIAREAAKKLEMDIKNCTVAIQGYGNVGSYTGIHLQRLGAKIVGVVDIYGGVYNERGIDAEKLAEHVRKTGSVKDFEGTTSLTNEELFALDVDVLIPAALENQITEENAPNVKARMVCEAANGPTTPEADRILREKGIFVVPDILANSGGVIVSYFEWVQNLMNYYWTEEEIKERQEIVMINAFNNIYQLAQEYKVDMRTAAYMIAIKRIYEAMKVRGWI

SEQ ID NO: 65222 - protein, 383 aa, Synechococcus sp. RS9917
MQDKLTLMIPGPTPVPETVLKAMGRHPIGHRSGEFQAVVQRTTEQLRWLHQTSGDVLVITGSGTAAMEAGIINTLSRGDRVLCGDNGKFGERWVKVARAYGLNVEVIKAEWGQPLDPEAFRKALEADTQKEIRAVILTHSETSTGVINDLEAISAHVKAHGTALTIADCVTSLGASNVPMDAWGLDVVASGSQKGYMMPPGLSFVAMSERAWQAYERSDLPKFYLDLGPYRKTAAKHSNPFTPAVNLYFALEAALEMMQAEGLEAIFARHARHRAAAQAGMKAIGLRLYAAEGHGSPAITAVAPEGLDAEQLRKAVKDRFDILLAGGQDHLKGQVFRIGHLGFVCDRDVLTAVSAIEATLHALGLHKGSMGAGVAAAAEALQG

SEQ ID NO: 65223 - protein, 395 aa, Thermoanaerobacter tengcongensis MB4
MNLSQNALQITPSMTLEITAKARQLKAEGVDVIDFGVGEPDFDTPDYIKEAAIEAIKKGYTKYTPASGILELKKAICEKLKRENGLFYEPEQIVVSNGAKHSIYNALSAILNPGDEVIIPVPYWLSYPEMVRLAYGKPVFVQTKEENNFKITAEELTAAINPKTKALILNSPNNPTGAVYTRKELQDIAEVVEETGIFVISDEVYEKLIYEGEHVSIASLGEKIKELTIVVNGMSKAYAMTGWRIGYTASSLDVAKVMANIQSHTTSNPNSIAQYASVTALTGDGVAIKRMVEEFNKRRLYAVERISKMKGLKAVRPQGAFYVFVNIEEYVGKKVNGRKIKGSLDFATLLIEEANVAVVPALPFGMDNYIRISYATSMENIEKGLDRIENFLNKI

SEQ ID NO: 65224 - protein, 462 aa, Desulfitobacterium hafniense Y51
MSSEKDHHVELHRGLKNRHIQMIALGGAIGTGLFYGSATTIQLVGPAIIVSYLLGGTAIFFIVRALGEMCVDQPVAGAFSYFAYKYLGDFPGFFSGWNYWFNYIAVSMAELTVVGVYINFWYPNVPQWVTALAFLVIITLINLINVEAFGEFEFWFALIKVVAILAMIAFGLVMIFFGLGEQGAVGFSNLWTHGGFLPNGVWGLLLSLVIVMFSFGGVELIGITAAEADDPKRSIPKAINQVVWRILIFYIGALTILMILYPWDQIGTSGSPFVEIFSAIGIPAAAHILNFVVLTAALSVYNSGIYSNGRMLHGLALQGNAPKFLTKVSRNGIPINGVFASSAVTLIAVILNFLVPGKVFLYLISIATIAGIFNWAMILVTQLRFRKVEAEKGREDQLQFKMPLYPISNYIALAFLAMVVVLMAYIPDMVYSLYIGPIWIIILYIGYKFLRRNPETKPPHRE

SEQ ID NO: 65225 - protein, 363 aa, Capsicum annuum
MGLAENQLCFDLIQEWVVNNPKASICTAKGAEDFQEIAIFQDYHGLPEFRQAVARFMEKVRGDRVTFDPNRIVMSGGATGAHEMLAFCLADPGDAFLVPTPYYPGFDRDLRWRTGVQLFPVVCESSNDFKVTRKALEEAYEKAQESNIKIKRLLINNPSNPLGTLLDKDTLRDIVTFINSKNIHLVCDEIYAATVFDQPRFISVSEVVDEMIGCNQDLIHIVYSLSKDLGFPGFRVGIVYSYNDTVVDIARKMSSFGLVSTQTQHLLASMLSDEIFIEKFIAESSERLSKRQGMFTKGLAQVGISTLKSNAGLFFWMDLRRLLKEPTFDAELELWRIIIHEVKLNVSPGVSFHCSEPGWFRVC

SEQ ID NO: 65226 - protein, 357 aa, Blumeria graminis
MAEFVRAQIFGTTFEITSRYSDLQPVGMGAFGLVCSAKDNLTGQNVAVKKIMKPFSTPVLSKRTYRELKLLKHLRHENVISLSDIFISPLEDIYFVTELLGTDLHRLLTSRPLEKQFIQYFLYQILRGLKYVHSAGVVHRDLKPSNILVNENCDLKICDFGLARIQDPQMTGYVSTRYYRAPEIMLTWQKYDVEVDIWSAGCIFAEMLEGKPLFPGKDHVNQFSIITELLGTPPDDVIHTIASENTLRFVQSLPKRVRQPLKDKFTNADPLAIGLLEEMLVFDPRRRIKATDALAHEYLAPYHDPTDEPIALEKFDWSFNDADLPVDTWKIMMYSEILDYHNVDSENQAMEDPLECP

SEQ ID NO: 65227 - protein, 450 aa, Pseudomonas syringae pv. phaseolicola 1448A
MNFSYGISMTFASLGLIEPLLRALEALGYQTPTPVQTQAIPPVLAGRDLMAAAQTGTGKTAGFALPLLQRLTMEGPKVAPNCVRALVLAPTRELADQVHESIRQYAEHLPLSTYAAYGGVSINPQMMKLRKGVDVLVATPGRLLDLHRQNAVKFSQLQTLILDEADRMLDLGFAEELRGIYAVLPKQRQTLLFSATFSDEIRLLAAQMLNDPLTIEVSPRNVAASSVKQWVVTVDKKRKADLFIHLMKKHRWGQVLVFAKTRVGVDQLVDRLQGLGLNADGIHGDKPQATRQRALDRFKSNEVKILVATDVAARGLDIDDLPTVVNLDLPIVAEDYIHRIGRTGRAGLTGEAISLVCADEVELLSAIEVLTRQTLERKEEQDFEPEHRVPTTDASGQILKKPKKPKKPKVSGSKRNLGKWVDSGESEPAPAVKPVRKVPVFNTGPRKKKP

SEQ ID NO: 65228 - protein, 708 aa, Candida glabrata CBS 138
MDSDKGFFHREKVTRSNGKKSNLSLAIQESESRQISGSDAEEAKLVPVPGGMMDLSGSSMKSGHSGGASSGADIDLQDVINNGSLNSAINNNGNSSNSNDNGVCGSTFPTVTARMYNDGGNGEDEDDDDCSSCDERNEESLKDYKPGGYHPAYKGEHYKEGRYVLVRKLGWGHFSTVWLAKDVTTGSHVAMKIVRSDKVYTEAAEDEIKLLQKLTDGQDDQLGAKYTLNLLDNFVHTGPNGRHVVMTFEVLGENLLALIKKYEHRGIPLVYVKQISKQILLGLDYMHRKCGVIHTDIKPENVLMEIGDVEAIVKMVELLDEQKKNLKRLQRSGSVLDHNQSFEFQRTIGHGANHSQTGMNDYTRSNEGTPLQRIPSRKPRRNTIITGSQPLPSPISSSNFNDMKTQLLGTSISNTMLTTNITSTQYPISNTPQRGSSINIHQGPIASSLQSSISNRSIKNNLMSHMSESSTSIANDLNGQQQQLAHSLSSFEISNIDETQDMDGNDTNIIQVKIADLGNACWYDEHYTNSIQTREYRSPEVLLGAPWGCSADIWSTGCLIFELITGDFLFEPNEGHSYTKDDDHIAQIIELLGDFPSYLLNNGRYTRTFFNSRGQLRNISKLKFWPLKDVLREKYKFDKEEAQEIADFLLPMLTLDPRKRCDAGGLANHPWLNDTLGMENVSVPERKLYGNGSDIPGWYNEVPSHQRH

SEQ ID NO: 65229 - protein, 406 aa, Burkholderia xenovorans LB400
MLKLDFHPAGRHFLQIPGPSPVPDRILRAMSYPTIDHRGPEFGELGLTVLDGIKKIFRTQQPVVIYPASGTGAWEAALSNTLSPGDHVLMFETGHFATLWKKMADSLGLKPEFLGLPGIEGWRRGVQPQMIEERLRADTQHAIKAVCVVHNETSTGVTSDIAAVRHAIDAAGHPALLLVDTISGLACADYRHDEWGVDVTVSGSQKGLMLPPGISFNAISPKAVAASKQAKLPRSFWDWAEIVEMNKTGYWPYTPNTNLLYGLSEALEMILGEGLDNVFARHERLAEATRRAVRAWGLEIQCADPAVYSPVLTGVMMPDGIDADAVRKLIYERFDMSLGTGLGKMKGRMFRIGHLGDCNDLMLLATLAGCEMGLRLAGVPLEGSGLPAAMEWLSQPTTALGLKVAA

SEQ ID NO: 65230 - protein, 185 aa, Zea mays
  misc_feature (44)..(44): Xaa can be any naturally occurring amino acid
  misc_feature (72)..(72): Xaa can be any naturally occurring amino acid
  misc_feature (80)..(80): Xaa can be any naturally occurring amino acid
  misc_feature (95)..(95): Xaa can be any naturally occurring amino acid
  misc_feature (117)..(117): Xaa can be any naturally occurring amino acid
LIGTSEESGSLIAEQVSMRGDDDESDDDDWEGVESTVPDEGFSXCGFRADPTSDRLSQTAFTAFIVTGIADXRVCSEGPXVPDQASALRITSRTXWQAWQKLDAIPLEEAMEKYIDXIHQLYSYRVEGVSKRRNRSGEKAAHKDPVISSSGSDEQWNKDSTISDHAHVISRRRSRVYPDNIEKRH

SEQ ID NO: 65231 - protein, 431 aa, Burkholderia pseudomallei K96243
MSRSAGDFATAGDASSRTVRAARDALEGRRKGVAAALPFVGPAVIASIGYMDPGNFATNIQAGAAYGYELLWVVLAANVIAMVFQAMSAKLGIVTGRNLAELCREHFPRPVVWGMWATSEIAAMATDLAEFLGGALAFGLLLHLPLIAGMAATAVLTCAILTLEKRGFRPLEAAIAALVGVIGASYLGELLIAPQDWHAAAYHLVVPQLRDGTALTLAVGIIGATIMPHTLYLHSGLTQRRTTPRDARERRLLLRFSNREVAVALGVAGFVNIAMVMMASSAFHRAAPGMADIGDAYHTLIPLLGPAAGALFLVALFASGVSSSVVGTLAGQVVMQGFLRRRVPIWMRRLVTIAPAFAIVALGCDVTRAMVLSQVVLSLVLPLPMAALLLLSSRRALLGEHALRAPTLVAASAAAAAIVALNVYLIWAAFN

SEQ ID NO: 65232 - protein, 129 aa, Glycine max
MVAHSSSWGRALVAISPYTFSAIGIAVAIGVSVLGAAWGIYITGSSLIGAAIRAPRITSKNLISVIFCEAVAIYGVIVAIILQTKLESVPASNIYAPESLRAGYAIFASGLIVGFANLVCGVRVGIHPS

SEQ ID NO: 65233 - protein, 259 aa, Triticum aestivum
VTLQNKFVQKSRLVPVRNSRDIVDPRVRCDEHFFYEEIENYNQPYLSSLHEYDDGKDLTKYDFEADCFSSPFDDVNKRKLAYRHRAIGDKYAKGLQKILDHRMFKVWSDLYSSPDKYTDGWLSSAHKLLEEALCKSTAEPAIKSSSINCIVTSGSLVPSIAKCLLYRLDDVVSSDNVYSSWESGKLQCFKWIKERHGGPNVRFCAVGDGPEERSAASIMKWPFVKIEIRPDAPHRFPGLSLSTIHGIMDAVYQSSGKDG

SEQ ID NO: 65234 - protein, 808 aa, Bacillus pumilus SAFR-032
MKKVISRSSVLLFSTIFVLSTFFTGQQAAAAPSNKQVELEKAEIFGEINVKSRKHTTVIVELKEKSLVEAKQEGKAQTKASLKKSRTKVKNEALKEIDKASVRQEYEKVFSGFSMKLPANEIPKLLAVDGVKAVYPDVTYQTDEVKKESIQLPNEDVSPLMDKSAPFIGAPKAWDAGYSGKGVKVAVIDTGVDYTHPDLKGNFGLYKGYDFVDNDYSPQETPKGDPRGESTDHGTHVAGTIAANGQMKGVAKDATLLAYRVLGPGGSGTTENVLAGIDRAVTDGADVMNLSLGNSVNNPDYATSIALDWAMSEGVVAVTSNGNSGPNSWTVGSPGTSRDAISVGATQLPYSLYNVTFPNYSTAKVMGYYQESDLKALDQKQVTLVHAGIGDEKAFEDIDVKGKVAVIERGAIAFVDKVDNAKAAGAIGVVMFNNTDGEIPVDVPGLALPTIKLSKAEGTALVNAIEAGNNTTTFSIQFVKELSEQVADFSSRGPVVDTWMIKPDLSAPGVSIVSTIPTHDPSQPYGYGSKQGTSMASPHVAGVAAIIKQAKPSYSTAQIKALLMNTAEKLFDANGNPFPHNTQGTGSVRIIESLQASSIVSDASYSYGTFLKEKGVQIKTKKFKVENLSKAPKTYTIDYKFDGSGISTNGTKKITVKGNSTGSFTSAVQVKYGKTKKGTYQGSITLRENGRKVTEIPTLLIVKEPDYPRVTSVSVEPDNRAGSYVISSYLPGGAENLAFLVYSTDGEYLGEAGVYQHVDKGEHRVKWNGTINQGQKLESGEYTMLAYASLKGKSDTVQTKEPFDIYPE

SEQ ID NO: 65235 - protein, 496 aa, Arabidopsis thaliana
MAKPEEVSVPIFTSLEPVYGEGSLLQEATQRFDVLKANFNDVFGASPQLFARSPGRVNLIGEHIDYEGYSVLPMAIRQDTIIAIRKCEDQKQLRIANVNDKYTMCTYPADPDQEIDLKNHKWGHYFICAYKGFHEYAKSKGVNLGSPVGLDVLVDGIVPTGSGLSSSAAFVCSATIAIMAVFGHNFEKKELAQLTCECERHIGTQSGGMDQAISIMAKTGFAELIDFNPVRATDVKLPDGGSFVIAHSLAESQKAVTAAKNYNNRVVECRLASIILGVKLGMEPKEAISKVKTLSDVEGLCVSFAGDRGSSDPLLAVKEYLKEEPYTAEEIEKILEEKLPSIVNNDPTSLTVLNAATHFKLHQRAAHVYSEARRVHGFKDTVNSNLSDEEKLKKLGDLMNESHYSCSVLYECSCPELEELVQVCKENGALGARLTGAGWGGCAVALVKEFDVTQFIPAVKEKYYKKRVEKGVVKKEDMELYLFASKPSSGAAIFNL

SEQ ID NO: 65236 - protein, 525 aa, Candida glabrata CBS 138
MSSIEQVNEVFDTILVLDFGSQYSHLITRRLREFNIYAEMLPCTQKIADLHFKPKGVIMSGGPYSVYAEDAPHVDHAIFDLGVPILGICYGMQELAWINGKQVARGEKREYGPATLNVLDKEDALFKNVDHSTVWMSHGDKLHGLPTGFKVIATSDNSPYCGIVHESKQIYGIQFHPEVTHSSNGKTLLKNFAVDLCHAKQNWTMKNFIGTEVQRIRDLVGPTAEVIGAVSGGVDSTVASKLMTEAIGDRFHAILVDNGVLRLNEAATVKKTLVDGLGINLTVVDAADEFLDNLKGVTDPEKKRKIIGNTFIHVFEREAEKIKPKDGKAIEFLLQGTLYPDVIESISFKGPSQTIKTHHNVGGLLENMKLKLIEPLRELFKDEVRELGELLGISHELVWRHPFPGPGIAIRVLGEVTREQVEIARKADHIYIEEIRKAGLYDKISQAFACLLPVKSVGVMGDQRTYEQVIALRAIETTDFMTADWYPFEHSFLRKVASRIVNEVDGVARVTYDITSKPPATVEWE

SEQ ID NO: 65237 - protein, 494 aa, Salmonella typhimurium LT2
MSDVTLLAEVTTFLRQRHGQFIAGERQAGNGTNFSVTNPATGKIIADVVSATPAQAEEAMQSARRAFDVWRKMPTLQRGALLLKLADTLAAHREELAQLESVCSGKTIMLSRGLELDQSVAFLRYFAGWAGKITGETLNVSLPSMGEERYTAFTQRQPIGVVVGIVPWNFSIMIAIWKLAAALVCGCTIVIKPSEYTPLTLLRVAELAKEAGFPDGVINVVNGAGGEIAQQLIAHPDCAKVSFTGSVATGEKVRRSATSSGKRVTLELGGKNAALFLNDLTAQAMVNGILEAGYLNQGQICAAAERFYLPQEKLDTVMTLLRQRLSEIVPGSPLDEKTVMGPLANQVQLEKVLRLIQRAREEGDTIVYGGETLPGEGYFLQPTAVKVRSKNSTLMHEETFGPVCSFIGYQNEKEALSHINDSPFGLAASVWSENISKALRYAEDIDAGMVWVNMHTFLDPAVPFGGMKGSGIGREFGSAFIDDYTELKSVMVRY

SEQ ID NO: 65238 - protein, 369 aa, Synechococcus elongatus PCC 6301
MKSRAAIAWAAGQPLTIEEVDVQAPQAGEVMVKLVATGVCHTDAFTLSGADPEGIFPCILGHEGAGIVVEVGEGVTSVAVGDHVIPLYTPECGECKFCKSGKTNLCQAIRATQGKGLMPDGTSRFSLNGQPIYHFMGTSTFSEYTVLPEIAIAKINPAAALDKVCLLGCGITTGIGAVLNTAKVEPGSTVAVFGLGGVGLSVIQGAVLAKASRILAIDINPDKAEFAKQLGATDFINPKDYDRPIQEVIVELTDGGVDYSFEAIGNVNTMRAALESCHKGWGESTIIGVAGAGQEISTRPFQLVTGRVWRGSAFGGVKGRSQLPGYVEQYLNGQIKVDEFVTETRPLEEINEAFEDMHAGKVIRTVITF

SEQ ID NO: 65239 - protein, 402 aa, Vitis vinifera
MSVSSRLSPGQSDIPTNAAARANEVITCKAAVCWGLGEAMKVEEIQVEPPKSSEVRVKMLVVESVGENVTGLKEGDVVIPTYLGECGECENCRSPKTNVCLKHPVTFTGLMPDGTSRMSIRGQRLHHIFSCSTWTEYMVVNANYLVKIDPRIAPSDASFLSCGFSTGYGAAWKDAKVEKGSSVAVLGLGAVGLGVLQGARNQGAARIIGIDKNERRREVGEAFGMTDFINPNESNKSISELVNELTGGQGVDYSFECTGIPSLVNEALQATKVGKGMSMVLGIANVPTVDISLMALLSGKTLKGCFFGGIKVQSDIPVIVDKCINKASSLDIQLDELLTHEVQLEDMNKAFELLKQPDCVKESDVIYPPKKNWRHMGMVMEASKYASKSLTHMFVRGRCQQW

SEQ ID NO: 65240 - protein, 417 aa, Oryza sativa Indica Group
MGRKRALLVGINYPGTKAELKGCHNDVDRMHRCLVDRFGFDEDDIRVLLDRDSSGTQPTGANIRRALAQLVGDARPGDFLFFHYSGHGTRLPAETGQNDDTGYDECIVPSDMNLITDQDFRELVQKVPNGCLFTIVSDSCHSGGLLDSAKEQIGNSTRQNQTQSRELEEPSDSGSGFRSFLKETVRDVFESEGIHLPRSRHSQSHYGGEDQDETYAQPTDGHTKNRSLPLSTLIEMLKEKTGKDDIDVGSIRMTLFNIFGDDASPKVKKFMKVMLGKFQQGQSGEQGGLMGMVGSLAQEFLKVKLEGNEEEAFKPAIEQEVHSVDEVYAGTKTWAPNNGILISGCQSNQTSADATTPQGSSYGALSNAIQTILADKRGNVSNKDLVMKARSLLAKQGYTQQPGLYCSDDHVHVSFIC

SEQ ID NO: 65241 - protein, 357 aa, Oryza sativa Japonica Group
MRTNTTATVLLAAAVALLLATAARGDGGDGGCGKEDAAAGRDRARARGLKIAAFFSILVCGALGCGLPSLGRHVPALRPDGDVFFLVKAFAAGVILATGFIHILPDAFDNLTDDCLPAGGPWKEFPFAGFGAMVGAIGTLVVDTLATGYFTRALSKKDAATAAAHEGQVHVHTHATHGHAHGSSALVAAVGEDDKETTLRHRVISQVLELGIVVHSVIIGISLGASQNPETIKPLVVALSFHQMFEGMGLGGCIVQAKFKVRSIVTMVLFFCLTTPVGIAVGVGISSVYNESSPTALVVEGILNSVAAGILIYMALVDLLAEDFMNPRVQSKGKLQLGINLAMLAGAGLMSMLAKWA

SEQ ID NO: 65242 - protein, 483 aa, Pseudomonas aeruginosa PAO1
MSVRRTKIVATLGPASNSPEVLEQLILAGIDVARLNFSHGTPDEHRARARLVRELAAKHGRFVALLGDLQGPKIRIAKFANKRIELQVGDKFRFSTSHARDAGTQEVVGIDYPDLVKDCGVGDELLLDDGRVVMVVEEVAADELRCRVLIGGPLSDHKGINRRGGGLTAPALTDKDKADIKLAADMDLDYVAVSFPRDAKDMEYARRLLTEAGGKAWLVAKIERAEAVADDDALDGLIRASDAVMVARGDLGVEIGDAELVGIQKKIILHARRNNKVVITATQMMESMIHSPMPTRAEVSDVANAVLDYTDAVMLSAESAAGEYPVEAVKAMARVCQGAEKHPTSQKSSHRLGQTFDRCDESIALASMYTANHFPGIKAIICLTESGFTPLIMSRIRSSVPIYAYSPHRETQARVAMFRGVETIPFDPAALPAEKVSQAAVDELLKRGVVTKGDWVILTKGDSYTAQGGTNTMKVLHVGDLLV

SEQ ID NO: 65243 - protein, 461 aa, Chlamydophila pneumoniae CWL029
MTQEFDCVVIGAGPSGYVAAITAAQSKLRTALIEEDQAGGTCLNRGCIPSKALIAGANVVSHIKHAEQFGIHVDGYTIDYPAMAKRKNTVVQGIRQGLEGLIRSNKITVLKGTGSLVSSTEVKVIGQDTTIIKANHIILATGSEPRPFPGVPFSSRILSSTGILELEVLPKKLAIIGGGVIGCEFASLFHTLGVEITVIEALDHILAVNNKEVSQTVTNKFTKQGIRILTKASISAIEESQNQVRITVNDQVEEFDYVLVAIGRQFNTASIGLDNAGVIRDDRGVIPVDETMRTNVPNIYAIGDITGKWLLAHVASHQGVIAAKNISGHHEVMDYSAIPSVIFTHPEIAMVGLSLQEAEQQNLPAKLTKFPFKAIGKAVALGASDGFAAIVSHEITQQILGAYVIGPHASSLIGEMTLAIRNELTLPCIYETVHAHPTLSEVWAEGALLATNHPLHFPPKS

SEQ ID NO: 65244 - protein, 224 aa, Zea mays
  misc_feature (55)..(55): Xaa can be any naturally occurring amino acid
  misc_feature (69)..(69): Xaa can be any naturally occurring amino acid
  misc_feature (155)..(155): Xaa can be any naturally occurring amino acid
  misc_feature (173)..(173): Xaa can be any naturally occurring amino acid
MTKQHANWSPYDNNGGTCVAIAGSDYCVIAADTRMSTGYSILTRDYSKIHKLADXAVLSSSGFQADVKXLQKVLKSRHLVYQHQHNKQMSCPAMAQLLSNTLYFKRFFPYYAFNVLGGLDEQGKGCVFTYDAVGSYEKVGYSAQGSGSTLIMPFXLEYQLQSPRTLLLSAQDXSHPLTDPEAVDLVKTVFASATERDIYTGDKLEIMILKADGIKTEVMDLRKD

SEQ ID NO: 65245 - protein, 253 aa, Methanothermobacter thermautotrophicus str. Delta H
MMEMRITFLGGGRVVRIILGGLQRAGKLPREVMVCDPDEDSLRSLEDEFGVKTSADCSSMEGDVIFLALHPPVLKDVLNKMESPSPESLIVSLAPRIRIEEIQQALDHPKVARVIPNALSLVNRGYNPFSAADELTGTDLEILQSLFEPLGKFPEVSEDKLEAYAVITAMGPTYLWFQLAELEKLAVEFGMSPDEAATAVHSMASGAVEALYSHPNRDMVMDLIAVKPLEDAEDDIRAIYRKSLMRIYQSLTE

SEQ ID NO: 65246 - protein, 277 aa, Triticum aestivum
  misc_feature (7)..(7): Xaa can be any naturally occurring amino acid
FPILQQXSHDQLASGVAFLNDETMRLFLIRHGETVDNVANLYAGSRDSALTAHGVMQAQKLASHLAEHVTIGRIFSSNLSRAVHTAQAILDAQKCAKDLKLVQAPELREKDFGTGEGAKFGSATKHEGSETPQAMRKRIDVFLDEHLPRLHEDSTVCIVAHGIILGTLYKALRDRIPSTSTAPDAAPEGRAESAFARPTWSNTGYVEALITTNASTTDKNVQMRVVKVNSVEHLKGLRKTRGGIGSAKFDAKQKTMDSFFKSVSRKRKIEDEDIVSR

SEQ ID NO: 65247 - protein, 114 aa, Brassica napus
NEAKSVDIFIPKSESDFLEYAEMISHKVQAYEISSQHIGLLKAVMRLSVANMKAADVKDVASSISAIGNEKLKAEKDAAAGKKKSGKKKQLHVDKPDDDLVSGPYGAMDDDDFM

SEQ ID NO: 65248 - protein, 191 aa, Galega orientalis
NWVNIREITKLELRVLRLANVQCPRDTHFWVYDDGRYEEEGQKNIRGNIWEKASTRFVCALFSLPFPHGQPHGSRDETSHYTTVPKYLEQRKTQKLLLLGLQGSGTSTMFKQAKFLYGNKFTAQELEDAKLMIQSNMYKYLSILLDGRERFEEEIVSKMNGQCSPRQITEPASNGEASNTSECIYSLNPRL

SEQ ID NO: 65249 - protein, 487 aa, Moritella sp. PE36
MSLVTYKNYVHGQSLSNDSGETFEVINPANGEVSYLVEVADASIQQATIESAKVGFATWSKLTAMERNRILLKAVALLRERNDELAAIEVQDTGKPWQEASVVDVVTGADSIEFFAGIAPSIEGNQQQVGDDFYYTRREPLGICAGIGAWNYPLQIACWKAAPALACGNVMIFKPSEETPRGAIKLAEIFTEAGVPDGVFNVVQGDGRVGAWLTTHDDIAKVSFTGEVGTGKKVMAAAAGSLKEVTMELGGKSPLIIFDDADIDNAVSAAMLANFYTQGEVCTNGTRVFVQEAIYPRFIEKLRERTENNIICGDPMDPETNFGALISKEHQDKVLNFIEIGKSEGAELLTGGHALQPDNAPNGYFVAPTIFTQCTDEMTLSKEEIFGPVMSVFTFADEDEVIARANDTRLGLAAGVFTQDITRAHRVIHQMQAGICWINAYGASPAEMPVGGYKMSGIGRENGSETLKAYTQIKAVYVGMQPLESPF

SEQ ID NO: 65250 - protein, 675 aa, Xanthomonas axonopodis pv. citri str. 306
MLEHYGLWLALGCAVLAIVYGIVSARWVVAQPSGNARMQEIAAAIQEGARAYLNRQYLTISVAGAVLFVLVGLFLSWYTAIGFALGAVLSGLAGYIGMNVSVRANVRTAEAARHGIGKAMDVAFRGGAITGMLVVGLGLLGVAGYFAVLQGMGLPLEQNLHALVGLAFGSSLISIFARLGGGIFTKGADVGADLVGKVEAGIPEDDPRNPAVIADNVGDNVGDCAGMAADLFETYAVTVIATMLLGSLTLADTGSHAVLYPLVLGGVSIIASIVGAAFVKVKDGGSIMGALYKGVIVSGVLAALAYWPITQSLMRDNIHGATALYACALIGLVLTGLIVWITEYYTGTQYTPVQHVASASTTGHGTNIIAGLGISMKSTALPVIAVCAAIWGAFHFGGLYGIAIAATAMLSMAGMIVALDAYGPITDNAGGIAEMAELPPEVRNITDPLDAVGNTTKAVTKGYAIGSAALAALVLFADYTHNLQAANPDQVYAFDLSDHTVIIGLLIGGLIPYLFGAMAMEAVGRAAGAVVEEVRRQFRELPGIMAGTAKPQYDRAVDMLTRSAIGEMIVPSLLPVVVPIIVGLLLGPRALGGLLIGTIVTGLFLAISMTTGGGAWDNAKKYIEDGHFGGKGSEAHKAAITGDTVGDPYKDTAGPAINPLIKIINIVALLLVPLL

SEQ ID NO: 65251 - protein, 304 aa, Synechococcus sp. RS9917
MLSDLVNRCRPLPAEPTLLVLGAGFSGSHFAALARQLGTRVLTSVRLPADRSDPSTLRFDSQLNQLPDPEQLQGVTHVLSTIPPERDGQDPVIRCLGETLQRLPLQWLGYLSTTGVYGDRQGAWVHESDPATPMQERSQRRLACEEAWQSLDGPVQILRLPGIYGPGRSPFQAILRGDLQPIDKPGQVFSRVHVDDIAGACWHLIQQAAQGRRPPVVNISDDEPAASAQIQGYAAELLGITLPQPRPYSDASQTMSAMARSFWAENRRVSNTLLCEELGYTLLHPTYRSGLLDCWEAEGFKASA

SEQ ID NO: 65252 - protein, 1298 aa, Arabidopsis thaliana
MASSSSSRTWNYRVFASFHGPDVRKSFLSHFRKQFICNGITMFDDQKIVRSQTIAPSLTQGIRESKISIVILSKNYASSTWCLNELLEILKCREDIGQIVMTVFYGVDPSDVRKQTGEFGTVFNKTCARRTEKERRNWSQALNVVGNIAGEHFLNWDNEAEMIEKIARDVSEKLNMTPSSDFDGMVGIEAHLKEMEVLLDFDYDGVKIVGIFGPAGIGKTTIARALHSLLLFKKFQLTCFVDNLRGSYPIGIDEYGLKLRLQEHLLSKILNQDGMRISHLGAVKERLCDMKVLIILDDVNDVKQLEALANDTTWFGPGSRVIVTTENKEILQRHGIDNMYHVGFPSDEKAMEILCGYAFKQSSPRPGFNYLAQKVTWLCGNLPLGLRVVGSSLRGKKEDEWKSVIRRLDTIIDRDIEDVLRVGYESLHENEQSLFLHIAVFFNCKDVDLVKAMLADDNLDIAHGLKILVNKSLIYISTTGEIRMHKLLQQVGRQAINRQEPWKRLILTNAQEICYVLENDKGTGVVSGISFDTSGISEVILSNRALRRMSNLRFLSVYKTRHDGNNIMHIPEDMKFPPRLRLLHWEAYPSKSLPLGFCLENLVELNMKDSQLEKLWEGTQLLTNLKKMDLSRSVHLKELPDLSNATNLERLELCDCRALVELPKSIGNLHKLENLVMANCISLEVIPTHINLASLEHITMTGCSRLKTFPDFSTNIERLLLIGTSVEEVPASIRHWSSLSDFCIKNNEDLKSLTYFPEKVELLDLSYTDIEKIPDCIKGFHGLKSLDVAGCRKLTSLPELPMSLGLLVALDCESLEIITYPLNTPSARLNFTNCFKLGEESRRLIIQRCATQFLDGYACLPGRVMPDEFNQRTSGNNSLNIRLSSASFKFKACVVISPNQQQHSWEHTDIRCIVGSYNKVICVEHPNESTRIQTEHLCIFHGSVSEVSSNEALFEFCIDASNQFDNFKILECGVRILTNEPERSSKKTVSRGLSFLTLGSMVSERRVHPDCINASNPYHECVEYCFKKIAEAKARFEKQNTGLAKVHEQTREPLDDKRIEEDSSEEEEEEEDNQEPQVDVTQLTGRQKKLFELRLKMNEARKSNQTDVGSEKKKMEAPTETKGISKQKWLEGRKKKIGKLLDANGLDMTQAYMLDTQEAAESKYKKWEKEPTPAGWDVFNQKTLYNAYKKRTKNIQVDLEEYNRMRAADPEFYREASSLQYGKAPKTSQDKIDKMAKELLDREQKRQEFSRRRKFREEKDIDSINDRNEHFNKKIERAFGKYTLEIKNNLERGTALPD

SEQ ID NO: 65253 - protein, 178 aa, Xanthomonas axonopodis pv. citri str. 306
MGLELVTSGKNLPEEINVVIEIPKDSEPVKYEVDKASGAIFVDRILSTPMRYPCNYGYVPNTLCGDGDPADVLVVLPLPLVPGSVVRCRPVGVLRMSDEAGSDEKILAVPIEKIFSGYAHIEDINQVSSHWMERIGHFFEHYKDLEKGKWVKLDGWGGAAEAKRILTESVERYNSDAP

SEQ ID NO: 65254 - protein, 494 aa, Klebsiella pneumoniae subsp. pneumoniae MGH 78578
MSEITLLAEVTAFLRQPHGQFIAGQREAGRGAPFAVINPATGRAIAEVTAADSDQADRAMESARQAFSQWREMPTLARGALLLKLADTLAEHREALAQLESLCSGKTITLARMLELDQSVAFLRYFAGWAGKVTGETLDVSLPSMAGEKYTAFTRRQPLGVVVGIVPWNFSIMIAIWKLAAALVCGCTIVLKPSEYTPLTLLRVAELAKAVGIPDGVINVVNGAGGEIAQRLITHPACAKVSFTGSVATGEKVQQSASASGKRVTLELGGKNAALFLDDLTPEAMVNGIIEAGYLNQGQICAAAERFYLPQGKLDAVLALLKDKLSAFAPGSPLDERTLMGPLANRQQYDKVLRLIQTARDEGDTIVCGGEALPGEGYFLQPTAVKVRSEESTLMREETFGPVCSFIGYRSEEEALARINASPYGLAASVWSDNIRQALRYSEAIEAGIVWVNMHTFLDPAVPFGGMKGSGIGREFGSAFIDDYTELKSVMVRY

SEQ ID NO: 65255 - protein, 458 aa, Klebsiella pneumoniae subsp. pneumoniae MGH 78578
MKDASTSSETVTESGPTLHRGLQNRHIQLIALGGAIGTGLFLGIGPAIQMAGPAVLLGYAVAGIVAFLIMRQLGEMVVEEPVSGSFAHFAYKYWGPFAGFLSGWNYWVMFVLVGMAELTAAGIYMQYWLPDVPTWVWAAAFFIIINAVNLVNVRLYGEAEFWFALIKVLAIIGMIAFGLWMLFGGHGGSKAGFDNLWKHGGFLATGWHGLILSLAVIMFSFGGLELIGITAAEAQNPEKSIPKAVNQVVYRILLFYIGSLVVLLALYPWVEIKSDSSPFVMIFHNLDSNLVASALNFVILVASLSVYNSGVYSNSRMLFGLSVQGNAPKFLARVSKRGVPVNSLLLSGIITSLVVVLNYLLPHEALGLLMALVVATLLLNWIMICMAHLKFRAAQRRKGRESKFKALLAPASNYFCIAFLGLILALMCTIDGMRLSAILLPVWILFLFIAFKLLRRPA

SEQ ID NO: 65256 - protein, 516 aa, Thermoanaerobacter tengcongensis MB4
MDVQAKIEELKRRYEKIKEGGGQKRIEKQHEAGKLTARERLNILLDEHSFIEIDPFVEHRCTDFGMEKTEAPGDGVVTGYGTIDGRLVFVFAQDFTVLGGSLGEYHAKKITKVMDMAMKMGAPLIGLNDSGGARIQEGVDALSGYGQIFYRNTLASGVIPQISVIMGPCAGGAVYSPALTDFIFMVDKTSYMFITGPQVIKAVTGEEVTHEQLGGATTHNTLSGVAHFVFPDEKQTLIAVRKLLSYLPSNNMEDPPVVETGDSPNRVEVDLNTVIPDNPNKAYNMKDVIKLIVDNGEFFEVQPYYAQNIITGFARLNGRSVGIIANNPSVLAGVLDINASDKAARFIRFCDAFNIPILNLVDVPGFLPGTDQEYGGIIRHGAKMLYAYSEATVPKVTLIIRKAYGGAYLAMCSRDLGADMVLAWPTAEIAVMGPEGAANIIFKKEIEEAENPAEVRQQKIEEYRTSFANPYRAAARGYIDNVIEPAVTRPILISAFDMLMSKRETRPAKKHGNIPL

SEQ ID NO: 65257 - protein, 239 aa, Oryza sativa
MPAHGNMSWGCVLWAGKDDKDEVEMLNHGGGLETVKEQLQRVLERITLQSQAQHGDGELLVQSKTAPRILLLPFLNLPTVREPSPVPVLTTYAVAHRAVAGAGQPLTAASRSPTTSSPSALSPVREDLLGQNKKAADDMSRVAGLDNQGIVGLQRQIMKEQDEGLEKLEETVLSTKHIALADDLEDHVDVTNSRLQRVQKRLAILNKRTKGGCSCMCLLLSVVAIVILAVIVWLLIKYM

SEQ ID NO: 65258 - protein, 531 aa, Triticum aestivum
  misc_feature (108)..(108): Xaa can be any naturally occurring amino acid
  misc_feature (135)..(135): Xaa can be any naturally occurring amino acid
  misc_feature (189)..(189): Xaa can be any naturally occurring amino acid
  misc_feature (316)..(316): Xaa can be any naturally occurring amino acid
MEAGTWAVVVAAAAAYLAWFWRMSRGLSGPRVWPLVGSLPGLLQHAEDMHEWIVGNLRRTGGTYQTCIFAVPGVARRGGLVTVTCDPRNLEHVLKARFDNYPKGPFWXTGVFSDLLGDGIFNSDGDTWVAQRKTXALEFTTRTLRTAMSRWVSRSIHHRMLPILSDAAASGAHVDLQDLLLRLTFDNIXCGLAFGKDPETLARGLPENAFATSFDSATEATLNRFIFPECVWRCKKWLGLGMETSLARSVAHVDRYLSAVIKTRKLELAGKSDGSTPHDDLLSRFMRKGTYSDDSLQHVALNFILAGRDTSSVALXWFFWLVSTHPDVERKIVRELCAVLAASRGADDPALWLAAPFDYEELDRLVYLKAALSETLRLYPSVPEDSKHVVADDYLPDGTFVPAGSSVTYSIYSAGRMKTVWGEDCLEFRPERWLSADGTKFEPHDSYRFVAFNAGPRICLGKDLAYLQMKNIAGSILLRHRLAVAPGHRVEQKMSLTLFMKHGLRMVVRPRDLAPTLDELPAAAPAVAACA

SEQ ID NO: 65259 - protein, 485 aa, Pisum sativum
MSDSDITFYCLSSILSLLLIFILIKTKQTKPKLNLPPGKMGWPFLGETIGYLKPYSATTIGEFMEQHIARYGKIYKSKLFGEPAIVSADAGLNRFILQNEGKLFECSYPRSIGGILGKWSMLVLVGDMHRDMRVISLNFLSHARLRTHLLKEVEKHTLLVLSSWKEKSTFAAQDEAKKFTFNLMAEHIMSLQPGEIETEKLKKEYVTFMKGVVSAPLNFPGTAYWKALKSRCKILKFIEEKMEERIKRMKDGNENLEEDDLLNWVLKHSNLSTEQILDLILSLLFAGHETSSVSIALAIYFLPGCPRAIQQLREEHREIARVKKQAGETELTWEDYKKMEFTHCVVNETLRLGNVVRFLHRKALKDVRYKGYDIPCGWKVLPVIAAVHLDPLLFDQPQHFNPWRWQNNGNCSNASSNNNNNFLPFGGGPRLCAGSELAKLEMAVFIHYLILNYHWELIDNNDQAFAYPFVDFPKGLRIQVQPHQL

SEQ ID NO: 65260 - protein, 403 aa, Zea mays
MASSMLSATTVPLQQGGGLSEFSGLRSSASLPMRRNATSDDFMSAVSFRTHAVGTSGGSRRAPTEAKLKVAINGFGRIGRNFLRCWHGRGDASPLDVIAINDTGGVKQASHLLKYDSTLGIFDADVKPVGDNAISVDGKVIKVVSDRNPSNLPWGELGIDLVIEGTGVFVDREGAGKHIQAGAKKVLITAPGKGDIPTYVVGVNADQYNPDEPIISNASCTTNCLAPFVKVLDQKFGIIKGTMTTTHSYTGDQRLLDASHRDLRRARAAALNIVPTSTGAAKAVSLVLPNLKGKLNGIALRVPTPNVSVVDLVVQVSKKTLAEEVNQAFRDAAANELTGILEVCDVPLVSVDFRCSDVSSTIDASLTMVMGDDMVKVISWYDNEWGYSQRVVDLADICANQWK

SEQ ID NO: 65261 - protein, 459 aa, Rickettsia conorii str. Malish 7
MEQYDVAVIGGGPGGYVAAIRAAQLKKKVVLIEKEHLGGVCLNWGCIPTKSLLKSAEVFEYIKHAKDYGIDAKGAEINIKKIVERSREISNKLAGGVKLLLKKNKVTVIDGVASLAGNKVININDKPIVKAGNIIIATGARSRVLKGFKPDGKQIWTSKEAMIPQHVPKSMIIVGSGAIGIEFASFYNSIGVDVTVIEAHNRILPAEDMEISGIARKNFEKKGIKIITNAKLIKQTKSKDKIEVELELADKTQKLQAEILLMAVGITANTENLGLEKTKIKVENGYITTNGLMQTAASGIYAIGDVAGVPCLAHKASHEGIIAAESIAGLKPHTINKHNIPGCTYSSPQIASVGLTEEAATTLGYELKIGRFPFIANGKALVSGDSDGLIKTIFDAKTGELLGAHMIGSEVTELIQGYVVSKNLEGTELDLINTIFPHPTLSEMMHESVFSAYDRAIHI

SEQ ID NO: 65262 - protein, 628 aa, Desulfitobacterium hafniense Y51
MLQRSYYDMSILYCRSCGVDVSGEALFRQVTFAVEKGEKVGLVGPNGAGKTTLLRACLGEHPLESGEVFLTGTWGYLPQNPLVEDQGTVWESMLAERADLIEMKEQLHVLEERMAHTADEKVFAQYSALTERFETMGGYALEAQVRKILSGLGLTKETEHPIQHLSGGQKTRLALSKLLLRSPEFLILDEPTNHLDMDALEWLEGFLKGYDGAILVVSHDRYFLDHVVQKVLHLEKGGLKSYPGNYSEYELQRAVEETTLVREAERVSKKIARLEEYIRRYKAGIKSKQARGRESQLQKIKPVEVNKTPKSLHISLATGRRSGDRTLMLEDVSVEFPGRRLFHGVDVELRRGDRVALLGENGIGKTSLLKAIKGSLPYQGEIRLGANVKLGYYSQEHEELHGKGSIMDEIRGDTDLLDPEIRSLLARFGFVGEEVFKPVSVLSGGEKSRLALAKLFLSQGNLLLLDEPTNHLDTRMRDVLEEALQDYDGTLLVVSHDRYFLDRVVNKIARLTPEGLKIYEGDYSMYKAQVQEEEAASTGGSASSGTAVGTRPHEQSKETEREARRRQRKAQQLEAQIAELEEEIQSLEEQMAAVTSNYEKALELHKLFEEKKVLLDSTMMEWLEITEE

SEQ ID NO: 65263 - protein, 357 aa, Mesembryanthemum crystallinum
MTAYRGKYADELIANAAYIGTPGKGILAADESTGTIGKRFAGINVENVESNRRALRELLFTTPGAVQYLSGVILFEETLYQKTAAGKPFVEVLKEGNVLPGIKVDKGVVELAGTNGETTTQGLDGLGARCAQYYAAGARFAKWRAVLKIGPTEPSPLAILENANGLARYAIICQENGLVPIVEPEILVDGPHDIDRCAEVTERVLAACYKALNDHHVLLEGTLLKPNMVTPGSESKKVAPEVIAEYTVRALQRTVPPAVPAVMFLSGGQSEEEATVNLNAMNKLQGKKPWTLSFSYGRALQSSTLKAWSGKEENVEKAQAVFLARAKGNSEATLGKYQGGAGGADASESLHVKDYKY

SEQ ID NO: 65264 - protein, 438 aa, Oryza sativa Indica Group
MTRPAARGIVAGAAASTVPLPRAGFASPCPTARSLGFAARGTDPRLAIHVSSRRRAASASAGSRLARAVATMAKKSVGDLAAADLEGKRVLLRADLNVPLDASQNITDDTRVRAAIPTIKHLIGNGAKVILCSHLGRPKGITPKFSLAPLVPRLSELLGIQVQKADDVIGPEVEKSVSVLPNGSVLLLENVRFYKEEEKNDPEFAKKLASLADLYELDYLVGAVSNPKRPFAAIVGGSKVSCKIGVIESLLEKCDILLLGGGMIFTFYKAQGFPVGASLVEDDKLELATSLLAKAKEKGVSLMLPTDVIVADKFAPEANCQVVSAYAIPDGWMGLDIGPDSVAAFSSALETTQTVIWNGPMGVFEFEKFAVGTEAIAKKLAELSGKGVTTIIGGKDSVAAVEKVGVANVMSHISTGGGASLELLEGKELPGVVALDEA

SEQ ID NO: 65265 - protein, 460 aa, Yarrowia lipolytica CLIB122
MADATTAAATAGSSAASAPAAAPSGNFLTSMLGENSGFLENPLFTGGMGLMVLGAVVALGRTGIVQGSQFLQRQLLVDLEIASKDRSYAWFLEWMSHHPQRSSRHLAVQTTVKQHASGSFTTQFSLVPGPGRHLIRYKGAFMLVKRERSNRLLDMNSGSPFETITLTTLYRDRYVFQELLAEAQQRAQKMQAGKTVIYTSFGPEWRPFGQPRRKRELDSVILDKGVSESIVEDVNDFLKNSQWYHDRGIPYRRGYLLYGPPGSGKSSFIQALAGELDYNICILNLAEATLTDDRLNHLMNHVPERTFLLLEDIDSAFNERKQSADQGYHSGVTFSGLLNALDGVASAEERIIFMTTNHPERLDPALIRPGRVDFKECIDNATEYQAEKMFMRFFPGEEKLCNEFIQTLKANNKLVSTAQMQGLFVMNKTDPVGAIHMAQYLPENEGTPSPASEPPVHKGV

SEQ ID NO: 65266 - protein, 865 aa, Oryza sativa Indica Group
MSHLQHLAAGELVTALRGASCPSSALRLYSLIRIHARPSDPALFAWRPAVLALKPLSAAASLPLLSHFHAHLIRSNLLAYPHVASSLLRGYSLLSPEHAHHLFDQIPPSTCNLVVVNVMLGSLCRSSDLPSARAFFDGIPDKEPWAIHGYIVRRGITFTMHLGTALIDCYAKAGRLDYASRVFCRVPLRNVMHWTAMICGSAAHLGSEKAIQLFEEMCRSGVQPNEMTFTAVLSACGQAGLVDQGRRFFKLMVDTYGFEPTIHHYGCIVDLYAKAGKLEDAYEVIKTMRMEPNIIIWTSLLAACKKFKNFYIAVEGIEKVLSMEISEENGGLYALISDLYAMGGQWEDVLRVRSLMEERNVWKIRGSSSIKGRPKGITPKFSLAPLVPRLSELLGIQVQKADDVIGPEVEKSVSVLPNGSVLLLENVRFYKEEEKKNDPEFAKKLASLADLYELDYLVGAVSNPKRPFAAIVGGSKVSSKIGVIESLLEKCDILLLGGGMIFTFYKAQGFPVGASLVEDDKLELATSLLAKAKEKGVSLMLPTDVIVADKFAPEANCQIMWMLVTVLTGCASAGLLPVSCRAIHGYIVRRGITFTMHLGTALIDCYAKAGRLDYASRVFCRVPLRNVMHWTAMICGSAAHLGSEKAIQLFEEMCRSGVQPNEMTFTAVLSACGQAGLVDQGRRFFKLMVDTYGFEPTIHHYGCIVDLYAKAGKLEDAYEVIKTMRMEPNIIIWTSLLAACKKFKNFYIAVEGIEKAGKLEDAYEVIKTMRMEPNIIIWTSLLAACKKFKNFYIAVEGIEKVLSMEISEENGGLYALISDLYAMGGQWEDVLRVRSLMEERNVWKIRGSSSIKVGEPQDFTFPAVS

SEQ ID NO: 65267 - protein, 400 aa, Azoarcus sp. BH72
MLIEVKVPQLSESVSEATLVTWHKKEGDAVTRDENLIDIETDKVVLETPAPADGVLVKIIKGDGGTVTSGELIAQIDTEAKAAAGGAKAAEPVQAVTPPPAAPAAAPSAAAGAASPAARKILEEKGIAAGDVAGSGRGGRVTKEDAVGASAKPAAAAAAAPAVVIAGERPEERVPMTRLRARIAERLLQSKNENAILTTFNEVNMAPVMALRKQYGDKFEKAHGVRLGFMGFFVKAAVAALKKFPILNASVDGNDIVYHGYIDIGIAVGSPRGLVVPILRDAESMSIADIEKKIAEFGQKAKDGKLSLEELSGGTFSISNGGVFGSMLSTPIINPPQSAILGIHATKDRPVVENGQIVIRPINYLAMSYDHRIIDGREAVLGLVTMKEALEDPARLILDV

SEQ ID NO: 65268 - protein, 330 aa, Bacillus pumilus SAFR-032
MTILVCGGAGYIGSHAVAALLAKGERVVVVDNLQTGHKEAVLEGAVLEKGDLRDHAFLRQVFKTHQIEAVMHFAADSLVGESVTDPLKYYDNNVGGATALLQVMNEFDVKHIVFSSTAAAYGEPKRVPIVETDETNPTNPYGETKLAIEKMLKWSEEAYGIEYVVLRYFNVAGAHTEGLVGEDHQPETHLIPIILQVALGKRDQIMIYGDDYETEDGTCIRDYIHVMDLVEAHILAVDRLRAGKGSATYNLGNGTGFSVKQVVEAVRKVTGHAIPAQVAKRRAGDPAKLIASSEKALQELGWTPQYADLHTIIQSAWDWFQKHPDGYQSE

SEQ ID NO: 65269 - protein, 465 aa, Lactobacillus plantarum WCFS1
MGIFQRIFQKEDLERYLQKDSHFERTLSAVDLIALGIGAVIGTGIFILPGTVAATKAGPGIILSFVLAAIVCAVAAMCYAEFASVLPIAGSAYSYGNIVYGEMIGWIIGWALVLEYVLAVATVAVGWAAYFNSFIAGFGLKLPKAITGSFDPAHGTYINVIAILIVCLIAWIIDTGLKTSIRLNNIIVVVKLAIIVLFLLVGSFYVKPSNWTPFAPFGGTEILKGAAVVFFAYLGFDAVSSSAAEVKNAKRNMPIGIIGTLVICTIFYILVSGVLTGMVSYKQLNVDDAVAFALQLVHQNFVAGIISIGALAGMFTMMVTMIYSSSRLLYSIGRDGLLPRFLGKIDKHHAPKNAMLTVTIVNSILAGLIPLDQLANLVNIGTLIAFAFVSFGILLLRRNPKLNAIKGFRVPLYPVLPIISGLLCLFMMTQLSMETWLASLVWFLLGLIIYFGYGIRHSRMNKADE

SEQ ID NO: 65270 - protein, 474 aa, Azoarcus sp. BH72
MSKEFDVLVIGGGPGGYVAAIRAAQLGFKTACCESNPYADPKGEPRLGGTCLNVGCIPSKALLHTSHLFEEAGHGFEAQGITVGTPKIDVAKMIARKSGIVDQLTGGIKGLFKKNKVTLLNGHGSFVAQAGEGWQVKVGDEVVTAKQVIVATGSKARHLPGIPVDNKIVCDNVGALDIDAVPKKLAIIGAGVIGLEMGSVWRRLGADVTILEAMPDFLAAADLDVAKEALKVFTKQGLKLQLGVKIGEVKAAKKGVSIAYTDKDGAEQKLDADRLIVSVGRVPNTDGLNAEAVGLKLNDRGMIEVDGHCRTNLPGVWAVGDVVRGPMLAHKAMEEAVMVAELMAGQAGHCNFDTVPWVIYTSPEIAWVGKTEQQLKGEGVAYKVGKIPFLANGRALGMGETTGFVKMIADAATDRILGVHIIGAGASELISEAVVAMEFAGCSEDLARICHAHPTLSEVVHEAALACDKRPLHF

SEQ ID NO: 65271 - protein, 418 aa, Pseudomonas aeruginosa PAO1
MAVPADASPLRKLALFVGPGLLVSVGYMDPGNWATAIEAGSRFGYALLFVVVLASFSGMLLQSLCSRLGIATGRDLAQLSRERYRPGVARGQWLLAELSIVATDLAEVLGAALAFHLLLGVSITTGVVLTAFDTLIVLALQGANFRRLEAIVLGLIATIGACFFVELVLIGPYWPDVAAGLRPSWDTLSSQEPLYLAIGILGATVMPHNLYLHSSVVQTRVSGDDAASKRSAIRFSRLDTIGSLSLALLVNAAILILAAAAFHGSGHTEVVEIQDAYHLLDPLVGGALASFLFGFALLAAGQSSTFTGTIAGQVVMEGFLRAKIPCWQRRLITRGLALVPALIGVLWLGEAAVGKLLVLSQVVLSLQLPFALWPLIRFSSDRGLMGEFVNPRWVSALAWSLFGLISAANLTLLYFWFG

SEQ ID NO: 65272 - protein, 108 aa, Triticum aestivum
  misc_feature (28)..(28): Xaa can be any naturally occurring amino acid
  misc_feature (38)..(38): Xaa can be any naturally occurring amino acid
  misc_feature (84)..(84): Xaa can be any naturally occurring amino acid
MTFFGFGVGYLQESSTPRGVGTERGLSXMEVLETENFXRMQCFSTLTGTKFLLFTEPQQPNVDLILSNIYELYVDYVMKNPFYXLEMPVRCEGWERRLVGCLRVMNSK

SEQ ID NO: 65273 - protein, 369 aa, Iris x hollandica
MPAPPARVESLASTGMASIPTEYVRPEWERDGSLGDALEEAKKSDQLEGPQIPTVDLKGFDSEDEKERSRCVEGVKEAAVEWGVMHVVNHGIPPELIERVRAAGKGFFDLPVEAKERYANDQSEGKIQGYGSKLANNASGKLEWEDYYFHLIFPPDKVDLSIWPKEPADYTEVMMEFAKQLRVVVTKMLSILSLGLGFEEEKLEKKLGGMEELLMQMKINYYPRCPQPELALGVEAHTDVSSLSFILHNDVPGLQVFYGGRWVNARLVPDSLIVHVGDTLEILSNGRYKSILHRGLVNKEKVRISWAVFCEPPKEKIVLEPLAELVGEGSPAKYPPRTFAQHVQHKLFKKAQAQVQDQAGVHIPEAIQT

SEQ ID NO: 65274 - protein, 135 aa, Pisum sativum
MATSVINRLRSSSTTKSLSSVLHGIRSYAKVATGTDILSAASNVSLQKARTWDEGVESKFSTTPVNDIFKDKKVVIFGLPGAYTGVCSSKHVPPYKHNIDKFKAKGVDSVICVAINDPYTVNAWAEKIQAKDAVS

SEQ ID NO: 65275 - protein, 276 aa, Oryza sativa Indica Group
MSQEQPRRPSEKAAGGGGGEQGIRYGDVFPVTGSLAAKPIAPRDAATMQSAENLVLGKTVKGGPAAAMESAASRNEEMGVVGHDQATDAAAEQGVNVSDTLVPGGGRIVTEFVAGQAVGHYVEQDDGAAVVAGVVGAAPGAVRVEEPAKITIGEALEAAALAAGGTPVERSDAAAIQAAEAKATGTDTYMPGGLAAQAQSAAVANLWTARDADKTKLGDVLSNATAKLAADKEVESGDAARVAGAETRNKPGAAARPGGVAASMAAAARLNRGPTT

SEQ ID NO: 65276 - protein, 203 aa, Chlamydophila pneumoniae CWL029
MTLVPYVVEDTGRGERAMDIYSRLLKDRIVMIGQEITEPLANTVIAQLLFLMSEDPKKDIQIFINSPGGYITAGLAIYDTIRFLGCDVNTYCIGQAASMGALLLSAGTKGKRHALPHSRMMIHQPSGGIIGTSADIQLQAAEILTLKKHLANILSECTGQPVEKIIEDSERDFFMGAEEAISYGLIDKVVTSAKETNKDTSST

SEQ ID NO: 65277 - protein, 156 aa, Bacillus anthracis str. A2012
MKTITNRGAKMKTRVNPELLQGLEMFPDLDLRPGNLQSIREGIAQMRPPTVVDDSLSLIDKVIVGPDDNPLPLRIYRPKSNHESLPVLLWIHGGGYILGSIDDNDDTCMRFAKEASCVVVSVDYRLAPEHPYPAPIEDCYSALKWIADNACKVIKH

SEQ ID NO: 65278 - protein, 340 aa, Synechococcus sp. RS9917
MTLRVAINGFGRIGRNFMRCWISRGANTDIEVVGLNDTSDPKTNSHLLTYDTMLGRIQGAEIGYTDDTLIVNGKTIKCYSDRNPLNLPWKEWDIDLVIESTGVFNTDEKASMHLQAGAKKVILTAPGKGDGVGTFVVGVNADQYRHEDFNILSNASCTTNCMAPIVKVIDQEFGIVKGSMTTVHSYTGDQRILDASHRDLRRARAAAMNIVPTTTGAAKAVALVYPAVKGKLDGLALRVPTPNVSLVDMVFNVSKTTTSEEVNAVLKAASEGSAKGIIKYCELPLVSTDHAGTDESTIVDAELTKVMGGDQVKILSWYDNEWGYSQRVVDLAEIVAKNWK

SEQ ID NO: 65279 - protein, 515 aa, Alkaliphilus metalliredigens QYMF
MTMSKLEGLRQQKSKIQEGGGEKRIAAQHEKGKLTARERVNLLFDEGSFVEIDGFVKHRCVNFGMETVDAPGEGVITGYGTVEGKLVYTYAQDFTVVGGSLGEMHAKKICKVQDMAVKMGAPIVGMNDSGGARIQEGVDALSGYAHIFYRNTIASGVIPQITAIMGPCAGGAVYSPALTDFIFMVDQSSQMFITGPQVIKTVTGEEVTSEELGGGMTHNRISGVAHGVANNDEECILEIRRLLSFLPSNNMEGAPVFETEDDINRIIPELDDMIPDSPNKPYDMKTIIEMLADDGDFFEVQPYFAMNIVTGFIRINGQSVGVIANQPKVLAGCLDINASDKAARFVRTCDCFNIPVLNIVDVPGFLPGKGQEHGGIIRHGAKMLYAYSEATVPKITLIVRKAYGGAYIAMCCKELGADLVLAWPTAEIAVMGAEGAANIIFRNEIKDAEDPQALRAEKIANYKQEFATPYKAAERGYVDDVIEPSSTRPRLVSALNMLASKRDSRPSKKHGNLPV

SEQ ID NO: 65280 - protein, 113 aa, Zea mays
QAAVVSALSNVAEGNMDCRLKLPSEGGAVDRFLKIGKTPPPVPGVCRKTSMILESLVFEPQNRMHFFVHENTFVEILPSEGKYLDPFARIVYELPPRPSNKVPSGPPFWGNIN

SEQ ID NO: 65281 - protein, 244 aa, Azospirillum lipoferum
MEHATMRLDRFERYPLTFGPTPIEHLPRLTAALGGKVEIYAKRDDCNSGLAMGGNKLRKLEYIVPDAIASGTDTLVSIGGVQSNHTRMVAATAAKIGMKCVVVQESWVPHEDAVYDRVGNILLTRLMGADSRIVPDGFDIGIRKSWEEAIQSVKDAGGKPYGIPAGASVHKYGGLGYVGFAEEVRKQEADLGFKFDYIVVCVVTGSTQAGMIVGFAADGRGDRVIGIDASGTPEQTRTQVRQIV

SEQ ID NO: 65282 - protein, 569 aa, Xanthomonas axonopodis pv. citri str. 306
MRRVPVLLVSALALLAPPLGAADRVTGQPFATRSEVIAPHAMAATSQPLATQIALDVMKDGGSAVDAAIAANAALGLMEPTGNGVGGDLFAIVWDPKTHKLYGYNGSGRSPKSLTLAEFQRRGLKDIPPTGPLPVSVPGAVDGWFALHARFGRKPMAQNLAPAIRYAREGHPVAETIAYYWDRSVPRLSQYPGFKEQFTIDGHAPRKGELWKNPNLANTLQQIADGGRDAFYKGDIARTIGAYFKANGGYLSYEDLASHTGEWVEPVSTNYRGVDVWELPPNSQGIAALQMLNILEGYDFSKIPFGSAEHVHLFTEAKKLAFADRARFYADPAFQPAPLAKLISKDYANRRRALISMDKALKEVQPGTPKQLEEGDTIYMTVADADGMMVSLIQSNYRGMGSGMAPPGLGFILQDRGEMFVLKKDHLNGYAPGKRPFQTIIPAFVTKDGKPWLSFGVMGGAMQPQGHVQIVMNLVDFHMNLQEAGDAPRIQHEGSTEPTGQATAMSDGGEVNLETGFSYDTIRALMRKGHRVIFADGPYGGYQAIARDPVSGVYYGASESRKDGQAAGY

SEQ ID NO: 65283 - protein, 160 aa, Nostoc punctiforme PCC 73102
  misc_feature (118)..(118): Xaa can be any naturally occurring amino acid
MYKRYIGRDVFVDISVFTSERSTGHRNRAMAHLMLNFGMIDRNIEESLDLYFQQCAVIVNCEDLAVMAATLANKGMNPITKEQAVDKRYIKDILSVMYTCGMYNFAGEWAYKIGIPAXAEFVVGYRRCTHRWFWGFFALLMSVYTVRAEGLKTFHGWFLF

SEQ ID NO: 65284 - protein, 264 aa, Burkholderia cepacia
EDCNTGLAFGGNKTRKLEYLVPDALAQGADTLVSIGGVQSNQTRQVAAVAAHLGMKCVLVQEHWVNYEDPVYDRVGNIQLSRMMGADVRLVADGFDIGIRRSWEEAMESVRQAGGKPYPIPAGCSEHPLGGLGFVGFAEEVRAQEAELGFRFDYVVVCSVTGSTQAGMVVGFAADGRADRVIGIDASAKPEQTREQITRIARHTAELVGLGRDIVERDVALDTRYGGPEYGLPSDGTLEAIRLCARLEGMLTDPVYEGKSMHGR

SEQ ID NO: 65285 - protein, 369 aa, Cryptococcus neoformans var. neoformans B-3501A
MSDDAADVDPCAMDNSESHFGLRIGSIFIILVTSVIGTVLPIILRQSSFVPRPVFDFAKYFGSGVIIATAFIHLLAPAWEELTSECLKGAWEDYDWAPAIVMAAVYFIFFAEVAAYRAGTRRLERLGINYSSHAHDETDAHAHSHSHEPPLGVDVTAPAPDHHIHPDHSNIASHPHGHHRTPSGEKDKDVESASDVSTVNQLPSQAEAAAQLIAVAVLEFGVVLHSVIIGLTLAVDESFVTLFIVIIFHQMFEGLGLGSRLSILTLPENLWWTRYAAAIFYSLCTPVGVAIGLGVRSTYNGNGAKANIISGVLDATSAGILLYTGLVELLAHEVLLNPRMMKSSNSKLAYVFCCMLLGSALMALLGRWA

SEQ ID NO: 65286 - protein, 372 aa, Xanthomonas axonopodis pv. citri str. 306
MPDSGRPSAQEPEVGDVAVSVADVLAAQARLRKYLSPTPLHYAERFGVWLKLENLQRTGSYKVRGALNALLAGLERGDERPVICASAGNHAQGVAWSAYRLGVQAITVMPYGAPQTKIAGVAHWGATVRQHGNSYDEAFAFARELADQNGYRFLSAFDDPDVIAGQGTVGIELAAHAPDVVIVPIGGGGLASGVALALKSQGVRVVGAQVEGVDSMARAVRGDLREIAPVPTLADGVKVKIPGLLTRRLCSSLLDDVVIVREAELRETLVRLALDEHVIAEGAGALALAAGRRVSGKRKCAVVSGGNIDATVLATLLSEVRPRPPRKPRRRNTERLRNERSANPPPATHVLSRPSAVASTPVTAIAVEESSW

SEQ ID NO: 65287 - protein, 264 aa, Pseudomonas fluorescens
EDCNSGLAFGGNKTRKLEYLIPEALEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVREQEKELGFKFDYIVVCSVTGSTQAGMVVGFAADGRSKNVIGIDASAKPEQTKAQILRIARHTAELVDLGREITEEDVVLDTRFAYPEYGLPNEGTLEAIRLCGSLEGVLTDPVYEGKSMHGM

SEQ ID NO: 65288 - protein, 480 aa, Populus trichocarpa
MPGPTVEMEPIEPQSVKKLSFKSLKRTSDLFSPTHAQLAPPDPESKKIRMNHKINLEYKGIKSTCEPQQVNSATTEASGPSNVLALPGSGDSSVSQKSGAQNALVVGPSLQSKARSDGGVSGKSTAVITASGSSERNFSTSAIMERIPSKWPRPVWRPPWKNYRVISGHLGWVRSVAFDPSNTWFCTGSADRTIKIWDVGSGRLKLTLTGHIEQVRGLAVSQRHTYMFSAGDDKQVKCWDLEQNKAIRSYHGHLSGVYCLALHPTIDLLLTGGRDSVCRVWDIRTKVQVFALSGHDNTVCSVFTRPTDPQVVTGSHDSTIKFWDLRYGKTMLTLTHHKKSVRAMALHPTEHCFASASADNIKKFNLPKGEFLHNMLSQQKTIINAMAVNEDGVMATGGDNGSLWFWDWKSGHNFQQAQTIVQPGSLDSEAGIYAVCYDVSGSRLVTCEADKTIKMWKEDEDATPETHPLNYKPPKDIRRF

SEQ ID NO: 65289 - protein, 265 aa, Pseudomonas fluorescens
EDCNTGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMI

SEQ ID NO: 65290 - protein, 268 aa, Pseudomonas fluorescens
EDCNSGLAFGGNKTRKLEYLIPEAIEQGCDTLVSIGGIQSNQTRQVAAVAAHLGMKCVLVQENWVNYSDAVYDRVGNIEMSRIMGADVRLDAAGFDIGIRPSWEKAMSDVVEQGGKPFPIPAGCSEHPYGGLGFVGFAEEVRQQEKELGFKFDYIVVCSVTGSTQAGMVVGFAADGRSKNVIGIDASAKPEQTKAQILRIARHTAELVELGREITEEDVVLDTRFAYPEYGLPNEGTLEAIRLCGSLEGVLTDPVYEGKSMHGMIITS

SEQ ID NO: 65291 - protein, 226 aa, Oryza sativa
SIFCSDIARAFLAADDDEFSDEEEQSMGKRLWEDEDAGDDFAAVKDTWDDDDDVKPGKETAATAASTKPPATKGKKSQANAKAKAEAADATPSETSTSNAAAEIAQKRPDDDEPIEKFVPKSEKEFAEYAERIAKDLLRPYEKSYHYIGLMKAMNKLAVASLTSTSVKEIVSSMTTVANEKLKAEKAADAGKKKPGQKKKRLHVNKAEGQKFRDADDDDDDDCLSS

SEQ ID NO: 65292 - protein, 416 aa, Shigella sonnei
MKFDTLNAKIGIIGLGYVGLPLAVEFGKKVTTIGFDINKSRIDELRNGHDSTLECSNLELLEATKLTYACSLDALKECNVFIVTVPAPIDKHKQPDLTPLIKASETLGKIIKKGDVIIYESTVYPGATEEDCIPVVEKVSGLKFNIDFFAGYSPERINPGDKEHRVTNILKVASGSTPDVAEYVDQLYKLIITVGTHKASSIKVERLQSNVNTQRDVNIALINELSIIFNKLGIDTLEVLEAAGTKWNLLPFRPGLVGGHCIGVDPYYLTHKAQSVGYHPEMILAGRRLNDSMGQYVVSQLVKKMLKQRIQVEGANVLVMGLTFKENCPDLRNTKVIDIISELKEYNINIDIIDPWCSTDEAQHEYGLTLCEDPKVNHYDAIIIAVAHNEFREMGESAIRALGKDEARFVRFKICA

SEQ ID NO: 65293 - protein, 341 aa, Shigella sonnei
MSRYEEITQQLIFSPKTWLITGVAGFIGSNLLEKLLKLNQVVIGLDNFSTGHQYNLDEVKTLVSTEQWSRFCFIEGDIRDLTTCEQVMKGVDHVLHQAALGSVPRSIVDPITTNATNITGFLNILHAAKNAQVQSFTYAASSSTYGDHPALPKVEENIGNPLSPYAVTKYVNEIYAQVYARTYGVKTIGLRYFNVFGRRQDPNGAYAAVIPKWTAAMLKGDDVYINGDGETSRDFCYIDNVIQMNILSALAKDSAKDNIYNVAVGDRTTLNELSGYIYDELNLIHHIDKLSIKYREFRSGDVRHSQADVTKAIDLLKYRPNIKIREGLRLSMPWYVRFLKG

SEQ ID NO: 65294 - protein, 578 aa, Rickettsia conorii str. Malish 7
MEKMNDHILINVIILLGTAVFIVAILKRLRLSPVLGYLIAGAAIGDHGLKIVTYDQTKLLGELGVVFLLFAIGLELSFERLKAMRRYVFGLGSLQVLTTAIVIAGAMVLIDGNSSAAIITGGGLALSSTALVMQVIEENRSQSTQIGRVSLAILLLQDLAVVPLLVIVPLLAGNNKASLAAALGIALLKAVTALLTIFIVGRVFLRPVFSFISSESNNASELPISMTLLIVLSAAWATETFGLSLALGAFVAGVLVAETEFRLQAEESIYPFKSLFLGLFFMTVGMNIDALEMYEKISHILTLSIALIGIKTLIITAFCILFGFNKGVAFYSGLLLSQGGEFGFILFSLGKDSGVLEESTADILLLVVTFTMALTPLLAALGQKIAEKVDKGLGKTPTQMIELGARDLTNHIIIAGLGNTGKMVARVLEAEGISYVILDLDDDRVKEELSNGLPVFKGDVSQADTLKALGTERAFAIILTMNNQVTIKKSLKTISGNYQDIPVVVKLKNLKNAREFYDLGATTIIPESYETGLQIGGTVLKNIGISEQEINRIKVQFRLGNYIIAKKEDALSEVEDND

SEQ ID NO: 65295 - protein, 295 aa, Rhizobium leguminosarum bv. viciae 3841
MAQHNKVRKAVFPVAGLGTRFLPATKAVPKEMLTVVDKPIIQYVVDEAIEAGIEHLVFVTGRNKHVIEDYFDIHFELEQTLRERAKKAEITLLAQQLPKAGTVSFTRQQEPLGLGHAVWCAREIVGDEPFALLLPDMIMKGDKGCMKGMIDLYAQSGGNIIAVEECAPDQAHKYGIVGVGEAIGDGFRITGMVEKPAKGTAPSNFFINGRYILQPEIFKILETQERGAGNEIQLTDGMLKLLKEQDFAGYHFRGATYDCGAKDGFILANVAFALERADIRPSVEGGFRELLAGLK

SEQ ID NO: 65296 - protein, 322 aa, Streptococcus agalactiae 2603V/R
MSYSNLKLFALSSNKELAKKVSQTIGIPLGQSTVRQFSDGEIQVNIEESIRGHHVFILQSTSSPVNDNLMEILIMVDALKRASAESVSVVMPYYGYARQDRKARSREPITSKLVANMLEVAGVDRLLTVDLHAAQIQGFFDIPVDHLMGAPLIADYFDRQGLVGDDVVVVSPDHGGVTRARKLAQCLKTPIAIIDKRRSVTKMNTSEVMNIIGNIKGKKCILIDDMIDTAGTICHAADALAEAGATAVYASCTHPVLSGPALDNIQNSAIEKLIVLDTIYLPEERLIDKIEQISIAELIGEAIIRIHEKRPLSPLFEMNKLK

SEQ ID NO: 65297 - protein, 391 aa, Streptococcus agalactiae 2603V/R
MTLEKRFNKYLDRIEVSLIRQFDQSISDIPGMVKLTLGEPDFTTPDHVKEAAKSAIDANQSYYTGMSGLLALRQAAADFAKDKYNLTYNPDCEILVTIGATEALSASLIAILEAGDVVLLPAPAYPGYEPIVNLVGADIVEIDTRENDFRLTPEMLETAIIQQGEKLKAVLLNYPTNPTGITYSRQEIAALAEVLKKYDIFVISDEVYSELTYTGQQHVSIAEYLPNQTILINGLSKSHAMTGWRVGLVYAPEAFIAQIIKSHQYMVTAASTISQFAGVEALSVGKNDTLPMRQGYIKRRDYIIDKMSKLGFKIIKPSGAFYIFAKIPDSYPQDSFKFCQDFAYQQAVAIIPGVAFGKYGEGYIRLSYAASMEVIETAMARLKVFMESYEG

SEQ ID NO: 65298 - protein, 496 aa, Zea mays
  misc_feature (458)..(458): Xaa can be any naturally occurring amino acid
METMAAAPAPQQRTGGIARRLARLLRRKSSPAGAGMAYSVAGDEFDDSLDSSINSLSKLKLSGNLAAAYTLDAIFKNATEKKAAAAAPQTQKQPSPAKDAAKHAFLATLFARASAVKAAYAQLQLSLHPYDAESIQAADAGLVAELTKLTSLKRRYTRDPAAAARGAGALAAHADEQLHLLRTYEITARKLEAELRARDAEAERARAALADELRAVRGLEERDHPGRRTLDGLHLSGLNATHFLTALQHAVKSVRAFARAMVDAMRPAGWDPAAAAAAAVHPGARLWDPAGDARFALESYVALRMFAGFHRKDLGLSSLHGRGSHDRRRFFQEFAEARAAAAADQLQDASDARWDALREFLRDRYVSVVHESMEAAFFGRGGDALPRAAWLREFAEMARRVWLLHCLFWAFDGAASVFQARPGERFSEVFMVSVRDADAGRSGHVSVGFTVVPGFKLXRDGDTMPGIPFTPGAPSLRTVTLGRPCRTPAHEGGGGV

SEQ ID NO: 65299 - protein, 543 aa, Lactobacillus plantarum WCFS1
MSINSETLVNHMNHEIAAIQPSDILAFNAEIANIPGIVRLTLGEPDFNTPEHVKQAAIESIEADESHYAPSNGTLALRTAAAEFLAAKYDVHYDPASEVIITAGATGGIYTALTSILNPGDEVLIPTPIFPLYIAIVKLSGATPVFMDTSDNGFVLSPDQLQTTLAAHPKTKAVVLNFPSNPTGVTYRHDDLKALAAVLADQPIFVLSDEIYSELTYGEPHESIANYLPTQTILLNGVSKSHAMTGWRIGIMCAPKAITAQLGKIHQFTVTSTTTNAQAAAAGLKQLTSRTAGVDTIDIPAAKAAGLVVTNVPAYSPNSVAEMSVAQTMRLIRNLEMFDQRISQQNFQWAGLQAREIRSLTVGIIGAGRIGGTAARLFHGLGAKVIAYDVVRHPELEDVLTYVDTKEDLLRQADVVDLHVDLNETSAGLIDAAALKLMKTDAYLINASRGPVIVTDDLVAALKAGEIAGCALDTVEGENALFNQNHQGEVLQDTNVAQLMQMPNVIITPHVGFYTNLAVKNMVDISLDDVLAILNGETTAHAF

SEQ ID NO: 65300 - protein, 617 aa, Kluyveromyces lactis NRRL Y-1140
MFVGTRKDAYGVRSVVRLVFVLLAVLSAFARAETTHVFNFTTGWVNVNPDGVGEKKMIGFNGHWPIPDIHVNKGDRIEIYLTNGFDDLPTSLHFHGLFMNTELGNSNQMDGPEMVTQCPIQPGDTFLYNFTVPDQVGTYWYHSHSGAQYTDGMRGAFVIHDPDMPFDYDEEMTILVSDLYDKPYYEVADFFLSQYNPTGAEPIPRNILFNHTTNNTIHFDTDKTYLIRLINGGTFVSQYLFIEDHDMTIVEVDGVYVDPTKAKLLYIAAGQRMSILVKSKHTKSKNFAFMQIMDDEMLDVIPADLELNRTNTISYSSKNGEAKQAYIDSFKHFTNDFHLVTRAKTELLDTYDYQIKLNVEMENLGDGVQYAFFNNITYVAPKVPTLLTALSAGKLATNPAIYGDNINAFVLEYGEVVEIVVNNHDAGKHPFHLHGHVFQVVQKSGGREDGEDPIDYDEKNPVSAYPEYPVLRDTVVVESLGHVVLRFQATNPGIWFFHCHVDWHLEQGLAAVFIEAPLLLQERETLTESVLNTCKSGNIPTKGNAVGNEKDWFNLEGLPRQPAPLPAGFTFKGYVAFFFSTAVGLWGIYTIAQYGLGEVVPDDQELAAQLKALLNNK

SEQ ID NO: 65301 - protein, 354 aa, Kluyveromyces lactis NRRL Y-1140
MSGTQKAVVLQKKGEITFEDIPAPEITDSHYVKIHVKKTGICGSDIHYYTHGSIGEFVVKKPMVLGHESSGVVVEVGKDVTLVQVGDRVAIEPGVPSRYSDETKSGHYNLCPHMAFAATPPYDGTLVKYYLAPEDFLVKLPDHVSFEEGACAEPLAVGVHANRLAETSFGKNVVVFGAGPVGLVTGAVAAAFGASAVVYVDVFENKLERSKDFGATNTINSTKYKSEDELTEVIKSELKGEQPEIAIDCSGAEICIRTAIKVLKAGGSYVQVGMGKDNINFPIAMIGAKELRVLGSFRYYFNDYKIAVKLISEGKVNVKKMITHTFKFEEAIDAYNFNLEHGSEVVKTMIDGPE

SEQ ID NO: 65302 - protein, 306 aa, Candida glabrata CBS 138
MSETKKPQSNFAIDFLMGGVSAAVAKTAASPIERVKLLIQNQDEMIKQGSLDHRYKGIVDCFQRTARQEGIISFWRGNTANVIRYFPTQALNFAFKDQIKAMFGFKKEEGYAKWFAGNLASGGIAGGLSLMFVYSLDYARTRLAADAKSSKKGGERQFNGLVDVYKKTIASDGVAGLYRGFLPSVIGIVVYRGLYFGLYDSCKPLLLTGSLEGSFIASFLLGWVVTTGASTASYPLDTVRRRMMMTSGQAVKYKGAMDCLQKIVAAEGVSSLFKGCGANILRGVAGAGVISLYDQLQMILFGKKFK

SEQ ID NO: 65303 - protein, 730 aa, Moorella thermoacetica ATCC 39073
MPGDLGVKLRVCEGMVEDARKGIVRVLTPVMDELGLKPNDVVAITGKRTTVARIMPAFQDGCPPGNIQMDGLQRQNAQVGIGEGVTLSPVEWETARTVVLAPVLPGWTLGGEHEIVHLKKHLIGRAVVPGDQVTIPQFSGGDEAFTVEGAAPRGAVVITRDTAVRFKGGEATEGRGQRVTYEDIGGLAREVQRVREIIELPLKYPQLFQRLGVEAPKGILMHGAPGTGKTLIARAVASETEAHFIHVNGPEIMHKYYGESEARLRQVFDEARRKAPSIIFLDEIDALAPRRADVHGDVEKRVVAQLLALMDGLESRGNVIVIAATNIPDLVDPALRRPGRFDREIAINVPDQRGRREILQIHTRGMSLAEDVSLDRLAAITHGFVGADLAALCREAGMYALRRALKSFQLGNERTEDLQLQVTMRDFLDALTEVEPSATREFAMEIPTATWEDIGGLEKIKERLQAMVEWPLRYPELFQQFGLQTPKGILLSGPPGTGKTLVAKALARESGINFIPVNSSLLFSHWWGEAEKTLHEVFRKARQASPCLLFFDELDALVPARKAGEGSSIGSRLVSQFLMELDGLEELREVIVLGATNRIDMIDPAVLRPGRFDQILEFPYPDQAARKEIFQIYLRNRPVDPGINLDSLAGAAEGLVGSEIEALCKRAALLAVSEVINHKGAGAYIKTCHLEQALAEIQAEKQQARTGAENHTLRPVWNNVVPGAISQVGR

SEQ ID NO: 65304 - protein, 297 aa, Arabidopsis thaliana
MDQYEKVEKIGEGTYGVVYKARDKVTNETIALKKIRLEQEDEGVPSTAIREISLLKEMQHSNIVKLQDVVHSEKRLYLVFEYLDLDLKKHMDSTPDFSKDLHMIKTYLYQILRGIAYCHSHRVLHRDLKPQNLLIDRRTNSLKLADFGLARAFGIPVRTFTHEVVTLWYRAPEILLGSHHYSTPVDIWSVGCIFAEMISQKPLFPGDSEIDQLFKIFRIMGTPYEDTWRGVTSLPDYKSAFPKWKPTDLETFVPNLDPDGVDLLSKMLLMDPTKRINARAALEHDTSRILEACLRKA

SEQ ID NO: 65305 - protein, 232 aa, Zea mays
LQSSGKVAALASEENDLPIWISDGGPYVVVTDPLDGSRNIEVSIPTGTIFGIYNRLVEVDHLPLEERAQLNSLQSGTRLVAAGYVLYSSATILCISFGAGQIYSVNDARYFDWPEGLRKYIDTIRQGKGQHPKKYSARYVCSLVADFHRTLIYGGVAMNPRDHLRLVYEANPLSFLAEQAGGRGSDGKNRILTIQPVKLHQRLPLFLGSMDDMLELESYGDVQQKVNPGYEV

SEQ ID NO: 65306 - protein, 176 aa, Brassica napus
MGSLGTFLRYPDDIYPLLKMKRAIEKAEKQIPPEPHWAFCYSMLHKVSRSFSLVIQQLGTELRNAVCVFYLVLRALDTVEDDTSIPTDEKLPILIAFHRHIYDTDWHYSCGTKEYKVLMDQFHHVSAAFLELEKGYQEAIEEITKRMGAGMAKVICQEVETVDDYDEYCHYVAGLV

SEQ ID NO: 65307 - protein, 334 aa, Chlamydophila pneumoniae CWL029
MKQHIGYLGMGIWGFCLASLLANKGYPVVAWSRNPDLIKQLQEERRHPLAPNVVISPNLSFTTDMKEAIHNAFMIVEGVTSAGIRPVAEQLKQITDLSVPFVITSKGIEQNTGLLLSEIMLEVLGDSVTPYLGYLSGPSIAKEVLNGSPCSVVVSAYDSQTLKQIHEAFSLPTFRVYPNTDIKGAALGGALKNVIAIACGIAEGLSFGNNAKAGLVTRGLHEMRKLAAIMDCKPETLNGLAGLGDLCVTCFSESSRNLRFGHLLAQGLTFEQAKAKIGMVVEGAYTALSAYQVAKHHKIDMPITTGIYRVLYENLDLKEGIALLLQRNTKEEFL

SEQ ID NO: 65308 - protein, 357 aa, Xanthomonas axonopodis pv. citri str. 306
MSKQILILPGDGIGPEIMAEAVKVLKRIDAQHGLGFQLVYDELGGTAYDKYGSPLADETLERARGADAVLLGAVGGPQWDTIDPALRPERGLLKIRSQLGLFANLRPALLYPQLADASTLKPEVVAGLDLLILRELTGGIYFGQPRGNRTLDNGERQAYDTLPYSESEIRRIAKAGFDMARLRGKKLCSVDKANVLASSQLWRAVVEEVAKDYPDIALSHMYVDNAAMQLVRAPKQFDVIVTDNMFGDILSDQASMLTGSIGMLPSASLDANSKGMYEPCHGSAPDIAGKGIANPLATILSVAMMLRYTFARATAADAIEHAVGKVLDQGLRTADIWSEGTTKVGTVAMGDAVVAAL

SEQ ID NO: 65309 - protein, 433 aa, Chlamydophila pneumoniae CWL029
MNHLNKEKLHIHNWQPYRACGLLSKVSGNLIEVDGLSACLGELCKISSTKDPNLLAEVIGFHNHTTLLMSLSPLHSVALGTEVLPLRRPPSLHLSDHLLGRVLDAFGNPIDKKEDLPKTHRKPLLSLPPSPMMRQPIDQIFPTGIKAIDAFLTLGKGQRIGVFSEPGSGKSSLLSAIALGSKSTINVIALIGERGREVREYIEKHSNALKQQRTIIIAAPAHETAPTKVIAGRAAMTIAEYFREQGHEVLFIMDSLSRWIAALQEVALARGETLSAHQYAASVFHHVSEFTERAGNNDKGSITALYAILYYPKHPDIFTDYLKSLLDGHFFLTSQGKALASPPIDILSSLSRSAQALALPHHYAAAERLRSLLKVYNEALDIIHLGAYTPGQDEELDKAVKLLPSIKAFLAQPLSSYCYLDNTLKQLEALADS

SEQ ID NO: 65310 - protein, 395 aa, Alkaliphilus metalliredigens QYMF
MNNMSIDMKEASLNLHRKRKGKVAMRGTTPMKNGTDLAMAYTPGVAEPCLEIFKDKNTVYDYTMKGKTVAILTNGTAVLGLGNIGPEAGLPVIEGKALLLKKFGQVDAMPICLDSTDSDAIIKTIQMIAPGFGGIHLEDIKAPECFYIEEKLRELLDIPVYHDDQHGTAIAVLAGLYNALKVTGKSIEDAKIVINGAGASGIATAKLLISAGVKHIVLCDLEGTLLEGDTGLNEAQQSIAQVTNRQLEKGSLRDIIKNKDVFIGVSAGNVVDEAMVRSMNADSIIFALANPLPEVHPTVAKAGGARIIATGRSDFPNQINNVLVFPGMFKGVLKVRAKDICSEMKIAAAKAIADLVREEELKEDYIVPNVFDKRVSIGVAKAVMKAAREVGIARV

SEQ ID NO: 65311 - protein, 334 aa, Synechococcus sp. RS9917
MEPPIEPKREPPWRFSVAPMLDCTDRHFRMLMRQISRRALLYSEMVVVQALHHSERRERLLDFDPMEHPLALQVGGDDPALLAEATRMAADWGYDEINLNVGCPSPRVQAGNFGACLMAEPDTVARCVEAMVRASPLPVTVKHRVGIDDLDSDALLQAFVDRLADAGASRFAVHARKAWLDGLDPKQNRTIPPLQYDRVIALKRRRPELLIELNGGLDTPDDCLEALQHCDGAMVGRAVYAHPLRWTAIDALIYGDPARSISAAGVVRGLLPHAERHLQRGGRLWDLGRHLVHLVEGVPGARHWRRDLGQNAQRKGADLSVLDDAARQLEAAGL

SEQ ID NO: 65312 - protein, 631 aa, Lotus japonicus
MSGPLDRFARPCFEGFYGSDERKERKSDFENSEDERRTRIGSLKKKALNASSKFKHSLKKKSSRRKSDGRVSSVSIEDVRDVEELQAVDAFRQSLIIDELLPERHDDYHIMLRFLKARKFDVEKAKHMWADMLRWRKEFGADTIMEDFEFKELSEVVKYYPHGHHGVDKEGRPVYIERLGKVDANKLMEATTMDRYVKYHVQEFEKSFAIKFPACTIAAKRHIESSTTILDVQGVGLKNFSKSARELMMRLQKIDGDNYPETLCQMFIINAGHGFRLLWNTVKSFLDPKTTSKIHVLGNKYQSKLLEIIDSSELPEFLGGTCTCADQGGCLRSDKGPWKNPEILKIILSGEARRARQVVKVLNSEGKVIAYAKPRCPMIKGSDTSTAESGSETEDIASPKTMKSYSHLRLTPVREEAKVVGKSNYAGSGNLAGYDEYIPMVDKAVDAGWKKQALLQIQRSHSTKGTPPLPDTPKAPEGIQARIWVAVTFFFLTLWTLFLSVACRVTKKLPTVSSTDYLRTSEPTLDTTNKEDSGSSSLTAAHTEADLLSSMMKRLGELEEKVETLQSKPSEMPNEKEELLNAAVCRVDALEAELIATKKALYGALMRQEELLAYIDRQEEAKLRVSCHMYL

SEQ ID NO: 65313 - protein, 489 aa, Oryza sativa Japonica Group
MGSRPVDEVLDAAAAGVHYSTLRLDELNINGSMTGEEQPTTSGVENGHQEPFVIGVAGGASSGKSTVCKMIIDQLRDQRVVVVTQESFYYGLSDEELVHVHDYNFDHPDAFDTELLLSCMENLKHGKAVDIPNYNFKTYKSVASARKVNPSDVIILEGILVFHDSRVRDLMNMKIFVDTDADVRLTRRIRRDTIEKGRDIKTVLDQYSKFVKPAFEDFILPTKKYADIIIPRGGDNDVAIDLIVQHIRTKLGQHDLCKVHPNLYVIQTTYQIRGMHTIIRDAATTTHDFIFYADRLIRLVVEHGLGHLPFKEKQVITPTGSVYTGVEFSKRLCGISVIRSGESMENALRACCKGIKIGKILIHREGDNGKQLIYHNLPKDIANRHVLLLDPILGTGNSAVQAISLLLKKGVQETNIIFLNLISAPQGVHVVSKRFPRVKIVTSEIEFGLNDDFRVIPGMGEFGDRYFGTDDYQSSTPFFCDEKNRVRLL

SEQ ID NO: 65314 - protein, 558 aa, Vitis vinifera
MGACLSATKVRSSNSNTTANAAATKNTRPRGSSKTSNKNQQKKPQEGDRNRSNQQHRNPQPQKVKDRANGRRGTGIIPCGKRTDFGYAKDFDARYTIGKLLGHGQFGYTYVATDKANGDRVAVKRIEKNKMILPIAVEDVKREVKILEALTGHENVVQFHNAFEDDSYVYIVMELCEGGELLDRILAKKDSRYSEKDAAKVVRQMLKVAAECHLHGLVHRDMKPENFLFKSTKEDSPLKATDFGLSDFIKPGKKFQDIVGSAYYVAPEVLRRKSGPESDVWSIGVITYILLCGKRPFWDKTEDGIFKEVLKNKPDFRRKPWPTISNGAKDFVKKLLVKDPRARLTAAQALSHPWVREGGDASEIPIDISVLSNMREFVKYSHLKQFALRALASTLDDEELADLRDQFDAIDVDKNGSISLEEMRQALAKDLPWKMKESRVLEILQAIDSNTDGLVDFTEFVAATLHVHQLEEHDSDKWRQRSQAAFDKFDVDRDGFITPEELKLHTGLRGSIDPLLEEADIDKDGRISLAEFRRLLRTASISSRQVPSSSGFRNPRKI

SEQ ID NO: 65315 - protein, 484 aa, Rhizobium leguminosarum bv. viciae 3841
MGKVTGFLEIDRQVAKYQPASDRIRHFREFTIPMSDPEVQKQAARCMDCGIPYCHGPTGCPVHNQIPDWNDLVYNNNWEAAIQNLHSTNNFPEFTGRVCPAPCEEACTLNLEDAPVAIKTVEQAIADKAYELGFIRPQPATVHTGKKVAVIGSGPAGMAAAQQLGRAGHEVHLYERETKPGGLLRYGIPDFKMEKNFIDRRVEQMKGEGVTFHCGVNVGVDVKVEQLLIDHDAVLYCGGSETPREAGIPGTDLAGVHDAMPYLVQQNRRVGRENIDSVGWPSDPILAGAKHIVVVGGGDTASDCVGTAFRQGAVKVTQLDIRPQPPEKEDKLAVWPFWATKMRTSSSQAEGAVREFQVATLEFVGEDGVLTGVKCCEVDERRRPVPGTEFVIRADLAFIAIGFRGPFTGSVLKELEGKLTLNTDKRGSTNVVANDRDYKTSVDKFWTAGDVRRGQSLVVWAIREGRQAARAIDEELMGSTVLPN

SEQ ID NO: 65316 - protein, 164 aa, Triticum aestivum
MLRAGGSRLVAPGLRRLLGPGAGERAYHERVVDHYNNPRNVGSFDKDDPNVGTGLVGAPACGDVMKLQIRVDEGTGKIVDACFKTFGCGSAIASSSVATEWVKGKQMEEVVSIKNTEIAKHLSLPPVKLHCSMLAEDAIKAAVKDYESKKAKLGDSPAEKAAEA

SEQ ID NO: 65317 - protein, 253 aa, Fusobacterium nucleatum subsp. vincentii ATCC 49256
MENIKLKKLDNGITLITENLPDISTFSMGFFVKTGAMNETKKESGISHFIEHLMFKGTKNRTAKEISEFVDFEGGILNAFTSREMTCYYIKLLSSKLDIAIDVLTDMLLNSNFDEESIEKERNVIIEEIKMYDDIPEEIVHEKNIEYALRGIHSNSISGTVSSLKKIDRKAILNYLEKHYVAENLVIVVAGNIDEKYLYKELNKRMKDFRKAKKKEVLDLTYEIKKGKKSCKETFKSNTSMLLLQKEFLQNLI

SEQ ID NO: 65318 - protein, 421 aa, Pseudomonas fluorescens
MRAQVQQGLVLGMSTLAFTVCFMVWMMFAVLGVPIKELLALNETQFGLLAATPVLTGSLVRLPLGLLTDRFGGRIVFFLLMLACVLPLYLITLATAYWQFLVLGLFVGLAGGSFSVGIAYVAKWFDKQNQGFAMGVFGAGNAGAAVTKFLAPALIAFGTWHLVPKVFSAILFITALLFWFLTAEKKEHRNAGGATLREQLKSLKDPAVWRYCQYYSIVFGGYVALALWMTKYYVQEYGFSLQSAALLAACFSLPGGVLRAVGGWMSDRWGAQSVTWWVLWVSWICLFLLSYPQTQLQVQTVNGIVDFHIGLNATLFPVILFVMGIAFAFGKASVFKYIANNYPQNMGAVSGIVGLAGGLGGFVLPIMFGALVDLTGVRSSCFMLLYGVVWVSLIWMYLSKVHKRPLLGKQPPASQSPFSSI

SEQ ID NO: 65319 - protein, 519 aa, Azoarcus sp. BH72
MRPLVFDNRFVRELPADPETGPHTRQVAGASYSRVNPTPVAAPHLVAHSAEVAALLGWDESDIASPEFAEVFGGNRLLDGMEPYAACYGGHQFGNWAGQLGDGRAITLGEVLNGQGGRWELQLKGAGPTPYSRRADGRAVLRSSIREFLCSEAMHHLGVPTTRALSLVGTGEKVVRDMFYDGNPQAEPGAIVCRVAPSFIRFGNFELLAARGDLDLLNRLIDFTIARDFPGIEGSARDKRARWFETVCARTATMVAHWMRVGFVHGVMNTDNMSILGLTIDYGPYGWVDNFDPGWTPNTTDAGGRRYRFGHQPRIANWNLLQLANALFPAFGSTEALQAGLNTYAEVYDRESRAMTAAKLGLAALADADLPMVDALHGWMKRAEVDMTLFFRALAEVDLLKPDPALFLDAFYDDAKRLETAEEFSGWLRLYADRCRQEGLDADQRRARMNAANPRYVMRNYLAQQAIDAAEQGDYGPVRSLLDVMRRPYDEQPERAAYAQRRPDWARERAGCSMLSCSS

SEQ ID NO: 65320 - protein, 636 aa, Synechococcus elongatus PCC 6301
MHLSEITHPNQLHGLSVAQLEQIGHQIREKHLQTVAATGGHLGPGLGVVELTLALYQTLDLDRDKVVWDVGHQAYPHKLLTGRYHNFHTLRQKDGIAGYLKRTENRFDHFGAGHASTSISAALGMALARDAQGEDYRCVAVIGDGSLTGGMALEAINHAGHLPKTRLLVVLNDNDMSISPNVGALSRYLNKIRVSEPMQLLTDGLTQGMQQIPFVGGAITQGFEPVKEGMKRLSYSKIGAVFEELGFTYMGPVDGHNLEELIATFREAHKHTGPVLVHVATTKGKGYPYAEEDQVGYHAQNPFDLATGKAKPASKPKPPSHSKVFGQTLTTLAKSDRRIVGITAAMATGTGLDILQKALPKQYIDVGIAEQHAVVLAAGMACDGMRPVVAIYSTFLQRAFDQVIHDVCIQKLPVFFCLDRAGIVGADGPTHQGMYDIAYLRLIPNMVLMAPKDEAELQRMLVTGIEYDGPIAMRFPRGNGIGVPLPEEGWESLPIGKAEQLRQGDDLLMLAYGSMVYPALQTAELLNEHGISATVINARFAKPLDEELIVPLARQIGKVVTFEEGCLPGGFGSAIMESLQAHDLQVPVLPIGVPDLLVEHASPDESKQELGLTPRQMADRILEKFGSRQRIGAASA

SEQ ID NO: 65321 - protein, 495 aa, Taxus canadensis
MDAMDLTVAKFKEFTQLQSSAILLTVVSGIIVIVILLLRSKRRSSLKLPPGKLGLPLIGESLSFLWALRSNTLEQFVDKRVKKYGNVFKTSLLGQPTVVLCGAAGNRLILSNQEKLLSRTVSDRVAKLTGDTSISVIAGDSHRIIRAAVAGFLGPAGLKIHIGEMSAHIRNHINQVWKGKDEVNVLSLARELVFAISASLFLNINDREEQHQLHKTLETILPGYFSVPINFPGFAFRKALEGNSKRRKHFSVLQEKRRRDLSVGLASRTQDLLSVLLAYEDDKGNPLTDEEVLDNISALIDGSYESTSSQMAMLLKLLSDHPECYEKVVQEQLEIASHKKEGEEITWKDVKAMRYTWQVMQETLRMFAPVFGPRGKAITDIHYDGYTIPKGWQLSWATYSTHQNDTYFNEPDKFMPSRFDEEGGRLAPYTFVPFGGGRRKCPGWEFAKTEILLFVHHFVKTFSAYTPIDPHESIWGRPLPPVPANGFPIKLISRS

SEQ ID NO: 65322 - protein, 295 aa, Candida glabrata CBS 138
MSLPVVQCIARARIPTTHGPDIFLHLYTNDRDNKEHLAIVFGEDIRSRTLFRQYPGETQQDRMVRGAYVGKLYPGRTVADVDERLGFRLEFDAEGNLLTNSATTWSEENDTLVRIHSECYTGETAWSARCDCGEQFDRAGKLISLDEEPETHIKGGCGHGVIVYLRQEGRGIGLSEKLKAYNLQDLGADTVQANLMLKHPADARDFGIGRAILIDLGIKNVRLLTNNPDKIQQVSYKDQLRCVERVPMIPIHWTDESKGIDSKEIEGYLRTKIERMGHLLQKPLNLHTPQEQETI

SEQ ID NO: 65323 - protein, 443 aa, Lactobacillus plantarum WCFS1
MQETKQATTLNRSLGFWSALSLVVGTVIGSGIFFKQSSVLDSAGSPSAALLAWLLGGLITLTAGLTIAQVGAQMPHTGGLYVYMEQIYGKLWGFLSGWMQIAVYGPAIIASISAYLGILLVGFFNLQAGWQAPLSIGVIVLIGILNMFENRWGAAFQIATTLGKLLPIAAIIIFGLFYGNQNALGQSLHTITQSTGSFGVAVLATLFAYDGWILVANLGGEIKNPQKLLPQAIILGISMVLIAYTLVSYGILHFVPAATIHKLGQQTTLYFAQAAFGTIGGRLLNIGIIISMVGCLNGKIMTFPRIVYAMAAQNQLPFAKQLSYLHKKSHEPIAATIAILVYASIMILFFNPDRLSDLCIFTVYCFYVATFVGVFILRKRRPASERPFSTPGFPITPLIAILGALFVIISEIGSDLSGVLISLVIVAVGFPIYYWKQQQNQNA

SEQ ID NO: 65324 - protein, 850 aa, Ustilago maydis 521
MGTIGIPVKLIHEAVGHVITVELKGGAAYRGTLYDAEDNFNIAMKDITVTAPDGKQSHLENVYIRGNMLRFIIVPDMLQQAPMFKRIGPNAMKGRGIGSARGRATVLRGEFCVHLGFPCLCKPTDVLTVPAFSFSQLQHKHDADEADHRIQAAVALLALDHPFADKRSLGSSTITDNLASLFRQTHCRIPRYCRFRAGSCAVTADEARTSTELCDSDAIRKALPTPQLSQLLCWIDDIQARLWHPKEMQLFSIHLPSSVEDERRHATFRCLLANKLKLDETSLYWCIAASPLYPSWALVWRACVSTSVSLLWFRHQAAITKARRSRDCRLATRGKEESVNAITMRTIVNVDSHEGISVTESFAENSRSPLFARSRYPFIYIFNQRALVLRQQSHLHQSAASSSPTILRYNGNQSKSPFFGSTAFASLGQTMSEVAKRQRDTSSTPEPEAKRPYVDAEKNADHRTSFSSATTADKSPSTTRTMASDTLPKPVSEEKDAVDLGSVTADATSSNDIKVDNGSVSNGHDGDQVAGSAGSVGDSSETQATQISMRTLIVTSDASIIIGKSGKHINEIRDKSNARLNISEIIPGNPERILTVSGPLDAVSKAFGLIVRRINDEPFDLASVPGSKSVTIRFIVPNSRMGSVIGKQGSKIKEIQEASGARLTAGEAMLPGSTERVLSISGVADAVHIAVYYVGSILLEHPDRNANNLPYRPTAGGPSTRAGAAGANPYAAPQQPFGYGAPAAGFGGAPAGAGGAPQLPPGSQTQQIFIPNDLVGCIIGKGGSKINEIRSMSASHIKIMEPGAGIAAGGSGNERLVTITGPPPNIQMAVSLLYQRLEQEKMRLAQGGAP

SEQ ID NO: 65325 - protein, 335 aa, Physcomitrella patens subsp. patens
MAAPLRSFAQAAQAEVEVQPLRVVQIEGLVALKIIKHCKECMPALVTGQLLGLDIGSILEVTNCFPFPVKDEDELDTDGANYQLEMMRCLREVNVDNNTVGWYQSTYMGSFQTVELIETFLNYQENIKRCVCIIYDPVRSGQGVLALKALKLSEDFMELYRSQSLSGEKLREKNMAWTHIFEEIPVKISNSALVSSLMTELEPEAPATQCDFDRLVLSTNPFMEKNLEFLIECMDDLSMEQQKFQYYYRNLSRQQAQQQAWLQKRRTENAARRASGEEPLPEEEPNNPVFKILPEPSRLDSYLITNQISNYCSQVNGFAGQSLSKLYLMDAFHED

SEQ ID NO: 65326 - protein, 356 aa, Brassica napus
YSNRRVVFISVPLLFSFLGFIVTQEMATVVSLQAIIGSIASPHSTSNSKASLFPKESFNLPIKFRQNRCFKIEATTASQTPVLDTLLSPSKTTTTPHKKKSNEASLILIRHGESLWNEKNLFTGCVDVPLTEKGVAEAIQAGKRISTIPVDLIFTSSLIRAQMTAMLAMTQHRCKKVPIILHDESEKAQTWSHVFSEETRKQSIPVVAAWQLNERMYGELQGLNKEETAERYGTQQVHEWRRSYHIPPPKGESLEMCAERAVAYFEDNIQPELALGNNVLIAAHGNSLRSIIMYLDKLTSQEVTSLELSTGLPLLYIFKDRKFMRRGSPVGPTEAGVYAYTKRLAQYRQKLDESLN

SEQ ID NO: 65327 - protein, 228 aa, Chlamydophila pneumoniae CWL029
MALLILLRHGQSVWNEKNLFSGWVDIPLSQQGIEEAFSAGRAIQNLPIDCIFTSTLVRSLMTALLAMTNHHSKKIPYIVHEDPKAKEMSRIYSAEEENNMIPLYQSSALNERMYGELQGKNKKQTAEQFGEERVKLWRRSYKTAPPQGESLYDTKQRTLPYFEKNILPQLQNGKNVFVSAHGNSLRSLIMDLEKLSEEEVLSLELPTGKPVVYQWKNHKIEKHPEFFG

SEQ ID NO: 65328 - protein, 403 aa, Corynebacterium glutamicum ATCC 13032
MNPLRTNQWGIKYSSCMSNDFVVSRLRPFGETIFATMTQRAVEAGAINLGQGFPDEDGPRRMLEIASEQILGGNNQYSAGRGDASLRAAVARDHLERFDLEYNPDSEVLITVGATEAITATVLGLVEPGDEVIVLEPYYDAYAAAIALAGATRVAVPLQEVENSWDVDVDKLHAAVTKKTRMIIVNSPHNPTGSVFSKKALKQLAGVARAYDLLVLSDEVYEHLVFDDQKHVSVAKLPGMWDRTVTVSSAAKTFNVTGWKTGWALAPEPLLEAVLKAKQFMSYVGATPFQPAVAHAIEHEQKWVSKMSKGLELKRDILRTALDKAGLKTHDSMGTYFIVADIGDRDGAEFCFELIEKVGVAAIPVQAFVDHPKKWSSKVRFAFCKKEETLREAAERLKGIKKL

SEQ ID NO: 65329 - protein, 318 aa, Musa acuminata AAA Group
MDSFPVIDMEKLLGRERGAAMEILRDACEKWGFFEILNHGISHDLMDEVEKVNKEQYNKCREQKFNEFANKALENADSEIDHLDWESTFFLRHLPVSNISEIPDLDDQYRKAMKEFAAAIEKLAERLLDLLGENLELEKGYLKKAFSNGSKGPTFGTKVSSYPPCPRPDLVKGLRAHTDAGGIILLFQDDQVSGLQFLKDGEWLDVPPMRHAIVVNLGDQLEVITNGKYKSVVHRVVAQTDGNRMSIASFYNPGSDAVIFPAPALVEKEAEEKKEVYPRFVFEDYMKLYVGHKFQAKEPRFEAMKAMEAVATHPIATS

SEQ ID NO: 65330 - protein, 393 aa, Fusobacterium nucleatum subsp. vincentii ATCC 49256
MSKIIIKKEKEQKILNFYPNIYKDEIKDIIGNVKTGDIVDVITSDMKFLARGYITEGTSAFVRILTTKDGKIDRKFIFERIKNAYEKRKHLLDETNSVRAFYSEADFIPGLIIDKFDKYVSIQFRNSGVEVFRQDIIEAVKKYLKPKGIYERSDVENRLIEGVETKTGIIFGEIPERTIMVDNGVKYNIDIVDGQKTGFFLDQRDSRKFIAKYINNQTRFLDVFSSSGGFSMAALKNGAKEVVAMDKDSHALELCYENYKLNEFTADFSTIEGDAFLMLNSLAIRNKKFDIITLDPPSLIKKKTEIYKGRDFFLDLCDKSFKLLENGGILGVITCAYHIGLQDLIEVTRMSASKNNKLLSVLGINYQPEDHPWILHIPETLYLKALWVKVEER

SEQ ID NO: 65331 - protein, 354 aa, Photobacterium profundum SS9
MKNNLIRLGMVVAGLCFSTFSFASADLPNIKILATGGTIAGAGQSATESNYTSGKVGIDELIAAVPDMTKIADISGEQVVKIGSQDMSDEVWLTLANRVNALLAQDDVDGVVITHGTDTMGETAYFLDLTVKSDKPVVLVGAMRPSTAMSADGPMNLYNAVVTAADKDSEGRGVLVAMSNNVFDARDVTKTNTTSVDTFQSPNFGTLGYIHNGDVKYQRSPERKHTSDTVFDVSKLKELPKVGIVYNYANASDLPVKALIDAKYDGIVSAGVGNGNMYHTIFDQLVKASKDGTMVVRSSRTPTGSTTLDAEVDDAKFGFVASGTLNPQKARILLMLSLTQTQDYKEVQKMFQFY

SEQ ID NO: 65332 - protein, 1076 aa, Oryza sativa Indica Group
MESPPTVCYSMGTINSLVEKITPLLENHPMMEDLLQDVKSLREDLMNKFAAGGRASGGERVKVWMKQVREMVYDMEDWIDLKLQEEGANLSQSDKPRMDGFRSLIQDARGRCERYELLERAAAATANSDAEAGRPGEVAGGRLLWEEKTVLLGIDAPKSELLNHLSSEQKELKVVSILGAGAHGKTALSREIYRDICTTKQFECQAFVSVGRTTSTRTALIELLRQVKSDTNAPQSRSYNDEKQVSEIITELFRFLKTKRYFICIDDIRSTQDSESITCALPDNNLGSRILTTSRMKDIAKLCSRRPSDVVYEMMSLGEDNTRSLFLNNVYVQEEEWPDHFKESSKKLFKVCGDVPFAIIITAGLLGRTSAELSARSDRLTKTILSELSARSERLTKTILSELDQFDSAPQVMGKILDISYGDLPLPLKSCFLYMAAFIGNHGIIKRGRLIQRWVAEGLIPERHGKSSLETGASYFDELISRRLIQPAFDDNDDQPIGCTVHGVVADFVASLSTEENFITMGAELKSGGLFPCDRVRRVSLDYSGEDEADTSFSTTYCLLEQKSWVCSDEKPSSDIDEAISLHLSRVRSLAFLGDATRIPDVSALKHMRVLDLEDTKGLENKHLGSIGQLSLLRYLGLCGTNVTVLPPEVMALKQLTTLNLRQTRVKRLPKFGDTKLVSLLAHQLTILPRGMGVMAELEELSEVLVGQDGSHAGDVARLIAELGQLRMLGVRFGRLFNNQETDRRGVKHLLEEMAKSNLQSLLLDNYLHHLLDLLIASWAKKRPQYLRKFELRIPGCLPLVPPDIGSLIALTHLHIHVEAVEPQPVHALGCLPNLVVLRLELSTDPTLTVCGTDGFQCLKVFWYGGGGNGIGLRFEVGAMPQLRRLRLDLDAREAMLNYGHLQFGIQHLPCLVHVHAIIQCKDASAGTEVDGMEAFIRDQVSLNPNDPVLEINTRVQRSVAKAAEGAVIAIHNREGWMNQIDPDKLMVVDFSTSWCPASRRMAPVFADLAKMYPNVVFLTVDVDDNDEMSTVAKQFGVNGVPTFLFMKGGYVQDRVVGAEKEELEEKLQEHAALML

SEQ ID NO: 65333 - protein, 726 aa, Oryza sativa Japonica Group
MAGAIRVTMEVGADGVAVVTICNPPVNALHPIIIQGLKEKYAEAMDRDDVKAIVLTGAGGKFCGGFDINVFTEVHKTGNVSLMPDVSVELVSNLMEAGKKPSVAAIQGLALGGGLELTMGCHARISTPEAQLGLPELTLGIIPGFGGTQRLPRLVGLPKAIEMMLQSKFITAKEGKEGGLVDALCSPDELIKMSRLWALEIANYRKPWIRSLARTDRLGSLSEARSVLNSARQQAKKVAANLPQHQACLDVMEEGVLCGGHAGVLKEAKVFKELVLSPTSKALVHAFFAQRLTTKVPGVTDVQLKPRKIRKVAVIGGGLMGSGIATALLVSNTSVVLKEVNPQFLQRGQKMIAANLEGLVKRGSLTKDKMNKAMSLLKGALDYSDFKDVDMVIEAVIEKIPLKQSIFSDLEKVCPPHCILATNTSTIDLNVVGEKTNSQDRIIGAHFFSPAHIMPLLEIVRTEKTSPQAILDLITVGKMIKKVPVVVGNCTGFAVNRTFFPYTQGSHLLVSIGIDVFRIDRVISSFGMPMGPFQLQDLAGYGVALAVKDIYAAAFGTRNLDSNLVDLMVQNGRQGKSNGKGYYLYEKGGKPKPDPSVQVVIDEYRRCAKTMPGGKPVTLSDQDILEMIFFPVVNEACRVMDENVVIRASDLDIASILGMGFPKFRGGLVFWADTIGAPYIHSKLSKWTEIYGDFFKPSSYLEDRAKRSLPLSAPNATQQASSRSRM

SEQ ID NO: 65334 - protein, 209 aa, Bacillus cereus ATCC 10987
MKTSEWIDISQPLNNDIATWPGDTPFSYEVSWPKEESGSVNVGKLTMSIHTGTHIDAPFHFDNEGKKVIDLDIQVYVGPVRIIDVSNLESIGKKELENFNLEGVERLLLRTSSHGKVNEFPDVIPHLHADIAPFLSEKGIRLIGVDVPSVDPLDDKELEAHHQLFKHGIHILENVVLDHVADGDYELIALPLALTDADGSPVRAVIRPI

SEQ ID NO: 65335 - protein, 370 aa, Synechococcus sp. RS9917
MPVSLLQNLRRRLTSTPVMQDWPGLIEAYRSWLPVSDATPVVTLREGATPLIPVPSIAERIGRGVKVFVKYDGLNPTGSFKDRGMTMAISKAKEAGCEAVICASTGNTSAAAAAYARRAGMRAFVLIPDGYVAQGKLAQALVYGAEVLAIRGNFDRALDIVREASDRYPVTLVNSVNPYRLQGQKTAAFEVIEALGDAPDWLCIPMGNAGNITAYWMGFQEYHQAGRSRTLPRMMGFQASGSAPLVSNTTVEDPHTIATAIRIGNPVNREKAIAARTASNGAFLDVTDAEIVAAYKLLGGQEGVFCEPASAASVAGLLKRKEEVPAGATVVCVLTGNGLKDPDCAINNNDAAFHTDLDPDLGTVARVMGF

SEQ ID NO: 65336 - protein, 371 aa, Ehrlichia chaffeensis str. Arkansas
MSQLTSYYNSILVLSDGKHFFGKSIGKKISTVGEVCFTTSMTGYQHTITDPSFAGQIITFTFPHIGNVGINYKDFEDRKILTHGIIVKTISEDSHSSSYSNLELWMIENNLTGISEIDTRALTCHLRQHGSQNGIIYHFDNINSINLAKLQKKASQYNYRDHCSSISFVNNYNSTDDDTLLYNIVVINFGIKLSILDALSKLRCKIHMISGNEDNLSEKVLFIKPQGIVLSNGPGDPSAIPENIIKQIKTIIESKIPILGICLGHQLISLALGAKIIKMLFGHRGSNHPVYNKINNNIEITSQNHGFTVKEDSLPTNVQVTHRSLFDNTIEGIQVNDYPIISVQYHPEGSPGPNDASYIFNHFINLIREND

SEQ ID NO: 65337 - protein, 529 aa, Arabidopsis thaliana
MEAEKWNSDGGEYTSEDEGTEDYRRGGYHAVRIGDSFKTGRYVVQSKLGWGHFSTVWLSWDTQSSRYVALKVQKSAQHYTEAAMDEITILQQIAEGDTDDTKCVVKLLDHFKHSGPNGQHVCMVFEYLGDNLLTLIKYSDYRGLPIPMVKEICYHMLVGLDYLHKQLSIIHTDLKPENVLLPSTIDPSKDPRKSGAPLVLPTDKDNTVVDSNGDFVKNQKTGSHRKAKLSAQGHAENKGNTESDKVRGVGSPVNGKQCAAEKSVEEDCPSTSDAIELDGSEKGKQGGKKGSRSSRRHLVASADLKCKLVDFGNACWTYKQFTSDIQTRQYRCPEVILGSKYSTSADLWSFACICFELVTGDVLFDPHSGDNYDRDEDHLALMMELLGMMPRKIALGGRYSRDFFNRHGDLRHIRRLRFWPMNKVLTEKYEFSEQDANDLSDFLVSILDFVPEKRPTAAQCLLHPWINSGPRSIKPSLKDENSDKLDTEKNKRENEEQEAVEVKMGNVVISSLDSKPGMSQSSSTLKLAI

SEQ ID NO: 65338 - protein, 521 aa, Azoarcus sp. BH72
MSHQKILILDFGSQVSQLIARRVREQHVYCELHPYDVSEAFIRDFKPQGIILSGGPNSVYEAVDWRAPQVVFELGVPVLGICYGMQTMAEQLGGKVESSAKREFGYAELRARGHSKLFQGIEDRTNAEGHGLLDVWMSHGDKVTELPAGFKVIGSNESCPVAAMADEERGFYGVQFHPEVTHTIKGKEMLARFVHEICGCGNDWNMPDYISEAVEKIRAQVGDEEVILGLSGGVDSSVAAALIHRAIGDQLTCVFVDNGLLRLNEGAQVMETFNRSLGVKVIHVDATEQFMGHLKGVSDPEQKRKIIGREFVEVFQAEAAKLPKARWLAQGTIYPDVIESAGAKTGKAHAIKSHHNVGGLPETLNLKLLEPLRDLFKDEVRELGVALGLPHDMVYRHPFPGPGLGVRILGEVKKEFADLLRRADAIFIDELRAADWYDKTSQAFAVFLPVKSVGVMGDGRTYEYVVALRAVQTQDFMTAHWAELPHSLLGKVSNRIINEVRGINRVVYDISGKPPATIEWE

SEQ ID NO: 65339 - protein, 275 aa, Salmonella typhimurium LT2
MANPTIIRLQDGNVMPQLGLGVWKASNEEVIAAIHKALEVGYRSIDTATAYQNEEGVGKALKAASVAREELFITTKLWNDDQKRPREALQESLKKLQLDYLDLYLMHWPVPAIDHYVDAWKGMIALQKEGLVKSIGVCNFQIHHLQRLIDETGVTPVINQIELHPLMQQRQLHAWNATHKIQTESWSPLAQGGEGVFDQKVIRELADKYGKTPAQIVIRWHLDCGLVVIPKSVTPSRIAENFAVWDFRLDKDELGEIAKLDQGKRLGPDPDQFGG

SEQ ID NO: 65340 - protein, 349 aa, Pectobacterium atrosepticum
MKRMFKALFVVVFVCFSSLANAAENLPNIVILATGGTIAGSAAANTQTTGYKAGALGVETLIQAVPELKTLANIKGEQVASIGSENMTSDVLLTLSKRVNELLARSDVDGVVITHGTDTLDESPYFLNLTVKSDKPVVFVAAMRPATAISADGPMNLYGAVKVAADKNSRGRGVLVVLNDRIGSARFISKTNASTLDTFKAPEEGYLGVIIGDKIYYQTRLDKVHTTRSVFDVTNVDKLPAVDIIYGYQDDPEYMYDASIKHGVKGIVYAGMGAGSVSKRGDAGIRKAESKGIVVVRSSRTGSGIVPPDAGQPGLVADSLSPAKSRILLMLALTKTTNPAVIQDYFHAY

SEQ ID NO: 65341 - protein, 476 aa, Oryza sativa Japonica Group
MVSDHDDGKLPAQWKKVCVVGGGMAGLAAARELRREGLDVTVLEQRGGVGGQWLYDAATDAGDPLGMAGVHSSVFASLRLNSPRESIGFSDFPFRPTNDAGGDARRYPVHGELLRYIRDFCDAFGLMDAVRLNTTVTRVAMAPPRRDGSLRWAVRSRRHGEAETEEVFDAVVVAIGHYSQPRLPTVDGMDRWRRKQLHSHSYRVPDSFAGEVVVIVGCSVSGAELALELRRVAKEVHLSTKSTEETITSAMSKSVARYENLHLRPQVEHLREDGTVVFDDGSFVVADAIIYCTGYNYSFPFLDTNGKVTVDDNRVGPLYEHVFPPELAPSLSFVGIPAKVLLPVFIEVQARWVAQVLSGRRTLPSQEEMQRAVEEHSRGMEAAGLPKRWTHDMFLDLERCDDSGERTCGFPRMEQWKKEIFFSSLSDMVDDMESFRDGYHDSDLVRDGLRRHGWTPVAPRPQEEDDDAKAIGVANI

SEQ ID NO: 65342 - protein, 204 aa, Zea mays
MASSMLSSAAVATSPAQATMVAPFTGLKSSAAFPVTRKSNTDITSIANNGGRVSCMKVWPPVGKKKFETLSYLPDLTDVELAKEVDYLLRNKWIPCVEFELEHGFVYREHGSTPGYYDGRYWTMWKLPLFGCTDSAQVLKEVQECKTEYPNAFIRIIGFDNNRQVQWISFIAYKPPSFTGGLISFQKQPKKNPNPFPFPMAGFT

SEQ ID NO: 65343 - protein, 259 aa, Rickettsia conorii str. Malish 7
MTIKIHTGKDFIKMRAAGKLAAETLDFITDHVKPNVTTNSLNGLCHNFITSHNAVPAPLNYKGFPKSICTSINHVVCHGIPNDKPLKNGDIVNIDVTVILDGWYGDTSRMYYVGDVAIKPKRLIQVTYDAMMKGIEVVRPGAKLGDIGHAIQSYAEKHNYSVVRDYTGHGIGRVFHDEPSILNYGRSGTGLTLEEGMFFTVEPMINAGNYDTILSKLDGWTVTTRDKSLSAQFEHTIGVTKDGFEIFTLSPKKLDYPPY

SEQ ID NO: 65344 - protein, 265 aa, Candida glabrata CBS 138
MSLRRALYTVMSGVAKREVAYDSVRQKQLVSQFLEVENRVQSEVNGSKSVLLLAVSKLKPASDVQILYDHGVRDFGENYVQELIEKAELLPTDIRWHFIGGLQTNKCKDLAKVPNLFSVETVDSLKKAKKLNEARGKYQPDANAISCNIQINTSQEDQKSGLVDEDEVYEIVKFFLSEDAKFVKLNGLMTIGSWEVSHEEGEENKDFSKLVEWKSKIDSKFGTDLKLSMGMSADFKQAIRQGTSEVRIGTDIFGTRPPKNEARIL

SEQ ID NO: 65345 - protein, 315 aa, Gluconobacter oxydans
MLACNRAIIARMESPVPLIPQLGAHLVAAGGKRLRPLLTLASARLCGYQPGPDHQRHVGLAACVEFIHTATLLHDDVVDESTLRRGLASANAVFGNKASVLVGDFLFARSFQLMTADGSLKVMAILSDASATIAEGEVLQMVVQNDLTTPVERYLEVIHGKTAALFAAACRVGAVVAERPEAEEEALERFGTNLGMAFQLVDDALDYAADQQVLGKTVGDDMREGKITLPVLAAYEAGSPEDRIFWERVIGEGEQTEDDLPHALNLIAKTGAINTTIARAQVYADAAVEALSIFPDSELRRLLIETVQFTVNRAR

SEQ ID NO: 65346 - protein, 575 aa, Glycine max
  misc_feature (140)..(140): Xaa can be any naturally occurring amino acid
METNNACTMHSHCIEMSMEVHQVVPPPHKSTLQKLKGRLKETFFPDDPLRQFKGQPLKRKLILGAQYVFPILQWGPKYNLKLFKSDLVSGLTIASLAIPQGISYAKLASLPPIVGLYSSFVPPLVYAVLGSSKDLAVGPXSIASLVMGSMLHQEVSPTTDPILFLQLAFTSTLFAGLFQALLGILRLGFIIDFLSKAILIGFMAGAAIIVSLQQLKSLLGITHFTNQMGLIPVMTSVFHNIHEWSWQTILMGICFLVLLLLARHVSIRKPKLFWVSAGAPLMCVIISTLLVFAIKAQNHGISVIGKLQEGINPPSWNMLLFHGSHLDLVMKTGLITGILSLTEGIAVGRTFAALKNYKVDGNKEMMAIGFMNVVGSFTSCYVTTGAFSRSAVNNNAGAKTAVSNVVMSVTVMVTLLFLMPLFQYTPNVVLGAIIVTAVIGLIDLPAACNIWKIDKFDFVVMMTAFLGVLFISVQGGLALAVGLSTLKILLQITRPKTVMLGKIPGTDIYRNLDQYKEAVRIPGFLILSIEAPINFANITYLNERTLRWIEEEEDNIKEQLSLRFLVLEMSGNFIR

SEQ ID NO: 65347 - protein, 218 aa, Lactobacillus plantarum WCFS1
MATFSVYMIRHGQTYFNKYRRMQGWCDSPLTAVGEQDARNAGKMLNGIDFDAVYASDMTRAMRTAELILPASGNTDLTVQPMAAFREAFYGYFEGDDTSQTWFMVGAPHQAPSLSAIIEQYGIEKAKDFCKEADPFHRAENNAEFWQRVTGGLDTLRAHHHDGDKVLVVSHGNTIYSIAARFAALTSPARPQNGSVTKFTISDNDVTLDYFGRKDHLD

SEQ ID NO: 65348 - protein, 982 aa, Oryza sativa Indica Group
MSLVYRLPLIHECGLVMFCRTLKIDVLGQVRIGVLQMTRVIHDSGEGMQKEALAMVSSDVNFPKGHFPDYEIGPNNQIIDPEEIHEAVPLKEIVAKETAQLLEQRRGLSVRDLKEKFEKGLSGASKLSEEAKRREAASLDRQVLLKKLRDVLDTLKGRVAGRNRDDADEAISLVEALAVQLTQREGELIYEKAEVKKLASFLKQATEDARKVAEEERALALAEIEKARTAIAIVEKGLQEHDAASSSREKEEIEGLRKEVREARRIKMLHQPSKVMDMEFELKALRTLIAEKNQLCNQLMKELAMIKRLEEDSSDLYDLEGSDILGSQFCIIPRFDDAPDISSCPTQWYRVISGGNRNLILGATKPTYAPEPFDVGRLLQAEIVLNAEKVTIQTMGPINPAAGLEHYVESLMKRADVEFNVVVTQMNGNDYSSNSVHAFHIGKMRIKLRKGWSTKARESYSTTMKLCGSRGGGNAAATAVFWQARKGLSYTLAFETDRDRNAAIMLARKFASNCNITLTGPGDEVHAELAGAAVAAALDGGEEGSRAARLHSFFASVISGIFGQGEEEEEGEMATRSQNVAAAPQPPQNRGNVAALGKQKAVVAGRPDAKNRRALGEIGNVMNVRLPEGKPLQQAPAGRTANFGAQLLKNAQANAAANKQNAVAPAAVARPAQRQARKAPVKPAPPPPEHVIEISSDSDQSMRQQSEGSASSVRKCSRKKVINTLTSVLTARSKVACGITDKPREVIEDIDKLDGDNELAVVDYIEDIYKFYKVAENECRPCDYIDTQVEINSKMRAILADWIIEVHHKFELMPETLYLSMYVIDRYLSMQQVQRRELQLVNDFILISDSAYTREQILAMEKGILNKLQWNLTVPTAYMEHMAFFFAELALMQYGLVASLPSKVAASAVYAARLTLKKSPLWTDTLKHHTGFTESQLLDSAKLLVTSHSTAPESKLRVVYKKYSSEQLGGVALRSPAVELCK

SEQ ID NO: 65349 - protein, 418 aa, Chlamydophila pneumoniae CWL029
MIETREEVGSANFVSLERAIEDLRAGKFVIVVDEASREDEGDLIIAGEKITVEKMTFLLQHTTGVVCAALSQERLLSLDLPPMVKDNRCRFKTPFTVSVDAAHGVTTGVSAADRTKVVQLLADPKSKPEDFISPGHFFPLASSPGGVLKRAGHTESTVDLMELAGLQPCGVLAELVNEDYSMMRLPQILEFARKHNIAVIPVTSIIAHRMLSDRLVSKISSARLPTIYGDFTIHVYESLLEGMQHLALVKGNVAGKSNVLVRVHSECVTGDILGSKRCDCGEQLSSAMSYIAEKGTGVLVYLRGQEGRGIGLGHKVRAYALQDNGYDTVDANLAMGFPVDSREYGIGAQILVDLKLTTIKLITHNPQKYFGLQGFGLSITERVPLPVRISEDNEQYLRTKQERMGHWLDLPCCNNRVQ

SEQ ID NO: 65350 - protein, 154 aa, Chlamydophila pneumoniae CWL029
MKTLKGHLSAKNLRIAIVGSCFNQAMADALVSGTQETFLKFGGSEDGLMTIRVPGAFEIPCTIKKLLSSERKFDAIVACGVLIQGETDHYNQIVNQVAAGIGALSLEFCLPITLSIVAAPSAEIAWQRSGIKGRHLGVSGMTTAIEMATLFTQI

SEQ ID NO: 65351 - protein, 159 aa, Pyrococcus abyssi
MCENEKERTLVIIKPDAVIRGLIGEIISRFEKRGLKIVGMKMIWISKELAEKHYAEHREKPFFKSLVEYITRTPVVVMVVEGRCAIEVVRKMAGATDPKNAEPGTIRGDFALEVSDAICNVVHASDSKESAEREIKLYFRDDEIFDYPRAEDWFYRKGI

SEQ ID NO: 65352 - protein, 414 aa, Magnetospirillum magnetotacticum MS-1
MLGINQPPVTIKNVEVSIIDEAFERGYVTPQVPQRLTGFTVAVVGSGPAGLAAAQQLTRAGHTVAVYERDDAVGGLLRYGIPDFKLEKHHIDRRVAQMEAEGTRFRPGVEIGVDITWDDLRARYDAVVVATGATVPRDLSVPGRELDGIHFAMDFLHQANAVVAGHEVPDQITATGKHVIVIGGGDTGSDCLGTSLRQGAASVTTLAIGKQPPLERSATQPWPTDPIVFEVSSSHEEGGEREFLASTVAFLGDENGAVRALRVAETEYLPDGRRVPKEGTEREIPADLVLVAMGFTGPETAALTTQTGADLTGRGLVARGDDFASSLPGVFVAGDAGRGQSLIVWAIAEGRAAAASVDAYLQGRDRAARARAREHRVLARLTCTPTSDVRRRDDERGILGRGTPRRPAPGRSED

SEQ ID NO: 65353 - protein, 209 aa, Oryza sativa Indica Group
MATVDGTTAPSSGGKTATVASESGGGRYGGGPPPPARCSGANLALRALLFAVSLSALVVLVTAKQTVMIPFVIRPPQFILAPVPAKYTHSPALIYLLAALCATCFYSLITAISSVRLLSSSACSAKTLFYLILLDVFYAAVMASATGTAGAVAWVGLKGNSHTRWNKICNVYGKFCRHIGSSTFLALIAAIVLVLLAFLNAYSLYRRSR

SEQ ID NO: 65354 - protein, 257 aa, Mycobacterium sp. KMS
MTREHGRLHGKSAVITGAAFGIGRATAVLFAREGARLVVTDIQSEPLLALADELRHAGADVEPVVGDVSVEYDAGRMIGAAVDRFGRLDVLVANAGIIPLGDALEMTAAGWDEVMAIDGRGMFLCCKFAIEAMLPTGGGAIVCLSSISGLAGQKRQAAYGPAKFIATGLTKHLAVEWADRGIRVNAVAPGTIRTERVKRFPEEPGGSEYLAAVERMHPMGRIGEPAEVASAIVFLASDDASFITGAVLPVDGGYLAQ

SEQ ID NO: 65355 - protein, 322 aa, Brassica juncea
MASRIAKDVTELIGNTPLVYLNNVAEGCVGRVAAKLEMMEPCSSVKDRIGFSMISDAEQKGLIKPGESVLIEPTSGNTGVGLAFTAAAKGYKLIITMPASMSVERRIILLAFGVELVLTDPAKGMKGAIAKAEEILAKTPNGYMLQQFENPANPKIHYETTGPEIWKGTDGKIDGFVSGIGTGGTITGAGKYLKEQNPNVKLYGVEPIESAILSGGKPGPHKIQGIGAGFIPSVLEVDLIDEVVQVSSDESIDMARLLALKEGLLVGISSGAAAAAAIKLAKRPENAGKLFVAVFPSFGERYLSTVLFDATRKEAESMTFQA

SEQ ID NO: 65356 - protein, 313 aa, Magnetospirillum magnetotacticum MS-1
MYGREHLGPWWGYVAGWGFVVGKTASCAAMALVLAAYAAPPGWERPVAAAAVVVLTAVGYRGVTRTARLARGIVAVALLAIATAVVASLAGTTPRWSVVLDADGAHGGWYGVLQAAGLLFFAFAGYARVATLGEEVRDPRRTIPRAVLVSLGTVVALYAVVAVTLLAVLGPARLAASAAPLADAVAAGSWSWAGPVVSVAAVAASAGALLALLAGVIRTGLAMARTGDLPGWFAAAHPVHRVPHRAELTVGAAVVLLVLATDLRGAIGFSSFGVLVYYLVANLSALRQTAPHRLYPRVLPVLGALGCVALVVT

SEQ ID NO: 65357 - protein, 416 aa, Magnetospirillum magnetotacticum MS-1
MLRKHPRYVEAAVLERVCEPERQIIFRVPWVDDIGRVQINRGFRVEFNSALGPYKGGLRFHPSVYLGIVKFLGFEQIFKNSLTGMPIGGGKGGSDFDPRGRSDGEVMRFCQSFMTELYRHIGENTDVPAGDIGVGGREIGYLFGQYKRITNRYESGVLTGKGISWGGSLVRTEATGYGTVLFAQNMLETRGQELDGRRVVVSGSGNVAIYATAKAQQLGANVVAFSDSSGYVVDEAGVDLELLRQIKEVERGRVADYAARRPGARVVTDGSIWDVPCDVALPCATQNELDEAAAKQLVANGVVAVAEGANMPTTPSAVALLQEAGVLFAPGKAANAGGVATSALEMQQNASRDAWSFEYTEDRLAQIMAGIHDRCVETADEYGTPGNYVLGANIAGFTKFADAILAGDPLDRLTAC

SEQ ID NO: 65358 - protein, 324 aa, Brassica juncea
MASRIGIANDVTELIGNTPLVYLNSVAEGCVGRVAAKLEMMEPCSSVKDRIGFSMISDAEKKGLIKPGESVLIEPTSGNTGVGLAFTAAAKGYKLIITMPASMSIERRIILLAFGVELVLTDPAKGMKGAIAKAEEILAKTPNGYMLQQFENPANPKIHYETTGPEIWKGTEGKIDGFISGIGTGGTITGAGKYLKEQNPNVKLYGVEPVESAILSGGKPGPHKIQGIGAGFIPNVLETNLIDEVVQVSSDESIDMARLLAREEGLLVGISSGAAAAAAIKLAKRPENAGKLFVAVFPSFGERYLSTVLFDATRKEAESMTFEA

SEQ ID NO: 65359 - protein, 445 aa, Klebsiella pneumoniae subsp. pneumoniae MGH 78578
MKLAIHNEVAVSNDEVRQLDRAYVFHSWSMQGNLNPLVIAGAQGCELWDYEGNTWLDFSSQLVNVNIGYQHPRVLAAMKSQLETLVTIAPATANLARGEAAKRIVDLAPAGFSKVFFTNAGADANENAIRMARLYTGRDKVLSAYRSYHGNTGSAIAATGDWRRVPNEFSRGHVHFFNPYLYRSEFNAATEEEECQRALAHLRRIIECEGPTAIAAILLESIPGTAGILVPPAGYMQGVRALADEFGIVLILDEVMAGFGRTGSWFAFEQDGVVPDLVTFAKGVNAGYVPAGGVLISEPIARYFDDHFFAGGLTYSGHPLAMAAIVATIDAMKEEKVVENAASIGNEVLRPGLEALAEKHAIIGEVRGRGLFQALELVSSREQKTPLTAADMAAIKGALTEAGLLAFVVENRIHVVPPCTITAEQVAQGLAIFDAVFARFASLAK

SEQ ID NO: 65360 - protein, 385 aa, Synechococcus sp. RS9917
MHRTLRDTATLLRHHGLKRWSLLLLPALLLALTAPLQPEGAGMEAVRFLGFGLALVPLARVISILVDALSEHLGDRYSGVVSVGLSNLVELVISITALGSGLYSLVVVSVAGAVITNCLLVLGVSTIWAGRRQKKVKIRPHSTNLQARQLLLSLLFLAVPTVFGIGGGIQPMAGTNALDRFAVYSLIVALLILGYYLLSFLLQLGTHRTFFKAETDDILQADGVEAAEKDRSHLPRLPAILAAMAVVSVLVVLVSEPLVNALETLVQGSHLSELFIGLFLLPLFGCTAEGVIAISAASRGRMDLAVTSTLESSGQLLMFVLPVLVLLGWPMGRFLHLSIPLVALGCTTITVLAVHWITENNELDWYEGVQLVALYGVMGLGSLLL

SEQ ID NO: 65361 - protein, 494 aa, Physcomitrella patens subsp. patens
MRAEWHVVLSACVTIATMVLTIMKLRKKIGKLPPGPRALPLIGNIHQIGDFSRRNLMQMAEKYGPIMYMRIGSKPLLVVSTAEAAHEFLKTQDKEWADRPTTTADKIFTNDHRNIVCAPYAAHWRHLRKICTMDLFTPKRLMSFRTPRTEEINQMMTSIHEDVAAGKEVKLHVKLGHLTTNNITRMLLGKRFFTVDEKGQMEAHRFKELVFELFRASSTPMIGDFIPWLKWVSIASGYVKYLKRVKADLDAFLQEFLEIKKAASDQATAERAKDFVDLLLEQKTVSGDGPLEDATIRSDMLLAGTDTVSNAMEWTIAELMRHPECMRKLQQELDTVVGKSRIVSETDLPNLPYLQAVVKEVMRFYPPAPLSLPHQSIVPTTVCGYDLPAGTQLCINLYAIQRDPKYWPNPVQFNPDRFLNCDVDVGGTHFQLIPFGAGRRQCPGMPLGNLLLQISVARLVQAFEYSLPRGTKRNYFMNYYSGANKLTSGIMYLI

SEQ ID NO: 65362 - protein, 253 aa, Rhizobium leguminosarum bv. viciae 3841
MTGSARSFLEFHDIPEAGLRSIIDRAGELAKAWDERAMPQSLAGKRVALIVDDGGWRNTTAFDLGIQAMGGICVHVPIGFNAREETGDIQGYLGNWFDMLVIRTRELAALKAVAAASPVPVINARTGSNHPCETLGDLAYIKNRRGSIDGLKVVGVAADANILRSWAEASIALPIEVVQVYPERWHISDAALLNGRFRVSTDMSELSDADVVITDSWPGDAASDALAGYRIGTDVCGRMRSFCRARRLRAARR

SEQ ID NO: 65363 - protein, 288 aa, Oryza sativa
  misc_feature (44)..(44): Xaa can be any naturally occurring amino acid
MEGKEEDVRLGANRYTERQPIGTAAQGAEEKDYREPPAAPVFDXEELTSWSFYRAGIAEFVATFLFLYISILTVMGVNKSASKCATVGIQGIAWSFGGMIFALVYCTAGISGGHINPAVTFGLFLARKLSLTRAVFYMAMQCLGAICGAGVVKGFQRGLYMGSGGGANAVNPGYTKGDGLGAEIVGTFVLVYTVFSATDAKRNARDSHVPILAPLPIGFAVFLVHLATIPITGTGINPARSLGAAIVYNRAHAWHDHWIFWVGPFIGAALAAIYHVVVIRAIPFKSRD

SEQ ID NO: 65364 - protein, 296 aa, Zea mays
MAGGTLQDRSEAEDVRVGVDRFPERQPIGTAADDLGRDYSEPPAAPLFEASELSSWSFYRAGIAEFVATFLFLYVTVLTVMGVSKSPSKCGTVGIQGIAWAFGGMIFALVYCTAGVSGGHINPAVTFGLLLARKLSLTRAVYYVVMQCLGAVCGAGVVKAFGSALYESAGGGANAVSPGYTKGDGLGAEVVGTFVLVYTVFSATDAKRTARDSHVPALAPLPIGFAVFLVHLATIPITGTGINPARSLGAAIIYDNPHGWHGHWIFWVGPFAGAALAAVYHQVVLRAIPFKSSAHY

SEQ ID NO: 65365 - protein, 344 aa, Oryza sativa Japonica Group
MESLPVPSVQSMVAADGGAHVPPRYIRPRDEAVATDGETEIPVIDFQRLQLGHDEEMARLDRACQDWGFFQLINHSVPEDVVDGMKANARGFFELPAETKKQFAQERGQLDGYGQLFVVSEDQKLDWADILFLNTLPVQNRNFRFWPNQLAKFRSALDKYSAAVKSIVDFLLVTVANNLGVDPEVIANKCGTDGIQAVRMNYYPPCVQADKVIGFSPHSDSDLLTLVLQVNEVDGLQIKRNETWFPVRPLEGAFIVNVGDILQIFTNGRYKSAEHRAVVDMKKERLSIAAFHSPSVHAVIGPLKEMVAHEHEAVYRSIGHDEFMKLFFSSKLEGKSFLDRMKKL

SEQ ID NO: 65366 - protein, 459 aa, Bacillus cereus ATCC 10987
MSKLVVIGGGPAGYVAAITAAQSGKEVTLIDEADLGGTCLNVGCMPTKSLLESAEVHDIVRKANHYGVMLNEGSISVDWKQMQARKSQVVTQLVQGIQYLMKKNKIKVIQGKAKFETDHRVRVTHGGKEIVVDGEQFIIAAGSEPTELPFATFDGKWILNSSHAMSLENIPKSLLIVGGGVIGCEFASIYSRLGTKVTIVEMAPQLLPGEDEDIAHILRGKLENDGVEIFTGAALKGLNNYKKQASFEYEGSTQVVNPEFVLVSVGRKPRVQQLDLEKAGIQYSNKGISVNEHMQTNASHIYAAGDVIGGIQLAHVAFHEGTTAALHASGEDVKVNYHAVPRCIYTAPEIASVGLSEKLAREQYGDILIGEFPFSANGKALIIGEQTGKVKVIVEPKYQEIVGISIIGPRATELIGQGTVMIHTEVTADIMRDYIAAHPTLSEAIHEALLQAVGHAVHA

SEQ ID NO: 65367 - protein, 114 aa, Triticum aestivum
  misc_feature (26)..(26): Xaa can be any naturally occurring amino acid
  misc_feature (50)..(50): Xaa can be any naturally occurring amino acid
TRKVFAEQTKANNGKIKDWNKRVVGXEPVWAMGTGKGEKPGQGEEVNANXRDWLKTNVSPEVAASTRIIYGGSVTGASCKELAGQPDVDGFLVGGASLKPEFIDIINAATVKSA

SEQ ID NO: 65368 - protein, 527 aa, Hordeum vulgare
MSSMQFSSVLPLEGKACVSPVRREGSACERLKIGDSSSIRHERASRRMCNGGAGAPPPPVRSACSPPTPARPTPLFSGRPSGGITPIRTRSRPSVAAVILGGGTGTQLFPLTSTRATPAVPIGGCYRLIDIPMSNCFNSGINKIFVMTQFNSASLNRHIHRTYLGGGINFTDGSVEVLAATQMPGEAAGWFRGTADAVRKFIWVLEDYYKHKSIEHILILSGDQLYRMDYMELVQKHVDDNADITLSCAPVGESRASEYGLVKFDSSGRVIQFSEKPKGDDLEAMKVDTSFLNFAIDDPAKYPYIASMGVYVFKRDVLLNLLKSRYAELHDFGSEILPRALHDHNVQAYVFTDYWEDIGTIRSFFDANMALCEQPPKFEFYDPKTPFFTSPRYLPPTKSDKCRIKEAIISHGCFLRECKIEHSIIGVRSRLNSGSELKNAMMMGADSYETEDEISRLMSEGKVPIGVGENTKISNCIIDMNARIGRDVVISNKEGVQEADRPEEGYYIRSGIVVIQKNATIKDGTVV

SEQ ID NO: 65369 - protein, 326 aa, Bacillus anthracis str. A2012
  misc_feature (181)..(182): Xaa can be any naturally occurring amino acid
MQKETAIIIGGGPCGLAAAISLQKVGINPLVIEKGNIVNAIYNYPTHQTFFSSSEKLEIGDVAFITENRKPVRNQALAYYREVVKRKSVRVNAFERVEKVQKDGEVFQVETTKRDGSKEIYIAKYIVVATEYYDNPNYMNVPGEELKKVAHYFKEGHPYFDRDVVVIGGKNSSVDAALELXXAGARVTVLYRGSEYSPSIKPWILPEFEALVRNGTIQMHFGAHVKEITEHTLTYTVDGEANTIQNDFVFAMTGYHPDHSFLTKMGVRIDEATGRPIYAEDTMETNAANIFIAGVIAAGNNANEIFIENGRFHGDAIAQTIATREI

SEQ ID NO: 65370 - protein, 399 aa, Bacillus cereus ATCC 10987
MAVEVVMPKLGMAMKEGIITSWNIKAGDHVSKGELIASINSEKIETEIEAPADGTVLDIAVSEDEGVPPGTVICYIGKLNEKVEINESINVVEEKAPNLEPKKVQHPEPYAKEVAKQRIKISPVAKKIAKSENLDIKALVGTGPGGRITKVDVLKAIEERVTIPEVLEQEESKVIPVTGMRKAIANRMHASLQNSAQLTLTMKVDVTDLVALHKEIAAVVQKRYDNKLTITDFVSRAVVLALGEHKEMNSAYMDDTIHQFEHVHLGMAVALEKGLVVPAIRFANNLSLVELSKQIKNVAQKAREGSLSSDDMQGTTFTISNLGSFGIEYFTPVLNTPETGILGVGAIEHVPVYKGKKIKKGSMLPLSLTFDHRVLDGAPAAAFLRTIKRYLEEPVTILL

SEQ ID NO: 65371 - protein, 216 aa, Arabidopsis thaliana
MNGEEVKTSQPQKKLQNPTPRLNERILSSLSKRSVAAHPWHDLEIGPGAPVIFNVVIEISKGSKVKYELDKKTGLIKVDRILYSSVVYPHNYGFVPRTLCEDNDPIDVLVIMQEPVLPGCFLRARAIGLMPMIDQGEKDDKIIAVCVDDPEYKHITNINELPPHRLSEIRRFFEDYKKNENKEVAVNDFLQPGPAIEAIQYSMDLYAEYILHTLRR

SEQ ID NO: 65372 - protein, 242 aa, Candida glabrata CBS 138
MATTVSSEYSTDTSNVPIEHRFNPYSDNGGTILGIAGEDFAVLAGDTRHTTDYSINSRYEPKVFDCGDNIIMSANGFAADGEALVKRFKNSIKWYHFDHNDKKLSISSAARNIQHLLYGKRFFPYYVHTIIAGLDDEGKGAVYSFDPVGSYEREQCRAGGAAASLIMPFLDNQVNFKNQYVPGTDGKVKRELKYLSLEEVIKLVRDAFTSATERHIHVGDGLEILIVTKEGVRTEFFELKRD

SEQ ID NO: 65373 - protein, 255 aa, Oryza sativa Japonica Group
MAAAAKTAVQPAVVVGGGRVGQALLSMGPPGADVLVGRGEKVPEDAPGPILVCTRNDDLDAVLDATPRSRWRVQWKKSPDLFLEWVVLGKLNGMLDPWFESKGLVDANQVLAYFAVSKLGEPPVDGITDTNPEGLTAAFGNWAPAVATRLQNGGLTCKVLEKEAFQKQMLEKLIWISAFMLVGARHPGATVGAVEKEYQSEVASLIAELASAAAEERGLTFDAGIEERLCAYSRAVAHFPTAVKEASPAYHKLSI

SEQ ID NO: 65374 - protein, 456 aa, Bacillus pumilus SAFR-032
MLTLDRAAQTAQSYIDRVLEEVEKRNPGEEEFQQAVREILESLVPVFAKHPEYEKQGILERLIEPERLVVFRVPWIDDEGKVQVNRGFRVQFNSAIGPYKGGIRFHPSVNASIIKFLGFEQIFKNALTGMPIGGGKGGSDFDPKGKSDGEIMRFVQSFMSELSRYIGPDQDVPAGDIGVGAREIGYMFGQYKKMRGAYEAGVLTGKSPGFGGSLARKEATGYGLVYFMEEMLKANGLQFEGRSVVVSGSGNVSIYAMEKVIELGGKVVACSDSSGAIYDPQGISLETVKRLKEVSNQRIGAYIDIHPHAELIEDCEQIWSVPCDIALPCATQNEISEMQAQQLVENGVIAVGEGANMPSTLKAVKVFEQNDILFAPAKAANAGGVGVSALEMAQNSARMSWTFEEVDDQLKQMMQTIYRQCTETADEYGHSGNLIVGANIAGFRKVADAMIAQGVI

SEQ ID NO: 65375 - protein, 338 aa, Streptococcus agalactiae 2603V/R
MKAVVVNQASTGVEVVEHDLPKVGHGEALVKVEYCGVCHTDLHVAHGDFGQVPGRILGHEGIGIVEEIGEGVTSLRVGDRVSIAWFFEGCGHCEYCTTGRETLCRSVKNAGYSVDGGMSEYAIVTADYAVKVPEGLDPAQASSITCAGVTTYKAIKEAGAAPGQWIAVYGAGGLGNLAVQYAKKVFNAHVVAVDINADKLQLAKEVGADLTVNGKEIKDVAAYIQEKTGGCHGVVVTAVSKVAFNQAIDSVRAGGTVVAVGLPSEYMELSIVKTVLDGIRVVGSLVGTRKDLEEAFAFGAEGLVVPVVEKVPVDTAPQVFDEMERGLIQGRKVLDFTK

SEQ ID NO: 65376 - protein, 518 aa, Lactobacillus plantarum WCFS1
MAKTDTASFDSILVLDFGSQYNQLITRRIRDFGVYSELLPNTITAEEIKARHPKGIIFSGGPNSVYDDGAFRVDPEIFKLGLPILGICYGMQLMTYTLAGGKVESADNREYGKANIDVTSDSATLFKDTPAEQSVWMSHGDLVTQAPDGFDVVATSKNCPIAAIQDVDRKLYGIQFHAEVRNTDYGNDILRHFAFDVCQAEANWSMDDFIDMQIEKIRAEVGDKKVLLGLSGGVDSSVVGVLLHKAIGTQLTSIFVDHGLLRKGEADQVMASLEGKFGLNIIKVDAKDRFLSKLAGVSDPERKRKIIGNEFIQVFDEEATKLNGMEFLAQGTLYTDVIESGTSTAQTIKSHHNVGGLPEDMQFKLIEPLRTLFKDEARELGEKLGMPSDLVWRQPFPGPGLGIRVIGEITEDKLEIVRDSDFILRDEIKKAGLDREIWQYFTVLPGIKSVGVMGDGRTYDYTVGIRAVTSIDGMTADFARIPWDVLQKISVRIVNEVDHVNRIVYDVTSKPPSTIEWE

SEQ ID NO: 65377 - protein, 388 aa, Desulfovibrio desulfuricans G20
MTQFTLADRLATLPPYLFAQIDKVKAEVAARGVDIISLGIGDPDMPTPDFVIEALKKAAEKPANHQYPSYTGMLAFRQEVANWYKRRYAVELDPKTEVLTLIGSKEGIAHFPTAFVNPGDLVLVCPPCYPVYAIASRFMGGVVQELPLLEENDFLPDLDAVDEATWEKARCIFVNYPNNPTAAMAPRSFFEKLIGIARKHNVIVVHDAAYTEMYYNENNRPLSIMEIPGAMDVAIEFNSLSKPYNMTGWRIAMAVGNASLVAGLGKVKENMDSGAFQAVQEAAIVALRDGDAFLAEIRDIYRKRRDTVIAALNKIGITCRVPEASLYVWARVPEGYTSSDFVTRVLQETGVVMTPGNGFGAAGEGYFRISLTVNDERLEEAVSRIASL

SEQ ID NO: 65378 - protein, 1028 aa, Ustilago maydis 521
MSSASNRKGLLPTSQDNSSQSNPDALNAPPPVQRRSSQPLPGISATASSLRSRRVGSTSTGSTTSSSKHQQLKGHINDVDDNDFDDETPGDYDPGSQPSITHRSKSPGNLLRSALVPGSSQSAGVKSGSNLSVSASKKASTPVAPLSPPPPPSNRFKGTPARATRYSLPVRAEKPVRTTKTSGKHVVLPSESQLAPLPGEDDEDDDDDDDDDDDELSEEEITDDETEQAAPSTAASAKPALVAPSKPPAKVPVITPRPGPSIPSNRHTAAAPVSGKLVTPVSKSSQRPAASSALARAAVSSVSAAQARHAQHAKPKAATTFRNAASRAPPLRPHKSGPVYHTFERMPPSARLMTPLPRVTAYSISTSIHLGTLLGFLRREHGVKPRLYDECAYAVYTKPLLPGFGRANVRSAPEPRSASPGAESRRERELEQREEFGYLGTYFEHRQEEDEDIDQDGYIKGGEGRGSDSETRRRGDSHRGDGRAEGETSAWESEAERWTSTERRSSRDRQLADHDPEEVEAVANAAHQHARHQSTDSSSHPISSSLDDDEGMLATPLARPVGALPEPSDKDAQSGSAATRAFLLERRRDSQSSVSDVEALPPYRTAGSPVDMVTDKNELAINDLDSAGARDMMLQQRAEERGETEPMAHSYRSNELSIASDLDDVVNTSREQSAPSGVRRTDELDSLQPPSEHVGGDRSGNSNEQKQLARDAENQAETQQKERRTRKVKLRRRKRRYAGPNMASHNHDTSANLNTPRPILEALQSAELVILPYGVLVMYNFSAAEERSIIEDVLSSGCARDPMDEAARETEAFHFCYDPNISAPRIFNDFFTFRAPNHLLKLSLAHAIAQSTKLSVFEERMQATLELTSHIPKEMASSGELKLKRREALRLTGRLFKLRVDVNLTSNVLDTPELFWSEASLKALYDAIRDYLEIDERVENLNERLAVANDLLEIIHEHIANTAMSKITWIVIILIIVACAVAVGEISARFIVGANRTAEEGFRAFAAVSKPLALTPPPTYFALAAESL

SEQ ID NO: 65379 - protein, 797 aa, Coccidioides immitis RS
MASNQALSDQSPDVQHAASTAGFSQPAPEPSRSAYLAGQETHDHDGHDSDTPGLSCSRKTSAQSFTPRSLLVGLGIGTLITFSNTYFGLQTGWISSMAMPSSLIGFAVFKAIAPCLSFPFSPIENVLIQTVAGAVGTMPLGCGFVGVIPALEFLLRDGPDGERGGDDGQGEGGPLRLGFWKLVVWSLGVCLFGVVFAVPLRKEVIVREKLKFPSGTATALMIRVLHGSGQEAEKPKTARGSPNAEYQETERLLASGPNPSEISRPPSSRDRRQDWKGKIRLLILAFGVSAFYTLLSYFVPIFRNLPVFGFTLASKWLWTLNPSPAYVGQGIIMGSATSLHMLVGAIVGWGILSPLAKSRGWAPGPVDNWENGSKGWIVWVSLAIMLADSVMNLGWLILRPVVHYAPDVFRVLRRRTGQRGFWQRLFSKSSNSREGYIPIGHGHDTEEQDPAPDISNKDYDEKDAPPSELVSMRTVAILLPLTLILNVVCMHIAFGSIITPFLSSLATLLALVLSVMGVRALGETDLNPVSGISKVTQLIFALATPSSSHTRRSAIVTNLLAGAVSESGALQAGDMMQDLKTGHILRASPKAQFYGQLIGSLFGAVISVAVYRLYINVYEVPGDMFQIPTAYVWIFTARLVTGQGLPDMAWQVSGIAAVIFTVTTIVRIFGAAGLRKGGSAPSWRAWIPGGIAVAVGMYNVPSFTLARAIGGLIDLWWRWRQKKRQKGQRAVAASALHGEDDGGGDGSLSRLQDEQGDNQGANGTHSTIVILASGLILGEGVVSIVNLALASAGVPHL

SEQ ID NO: 65380 - protein, 423 aa, Medicago sativa
MFGRGPTRKSDNTKYYDILGVSKSASEDEIKKAYRKAAMKNHPDKGGDPEKFKELGQAYEVLSDPEKKELYDQYGEDALKEGMGGGAGSSFHNPFDIFESFFGAGFGGGGPSRARRQKQGEDVVHSIKVSLEDVYNGTTKKLSLSRNALCSKCKGKGSKSGTAGRCFGCQGTGMKITRRQIGLGMIQQMQHVCPDCKGTGEVISERDRCPQCKGNKITQEKKVLEVHVEKGMQQGHKIVFEGQADELPDTITGDIVFVLQVKGHPKFRRERDDLHIEHNLSLTDALCGFQFNVTHLDGRQLLVKSNPGEVIKPGQHKAINDEGMPQHGRPFMKGRLYIKFSVDFPDSGFLSPSQSLELEKILPQKTSKNLSQKEVDDCEETTLHDVNIAEEMSRKKQQYREAYDDDDDEDDEHSQPRVQCAQQ

SEQ ID NO: 65381 - protein, 286 aa, Oryza sativa Indica Group
MGKEVDVSTLEAGGARDYIDPPPAPLVDVDELGKWSLYRALIAEFVATLLFLYVTVATVIGYKHQTDAAVNGADAACGGVGVLGIAWAFGGMIFILVYCTAGVSGGHINPAVTLGLFLARKVSLVRALLYMAAQCLGAICGVALVKGFQSSLYDRYGGGANELAAGYSTGTGLAAEIIGTFVLVYTVFSATDPKRNARDSHVPVLAPLPIGFAVFMVHLATIPITGTGINPARSLGAAVIYNNNKAWSDQWIFWVGPFIGAAIAALYHQIILRASARGYGSFRSNA

SEQ ID NO: 65382 - protein, 327 aa, Oryza sativa Indica Group
MGKEVDVSTLESGGVRDYEDPPPVPLVDADELCRWSLYRAVIAEFVATLLFLYVTVATVIGYKHQTDAAANGADAACGGVGVLGIAWAFGGMIFVLVYCTAGVSGGHINPAVTLGLFLARKVSLVRAVLYMAAQCLGAICGVALVKGFQSGLYARHGGGANELAAGYSTGTGLAAEIIGTFVLVYTVFSATDPKRNARDSHVPVLAPLPIGFAVFMVHLATIPITGTGINPARSLGAAVMYNNSKAWSDQWIFWVGPFIGAAIAALYHQPLSLSPSEFKMKWREQSTGFYPQWRFINIYMYIGNARKSYIVKRREYPDDIGDLEWNT

SEQ ID NO: 65383 - protein, 487 aa, Klebsiella pneumoniae subsp. pneumoniae MGH 78578
MAEQQLYINGGYTSATSGRTFETINPATGEVLATVQAAGREDVDRAVESAQRGQKIWAAMTAMERSRILRRAVDLLRQRNDELARLETLDTGKPLSETAAVDIVTGADVLEYYAGLIPALEGSQIPLRDSSFVYTRREPLGVVAGIGAWNYPIQIALWKSAPALAAGNAMIFKPSEVTPLTALKLAEIYSEAGLPDGVFNVLPGIGAETGQYLTEHPDIAKISFTGGVASGKKVMANSAASSLKEVTMELGGKSPLIIADDADLDLAADIAMMANFYSSGQVCTNGTRVFVPAKQKAEFEHKILERVARIRAGDLFADDTNFGPLVSFPHRDNVLRYIESGKREGARLLCGGEALKGDGFDNGAWVAPTVFTDCSDEMTIVREEIFGPVMSILSYADEAEVIRRANATEYGLAAGVVTPNLNRAHRIIHQLEAGICWINSWGESPAEMPVGGYKHSGIGRENGVMTLQSYTQVKSIQVEMGKFQSIF

SEQ ID NO: 65384 - protein, 343 aa, Anabaena variabilis
MAKLKVGINGFGRIGRLVLRAGINNPNIEFVGINDLVPPDNLAYLLKYDSTHGKLRSQVEAKDDGIVIDGHFIPCVSVRNPAELPWGKLGADYVVESTGLFTDSEGASKHLQAGAKRVIISAPTKDPDRVRTLLVGVNHDLFDPSKDVIVSNASCTTNCLAPIAKVINDNFGLTEGLMTTVHAMTATQPTVDGPSKKDWRGGRGAAQNIIPSSTGAAKAVALVLPELKGKLTGMAFRVPIPDVSVVDLTFKTAKATSYKEICAAMKQASEGSLAGILGYTDEEVVSTDFQGDTHSSIFDAGAGIELNSNFFKVVAWYDNEWGYSNRVVDLMLSMIQKEQLAAV

SEQ ID NO: 65385 - protein, 283 aa, Oryza sativa Indica Group
MGKEADVEAGGVRDYEDPPPAPLVDIDELGRWSLYRAVIAEFVATLLFLYVTVATVIGYKHQTDASASGADAACGGVGVLGIAWAFGGMIFILVYCTAGISGGHINPAVTFGLFLARKVSLVRAILYIVAQCLGAVCGVALVKGFQSSFYDRYGGGANELAAGYSKGTGLAAEIIGTFVLVYTVFSATDPKRNARDSHVPVLAPLPIGFAVFMVHLATIPVTGTGINPARSLGAAVVYNNSKAWSDQWIFWVGPFIGAAIAALYHQIVLRASARGYGSFRSNA

SEQ ID NO: 65386 - protein, 420 aa, Rhizobium leguminosarum bv. viciae 3841
MVEKRVQPLARDAMAYVLAGGRGSRLKELTDRRAKPAVYFGGKARIIDFALSNALNSGIRRIGVATQYKAHSLIRHMQRGWNFFRPERNESFDILPASQRVSETQWYEGTADAVYQNIDIIQDYGVEYMVILAGDHVYKMDYEWMLQQHVDSGADVTIGCLEVPRMEAVGFGVMHVNDKDEIIAFVEKPADPPPIPDKPDFALASMGIYVFHTKFLLDALRRDAADPNSSRDFGKDIIPYIVKNGKAVAHRFAKSCVRSDFEHEPYWRDVGTIDAYWQANIDLTAIVPELDIYDKSWPIWTYAEITPPAKFVHDDEDRRGSATSSVVSGDCIISGAMLNNSLLFTGVRANSFSKMEGAVILPNVKIGRRAQLKNVVIDHGVVIPEGLVVGEDAELDAKRFRRTESGICLITQPMIDKLDI

SEQ ID NO: 65387 - protein, 340 aa, Bacillus anthracis str. A2012
  misc_feature (273)..(273): Xaa can be any naturally occurring amino acid
MTKITVVGAGSWGTALAMVLADNGHDVRIWGNRSELMDEINTKHENSRYLPGITLPSTIVAYSSLEEALVDVNVVLIVVPTKAYREVLQDMKKYVAGPTTWIHASKGIEPGTSKRISEVIEEEIPEDLIKDVVVLSGPSHAEEVGLRQATTVTSAAKRMEAAEEVQDLFMNSYFRVYTNPDIVGVELGGALKNIIALAAGITDGLGLGDNAKAALMTRGLTEIARLGRKMGGNPLTFAGLTGMGDLIVTCTSVHSRNWRAGNMLGKGHSLEEXLESMGMVVEGVRTTKAAHELAEKMEVEMPITAALYDVLFNGNNVKDAVGSLMGRVRKHEVEAIPDLL

SEQ ID NO: 65388 - protein, 487 aa, Vitis vinifera
  misc_feature (221)..(221): Xaa can be any naturally occurring amino acid
MRINPTTSGPGVSTLEKKNLGRIAQIIGPVLDVAFPPGKMPNIYNALVVKGRDTVGQQINVTCEVQQLLGNNRVRAVAMSATDGLMRGMEVIDTGAPLSVPVGGATLGRIFNVLGEPVDNLGPVDTRTTSPIHRSAPAFIQLDTKLSIFETGIKVVDLLAPYRRGGKIGLFGGAGVGKTVLIMELINNIAKAHGGVSVFGGVGERTREGNDLYMEMKESGXALVYGQMNEPPGARMRVGLTALTMAEYFRDVNEQDVLLFIDNIFRFVQAGSEVSALLGRMPSAVGYQPTLSTEMGTLQERITSTKEGSITSIQAVYVPADDLTDPAPATTFAHLDATTVLSRGLAAKGIYPAVDPLDSTSTMLQPRIVGEEHYETAQRVKQTLQRYKELQDIIAILGLDELSEEDRLTVARARKIERFLSQPFFVAEVFTGSPGKYVGLAETIRGFQLILSGELDGLPEQAFYLVGNIDEATAKAMNLEMESKLKK

SEQ ID NO: 65389 - protein, 483 aa, Rickettsia sibirica 246
MAEFTPITIAYGDGIGPEIMEAVLYILRKAEARIRLETIEVGEKLYKKHYTSGISEESWESIQRTGIILKAPITTPQGGGYKSLNVTIRKTLQLFANIRPAVSFHPFTRTLHPNLNLTIIRENEEDLYAGIEYRQTHNMYESMKLISHTGCEKIIRYAFEYAVKNNRKKVMCLSKDNIMKFSDGILHKVFNEIAKEYPQINNAHYIIDIGTARLATKPEIFDVIVTSNLYGDIISDLAAEISGSVGLAGSANIGQHYAMFEAVHGSAPDIAGKDIANPSGLLNAAIMMLVHIGQGDIATLIENAWKKTIEDGVHTADIYNEQSSSKKVGTKEFAAEVTKRLGQLPTKLPKADYPLIAEKQESNIDYKIDTKEVKKLVGTDIFVNMNVSAAHDIADKINKLDLGNFELKTISSKGLKLWPRDTRFETVSDHWCCRFMNKDGTEIKHLDITRLLEALSTANIDFIKVENLFEFDGVAGYSLAQGE

SEQ ID NO: 65390 - protein, 243 aa, Bacillus anthracis str. A2012
MEEGTSMQQSKEERVHDVFEKISDKYDVMNSVISFQRHKAWRKETMRIMDVKPGSKALDVCCGTADWTIALAGAVGEQGKVVGLDFSENMLSVGKQKVEALQLKQVELLHGNAMELPFEDNTFDYVTIGFGLRNVPDYMHVLKEMTRVVKPGGKVICLETSQPTMIGFRQGYILYFKYIMPLFGKLFAKSYKEYSWLQESASTFPGMKELANMFEKAGLERVQVKPFTFGVAAMHLGMKPESK

SEQ ID NO: 65391 - protein, 160 aa, Zea mays
MEAAVPSRVALSAASRLPNPHAVTGDRSFIYKGRCQSLAIPMALSAAAPGKGGGVLDWPVEKTTPGRQSEFDVKKSRKMSPPYRVILHNDNYNRREYVVKVLMKVIPGMTVDNAVNIMQEAHVNGLSVVIVCSQSEAEEHCTSLRGNGLRSSIEPASGGC

SEQ ID NO: 65392 - protein, 388 aa, Staphylococcus aureus subsp. aureus MRSA252
MNIHEYQGKEIFRSMGVAVPEGRVAFTAEEAVEKAKELNSDVYVVKAQIHAGGRGKAGGVKITKSLSEVETYAKELLGKTLVTHQTGPEGKEIKRLYIEEGCAIQKEYYVGFVIDRATDQVTLMASEEGGTEIEEVAAKTPEKIFKETIDPVIGLSPFQARRIAFNINIPKESVNKAAKFLLALYNVFIEKDCSIVEINPLVTTADGDVLALDAKINFDDNALFRHKDVVELRDLEEEDPKEIEASKHDLSYIALDGDIGCMVNGAGLAMATMDTINHFGGNPANFLDAGGSATREKVTEAFKIILGDENVKGIFVNIFGGIMKCDVIAEGIVEAVKEVDLTLPLVVRLEGTNVELGKKILKDSGLAIEPAATMAEGAQKIVKLVKEA

SEQ ID NO: 65393 - protein, 484 aa, Zea mays
  misc_feature (161)..(161): Xaa can be any naturally occurring amino acid
QAERSRAPNRVSRKRGKGGRGTMVRSRGHLALSTRLMNVGLASLCRGGWLDRAESVLVDAIRLGLPPDVVTYNTLLAAYCRVDGLDAGLAVVHRMREAGVRPDAVTYNSLITGADRSGLTVRALDLFDEMLRSGVAPDSWSYNALMHCLFRSGHPEHAYRXFADMADRGVAPCATTYNTLLDGLLKAGHVTNAFRMFRYLQRAGLPVGIVTYNTMINGLCKSGKVGYARMVLKELGRTEHAPNAVTYTTVMKCCFRYGRFEQGLETFLSLLEGGYISDAFPYTTVISALVKKGRMQEANTYCELMIQSGSTLDNACYNTLIHLRCQEGKINDAFELLNMMEEGGLESDEYTFSILVNGLCKMGQIEAAEKQIWSMEMMGMQSNVVAYNCLIDALCKCHEVDAAIKILHSMKLKDDFSYTSLVHGLCKVGRYHMASKFLRICLHEGNNVLASAKRAVISGLRSAGFKNDLRKVRSALYMARLLRS

SEQ ID NO: 65394 - protein, 267 aa, Clostridium difficile 630
MKTLGFIGSGNMGSAMIGGIVQSGLVKAEDITVSDLSQVALDKVKEEFGVNTTTDSKVAVTNSDVVIVALKPNICEKALTPLKELIDANKIIVSIAAGKTIESLESFIGSDKKIVRVMPNTPALVGEGMSALCKNSNVTDEELNMIKALFESFGEAEIVSEYLMDTVTGISGSSPAYVFMFIEAMADAAVLAGMPRQQAYKFASQAVMGSAKMVLETGKHPGELKDMVCSPAGTTIEAVKVLEEEGFRAAVIKSIVACIDKSKDMSK

SEQ ID NO: 65395 - protein, 331 aa, Populus trichocarpa
MDAKALFFFALLSFSAVSVRPALAENEEDPGLVMNFYKDTCPQAEDIVKEQVRLLYKRHKNTAFSWLRNIFHDCAVQSCDASLLLDSTRRTLSEKETDRSFGLRNFRYFDDIKEAVERECPGVVSCADILVLSARDGIVSLGGPHIPLKTGRRDGRKSRADVIEDYLPDHNESISVVLDRFASMGIDTPGLVALLGAHSVGRTHCVKLVHRLYPEVDPALNPDHVEHMLYKCPDSIPDPKAVQYVRNDRGTPMVLDNNYYRNILDNKGLLIVDHQLATDKRTKPYVKKMAKSQDYFFKEFSRAITILSENNPLTGTKGEIRKQCTVANKHH

SEQ ID NO: 65396 - protein, 211 aa, Oryza sativa Indica Group
MEMRVPAAVTGGCGCDVDGGGGGFCRGGGKLADWEEGKDEIKSVVVKGWTMAQVVPVHGNVSAEDDDEEDDDEDDDNEDDEEEAEAEAAPPPYVMAVDDSSVDRAVITALLRRSKYRVTAVDSGKRALEILGSEPNVSMIITDYWMPEMTGYDLLKKIKESSELKQIPVVIMSSENVPTRISRCLEEGAEDFLLKPVRPADISRITSRMLQ

SEQ ID NO: 65397 - protein, 316 aa, Klebsiella pneumoniae subsp. pneumoniae MGH 78578
MSNSEHLATVMVNAFIDAVDRGVDLVPVVADSTSTAKIAPFIKRFPGRLVNVGIAEQTLVGAAAGLALGGKVAVTCNAAPFLISRANEQIKVDVCYNNTNVKLFGLNAGASYGPLASTHHSIDDIAILRGFGNIEIYAPSSPGECRQIIDYALAHVGPVYIRLDGKALPELHDERYRFVPGNIDVLRLGRDIALVAMGSTVHEIVEAAAQLAAEGIDATVISVPSIRPCDTQALLAAIQSCPAAITVEEHNVNGGVGSLVAEVLAEAGCAIPLRRLGIPDGQYAIAADRAATRARHEIDAAGVVKHARKLHIKKAS

SEQ ID NO: 65398 - protein, 358 aa, Populus trichocarpa
MSCFKSKYADELIKNAAYIGTPGKGILAADESTGTIGKRLSSINVENVEENRRALRELLFCAPGALQYLSGVILFEETLYQKTASGKPFVDVLKEGGVLPGIKVDKGTVELAGTNGETTTQGLDGLGQRCAKYYEAGARFAKWRAVLNIGANEPSELAIHENAYGLARYAVICQENGLVPIVEPEILVDGSHDIEKCAAVTERVLAACYKALNDHHAILEGTLLKPNMVTPGSEAPKVAHEVIAEYTVRALQRTVPPAVPAIVFLSGGQSEEEATLNLNAMNKLNTKKPWSLSFSFGRALQQSTLKAWAGKPENVGKARAALLARCKANSEATLGTYKGDATLGEGASESLHVKDYKY

SEQ ID NO: 65399 - protein, 485 aa, Neptuniibacter caesariensis
MPIQLKDSGLLKTNAYINGQWVAGEAGETFPVINPATGEELAQVASVTAVQTKEAINAAEKAMKAWRALPAKERSDLLERWYGLILDNQEDLAQLMTAEQGKPLFESRGEVMYGASFLKWFAEEGKRVYGDVLPATQDRRSIVIKQPVGVVAAITPWNFPNAMITRKVAPALAVGCAMVLKPAAETPLSALALAELGERAGLPAGLFSVLTTADAVAVGGEMTSNPVVKKVTFTGSTGVGKLLMKQCADTVKRTSMELGGNAPVIIFDDADLDKAVAGALVSKYRNSGQTCICANRIMVQAGIYDAFVEKFSAAVAEFRIGDGLEEATTHGPVITEKAVGDIHSKVTAAVESGATVVQGGQPSELGSYFYEPTVLTNVTRDMSLFKEEIFGPVAPIFKFETEEEAIDMANDTEFGLASYVYTNDLGRIWRVSEGIEYGMVGVNETMISSEVIPFGGVKESGQGREGSKYGLDDYLETKYICMGGL

SEQ ID NO: 65400 - protein, 239 aa, Zea mays
MKLNISYPNNGTQKLIEIEDERKLRVFVDRRMGQEVPGDSVGDEFKGYIFRITGGNDKQGFPMKQGVMHPTRVRLLLGEGHSCYRPRRDGERKRKSVRGCIVALDLSVLALSIVKKGDAEIPGVTDVVHPKRLGPKRATKLRRFFGLSKEDDVRKFVIRREVQPKKEGAKPYTKAPKIQRLVTPQRLQHKRHRVALKRRRAEASKDAANEYAQILHKRINEAKSAHDEAKKRRASSMKH

SEQ ID NO: 65401 - protein, 450 aa, Neptuniibacter caesariensis
MSTIIYPTTNLKATETLTLERGDGAYVYDNQGKQYFEALAGLWCTSLGYNNRELIDTVNQQMGQLSYSHMFGGKTHQVGMDLSEKLSAMVPVENAKVFFGNSGSDANDTHIKMLRYYFNAIGKPEKYKIIARDRAYHGVTVAAASLTGLVPNHTHFDLPFEALGILRTDAPHYYRGALPGETEEQFVDRITNNLEQMILAEGADTIAAFIAEPITGASGVIVPPKGYYEKVQAILNKYDILFWADEVITGFGRTGNDFGSRTMGIENPAMMTLAKQLSSAYMPISASVIRGDMYEAMIEPSAQVGVFGHGYTYSGHPVACAVALKTLEIYERDNIFGHAAEMGDYMQKRLREFADHPLVGEIRGEGMIAAIEMVANKATGKAFEGGAVGGFAMQACQNHGMITRAVAGSSLAFCPPLIINKDQVDEMIEKLSKGLDDTLDFVTREGLLEA

SEQ ID NO: 65402 - protein, 299 aa, Alteromonadales bacterium TW-7
MSAKNPIIAITGSSGAGTTTTTNAIKHIFRSLNIQAAFIEGDSFHRYTRPEMDKKIREAQQESKHISYFGREANDFSALESLFSNYGETGQGKLRRYLHTFDEAVPYNQLPGTFTPWQELEHNTDILFYEGLHGGVVDQDVDVAKHVDLLIGMVPIINLEWIQKLIRDTSERGHSREAVMGSIVRSMDDYINHITPQFSRTHINFQRVPTVDTSNPFSAKDIPSLDESFVVIRFRGIEDVDFPYYLRMIEGSFMSRINTLVVPGGKMGLAMELVLTPLIKDIIMKKRALENLAPLDLPI

SEQ ID NO: 65403 - protein, 804 aa, Hyaloperonospora parasitica
MSDKKDDFKAGIMDRKRSPNRLVVDEALNDDNSVVALSMAKMEELQLFRGDTVLLKGKKGHETVCVVLQDETVDDHNVRMNKVVRKNLRVRLGDVVGLHTCGDVPYGKRIHVLPIDDTIEGVTGNLFDVYLKPYFVEAYRPVKKGDLFLVRQAMHPVEFKVVETEPGPYCIVAPDTIIHCEGEPVRREDEEKMDEVGYDDIGGCRRQMAQIREMIELPLRHPQLFKTLGVKPPRGVLLYGPPGSGKTLIARAVANETGAFFFLINGPEIMSKMAGESESNLRKAFEEAEKNAPAIIFIDEIDSIAPKREKTNGEVERRIVSQLLTLMDGLKQRASVVVIGATNRPNSMDPALRRFGRFDREIDIGVPDENGRLEIFRIHTRNMKLDDDVDPELIARDTQGFVGADMAALCTEAALQCIREKMDVIDIEDETIDAEILDAMSVTQAHFKYALGVSNPSSLRETTVEVPTVTWRDIGGLEGVKRELLELVQYPVEHPEKFEKYGLSPSKGVLFYGPPGCGKTLLAKAVANECQANFISIKGPELLTMWFGESEANVREVFDKARGAAPCVLFFDELDSIAQQRGSSSGDAGGAGDRVMNQLLTEMDGMGAKKNVFIIGATNRPDIIDPALMRPGRLDQLIFIPMPDFDSRLSILRSVLRKSPVSKDVDLNFLAQQTDKFSGADLTEICQRAAKLAIRESIARDMERDRLRAEAGDEMEDIEDDDPVPEITPRHFEEAVRNARRSVSDRDLAQYSTFAQTLQQARSHVTAGGTSLANFSFPGRNVSANTGGGAAVAADEEDEEDLYS

SEQ ID NO: 65404 - protein, 569 aa, Arabidopsis thaliana
MRFSSIFRNTPIQFSNRRSSVKLLHSLPRLKPTNSKRFSQKPKLVKTQTLPDPSVYTRDIVSNIYNILKYSNWDSAQEQLPHLGVRWDSHIINRVLKAHPPMQKAWLFFNWAAQIKGFKHDHFTYTTMLDIFGEAGRIQSMYSVFHLMKEKGVLIDTVTYTSLIHWVSSSGDVDGAMRLWEEMRDNGCEPTVVSYTAYMKMLFADGRVEEATEVYKEMLRSRVSPNCHTYTVLMEYLVATGKCEEALDIFFKMQEIGVQPDKAACNILIAKALKFGETSFMTRVLVYMKENGVVLRYPIFVEALETLKAAGESDDLLREVNSHISVESLCSSDIDETPTAEVNDTKNSDDSRVISSVLLMKQNLVAVDILLNQMRDRNIKLDSFVVSAIIETNCDRCRTEGASLAFDYSLEMGIHLKKSAYLALIGNFLRSNELPKVIEVVKEMVKAQHSLGCYQGAMLIHRLGFGRRPRLAADVFDLLPDDQKGVAAYTALMDVYISAGSPEKAMKILREMREREIMPSLGTYDVLLSGLEKTSDFQKEVALLRKEKKSLVASARFRENVHVEDKICM

SEQ ID NO: 65405 - protein, 422 aa, Populus trichocarpa
MAFSCLLRSTPAAPLVEASRSDFSPSPSDRFKVSSVSFNSLKSIFGTSIPTGSSSSQTCSGRSIQPIKATATEMPPTVLKSRADGKTKIGINGFGRIGRLVLRVATFRDDIDVVAVNDPFIDANYMAYMFKYDSTHGVFSGTIKVLDDSNLEINGKQIKITSKRDPTEIPWGDFGAEYVVESSGIFTTVEKAAAHMKGGAKKVVISAPSADAPMFVVGVNEKTYKPNMDIVSNASCTTNCLAPLAKVVHEEFGIIEGLMTTVHATTATQKTVDGPSRKDWRGGRGAAQNIIPSSTGAAKAVGKVLPELNGKLTGMAFRVPTPNVSVVDLTCRLEKSASYEDVKAAIKYASEGPLKGILGYTDDDVVSSDFLGDSRSSIFDAKAGIGLSASFMKLVSWYDNEWGYSNRVLDLIEHMALVAAHN

SEQ ID NO: 65406 - protein, 193 aa, Bacillus cereus ATCC 10987
  misc_feature (72)..(72): Xaa can be any naturally occurring amino acid
  misc_feature (80)..(80): Xaa can be any naturally occurring amino acid
  misc_feature (85)..(85): Xaa can be any naturally occurring amino acid
MNAIPYVVEQTKLGERSYDIYSRLLKDRIIIIGSEINDQVASSVVAQLLFLEAEDAEKDIFLYINSPGGSTXAGFAILDXMNLIXPEVQTLCMGLAASFGALLLLAGAKGKRFALPNSEIMIHQPLGGVKGQATEIEITAKRILKLKHDINKIIADRTGQPIEKIAHDTERDYFMTAEEAKEYGIVDGVVEKK

SEQ ID NO: 65407 - protein, 280 aa, Phaseolus vulgaris
GEGTYGVVYKARDRVTNEAIALKKIRLEQEDEGVPSTAIREISLLKEMQHRNIVRLQDVVHSGKRLYLVFEYLDLDLKKHMDSSPEFAKDLRQVKMFLYQILCGIAYCHSHRVLHRDLKPQNLLIDRSTNSLKLADFGLARAFGIPVRTFTHEVVTLWYRAPEILLGSPRYSTPVDIWSVGCIFAEMVNQRPLFPGDSEIDELFKIFRILGTPNEDTWPGVTSLPDFKSAFPKWQPKDLKTVVPNLDPAGLDLLSRMLHLDPSKRITGRSALEHEYSERH

SEQ ID NO: 65408 - protein, 624 aa, Physcomitrella patens subsp. patens
MQLNEEETSLFDVLWLLLASVVFVPLVQKIPGGSPVLGYLAAGVLIGPYALSIIQNVHGTKAIGEFGVVFLLFNIGLELSVERLSSMKKYVFGFGSAQVLATAVAVGYFTFLVSGASGPLAIVIGNGLALSSTAVVLQVLQERGESTSRHGRATFSVLLFQDLAVVVLLILIPLLSPNSSKGGVGFQAIAEALGLAAVKAVVAITAIIAGGRLLLRPIYKRMADNHNAEIFAANTLLVVLGTSFFTARAGLSMALGAFLAGLLLAETEFALQVESDIAPYRGLLLGLFFMTVGMSIDPKLLVAKFPMIMGALTLLIVGKTLIVTGLGRCFGLSTVAAVRAGLFLAPGGEFAFVAFGEAMVFDKMQGIMSLEMSSLLFLVTGLSMAITPWLAAGGQLIASRFDQQDVRSLLPAESETDDLQNHMIICGFGRVGQIISQLLAERLIPFVALDVRSERVSMGRALDLPVFFGDAGSREILHKVGAERASAAVIALDTPGANYRTVWALSKYYPHVKTFVRAHDVDHGMSLEKAGATAVVPETLEPSLQLAAAILAQAKLPPSEIASAIDQFRSNHLSELTELSEASGSSLGYGTTRNKTRSKLVPTELISKEDDGNYSAPPGIVAVP

SEQ ID NO: 65409 - protein, 542 aa, Mycobacterium avium subsp. paratuberculosis K-10
MALGAGPHAGVTLAKVNQPFGWDFPYAWPRKPVLADNVVCTSQPLAAQAGLRMLAEGGSAVDAAIATAITLTIMEPVSNGIGSDAFAIVWDGEKVHGLNASGRSPAAWTPEYFGGNAVPVLGWNSVTVPGAVSAWTELHARFGKLPFERLFAPAIAYGRNGFPVSPVVAEQWAAQVPLFAGQPGFAKAFAREGRAPRPGERFRLPAHADTLEAIAASRGEAFYRGALAARVAEHAAANGGAMTADDLAAHRADWVETITGDYRGYTVHEIPPNGHGIVALIALGILERFDMASLPVDSADSVHLQIEAVKLAFADAQAYLADIEHMPLRPERLLDTEYLEQRAALIDPARAKPVSAGAPAGGTVYLTAADAAGMMVSMIQSNYMGFGSGVVVPGTGISLQNRGANFTAGLGHPNSVGPNKRPYHTIIPGFVTKDGAPVMSFGVMGGMMQPQGHVQVMVRIADHGQNPQAACDGPRFRWVQGTQVSCENGFPAATLDELRRRGHDLVAVDDYNQFGSCQAIWRMDTGYVAASDPRRDGQAAAF

SEQ ID NO: 65410 - protein, 487 aa, Zea mays
  misc_feature (59)..(59): Xaa can be any naturally occurring amino acid
SLTIVHYSSDDNSNNVSPTAAKAEPPDPQQLAAASSSGPSSFTLAKPASSGPNSVCFIXASGRTKHAARTRMAIVREEAVDTSISPRVSALRPSKTMAITDQAMALRQAGVPVIGLAAGEPDFDTPPAIAEAGMDAIRNGYTRYTPNAGTLELRKAICTKLQEENGVSYLPDEVLVSNGAKQCITQAVLAVCSPGDEVLIPAPYWVSYPEMARLADATPVILPTNISENFLLRPELLTDEINEKSRLLILCSPSNPTGSVYPKELLEKIADIVKKHPRLLVLSDEIYEHIIYQPAKHISFASLPGMWERTLTVNGFSKAFAMTGWRLGYLAAPKHFVAACGKIQSQFTSGASSISQKAGVAALNLGYAGGEAVSTMVKAFQERRDYLVKNFKELPGVKISEPQGAFYLFIDFSAYYGSEVEGFGTIKNSESLCIFLLEKAQVALVPGDAFGDDKCIRISYAASLTTLQTAMSKLKEAVALLKPCVAA

SEQ ID NO: 65411 - protein, 220 aa, Bacillus cereus ATCC 10987
MNLKQLAGEYAATFVKDGMKIGLGTGSTVYWTIEKLGERVKEGLSFQAVPTSKETEVLAQQLNIPLISLNDIQSLDLTIDGADEIDSNLHLIKGGGGALLREKIVASSSKELLIIADESKLVTHLGTFPLPVEIIPFSWKQTESKIQSLGCQTTLRLKNNETFITDNNNMIIDCVFPHNITNPANLHNHLKMITGVVETGLFVNMTSKAIIGTKNGIQEL

SEQ ID NO: 65412 - protein, 524 aa, Physcomitrella patens subsp. patens
MAATLASTAAAVTSARLSNGSTTPRGGGFAKRGSALVGSNSSSLRGARLAVSSSYSSASARAQRPRKGVVSPRNVSDSPVVGEACLDPDASRSVLGIILGGGAGSRLYPLTKKRAKPAVPLGANYRLIDIPVSNCINSNINKIYVLTQFNSASLNRHLSRAYASNMGGYKNEGFVEVLAAQQSPENPNWFQGTADAVRQYLWLFEEAQVLEYVILAGDHLYRMDYQKFIQVHRETNADITVAALPMDETRATAFGLMKINDQGRIIEFAEKPKGDELRAMQVDTTVLGLDAARAKEMPYIASMGIYVVSKEAMISLLRNDFPEANDFGSEVIPGATEMGMKVQAYLYDGYWEDIGTIEAFYNANLGITKKPVPDFSFYDRSAPIYTQARFLPPSKMLDADVTDSVIGEGCVIKNARIYHSVVGLRSWVAEGAVIEDALLMGADYYETDDQRNELLATGGIPMGIGKNSVIKRAIVDKNARIGENVQIVNKDGVQEAARETDGYFIKSGIVTIIKDAIIPHGTII

SEQ ID NO: 65413 - protein, 352 aa, Zea mays
MQLAHLFSFDSATTSVATFVVLVVTALYLSLKKRYNEAIHLKVEMFLKTYGTSKPTRYTFSEVKKIARRFKEKVGQGGFGTVYKGQLPNGVPVAVKMLENSTGEGEDFINEVATIGQIHHANIVRLLGFCSEGTRRALIYEFMPNESLGRYIFLPQELLVPEKMLDIAIGIARGMEYLHQGCNQRILHFDIKPHNILLDYSFNPKISDFGLAKLCARDQSIVTLTAARGTMGYIAPEIYSPNFGGVSYKSDVYSFGMLVLEMVSGRRNSDPGIENQNGVYLPEWVYERVVTGQDLTLSKKIADQEKETVRQLAIVALWCIQWNPKNRPSMTKVVNMLTGRLQNLPIPPKPYA

SEQ ID NO: 65414 - protein, 253 aa, Bacillus pumilus SAFR-032
MDKHTDLKTAILKDKIKRVQQEDGYIYITGPIKLPVNLDGRTVMFNWYSWLKDDGLEPLSDEALIESLSSRQLADHQQSSVLVYGDFEHADEALIRMHSICHTGDIFGSKRCDCGFQLKQSMRMIEDNGAGALFYLANHEGRGIGLFTKAMAYILQENGYDTVEANEALGFEDDTRQYEEAIAVLQTLRTKPVRLITNNPKKTDAISHAGLSLSGRIPLWGDVSEFNEKYLQTKINRSGHMKADQEVRTIATS

SEQ ID NO: 65415 - protein, 1142 aa, Triticum aestivum
METGEAGSPSPDDAVLFFGVALVLGIASRHLLRGTRVPYTVALLVLGVALGGLEYGTKHGLGKLGAGIRIWSAINPDLLLAVFLPALLFESSFSMEVHQIKKCMAQMVLLAVPGVVISTVLLGAAVKLTFPYDWNWKTSFLFSGLLSATDPVAVVALLKDLGASKKLSTIIEGESLMNDGTAIVVYQLFYRMVLGKTFDAGSIIKFLSQVSLGAVALGLAFGIASVLWLGFIFNDTIIEISLTLAVSYIAFFTAQDALEVSGVLAVMTLGMFYAAFAKTAFKGDSQQSLHHFWEMVAYIANTLIFILSGVVIADGVLQDNIHFERHGTSWGFLVLLYVFVQISRAVVVGVLYPLLRHFGYGMDIKEATVLVWSGLRGAVALSLSLSVKRASDSVQTYLKPEVGTMFVFFTGGIVFLTLILNGSTTQFLLHLLGLGKLSATKLRVLKYTQYEMLNKALEAFGDLRDDEELGPVDWVNVKKYITCLNNLEDEQAHPHDVPDKDDHIHTMNLKDTRVRLLNGVQAAYWGMLEEGRITQSTANILMRSVDEAMDLVSSQSLCDWKGLRSNVHFPNYYRFLQMSRLPRRLVTYFTVERLELGCYICAAFLRAHRIARRQLHDFLGDSEIARIVIDESTAVGEGAKKFLEDVRVTFPQVLRALKTRQVTYAVLTHLSEYIQDLGKTGLLEEKEIVHLDDALQTDLKKLKRNPPLVKMPRVRELLNTHPLVGALSADVRDPLLSNTKETIKVHGTILYREGSRRTGIWLVSTGIVKWTSRRLCTRHSLDPILSHGSTLGLYEALTGKPYICDIITESVVHCFFIEAEKIEQLRQSDPSIEDFMWQESALVIARILLPQIFEKMAMREMRVLISERSSMNVYIKGEAIELGHNNVGILLEGFLKTENRTLITAPAVLLPSNTDLNLFGLQSSAMNQIDYCYTAPSYQVEARARAIIFEIGRLDIEADLQRSASLLSSTLGPSRTQSKEHVGLLRWPESFRRSSGPGNASLAEIRGQPGSFSARALQVSMYGSMTDGMHRARRQPRLAHVEGNQKHSVSYPKVPSRAADTRPLLSVRSEGSNAMKRKSAPAPAIAPALAPFPPPLAEGQQRRAVGEDDDSSDESVGEEVIVRVDSPSMLSFNPPSGPPRGS

SEQ ID NO: 65416 - protein, 442 aa, Candida glabrata CBS 138
MVDNKDENKDKPAVRKPEQVEGHTVTKFFNKLNGQPESYVSKSNYVFGKTLGAGTFGVVRQARYSPTNEDVAVKILLKKALKGNDVQLQMLYDELSILQMLKHPNIVEFKDWFESKDKFYIVTQLAVGGELFDRILAKGKFTERDAVSITMQILSAVDYMHSKNVVHRDLKPENVLYIDKSDDSQLVIADFGIAKQLQDNDDLIFKAAGSLGYVAPEVLTNNGHGKPCDIWSIGVIVYTLLCGYSAFVAETVDGFLEECTQNKYPVTFHKPYWDNISDEAKNFILRALTLDPAERPTAAELMKDPWITNTRPETANIYPEIRKGFDLRKKLRDAIEIVKLNNRIKKLRSLYMVETDTDIEENVASVAFNTLASSLNDLRLHSQKRVGQLTAEQRRLKSALTQDTFAQIVRAATKNKERIWGEKTASPTPSQSSTSSTSTNKK

SEQ ID NO: 65417 - protein, 298 aa, Schizosaccharomyces pombe
MSGQNNVVGVHYKVGRRIGEGSFGVIFEGTNLLNNQQVAIKFEPRRSDAPQLRDEYRTYKLLAGCTGIPNVYYFGQEGLHNVLVIDLLGPSLEDLLDLCGRKFSVKTVAMAAKQMLARVQSIHEKSLVYRDIKPDNFLIGRPNSKNANMIYVVDFGMVKFYRDPVTKQHIPYREKKNLSGTARYMSINTHLGREQSRRDDLEALGHVFMYFLRGSLPWQGLKAATNKQKYERIGEKKQSTPLRELCAGFPEEFYKYMHYARNLAFDATPDYDYLQGLFSKVLERLNTTEDENFDWNLL

SEQ ID NO: 65418 - protein, 250 aa, Desulfovibrio desulfuricans G20
MKKLMAANWKMYKTPQEAALTAGELVKAVGTVPDDREVLVFPPFVGLAQVAQAFSGVAGFYCGAQNVYPADEGAYTGEISPGMIVSTGAAWALTGHSERRSVLGESSAFVGQKTAFCLEKGLNVVLCIGETLEEREGGQLEKVLRGQLSEGLSGVPAGIAPERLAIAYEPVWAIGTGKVAGTAEIAATHAVVRGMLRELLPAAADSMRILYGGSVKPDNAAAIISLDNVDGVLVGGASLQAESFSRIILA

SEQ ID NO: 65419 - protein, 2178 aa, Synechococcus sp. CC9311
MTGLDHPDKPNQQEAIAVIGMGCRLPGGVESSDDFWDLLAEGRDVVGEIPPERWDPQRHHDPDPRRPLHQHVRRAGLVEGVDRFDPGFFGISGREAQCMDPQQRLLLEVCWRAIEGAGHPLEQLRGRAVGVFMGISSADYSALLWASEAQYLMPDNEPFILTGNTGCIAANRISYAFDLKGPSFTVDTACSSSLVAVHLACESLRRGESELALAGGVQALIHPGIQMSFCKAGLLSPSGRCRSFDAEADGYVRSEGAGAVFLKPLRAALRDGDRIEAVIRGTAVNSDGRSQGIAAPSQKAQMACVQAAYAAAGLSPAAAQYVEAHGTGTRQGDPIELRALGAVLGAGRSKAKPCLVGSVKSNLGHGETAAGITGLIKTVLCLKRRQIPASLHYSRPSPSVDMLGLGLKVSDALMPFPAEDQELVASVSSFGFGGTNAHAVLSAATELDGDCAKASGSAAPALQLLWLSARSPEALAVLRRDYAEWLDSHPEVEIADLCASTHLRRSQFPHAIALIVSSRKELLNQLLGQGAVAWSGEVPSRGQAALPASLQKIQLKMLSPGASARRMLEELVEALASGAQMSWSTWHEGADWCLVQPPGHPFLRSRYWWSSIETAAKDVKASLWLDHLGLTSPAPQRQGALQLQRLDLPGETQHWNAELDADSVPDLKHHRLGGQPVFAAAGYLALVLDWLKERKQALQLGAVQLERPLWLHDGPVRLQALLHGQELSLHSRPVSGDDSSDWQLHGQVQLAVEAGEASLLPEQGFIPSSEAERQAPEELYGALKRLGLSYGQTYRPIREFWVDGLCAEALLIRPEGAPDRCLIDGCFQLVAAVIAQEPAAAQLLLPTGVEAVHFGCWPLPDALRCRLQLRESSVEQQGAEARGHRVADLELHDVAGAPIGSIRGLQLRQLSRTMLDLMVPVAPALPAARLLEDGWSELPAGALSEWSSVASEPISLIALGEIPETVQTWCDQQAIDPIVMEESADPATLVPALVQTLQALPLQRPRQLFVLLPHLFSPAVGAVQAAVRSLAQDCPAWRCSTITLKGEVLSSPQWQRLLAATGGDAELRWCGEDRIDTRCLHPMDGDRFRILADGSGRLEGLVHAPLPLPQLLPGELELAVEATGLNFRDVLNALGLLQTHNQSLGLRADAQLPFGGEAVGRVVAVGPGTDPSLLGSRMLAALTLGSLASHVSCRADLCVPWPESLDPVLGASLSTAYLTAEHGLEQLAQLQQGETVLIHAAAGGVGQAALQVALRCGAHILATASAAKQAALLEQGVDAVFDSRSTAFADQVLEHTGGRGVDVVLNSLKGEWVDASFRALSEGGRFVELGKLEIWSDHQVRERRPDVTYHRFDLLELAASDPQPLRQRLLALVEAVQQERVKALPTSVFSLAECKDAFRLMAQGRHVGKLVITLPTQAPPCRIRSDGTYLIVGAFGGLGLRLQRWLVEQGARALLLVGRRLPQPDSDAEQQLQRLRTQGIEVESLTWVELPRALDVLPNNQPLRGVIHAAGTLWDQRIDAIDALGLETVLSAKWGVGEQLQQVQQLQPEAWLQVDFQLVFSSLAAGVGSPGQLVYGAANAALEAMCLSAEHSEQPGGPLRLAIQWGPWGGTGMAAGLEKRFEAVGLKPLQDSEAFEALARLLQRGRSGVVTVMAADWPRLVSQALPRQAAWFQALLPEASGRSEAQVRAQLEALPMRQRRPWLLATLQELLAGVMEEPSAQLDPHTSLFDLGLDSLMAAEFAAVVQEALGWRLDLAALSDAPCLDDLAALALERLSTDGEVSDRMALNLDQEAELPEAWSRPNLPTLEAPGEQLLLTGASGFLGAYLLAGQLERWPELRLRCLVRAASRQQGSEKLELNLRRYGLWNPAWAERLEVVLGDLAQPRLGLDPDQFAALGQGLGGILHNGAQLSQMASYAQLAAANVGGTRELLHLATAGSPVRFELISSVAVFEADVCCDQVIAEHDPLEAWTGIQLGYSQTKWVTDRMVRRAGEAGLPVTIYRPPLIAGPSNGSSWHQGDLLQRLLQGCLALGASPDLAWELDMVPVDYVADAITALAWSGPAKGRCFHLQHPEPLMLNALLSQITETLSGWRIVPMQVWISEIEQSSANPLQPLLPFLQQRWGDDGLTYPERNCRGKRARPSCASTTELLAEQGVRCPDWPQLIGPWSSVLLQQSSGV

SEQ ID NO: 65420 - protein, 258 aa, Agrobacterium tumefaciens
MKYGSLLNKFRLDGKVALITGGTRGIGLATAYAFGEAGAKLYLSARREEYEDAGAILTAGYDVTFYPADLKTREAACALVKRVADDAGRLDILINNAGIANGGDTPLFTEQQWRDVIATNVETVFWCSQAAIPVMREGGRGAIVNVGSMSGIVSNIPQNQVAYNSSKAAVHMMTKSLASELALDNIRVNAVAPGYIDTDMSRGGMVHPVRGPIWLEMTPMKRFGRPDEIATAILFLASEASSYVTGDILVVDGGYTTR

SEQ ID NO: 65421 - protein, 240 aa, Bacillus sp. SG-1
LLVLMLSACGTANQEEQSQNNSQNETTGSEPQQETADPVDDSDVNYPQLNDEIQENEQAVKMITNMGDITIKLFPEQAPKAVENFITHSKDGYYEGVTFHRVISDFMIQGGDPDGNGTGGESIWGEPFEDEFSKELLNIRGALSMANAGANTNGSQFFIVQNSAIDPGLEEKMAAAGFGKKAIEIYMERGGTPHLDNRHTVFGQVIEGMDVVDAIAAVETGANDKPVEDVVIEKIEIIKE

SEQ ID NO: 65422 - protein, 444 aa, Xanthomonas campestris pv. vesicatoria str. 85-10
MSANTAASAPSPATATGGLGDHQASVSVPKGGHWWFRLLAFLGPGYMVSVGYMDPGNWATDLAGGSQFGYLLLSVILLSNLMAIVLQGLSARLGIATGLDLAQACRVRYPRGVNLALWGICELAIIACDLAEVIGTAIALKLLFGIPLTLGAIITAVDVVLVLLLMNRGFRALEAFVIALLLIIFVCFGIQIALAAPPVAAVLGGFIPRAQVVTDPQALYLAIGIIGATVMPHNLYLHSSIVQTRAYPRTDVGRKSALRWAVTDSTVALMFALFINASILILAAAVFHAQGRTDVQEIEQAHALLAPMLGVGLASTLFAVALLASGINSTVTATLAGQIVMEGFLQLRLPPWIRRLLTRGIAIVPVVIVTWLYGEAGTARLLVLSQVVLSMQLPFAVIPLVRFVSDRQLMGALVAPAWLVRIAWVIAAVIVCLNLKLLWDTALH

SEQ ID NO: 65423 - protein, 186 aa, Bacillus anthracis str. A2012
MNAIPYVVEQTKLGERSYDIYSRLLKDRIVIIGSEINDQVASSVVAQLLFLEAEDAEKDIFLYINSPGGSTTAGFAILDTMNLIKPDVQTLCMGFAASFGALLLLSGAKGKRFALPNSEIMIHQPLGGAQGQATEIEITAKRILKLKHDINKMIAEKTGQPIERVAHDTERDYFMTAERAKAYGDW

SEQ ID NO: 65424 - protein, 125 aa, Moorella thermoacetica ATCC 39073
MYSEKVMDHFTNPRNVGEIENADGVGQVGNPVCGDIMRLYIKVEDGIIKDVKFKTFGCGAAIATSSMVTEMVKGKTVEEALKISNAAVAEALDGLPPQKMHCSNLAADALHKAIEDYQNRNKKAS

SEQ ID NO: 65425 - protein, 383 aa, Vibrio cholerae O1 biovar eltor str. N16961
MASPKHKIVYTLSKLNKVTVMGFKCGIVGLPNVGKSTLFNALTKAGIEAANFPFCTIEPNTGVVPVPDPRLDALAAIVKPERILPTTMEFVDIAGLVAGASKGEGLGNKFLANIRETDAIGHVVRCFENENIIHVAGKVSPLEDIEIINLELALADLDSCERAILRQSKRAKGGDKEAKFELAVLEKLQPVLSEGQSARSVNLTKEELLAVGYLNLLTLKPTMYIANVNENGFENNPYLDAVVEFAAKENASVVAVCAAIEAELSELEEEERDEFLADLGIEEPGLNRVIRSGYDLLNLQTYFTAGVKEVRAWTIPVGATAPQAAGKIHTDFERGFIRAEVIGYNDYIQFNGESGAKDAGKWRLEGKEYIVKDGDVIHFRFNV

SEQ ID NO: 65426 - protein, 123 aa, Oryza sativa
MDANRRQGGIQQLLAAEQEAQQIVNAARSVPRKLSEKHAFLLLFFCTLTKAKEEAEREIAEYRAQMEAEFQRKVAESSGDSGANVKRLEQETDTKIAQLKEQAANVSPEVIQMLLRHVTTVKN

SEQ ID NO: 65427 - protein, 148 aa, Mesembryanthemum crystallinum
MEQTFIMIKPDGVQRGLVGEIISRFEKKGFSLKALKFINVDRPFAEKHYADLSAKPFFNGLVEYIVSGPVVAMVWEGKGVVLTGRKIIGATNPLASEPGTIRGDFAIDIGRNVIHGSDAVESATKEIALWFPEGVVNWQSSLHSWIYE

SEQ ID NO: 65428 - protein, 792 aa, Xanthomonas campestris pv. vesicatoria str. 85-10
MNENILWLHELRLADLARVGGKNSSLGEMIGNLAGLGVSVPGGYATTAEAFKDFIAHNDLSKRIFDKLATLDVEDVNALTLAGKEIRGWVIDAPLQPELDRDIRTAYAQLCAENGGGDVAVAVRSSATAEDLPDASFAGQQETFLNVTGADDVVHKVKEVFASLYNDRAIAYRVHHGFKHEDVFLSAGVQLMVRSGVGAAGVLFTLDTESGFRDVVFVTSSFGLGEMVVQGAVNPDEFYVYKPTLTAGKPAILRRSLGSKAIRMVYSDVPGERVRTEDTPVELRNTFSISDEDVHELSKQALVIEKHYGRPMDIEWAKDGVSGKLFIVQARPETVKSRSHATQIERFALEAKDAKILAEGRAVGAKIGSGVARVVRSLDDMNRVQAGDVLIADMTDPDWEPVMKRASAIVTNRGGRTCHAAIIARELGVPAVVGSGNATAVIKDGQEVTVSCAEGDTGFIYEGKLAFERTTTDLGNMPPAPLKIMMNVANPERAFDFGQLPNAGIGLARLEMIIASHIGVHPNALLEYDKQDADVRKKIDAKIAGYGDPVSFYVNRLAEGIATLTASVAPNTVIVRLSDFKSNEYANLIGGSRYEPHEENPMIGFRGASRYVDPSFTKAFALECKAVLKVRNEMGLDNLWVMIPFVRTLEEGRKVIEVLEQNGLKQGENGLKIIMMCELPSNALLADEFLEIFDGFSIGSNDLTQLTLGLDRDSSIVAHLFDERNPAVKKLLSMAIKSARAKGKYVGICGQGPSDHPELAEWLMQEGIESVSLNPDTVVDTWLRLAKLKSEG

SEQ ID NO: 65429 - protein, 457 aa, Vitis vinifera
MQKRDQSKLGGTAGGATTPAAKRGRPFGSGGSNSAAAAAADAAAPSTLLGPSLHVHSSFADQNNKRIVLALQSGLKSELGWAINALTLLSFKEKDDVRKDATPLAKIPGLLDALLQVIDDWRDIALPKELAKAPRARLLGANSFVTGFGNEYEALGSNDVLSHPGSGSSISEASVQKNTTKLRPSEWWLDEDGLFNLDEEGRAEKQQCAVAASNIIRNFSFMPDNEVIMAQHRHCLETVFQCIEDHITEDEELVTNALETIVNLAPLLDLRIFSSSKPSYIKITEKRAVQAIMGMLGSAVKAWHCAAAELLGRLIINPDNEPFLLPFASQIHKRLVDLLSLPAVDAQAAAVGALYNLAEVNMDCRLKLASERWAIDRLLKVIKTPHPVPEVCRKAAMIIESLVSEPQNRAQLLAYENAFAEILFSDGRHSDTFARILYELTSRPNNKMAAARGIWGM

SEQ ID NO: 65430 - protein, 153 aa, Spinacia oleracea
AEFERTFIAIKPDGVQRGLISEIVARFERKGFSLVAIKVVIPSRPFAQKHYADLKDKPFYVGLVAYWSSGPVVAMVWEGEGVIKYGRKLIGATDPQKSEPGTIRGDLAVVNGRNIIHGSDGPETAKDEIKLWFKPEELVNYTHNAEKWIYGDN

SEQ ID NO: 65431 - protein, 466 aa, Novosphingobium aromaticivorans DSM 12444
MAEYDYDVLFIGAGPGGYVGAIRTAQLGLKTACAEGRETLGGTCLNVGCIPSKALLHGSEKFDEARNGTFASYGIKTGAVELDLDAMQAQKADSVKSLTGGIEFLFKKNKVTWLKGYAAFEDAHTVTVAGQKVTAKNIVIATGSSVTPLPGVTVDNDAGVIVDSTGALALNRVPQHLVVIGGGVIGLELGSVWRRLGAKVTVVEFLDQLLPGMDGDVRKEAAKIFKKQGMELKLGTKVTGVAVNGGTATLTVEPSKGGEASTIEADCVLVAIGRRPNVDGLGLDKIGLELNARGQIETDHDFATKIPGVWAIGDVIPGPMLAHKAEDEGIAVAENIAGLTGIVNHDVIPGVVYTMPEFAGVGLTEEAAKERGEIKVGKFPMLANSRAKTNHEPDGFVKVISDAKTDRVLGVWCIASVAGTMIAQAAQAMEFGATSEDIAYTCHAHPTHSEALKEAAMAVTGKPIHM

SEQ ID NO: 65432 - protein, 350 aa, Aspergillus oryzae
MSIPEMQWAQVAEQKGGPLIYKQIPVPKPGPDEILVKVRYSGVCHTDLHALKGDWPLPVKMPLVGGHEGAGVVVARGDLVTEFEIGDHAGLKWLNGSCLACEFCKQADEPLCPNASLSGYTVDGTFQQYAIGKATHASKLPKNVPLDAVAPVLCAGITVYKGLKESGVRPGQTVAIVGAGGGLGSLALQYAKAMGIRVVAIDGGEEKQAMCEQLGAEAYVDFTKTQDLVADVKAATPEGLGAHAVILLAVAEKPFQQAAEYVRSRGTVVAIGLPAGAFLRAPVFNTVVRMINIKGSYVGNRQDGVEAVDFFARGLIKAPFKTAPLQDLPKIFELMEQGKIAGRYVLEIPE

SEQ ID NO: 65433 - protein, 408 aa, Novosphingobium aromaticivorans DSM 12444
MSIEVKVPTLGESVSEATVGQWLKKPGEAVALDEPIVSLETDKVAVEVPAPAAGVLGALVANEGDTVAVGALLALIEDGVAAAGAQAPAPRTEAPVPPASASEAPAAPAGDAAVLSPAVRRAVLEYGIDPSTVKGTGKDGRLTKEDVMAAAAAKQAAPAAAVSAQAATPAAAPAGGRNEERVKMTRLRQTIAKRLKSAQETAALLTTFNDVDMSAVMEARAKYKDVFEKKHGVKLGLMSFFAKASVLALKDIPSVNAQIQGDEIVYFDYVDISVAVSAPNGLVVPVVRDVDKMSFADIEKSIADYGKKARDGALTMADMAGGTFTISNGGVFGGLMSTPIINPPQSAVLGLHRIEDRPVVRNGEIVIRPMMYIALSYDHRIIDGREAVTALKTIKEAIEDPTRLLIDL

SEQ ID NO: 65434 - protein, 194 aa, Clostridium difficile 630
MSAVNKSQYPAEGIPEIALAGRSNVGKSSIINTLLNRRNFARTSQTPGKTRTINFYLINNEFYFVDLPGYGYAKIAKSEKEKWGGIMERYLESRQELCSIFLLVDIRHEPTADDKLMYEWIKHFGYNCVVIATKADKISRGQYQKHISIIRKKLQMESSEKVIPVSSLKKTGVEELWEEIVNQYNQHGYEITVD

SEQ ID NO: 65435 - protein, 215 aa, Fusobacterium nucleatum subsp. vincentii ATCC 49256
MTNGIKIAPSILSSDFSKLGEEVVAIDKAGADYVHIDVMDGQFVPNLTFGPPVIKCIRKCTELVFDVHLMIDKPERYIEDFVKAGADIVVVHAESTIHLHRVIQQIKSFGVKAGVSLNPSTPEEVLKYVINDIDMVLVMSVNPGFGGQKFIPAVVEKIKAIKKMRADIDIEVDGGITDETIKVCVDAGANIFVAGSYVFSGNYKERIDLLKIKAK

SEQ ID NO: 65436 - protein, 610 aa, Aspergillus oryzae
MSPLVGPDNDNDVDLITAQEMQNDFGAEDPGHSSETKSTWYLFLLTLSIGGLQIVWSVELSNGSPFLLSLGMSKALLAFVWIAGPLTGTLVQPYIGICSDNCRSSWGKRKPFMVVGGLATVVALLALAWVRELVGGFLGIFGADQASTGTKTAIIVFATILMYCLDFAINTVQAGIRCFIVDNAPAHQQESANAWASRLTGVGNILGYIFGYIDLPRYLPFLGNTQFKVLCALASLSLVITLLISCLYIQERDPRLEPSASTGNPGIVAFFRQVFKSIRYLPPQIAKVCEVQLAAWVGWFPFLFYATTYIGQLYVNPIFDEHPNLPDNELDKAWEEATRIGTFALLVYAIISFVTNITLPIFVVPTYRSVVSPEETDTPSDERRPFLGARRMSCSSLPVGTASEPPPALPDKQNVEATVGSTWLSKLQIPGFTLRRAWLLSHVLFALCMFSTFFIYTYQAATVVIGIVGISWALTLWAPFALISAEVARIDAERRVRRHRSGMAEHHSADNSTQPNLATNVGDLEDGPRKPTDEEENLAQAGIILGLHNVAVSSPQILSSLICSAIFKVFQKPRGEPWDDSVGWVLRFGGCAAVLAAWLTSRLAEGRRLK

SEQ ID NO: 65437 - protein, 511 aa, Bordetella parapertussis 12822
MSHEELLVDYAARKDHALGMGGPAKLEKRRAEGVLNARERLELLLDPGTFEESGLFAVSHRKEVAERTPADGKIAGYGKVQARKVAVVANDFTVMGASSSVVNGKKIRHMREVATKNGLPLIFLGESTGARMPDRMGAEGRAILGQDPYEYRRLRETPWVSALLGPCYGSSTWYACLSDFVVMRRGATMAVASGRVTSKAIRQEIDSEELGGWRMHTQSTGLVDALAETDEEALEIVKKWLAYFPSNQNEPPPRQAVTPESVPDTGAILQHVPTDSNKVYDVRKAIDCIVDRDSVMELKARFGRSICTMVARLDGHPVGILASNPMFKGGAIDVDACNKAISFLVLCDSFNIPLVFLVDQPGFLIGIEGERRAAPGRIMNWMNAISLVTVPKISVIMRKSYGQAYLNMGGGRNSDEVLAWPSADLGFMAPGVGANVLFGVNEQDDPERYRELVAQLSKDTSAWGLAALYETHAVIDPRETRAHLIRLLDIHRGAQGRRIGQHLLSNWPTTY

SEQ ID NO: 65438 - protein, 668 aa, Archaeoglobus fulgidus DSM 4304
MPRRVKQVINMDVRERIKTVAVLGAGLMGHGIAEVCAMAGYNVTMRDIKQEFVDRGMNMIKESLAKLEQKGKIKSAEEVLSRIKPTVDLEEAVKDADLVIEAVPEVVEIKKQVWEEVDKLAKPDCIFTSNTSTMRITMLADFTSRPEKFAGLHFFNPPVLMRLVEVIRGEKTSDEVMDLLVEFVKSIGKTPVRVEKDVPGFIVNRVQAPASVLLMAILEKGIATPEEVDATVRRLGLPMGPFELVDYTGVDILYNALKYYAQTISPDYEPPKFLEEMVKANKLGRKTGQGFYDWSKGRPQIDSSKATDKINPMDFTFVEINEAVKLVEMGVATPQDIDTAIKLGLNRPFGPFELAKQFGAEQIAKRLEELAKQFGKKIFEPAKTLKEGKLEELLKAGKAEAEEKKEDEFKTIKIEKLDGGITKLVLNRPDRLNTISPEVLDEIDRAITQLWNDKDTRVIVITGAGDRAFSAGADLGGSIITHPFDFLEHNRKGERVFTRLREIPKPVIAAINGYALGGGLEIAMNCDIRLAKKSAVLGLPEVGLGILPGWSGTQRLVKLVGISRAMQLALTGERITAEEAERWGLVNKVFDDDKFEEEVMNYAKNIAERCAPISMALIKRLINKGGEVPMDIGLEWECTAAGLLFATEDMREGISAFLRKDKPQFKGR

SEQ ID NO: 65439 - protein, 498 aa, Thermoplasma volcanium GSS1
MINTENFGNIINGTEEMVGDESIVKSPVDGSPIASVYFADRDAVSKAIDSSYDSYYKVWSKFTLSERKKLLAKLADRIQEKSERYATLESLNTGKTLRQSMLMDIPLGIEHLRYFATETEFKMERQITHPEYPDSHGIVQYVPMGVVGAITPWNVPFLMAVWKAAPALLAGNTVVIKPSSFTPLTTIEMARDAISVGFPPGVLNVVNGRGETVGEELARNKKVRMLSFTGSTYTGKRITEITGIKKVTLELGGKSPNIVFDDADLERAALGVMFGIYLNSGQLCESGSRLLVQSSIKDKFLNLLKSKIEKMRPGNPMSMETDISAITTKNQRDKIEKMVNSGLKDGSVIFYQKSIDGSVPKGGLYFPPTILDKVSEDMEVAKEEIFGPVLSVMEFDDEADAIDKANMTDYGLAAGVWTQDSEKATRVASSIEAGTVWINEYHLLSAAAPRGGFKNSGVGRELGLDGIMEFTQTRHLFVSHGSTDQDTVAYGLVLADLS

SEQ ID NO: 65440 - protein, 455 aa, Methanothermobacter thermautotrophicus str. Delta H
MEMIIDGEGVSGEKIFTVRNPFNGDEVDRVPLAGRSDVERAIRAAHRARDAMADLSARKISEKLYDVADELKTELDEFARLITLESGKPIRFSRDEVKRSVETARLSAEEAGRLYGESIPMDAGIGGKGLTGFTVRIPLGVVAAITPFNYPLNLAIHKVGPALAAGNTTILKPSLEAPLSALKLAWILSEHFPAGAVNAVTGRGSEVGDVIIDSPLVDKITFTGSVEVGRYISARASMKKITLELGGNDPLIVMDDADIDSAVEAAVRGSYLYSGQVCIAVKRMIVHEDVADEFADKLVNITGSLRAGDPMDVRTDVGPLINEDAAIEVERVIGAAVEDGAELLCGGSRRGNFVEPTVLDHVVPGMEVIERETFGPVSPIIRFNGADEAIRIANGTCYALQAGVFTENIRTALRMAREIEAGTVLVNKQSTFRVDHMPFGDSGAVEWVRRVSSTP

SEQ ID NO: 65441 - protein, 512 aa, Catharanthus roseus
MALEKLVLFDFLAAISILILVQKFIQIVFLRSSSRIRLPPGPKGWPIIGALPYLGTMPHSILANMAKKYGPIMYLKLGTNGMVVASTPDAVKAFLRTLDMNFSNRPIDAGATHLAYNAQDMVFAHYGPKWKLLRKLSNLHMLGGKALENWSNVRATELGYMLQAMYESSRKGETVVVPEMLTYAMANMIGQVILSRRVFVTKSLESNEFKDMVVELMTTAGYFNIGDFIPSIAWMDLQGIERGMKRLHKKFDALLTKMLEEHKSSSHKRKEKPDFLDYVLANRDNSEGERLTTTNIKALLLNLFTAGTDTSSSVIEWAISEMLKNPTILKRAQEEMDQVIGRNRRLMESDIPKLPYLQAICKETFRKHPSTPLNLPRIAQKDCQVNGYYIPKGTRLSVNIWAIGRDPNVWENPLEFNPDRFLSGKMAKIEPRGNDFELIPFGAGRRICAGTRMGIVLVEYILGTLVHSFDWKLPFDDINELNMDESFGLALQKAVPLVAMVSPRLPINAYSP

SEQ ID NO: 65442 - protein, 487 aa, Ralstonia eutropha JMP134
MGKATGFLEFPRQNEGYEAVVKRVKHYKEFVFALSDSEAKIQGARCMDCGIPFCNNGCPVNNIIPDFNDLVYRQDWKSAIEVLHQTNNFPEFTGRICPAPCEAACTLGINELPVGIKSIEHAIIDKAWEEGWVAPQPPKHKTGKTVAVVGSGPAGMAAAQQLARAGHDVTVFEKNDRIGGLLRYGIPDFKMEKTLIDRRIEQMQAEGVTFRAGVMVTDGALPAGIKNYARETISAKDLMDQFDAVVLAGGSEVPRDLPVPGRDLDGIHFALEFLIPQNKEVAGDGENEIRAEGKNVIVIGGGDTGSDCVGTSNRHGATSVNQFELLPQPPEEEDKPLVWPYWPIKLRTSSSHEEGCDRDWSVATKEFIGENGKVTALKACRVEWKDGKMQEVPGSEFILPADLVLLAMGFTNPVGSMLDAFGVDTDARKNAKAATEGERAYHTNVPKVFAAGDVRRGQSLVVWAIREGRQAARSVDAFLMGHTELPR

SEQ ID NO: 65443 - protein, 256 aa, Aspergillus oryzae
MTKFRPCIDLHSGQVKQIVGGTLSNIPADLKTNYVSKLPASHYAELYQRHDLRGGHVVMLGSGNDAAAKEALSSWPSGLQVAGGITDKNAQYWIDQGAEKVIITSFLFPEGKFSLERLKAVLSALGGDRSKLVLDLSCRKKDNTWFVAMNRKKNIPYTDQDKESISLLEPYCSEFLIHAADVEGLQQGIDGELVSKLSEWCSIPVTYAGGARSLEDLEKVHSSSRGKVDLTIGSALDIFGGSGVTFDECIQWNKTH

SEQ ID NO: 65444 - protein, 110 aa, Arabidopsis thaliana
  misc_feature (83)..(83): Xaa can be any naturally occurring amino acid
MPSSMLSSATMVASPAQATMVAPFNGLKCYAAFPATLKANNDITSITSNGGRDNCIAVWPALGKKKFETLSYRSDLTDSELAXGVHYLIPNQGVSCVKFEVEHGFVYPEH

SEQ ID NO: 65445 - protein, 194 aa, Clostridium difficile 630
MALVPVVVEQTGRGERSYDIFSRLLKDRIIFLGDQVNDATAGLIVAQLLFLEAEDPDKDIHLYINSPGGSITSGMAIYDTMQYIKPDVSTICIGMAASMGAFLLAAGAKGKRLALPNSEIMIHQPLGGAQGQATDIEIHAKRILKIKETLNEILSERTGQPLEKIKMDTERDNFMSALEAKEYGLIDEVFTKRP

SEQ ID NO: 65446 - protein, 245 aa, Alteromonadales bacterium TW-7
MANLIDLTVKNSVAVLTMNTAENRHNPSFLAEFNLHLDHIEADKSIHSVVLTSASDKSWSLGIDLEWMANPSILPAAISDFMLQITQLLQRIVTFPMPIIAALNGHTYGNGAVLACACDFRFMKSDKGFFCFPEVDVLVPFVPSMFPIINKAIPQTFFNRLAMTGERVGAQQLFENNVIEAVFSNSDELQAGVLEFAAQFNKNRWIYAQNKSQMNKHILQTIKEEDPAFIDNVSKMLYKNLHKTK

SEQ ID NO: 65447 - protein, 431 aa, Clostridium perfringens ATCC 13124
MEKVIANELINFLYESPTAFHAVKNVKDTLEFEGFKELKEADRWNLEVEGKYFVSKNDSALIAFRVGKGDIAENGFKIIGAHTDSPGFRIKPNPEITVENTYVKLNTEVYGGPILNTWFDRPLALAGRVSLVSKNPLKPVNKIVNINRPILIIPNLAIHMNREVNEGYKINRQKDTLPLLSLVNETLEKGNYLVELLAKELYCEKEDILDFELYPYEYEKGCLMGLNEEFISSGRLDDLSMVHAGIKALMDAEVSQATNVMVCFDNEEVGSATKQGGDSDFLKTILERIVLALGKDREDFLRSLSESFMISADLAHAVHPNLGEKHDPVVRPVLGKGPVIKIAASQSYTSDSDSSAVYEMICRNAGVNVQKFVNRSDMRGGSTIGPISSTHLPIRSVDMGTPILAMHSIREFGAVKDHFDCIKSFTEFFRI

SEQ ID NO: 65448 - protein, 417 aa, Zea mays
MAMSSSRALLRRIGGALRRRSFSDAAAGPDSAAVGYHVAGGPSYMRGAVFWEPGRPLTLEEFHMPRPKAGELLIKTKACGVCHSDLHVLKGELPFSSPCVVGHEITGEVVDHGTHTPAEIISRFPVGSHVVGAFIMPCGNCFYCVKGQEDLCESFFAYNRAKGTLYDGETRLFLRGNGKPVYMYSMGGLAEYCVVPANALAVLPASLPYTESAILGCAVFTAYGALRHAAEMRAGDSVAVIGVGGVGSSCLQIAKAFGASEVIAVDVLDEKLRNATTLGATHTVNAAKEDAVERIKEITGGRGVDVAVEALGKALTFSQCARSVRDGGKAVMIGLAATNVVGEVDITRLVRRQVKIIGSYGARARQDLPQIVKLAESGAFSLRNTVSRKCRFEEANGAYEDLDQGKIVGRAVVEIME

SEQ ID NO: 65449 - protein, 473 aa, Zea mays
MSDGKDSLDLSALGAAIPNSAELSAEDKANLVASIKNTLEGLASRHTDVLESLEPKVRKRVEKLREIQGEHDELEAKFFEERAALEAKYQKLYEPLYSKRYEIVNGVVEVEGITVESAAETPAEQKTGDETSADQKEEKGVPAFWLNAMKNHEILAEEIQERDEEALKYLKNITWYRISEPKGFKLEFQFGTNPFFKNSVLTKTYHMIDEDEPILEKAIGTEIEWYPGKCLTQKVLKKKPRKGSKNTKPITKTEDCESFFNFFSPPQVPDDDEEIDEDIAEQLQNEMEQDYDIGSTIRDKIIPHAVSWFTGEAAQDEEFEVMDGEDDDDEDNDDEDEDDEDDDDDDDYDSKKTKGTAGGEGQQGERPAECKQQYYMCSYAWSEDGCHSGDMLPSERARPHGGNCVKILFLYRSSVPDSISEVPEFILVFRNKESRFVNFNASHRYYCSQPTFQGPLRKEQTAPGLQGLSPLLY

SEQ ID NO: 65450 - protein, 256 aa, Populus trichocarpa
MTSKIISGKRFEGKVVIVTASTQGIGFSIAERFGLEGASVVISSRKQKNVDEAAEKLKAKGIKVLGVVCHVSNAQQRKNLIETTVQKYGKIDIVVSNAAVNPSTDSILETQESVLDKLWEINVKAAILLLKDATPHMKKGSSVILISSIGGYHPHSSMAMYGVTKTALFGLTKVLAAEMAPHTRVNCIAPGFVPTHFADFITGNQTIRKTIEDQTLLKRLGTTDDMASAVAFLASDDASYITGETLVVAGGMPSRL

SEQ ID NO: 65451 - protein, 144 aa, Oryza sativa Japonica Group
MLKFLSKVVVEYCPLDPRKAAVVELLAQCNGRKAKDSNPACSVELRRLPSPPPADAAAAGEKNAHPPPRVLVTYFNGVEESFVAAEGATAQGIRDQILDRGRLLDTEQLFRDGGEKWPVLIPEEELTMSFPGIKPKKAEEKPQA

SEQ ID NO: 65452 - protein, 224 aa, Triticum aestivum
  misc_feature (222)..(222): Xaa can be any naturally occurring amino acid
MEDTTFPAGITGMEVGGVVFGASATPPHSSKILFLGGAGERIGPRHGTLKLVTVIGVYLEQSAVPFLTSRWQGKPAEELAGSADFFRDIVAGPFDKFTQVTLVDTLTGQEYSDKVTENCVNIWKSSEHYSVDEGHGSAATSELKAIFYPASFPTGSTIFFTHSADGVLQVAFSDDTKVPEQESARVDSRALSEAVLESIIGDNGVSPSARRSLAFRLCDLIXHK

SEQ ID NO: 65453 - protein, 346 aa, Oryza sativa Japonica Group
MGQQSLIYAFVARGTVILAEYTEFTGNFTTIASQCLMKLPASNNKFTYNCDGHTFNYLVEDGFTYCVVAVESVGRQIPIAFLDRVKDDFTKRYAGGKAATAAANSLNRDFGSKLKEHMQYCVDHPEEISKLAKVKAQVSEVKGVMMENIEKVLDRGEKIELLVDKTENLRSQAQDFRQAGTQGTRRQTLGEILMDPDGSVAARANPHALPSPTLVLANPDECSALILPSSYRKLFSSAANLRPPAYAASQLPALICGLSAQLPALCCQVINGASCGASRRGVRPSFIRSHCATATCTTSSTDGWTNGVRETVIHVKAHHFATSLGLAPPPTSPSSGGVRARGVEWP

SEQ ID NO: 65454 - protein, 284 aa, Ipomoea nil
MEHREEDVRLGANKFPEKQAIGTAAQDKDYTEAPPTALFEPSELSSWSFYRAGIAEFIATFLFLYITILTVMGVSKSDSKCKTVGIQGIAWAFGGMIFALVYCTAGISGGHINPAVTFGLFLARKVSLTRLVYYIVMQCLGAICGAGVVKGFGKTLYNSKGGGANVVNPGYTKGDGLGAEIVGTFVLVYTVFSATDAKRNARDSHVPVLAPLPIGFAVFLVHLATIPITGTGINPARSLGAAIIYNNEHAWNDHWIFWVGPFVGAALAALYHQVVIRAIPFKSS

SEQ ID NO: 65455 - protein, 448 aa, Novosphingobium aromaticivorans DSM 12444
MTAPTAADLSADIARVFALQQAHMWEAKASTAAERKEKLARLKAAVEAHADDIVAAVLEDTRKPVGEIRVTEVLNVTANIQRNIDNLDEWMKPVEVATSLNPADRAQIIHEARGVCLILGPWNFPLGLALGPVAAAIAAGNTCIVKLTDLCPATARVASVIVREAFDEKDVALFEGDVSVATALLDLPFNHVFFTGSPRVGKIVMAAAAKHLTSVTLELGGKSPVIVDDSADIDQVAAQLAAAKQFNGGQACISPDYVFVKEDKKAALVEGFRANVQKNLYDDAGNLKKDSIAQVVNKANFDRVKAMFDDAVAKGATVAAGGTFEADDLTIHPTMLTGVTPQMTILQDEIFAPVIPVMTYDTLDQAIGYIEARDKPLALYVYSKDEANVEKVLARTSSGGVTVNGVFSHYLENNLPFGGVNTSGMGSYHGVFGFKCFSHERAVYRHQQ

SEQ ID NO: 65456 - protein, 154 aa, Zea mays
  misc_feature (120)..(120): Xaa can be any naturally occurring amino acid
MADPDVIEVTFGNDVINTTVTSSGQAVERWIAEILALHRPGSNGYSIIVGLDVEWRPSFGPHQNPVATLQLCVGHSCLIFQLLYADYVPGALAEFLGDRGIRFVGVGVEADAERLSDDHXRWDASCLSYEQIKYACIDAFVSFEVARRLLGGAY

SEQ ID NO: 65457 - protein, 272 aa, Rhizobium leguminosarum bv. viciae 3841
MSKSTGLGLAGQQPQPLGDASVWTVIRAEATELAAREPILRQLLAADVTDTAGNDEIIARVLAARLSVAQVETSDLFDLILSALDDDIMRKVEADLIAVRERDPACTTFLHALLNLKGFHALETHRIAHALWIAGRPEIASWLANLVSLVFGPDIHPAARIGASIMLDHGSGIVIGETAVIEDEVSILQNVTLGGTGKETGDRHPKIRHGVMIGAGAKILGNIEIGAFSKVAAGSVVLKSVPTHCTVAGVPATVVRIHRADEIPAETMDQNI

SEQ ID NO: 65458 - protein, 238 aa, Methanococcus vannielii
MLIIPAVDMKNKKCVQLIQGNPDKKHVELDNPPEIAKKWVEQGAEMLHLVNLDGAINGKRVNDEFIEETIKNSGVPVQIGGGIRSVSDALYFIEKGAEKVILGTVAIQNPKIVREISSIVGKEKVTVALDAKDGKVLIKGWTEKTDYSPVQIGKILENMGAGSILFTNVDSEGLLEGINVLPTKELVDNLNIPIIASGGVTTVEDLLKFKEIGVYAVVVGSALYKDMINLKDAILASK

SEQ ID NO: 65459 - protein, 399 aa, Bacillus cereus E33L
MLENQINERSLLLHKELVGKIEITSKVEVNSADDLSLTYTPGVAESCKAIAADEETVYDYTARGNMVAVVSDGTAVLGLGNIGPKAAMPVMEGKSILFKKFANVDAFPLCLGTTDVDEIVSLVKNLEPTFAGINLEDIAAPRCFEIEKRLKEETNIPVFHDDQHGTAIVVLAAVINALKVVSKQMDHVKIVINGAGSAGIAIGKLLLKAGAQHITLVSLEGIVCEGEAWMNEAQIEVSKKTNREHVRGTLKEAIHQADIFIGVSAPNVLTKELVQMMNEKAIVFAMANPIPEIFPEDALEAGAAVVGTGRSDYANQVNNVLAFPGIFRGALDVRATDITEEMKLAAAYGIANIITDEERNANYVIPNPLDKRVVPSVAEAVAKAAIDSGVAQIMKIPSY

SEQ ID NO: 65460 - protein, 291 aa, Saccharomyces cerevisiae
MPKTSYLNKNFESAHYNNVRPSYPLSLVNEIMKFHKGTRKSLVDIGCGTGKATFVVEPYFKEVIGIDPSSAMLSIAEKETNERRLDKKIRFINAPGEDLSSIRPESVDMVISAEAIHWCNLERLFQQVSSILRSDGTFAFWFYIQPEFVDFPEALNVYYKYGWSKDYMGKYLNDNQREILLNYGGEKLRSLLSDRFGDIEVTIYSPSDPNASTVTAENSQFLWRAAITLNQFKEFVKSWSIYTSWARDNPSKPDIADIFINELKEICHCEDLNVPLKIEWSTFYYLCRKRE

SEQ ID NO: 65461 - protein, 224 aa, Synechococcus sp. CC9311
MASSSSESETIQSRWQAIHAECPDSVNLLAVSKGHPAMAVRELAALGQVDFGESRVQEALPKQQDLEDLSSLRWHFIGRLQANKVRAVVRAFPVIHSIDSQGLAERTSRIAVEENRIPEVFFQVKLREDPAKGGWEPDALREVWPQLQSLPGLKPIGLMTMAPLGLGLEDRQSLFHDCRTLADELALSECSMGMSGDWKQAAKAGATWVRVGSGLFGPRPERLV

SEQ ID NO: 65462 - protein, 326 aa, Archaeoglobus fulgidus DSM 4304
MDRFQRLIAMLKEEIAKRAEIINKAIEELLPEREPIGLYKAARHLIKAGGKRLRPVISLLAVEALGKDYRKIIPAAVSIETIHNFTLVHDDIMDRDEMRRGVPTVHRVYGEATAILAGDTLFAEAFKLLTKCDVESEGIRKATEMLSDVCIKICEGQYYDMSFEKKESVSEEEYLRMVELKTGVLIAASAALPAVLFGESEEIVKALWDYGVLSGIGFQIQDDLLDLTEETGKDWGSDLLKGKKTLIVIKAFEKGVKLKTFGKEKADVSEIRDDIEKLRECGAIDYAASMARKMAEEAKRKLEVLPESKAKETLLELTDFLVTRKK

SEQ ID NO: 65463 - protein, 451 aa, uncultured crenarchaeote 4B7
MNTFDELKINEDIMRSIKELGFTTPFPIQTQSIPELLRGNDVIGQAHTGTGKTAAFGIPMLQNIIHGGGIQGLVIAPTRELAMQITEEIKKVGKYTKIKVVTVYGGQGIGIQLDALRRKPEIVVATPGRLIDHLDNGSIRTDNIKHVVLDEADVMLDMGFIEDIEYVLQKIPGNRITSLWSATMPPEILRLSDKYLNNAKNILIDSDDLSGEGIDQAFLVIKDREKHKYLTDFINQNKGQVIVFCSTKIRTRNVARDLIKSRYKVVPIEGDMSQNKREYSMMKFRKNQADILVATDVAARGIDVPRVGLVVNYDVPNQDMVYFHRIGRTARAGAKGKAITLVSYSSIGDWKFIKKQIKSDLTDLNKKMGIEVHIPDPLKRNVGRRIAQPMRSGYGRRPSYGGGGRSSYGGGGRSSYGGGHSRDGPARDQYKRKGSSRSSYGRQNRDTKKKW

SEQ ID NO: 65464 - protein, 351 aa, Arabidopsis thaliana
MAKPNIDELNQILTSYQNTINDTLQLFEQVPSPTQDKLYWNDVLQISDHLSKQATIVGMLWITGEPPKAEAMKETMEAYFNALQGFLLHCHGSMVGAGTTLSSTIHASVKQIVDSSFRLLQGSVSLYEGSYEKGRKPTIPQLAGAVWEACSNLKNVPETNIKAIGRAMAHVAVSMKDVLREMKELKPASSSPDHNVSTNSDDDDLGDELSPEEFEVAKMVADIVSETLVVIKELIRAITCMIKLENPKDNSEFVDSFEKLLKLCQGIGVQIDELGACVYPPQEFGLMKQTVENMRESIGEIESDVKSSKNSSSEALSGSCRRLQSLIEHMVTELDTRIEAEVVYKMQKVTL

SEQ ID NO: 65465 - protein, 127 aa, Brassica napus
  misc_feature (84)..(84): Xaa can be any naturally occurring amino acid
RTIYKGTLSTGAEIAVVSIAAGSRANWSTDMEIQLLQKIRKLAKVDHKNFLNVIGYCHENEPFHRMLVFEYAPNGSLSEHLHSXHTEHLDWPTRLRIFMGIAYCLEHMHNLNPPILHTNLDSSCIYL

SEQ ID NO: 65466 - protein, 295 aa, Desulfovibrio desulfuricans G20
MQNDAFKSKVLIESLPYFRQFSGETVVIKYGGNAMIDESLKQAFALNIVLLKYVGVNPVVVHGGGPQIGRMLQQLNIPTNFREGLRVTDDATMDVVEMVLVGKVNKQIVNLLNLSGAKAVGLSGKDGQLIRARQMEMVISKEAQAPEIIDLGKVGEVTGVETKLLHSLQRDGFIPVIAPVGVDENGETYNINADLVAGAVAGALGAKRLLLLTDVPGILDKDGRLISSLDTARTMQLFEDGTLKGGMLPKVKCCLEALEDGVEKAMIIDGRIENCVLLELFTDHGIGTEITRACS

SEQ ID NO: 65467 - protein, 394 aa, Geobacillus kaustophilus HTA426
MGLNTFSDIVQTMPPYLFSRFQKKKEELLKLGVDVIDLGIGAPDLPPPSFVIEELKEALDAPEHYTYSPYGGCREYREAVARFYEREYGVKLDPETEVLALIGSKEGIVHLLQAVLNPGELALVPDPGYPVYRTAVHFARGQSLSLPLDAQHGYIPRFDALPSSVYDQAKIMFLNYPSNPTAAAVDLDVFAEAVSLARQHQMFIAHDAAYSFVTFAGFQAPSILQVDGAKEVAVEFGSLSKSYNMAGCRIGYVVGNRDMIRALSVIKSNTDTCQFIPIQKAAVAALTNGRTFIRENSRIYEQRMNMMVERLRELGIDVQRPKATFFLWIPVYDGYSSERFAAKLLEEAGVIVTPGTAFGSAGEGYVRVSLSAPMERLQQAVERWKQVDWEESAR

SEQ ID NO: 65468 - protein, 316 aa, Myxococcus xanthus DK 1622
MNLDPSTQKFVSDLAASNSPPLYTLTPEQAREVLLEAQSIPVPMPDADVEERKLPVGPRGSVRTLLFRPKGSKERLPVLMFVHGAGWVMGDARTHERLVRELVKGANVAAVFVDYGRSPENKFPVAIEEAYAATKYVAEHPDEFNVDARRMALVGDSVGGNMATVVSMLAKERGGPSIRFQVLFYPVTDANFDNGSYQEFAEGPWLTRKAMKWFWDAYLPEAGKRVDPHVSPLRASLDQLNGLPPALVITDENDVLRDEGEAYAAKLSEAGVNVTQVRFLGTHHDFVMLNALAQTPAARGAIALTTTKLREWLHAN

SEQ ID NO: 65469 - protein, 432 aa, Mycobacterium avium subsp. paratuberculosis K-10
MSGGPRNQTKSSASAQGLCEFIDASPSPFHVCATVAARLIAAGYTELDEAKHWPSQPGRYFTVRAGSLVAWDSTGADGPFRIVGAHTDSPNLRVKQHPDRTVAGWRVVALQPYGGAWLNSWLDRDLGISGRLSVRDGSGLSHRLVRIDEPILRVPQLAIHLAEDRKSVTLDPQRHVNAVWGVGESARSFVDYVAARAAVAPDDVLAADLMTHDLTPSTLIGASENGTADLLSAPRLDNQASCYAGLEALLATEPSGPLPVLVLFDHEEVGSSSDHGAHSDLLSTVLERIVLAAGGTRQDYLSRLPASLLASADMAHATHPNYPERHEPGHPIAVNAGPVLKVHPNLRYATDSRTAAAFALACRQAGVTLQRYEHRADLPCGSTIGPLAAARTGIPTVDVGAAQLAMHSARELMGAHDVAAYSAAMHAFLSPG

SEQ ID NO: 65470 - protein, 493 aa, Geobacillus kaustophilus HTA426
MKIQNYINGEWKEPSTGQFAPVINPATGETIAEVAMSGPNDIDEAVQAAKEAQKQWALVPAPKRAEILYKVGMLLKERKEQLARMLTMEMGKVIEEARGEVQEGIDMAFYMAGEGRRLFGDTTPSELKDKFAMSVRVPVGVVGIITPWNFPIAIATWKSFPAIVAGNAVVWKPAPETPIMAQELARIFEEAGLPPGVFHVVHGDGPTVGNALVEHPDVKVISFTGSNEVGRMIAEKCGRLLKKVSLEMGGKNAVIVMDDADLTLAVDGIIWSAFGTSGQRCTACSRVIVHERVKQELERRLLEAVKTLKIGNGLDETVKVGPVIHEEALQKIDRYVRIGVEEGAKLLVGGYILREGDYARGFYYAPTIFTDVTPNMRIAREEIFGPVVSIISVRSLDEAIAVNNSVDYGLSSAIFTRDVNNVFRAMRDLDTGIVYVNAGTTGAEIHLPFGGTKGTGNGHRDSGVAALDVFTEWRSIYVDFSGKLQRAQIDTDD

SEQ ID NO: 65471 - protein, 246 aa, Brassica napus
  misc_feature (225)..(225): Xaa can be any naturally occurring amino acid
FPYRRRLIGVMAGVIIPPASLLKRIAEIAEIPLNAGVFKKDCTDLTRRVSLLTHLIEEIKDSNQIDSAASSSSENDWWSDLVVALEASKRLLSSAVRFQARDSSDVAAKRISFQFQCATWKLEKALSNLPYDLYDISDEVREQVELARSQLRRAMQRYGLLNSNKFSSALFELMERDVKIKAEEEKDESVAETLHLAEEKKQLTKSPSISLAFYLSKDADSERLXKMVTKNTDESSKLTVPVDFLG

SEQ ID NO: 65472 - protein, 487 aa, Chlamydomonas reinhardtii
MTNQQSSTPLTRIEMPHLTDASDDVFGGTRSIHSAYVFSVDKQIGEGTYGQVFMGHDRKTNDKVALKKIRMDTEKEGFPITAIREIKILSQLSHPNVVNLREIVRSEIHKNNNFKGSIYMVFDYADFDLTGLMETTKYQFTEPQVKCILKQLLRGLAYCHSNGVLHRDLKASNILIDAKGVVKLADFGLARPYTAENEAGFTNRVITLWYRPPELLLGANKYGGEVDMWSVGCIFAELLTGKPLFPGKDDLDQMDKIFHIMGPPTEAAWPGVTALNLKNYANVPLSRYPAKNRLRETLRSKAGPGRTISDAAICLLEKMLCLDPKRRIKAQDSIMDDYLWKDPMPCEPQQLPCRGSGHEFTMKKRRNDMAHRDTTAAVGQPMPLPGVPGGGPGGGGPGGGYSNMGAYSQQGPDPKRQRYGQVPGGSMQGYPGGGPGPGTSRPPQPQSYPGGAGGSAAGGFGGRQVQGGGGGAGYGMAPPGHTDMLDE

SEQ ID NO: 65473 - protein, 635 aa, Glycine max
MSNPASKATWTPGFHRVFVDLCLGEMLKNEPGSTRITKAGWRNIVGSFYAKTGVRYDKKQFKNHYDSTRKLWKVWVKLTEDSNMKWDPETGAFGASEEDWQNYVKAIPEAAQFQSKEIQFKDKLDIIFDGGNRIEEVKRWASLKWQNDSSTTSPLCGREREKKRKNFDRDCELDSTIVVDYSPTPKASWSPAYHKMFVDLCIEETLKGNKSATHFTKEGWRNIVGSFNAKTGMRYDKKQIKNHYDSTRKLWKIWAKLTGDDNMKWDPQTNTFGASEEDWHNCIKVFRAFPEAAQFRFKELQFSDKLNVIFDGAMPTEEMITRLKRQNDASATLRGKEREKKRRNVGRDCGLKSAIMVNAIPISTIPSEQSMSSSSYTKVKATWTPTLHKIFVDLCMQETLKGNKPGTHFTKEGWKNIMESFYAKTGVNYGRLQLKNHWDSTKEQWRTWCKLIGTSYMKWDPSDQKFEASEEDWTNYLQENPEAAQFRYKELKFTDQLETIFNGTTVTGETEPAVQQRKSDDSVVTFPLHIKEPDTDNFDEKTECHCDVVASRNGVSIQKNASAVSSTEGKRNYSIGECIECLDRMEEIEQGSDLYMFALDVFLKQEYREIFLQLKTPNLRISWLQRLQSCGPPPV

SEQ ID NO: 65474 - protein, 493 aa, Triticum aestivum
  misc_feature (190)..(190): Xaa can be any naturally occurring amino acid
MPMAPPPLLPLSALLLLLAAASHASAKPVQIQALLATPLSPDRVSAPSELARDDDSNVFAGNLAAAEDAAASTVRFRVVHRDDFSKNATAAELLAYRLERDEKRAARLSAAAGAANGTRRGGGGVVAPVVSGLAQGSGEYFTKIGVGTPATPALMVLDTGSDVVWLQCAPCRRCYEQSGQVFDPRRSRSXYGAVGCAAPLCRRLDSGGCDLRRSACLYQVAYGDGSVTAGDFATETLTFAGGARVARVALGCGHDNEGLFVAAAGLLGLGRGSLSFPTQISRRYGRSFSYCLVDRTSSANSASRSSTVTFGSGALGSTVASSFTPMVKNPRMETFYYVQLIGISVGGARVPGVANSDLRLDPSSGRGGVIVDSGTSVTRLARPAYSALRDAFRGAAAGLRLSPGGFSLFDTCYDLSGRKVVKVPTVSMHFAGGAEAALPPENYLIPVDSKGTFCFAFAGTDGGVSIIGNIQQQGFRVVFDGDGQRVAFVPKGC

SEQ ID NO: 65475 - protein, 120 aa, Zea mays
HTSLPSDLVPPSSAPAKMSTVTRAYLDQRLAAAKRCSREAAMAGAKAAAVATVAAAVPTLASVRMLPWAKANLNPTGQALIISTVAGMAYFIVADKTILSMARKHSFDDAPDHLKNTSFQ

SEQ ID NO: 65476 - protein, 339 aa, Hypocrea jecorina
MAPIKVGINGFGRIGRIVFRNAVEHPEIEVVAVNDPFIETSYAAYMLKYDSSHGLFKGDVTVDGKDLVVNGKKVRFYTERDPANIKWSETGAEYIVESTGVFTTTEKAKAHLAGGAKKVIISAPSADAPMYVMGVNEKDYDGSADVISNASCTTNCLAPLAKVIHDNYGIVEGLMTTVHSYTATQKTVDGPSAKDWRGGRGAAQNIIPSSTGAAKAVGKVIPSLNGKLTGMSIRVPTANVSVVDLTVRLEKGASYDEITETIKKAADGPLKGILAYTNDAVVSTDMLGNTNSSIFDIEAGISLNPNFVKLISWYDNEWGYSRRVLDLLAHVAKVDASKK

SEQ ID NO: 65477 - protein, 287 aa, Oryza sativa
MKLSLLVLACAVALVVAQPAPTNGPTNEQPVAWNYAKGGADWPGLCSTGKAQSPININTSATTCVRAGEPDAKPFRLDFHYKPAEGLTLSNNGHSLQVKGDLGFITIGGCNPCDGQKYHVKQVNFHAPSEHTINTEPYKDGHYVMETHIIHQKEGSSGLNDLATVVILWYKQQPGGFPNPFLESIDWANAPADTTRHTTIQNKVRLGKLKEAFDGEYYSYLGSLPVPPCTESVQYFVMKRPLGITEKQLDTVQALFQKNPNFANGHGNHRDVQPVNDRKVWYYRKHH

SEQ ID NO: 65478 - protein, 221 aa, Corynebacterium glutamicum
MQARIDATLNEHNRPEGSVRLLPVTKFHPVEDIKILQELGVTAVGENREQEARAKALELPDMDFHMIGQIQSKKANSIARWSAAVHSVDSEKIAEALGRGVALALERGDRTSDELPCFIQLSLDGDPSRGGTPLSQVTQLADCISDTTHLRFEGLMCVPPLGWDPEKAFSQARDVLSGLEEHFDRSLEFSAGMSGDLVAAIKHGSTIVRVGTEILGNRPLA

SEQ ID NO: 65479 - protein, 414 aa, Archaeoglobus fulgidus DSM 4304
MTIDDVLSLLEKAESEDLNPRTGRLFAYVYETGDENIRKVAEKALVRFAEKNLLDFTVFRSAVFFEKEVVGFARNLMHGDAAVGSFTFGGTESIMLAVKAARDYYRKKEGTAEVPEILAPISIHPAFLKAADYLGLKVVRLPVKDAKGDVDAFAEAVSGKTALIALSAPNWPFGTIDPVEEIAEIAAERNVLLHVDACLGGFILPFFEMLGEKIPKFDFRVEGVTSISLDAHKYGYAPKGASVVLFRDAELKKCSMFVDVTSPGYVFVNQAVLSSRPEGPLAAAFAVIKYLGVEGYKELASKILSARDKIYRGLKSLGFESVGEVESSVLAMTNPDVDLMGFVNNMKKLGWQLHLQKGLKEYDIPDNIHLTLSPVHDGVAEKFVEDAAKALEMEPELTLSRFTQWLKGGSLPKS

SEQ ID NO: 65480 - protein, 400 aa, Lactobacillus plantarum WCFS1
MEIIVQKFGGTSVKDEAARIQALKHVQYAVDQGDKVIVVVSAIGRKGAPYATDSLLGLVGAEHSRLTNRELDMLVSVGETISTAVFTELARKQGLNVTAMTGHDAGIVTNDDFQNAKILRVDPKPITDAFIDADVVVVTGFQGATESGHVTTIGRGGSDTSAAILGAALKAKRVDIFTDVNGMMTADPRLVTHARFIKAISYEELANMAHEGAKVIHPRAVEIAEQAHVPMRIRSTYQEPDELGTLVTDRTTTQIEHYRTVTGIAHQTDLTQFTVPTDTLSSSAIFQLMAQHGLSVDFINITPHQVVFNLVDGDADVAKQLLTDAHVHCQSIANCAKVSVVGAGITGTPGVTARIVSALAAQHIDILQSTDSYTTIWVLVKEADLKAAMNALHDEFLGIE

SEQ ID NO: 65481 - protein, 509 aa, Veillonella parvula
MATVQEKIELLHEKLAKVKAGGGEKRVEKQHAQGKMTARERLAKLFDDNSFVELDQFVKHRCVNFGQEKKELPGEGVVTGYGTIDGRLVYAFAQDFTVEGGSLGEMHAAKIVKVQRLAMKMGAPIVGINDSGGARIQEAVDALAGYGKIFFENTNASGVIPQISVIMGPCAGGAVYSPALTDFIYMVKNTSQMFITGPAVIKSVTGEEVTAEDLGGAMAHNSVSGVAHFAAENEDDCIAQIRYLLGFLPSNNMEDAPLVDTGDDPTREDESLNSLLPDNSNMPYDMKDVIAATVDNGEYYEVQPFYATNIITCFARFDGQSVGIIANQPKVMAGCLDINASDKSSRFIRFCDAFNIPIVNFVDVPGFLPGTNQEWGGIIRHGAKMLYAYSEATVPKITVITRKAYGGSYLAMCSQDLGADQVYAWPTSEIAVMGPAGAANIIFKKDEDKDAKTAKYVEEFATPYKAAERGFVDVVIEPKQTRPAVINALAMLASKRENRAPKKHGNIPL

SEQ ID NO: 65482 - protein, 450 aa, Desulfovibrio desulfuricans G20
MDQEIFIIGLNHRTADVEVREKFALTGCTSLEPAVIPLGNGISEVIILSTCNRVEIMVAGRGDDVPDTVLSLWANARGQHPEELRPYVYIHRGLAAVEHLFTVASSLDSMVLGEPQILGQLKDAYRDAVARNTTRVILNRMMHKAFSVAKRVRTETAVASSAVSISYAAVELAKRIFGEMNEYKAMLIGAGEMAELAATHLLNCGVNKIYVANRTFERGLELAKQFDGEAILFEELFTRLPEVDIVISSTGAQQAVIRAKDIRDVLKRRKNRPMFFIDIAVPRDIDPDVNNLDNVYLYDIDDLKEVVEENLSHRREEAAKAKAIVRSETEVFGRWLRSLDLQPTIVDMYSRSTEIAQEELLKTLRRIGPVDESTQKALEAMLNAVVKKIHHEPICFLKRRYEEEDSGQRYIDFARRMFNLDNEPEQPEAHKNRKRPQPDLPAGCPGKTIL

SEQ ID NO: 65483 - protein, 302 aa, Vibrio cholerae
PSYSQQIVTLTYPHIGNTGTNSEDEESTAIHAQGLVIRDLPLIASNFRSEQSLSDYLKSQNIVGIADIDTRKLTRILREKGAQNGCIMAGDNLDEALALAKAKEFPGLKGMDLAKVVSTKEAYAWKQGSWTLEGGLPEAKADSELPYHVVAYDFGAKRNILRMLVDRGCRLTVVPAQTSAEDVLALNPDGVFLSNGPGDPEPCTYAIEATRVFLEKNIPVFGICLGHQILALASGAKTVKMKFGHHGANHPVKDLDRGVVMITSQNHGFAADEATLPDNLRATHKSLFDGSLQGIHRTDKPA

SEQ ID NO: 65484 - protein, 295 aa, Neptuniibacter caesariensis
MRRVTKAVIPVAGLGTRVLPASKAIPKEMMPVVDKPVIQHVVEEAVAAGIKDIVLVTRSGKASVEDHFDCHYELEAELERKGKTSILEAVRNIIPADVSISAVRQHKALGLGHAVLCASPIIGDEDFAVLLPDMLINSHGLPKADLTAMVEAYQDSGHGQIMVEPVPMEHVDRYGVVDCEGVSISAGQSADIARMVEKPPVDEAPSNLTINGRYILPARIMELLKDTKPGAGGEIQLTDAMADYLSEGNLQAFHMSGKTYDCGNKAGYLQANVVYGLQHAETAESLKAFIKELDL

SEQ ID NO: 65485 - protein, 544 aa, Neptuniibacter caesariensis
MPANESVAWNDLQSHAYYMSQSHISTLFREETDRFSLYTFEQNKFLLDLSKQRITEETLALLIKLAEEKGLQQWIQKLFDGDHVNDSEDRPALHTALRTPADRILSINDKNIIDEVHSNLSRMEEIVERIHSGQWRGFTGHSIDTVVNIGVGGSDLGPFMACKALAENQADTAKSLKIHFVSSMDGSQLAELLSELNPARTLFVISSKSFTTIDTLANAQTAKEWLKKSSYAASEETLISRHFIGVSANPDKVCEWGIPKSNQLEFWDWTGGRYSMWSTIGLPIALKLGMSGFREFLNGAHEMDEHFRNAAFSENLPVLLAMAGIWNINFLNINAHAILPYDGRLSHIPAYLEQLEMESNGKSVDRQGNNVDYKTCPILWGEVGTNAQHAFYQLLHQGTEAVMCDFIVAARRYHDTNNPELQHQHQLNLANCLAQSRILALGDSVLEGAESAPAFKRYKGNQPCTTIMLDELNPFSFGQLIALYEHKVFVQSVIWDINPFDQWGVELGKKVATSLLDALGTERKQPDFDSSTNGLINRITERGE

SEQ ID NO: 65486 - protein, 423 aa, Neptuniibacter caesariensis
MKVTIWGNELLAWTAAAALAESGNHVLLVTNEHEVPNEAETEFKVSNEPGLEQLITDSKACGRLKVGSDEEGVIHASNHILALNPDQFVTAERLVARLSQTHSSNLLIINQSNFGVGSSDRLQSQIGEANNQVICYIPDMLAEGSALQDYKWPQTYIIGCTNDWAMLNIKALFRPFSQAVKQWMIMTAKEAEFTKFANTGMLALRLGYINELANLADQLEVDIEVIREAMVTDPRIGPHYLHPGCGFGGLHFQQYIEALSELMSEARNSKLLDTVLTENEKQKEQPFRKLWRHYDCDLENRVVTIWGLSFKPGTASIDNAPSLKVINTLLAQNCRVQVHDPEAMGNIREHFGEQPNLAYFDNGYDSLKKSDGLLLLTDWPEYWSPDYDEILNQMKYPLIIDGRNIFDKEMLESLGFIYYGVGR

SEQ ID NO: 65487 - protein, 338 aa, Streptococcus pneumoniae R6
MEKQTVAVLGPGSWGTALSQVLNDNGHEVRIWGNLPEQINEINTHHTNKHYFKDVVLDENIIAYTDLAETLKNVDAILFVVPTKVTRLVAQQVAQTLDHKVIIMHASKGLEPDSHKRLSTILEEEIPEHLRSDIVVVSGPSHAEETIVRDLTLITAASKDLQTAQYVQELFSNHYFRLYTNTDVIGVETAGALKNIIAVGAGALHGLGFGDNAKAAIIARGLAEITRLGVALGASPLTYSGLSGVGDLIVTGTSIHSRNWRAGDALGRGESLADIEANMGMVIEGISTTRAAYELAQELGVYMPITQAIYQVIYHGTNIKDAIYDIMNNEFKAENEWS

SEQ ID NO: 65488 - protein, 299 aa, Streptococcus pneumoniae R6
MTSKVRKAVIPAAGLGTRFLPATKALAKEMLPIVDKPTIQFIVEEALKSGIEDILVVTGKSKRSIEDHFDSNFELEYNLKEKGKTDLLKLVDETTGMRLHFIRQTHPRGLGDAVLQAKAFVGNEPFVVMLGDDLMDITDEKAVPLTKQLMDDYKRTHASTIAVMPVPHDEVSAYGVIAPQGEGKDGLYSVETFVEKPAPEDAPSDLAIIGRYLLTPEIFQILENQAPGAGNEIQLTDAIDTLNKTQRVFAREFTGARYDVGDKFGFMKTSIDYALKHPQVKDDLKNYLIQLGKELTEKE

SEQ ID NO: 65489 - protein, 86 aa, Glycine max
  misc_feature (32)..(32): Xaa can be any naturally occurring amino acid
VQNLKGGNFNSKEHGWWVVEIAERTASLIARXQGVGFTHGVLNTDNMSILGLTIDYGPFGFLGAFDPKFTPNSTDLPGRRYCFANQ

SEQ ID NO: 65490 - protein, 458 aa, Myxococcus xanthus DK 1622
MSIHPAGASTAAPLPPLSPGAPLIGHLRALRKDPLHFLQAQAREYGDVVRLPMGPADLVLVAHPDGVRHVLQDHARNYSKQSRGFRVLQELLGHGLLTSDGDHWLRQRRLAQPAFHRQRVAGFTRTMVDAAADLAATMEARADTGAAFNVAEDFTRLTLRIASSTLFGADVSSATHDIATVMSRLQVFVYKRLTQPVPLSLRLPLPAHRQFERDVGSLNRVVHGIIAKRRRESGEHHDLLQMMMEAHDDDTGERMSDSQLRDEVLTLLLAGHETTASALAWTIMLLSQHPGVRRDMESELARELGGRNPTHEDLPRLELTHRVVDESLRLYPPAWALSRIATKEDLVGGFRIPKGAHLLIAPWVTHRHPSIWDNPEGFDPDRFLPEREQARPRFAWFPFGGGPRQCIGNQFALMELVLVLATLLQRVRLNLTPGQVIHPTPAITLRPRPGVWVTASRP

SEQ ID NO: 65491 - protein, 232 aa, Streptococcus pneumoniae R6
MTATKMNAQEIIQFIANAEKKTSVKVTFEGQLATAVPSSVVKLGNVLFGDWKDVAPLLEGLVENQDYVVEQDARNSAVPLLDKRAINARIEPGAIIRDQVEIGDNAVIMMGAVINIGAEIGAGTMIDMGAILGGRAIVGKNSHVGAGAVLAGVIEPASAEPVRVGDNVLIGANAVVIEGVQIGSGSVVAAGAIVTQDVPENVVVAGVPARIIKEIDAQTQQKTALEDALRTL

SEQ ID NO: 65492 - protein, 369 aa, Myxococcus xanthus DK 1622
MKSRAAVAFEAGKPLSIVELDVAPPQKGEVLVRITHTGVCHTDAFTLSGDDPEGLFPVVLGHEGAGVVEAVGEGVTSVKPGDHVIPLYTAECGQCLFCKSGKTNLCVAVRATQGKGVMPDGTTRFSYNGKPVYHYMGCSTFSEYTVVAEVSLARINPNANPEQVCLLGCGVTTGLGAVKNTARVQEGDSVAVFGLGGIGLAVIQGAQMAKAGRIIAIDTNPAKFELAKAFGATDFVNPKDHDRPIQQVIVEMTGWGVDHSFECIGNVGVMRAAIECSHRGWGQSIIIGVAGAGQEISTRPFQLVTGRTWKGTAFGGVKGRSELPGMVEDAMAGKIQLAPFVTHTRSLTDINEAFDLMHEGKSIRTVVRY

SEQ ID NO: 65493 - protein, 348 aa, Myxococcus xanthus DK 1622
MLSACTEARGAAPAAPGPTIQDTRRYEKPSDADLRRTLSPLAYEVTQKGATEPAFRNPLWNHHEEGLYVDVVSGEPLFSSRDKFDSGTGWPSFTRPVDSARIVEKRDSTQGMERVEVRSKAAGSHLGHLFGDGPAPAKTRYCINSAALRFVAVNDLAKEGYGAWLPLFGRPAPAAATKRQDTSPFTETALLAGGCFWGMEDLLRKIPGVVQTEVGYTGGSSAFRNPTYHDVSSDKTGHAEAVRVVFDPTRLTYETLLEQWFFRMHDPTTLNRQGNDVGTQYRSAIFYLSDAQKRVAEEVKARVDASRKWPRPVVTQIVSAGAFTPAEDYHQDYLVKNPGGYTCHYMRD

SEQ ID NO: 65494 - protein, 464 aa, Bdellovibrio bacteriovorus HD100
MIPVILSGGSGTRLWPVSRQQMPKQFCDIFGEPLQTLTLKRCLRMGSPWIVTSKALQTLTELNLKANQGDGANQGEAVKVVYEPVGKNTAPAVAALCKLLLDQGKGDEIVGVFPSDHLITKEDAFLKVVEFASAVAKENRVVTLGITPSYPETGYGYIQTKTTSLKDQAGLKAYSVVKFHEKPDLKKAEEFISQGGFSWNAGIFVFKVSHMASLFEKHQPTLWNQISALKADASNLGDIYAQVQSISIDYAIMEKLSEAELACVPADFGWSDVGSWDAVAALQKGQDIINVKGKDNFVFGEPTKNYSMIGLEDVIVVDTKDALMLVKKGQSQDVRHVVETLTQAKSPLVKEHVYEYRPWGYFEILKDTENFKSKIIRVNPHSQLSYQSHAKREEHWTITQGSGEVVLNDQVIPVKAGSHVHIPLGAKHRMRNNSSEMLEFVEVQLGTYFGEDDIVRYQDDYSRN

SEQ ID NO: 65495 - protein, 466 aa, Physcomitrella patens subsp. patens
MIADAWETLRKSMVFFRSKPVGTIAALDPTEDSLNYNQVFVRDFVPSALAFLMNGEPEIVKNFLLKTLRLQSIEKRIDCFTLGEGVMPASFKVLHDPARKTDTMIADFGESAIGRVAPVDSGFWWIILLRAYTKSTGDHSLADMPDCQRGMRLILTLCLADGFDTFPTLLCADGCCMVDRRMGIYGYPIEIQSLFLMALRSAKSLIKAEGEGKEFLERIDKRLHALSFHMREYFWLDHQQLNNIYRFKTEEYSHTAVNKFNVIPDSIPDWIFDFLPLKGGFFIGNVSPARMDFRWFAIGNFMAILASLATSEQAAAIMDLLEARWPELVGDMPLKVSYPAMEGHEWRVVTGCDPKNTRWSYHNAGSWPVILWMLTAACIKTGRPQIARRAIEQVETRLAKDGWPEYYDGKLGRYVGKQARKFQTWSIAGYLVAKMMLEDPSHLGMIGLEEDKKMKPSLTRSASWTA

SEQ ID NO: 65496 - protein, 294 aa, Allium cepa
MDQYEKVEKIGEGTYGVVYKARDRLTNETIALKKIRLEQEDEGVPSTAIREISLLKEMQHANIVRLQDVVHSEKRIYLVFEYLDLDLKKHMDSCPDFAKDSRLAKTFLYQLLRGIAYCHSHRVLHRDLKPQNLLIDRRTNSLKLADFGLARAFGIPVRTFTHEVVTLWYRAPEILLGARQYSTPVDIWSVGCIFAEMVNQRPLFPGDSEIDELFKIFRIMGTPNEDTWPGVTSLPDFKSAFPKWPAKDLATIVPKLDSAGIDLLYKMLHLEPSKRITARKALEHEYFRDLGTIP

SEQ ID NO: 65497 - protein, 355 aa, Oryza sativa
  misc_feature (56)..(56): Xaa can be any naturally occurring amino acid
YLCIFNCFFRKDDGVKVVSVENLKNPYEKQGNFNMRFKLTLNKLYAWSLVSYDRGXFVLQPSMDVFKNMLHELAVGRDNPDGADQGFLASYFPDLLDRPMFHPPVNGTKLEGTYRLPLGYQMDASYYYLKLRWSIPCGPNSVITFPSAPWFKPWYWWSWPVLPLGLSWHEQRRENLGYSSELPVVLIQALFYIGVIAVTRLARPSLSKMCYNRRMEKSTIVLLTTLRVVAAWSILAAYTIPFFLIPRTVHPLLGWPLYLLGAFSFSSIVINVFLLHPLAVLTTWLGIIGALFVMAFPWYLNGVVRALAVFAYAFCCAPLIWGSLVKTMSSLQILIERDAFRLGEPNQTAEFTKLY

SEQ ID NO: 65498 - protein, 110 aa, Physcomitrella patens subsp. patens
SPCAACKLLRRRCTRDCVFAPYFPPDEPQKFANVHKVFGAANVNKMLQELPVEARGDAVSSMVYEADARVRDPVYGCVGAISSLQQQVAHLQTQLAVANAEIVCMRIHNT

SEQ ID NO: 65499 - protein, 439 aa, Streptococcus agalactiae 2603V/R
MKKYDVIVLGFGKAGKTLAAKLATQGKSVAMVEEDDKMYGGTCINIGCIPTKTLLVSASKNHDFQEAMTTRNEVTSRLRAKNFAMLDNKDTVDVYNAKARFISNKVVELTGGADKQELTADVIIINTGAKSVQLPIPGLADSQHVYDSTAIQELAHLPKRLGIIGGGNIGLEFATLYSELGSKVTVIDSQSRIFAREEEELSEMAQDYLEEMGISFKLSADIKSVQNEDEDVVISFEDEKLSFDAVLYATGRKPNTEGLALENTDIKLTERGAIAVDEYCQTSVENIFAVGDVNGGPQFTYISLDDSRIVLNYLNCDKDYSLKNRGAVPTSTFTNPPLATVGLDEKTAKEKGYQVKSNSLLVSAMPRAHVNNDLRGIFKVVVDTETNLILGARLFGAESHELINIITMAMDNKIPYTYFQKQIFTHPTMVENFNDLFNF

SEQ ID NO: 65500 - protein, 228 aa, Ralstonia eutropha JMP134
MSLLHQARFFTTVNHLRDLPATAVPEVAFAGRSNAGKSTAINILCNQKRLAFSSRTPGRTQHINYFTVAPVKAPDPIAFLVDLPGYGYAEVSGSAKYHWQGLLSDYVQTRSQLSGLILMMDARRPFTDLDCQMVEWFLPTGKPVHVLLTKADKLTNSENAKALRETRKMLEGYAEQLATPVPLTAQLFSSLKRRGIEEAQRVIAGWLSLPEAQAAAPAEQPAAPGASE

SEQ ID NO: 65501 - protein, 144 aa, Prunus armeniaca
DPFDQDDWEHYAKMTAECGEQVQIVGDDLLVTNPKRVEKAIKEKSCNALLLKVNQIGSVTESIEAVRMSKKAGWGVMASHRSGETEDTFIADLSVGLATGQIKTGAPCRSERLAKYNQLLRIEEELGAEAVYAGAKFRVPVEPY

SEQ ID NO: 65502 - protein, 345 aa, Escherichia coli
  misc_feature (133)..(134): Xaa can be any naturally occurring amino acid
MHGNSEMQKINQTSAMPEKTDVHWSGRFSVAPMLDWTDRHCRYFLRLLSRNTLLYTEMVTTGAIIHGKGDYLAYSEEEHPVALQLGGSDPAALAQCAKLAEARGYDEINLNVGCPSDRVQNGMFGACLMGNAXXVADCVKAMRDVVSIPVTVKTRIGIDDQDSYEFLCDFINTVSGKGECEMFIIHARKAWLSGLSPKENREIPPLDYPRVYQLKRDFPHLTMSINGGIKSLEEAKAHLQHMDGVMVGREAYQNPGILAAVDREIFGSSDTDADPVAVVRAMYPYIERELSQGTYLGHITRHMLGLFQGIPGARQWRRYLSENAHKAGADINVLEHALKLVADKR

SEQ ID NO: 65503 - protein, 142 aa, Zea mays
  misc_feature (50)..(50): Xaa can be any naturally occurring amino acid
  misc_feature (59)..(59): Xaa can be any naturally occurring amino acid
  misc_feature (68)..(68): Xaa can be any naturally occurring amino acid
  misc_feature (80)..(80): Xaa can be any naturally occurring amino acid
  misc_feature (93)..(93): Xaa can be any naturally occurring amino acid
  misc_feature (107)..(107): Xaa can be any naturally occurring amino acid
MDAEKLIYRTICILGKKRTTLGLLDFVGLGDFLQIIVVKQEKAVNVVEIXARALNILTXKLTIEGSYXVTSQTGVDISLXAKSSCLSSVMNIXFTKNYDVVVDIFNXKGLCWSITYDDESLRIARYDIRNIFVLERTELSDV

SEQ ID NO: 65504 - protein, 519 aa, Xanthomonas campestris pv. vesicatoria str. 85-10
MSASIPRCAHASVAQEQTYRPPDDRRLSDKLLITMSPESETRSMHNTLILFGATGDLAQRYLFPSLLRLFIDGLLPEDFRIRALALSPHDTDAFREVLRPRLTEALPIATAEQIDTLLQRIDYRSVDLRDAESVANAVRELASRRCVSYLAIPPGLYISTCQGLALGGALEAPHRLMLEKPIGHDSDSARDILQSIGALIDEDRVFRLDHYLGKAAVQNLIALRFGNTLLEAVWNRAYIESVQILVAESEGVDGRDAYYARSGALRDMVQSHILQLLCLVAMEPPASLEADRIRDEKVKVLRALRPMTAEHAAHDCVRGRYTAGSINGQPAQAYHPPEGSDVETFVAVTAHIDNWRWAGVPFHLCTGKRLAERSTRIVVTLKPVTHWLFERPDRQNAVPNRLTFQLQPQENIELGLMSSLAGPEWGAIELQPLELELSVPTGLHRRIAYERLFVDAFNGNPALFVRDDEVKAAWSWIDSVSDAWKDAALPLQPYPAGSWGPESAAHFLPPATDAQGNNA

SEQ ID NO: 65505 - protein, 484 aa, Brucella suis 1330
MGKVTGFLEIDRQVAKYQPASDRIRHFREFTIPMTDGEVQKQAARCMDCGIPYCHGPTGCPVHNQIPDWNDLVYNNNWDQAIRNLHLTNNFPEFTGRICPAPCEEACTLNLEDMPVAIKTVEQALGDKAYELGYIVPQPAASKTGKLVAIIGSGPAGLAAAQQLARAGHMVDVYERESRPGGLLRYGIPDFKMEKHLIDRRVAQMEGEGVRFHCGVNIGVDKPLRGLLDTYDAVLYCGGSETPRPAGIPGADLDGVHDAMPYLVQQNRRVGRENIESVAWASVPILAGGKHVVVVGGGDTASDCVGTAFRQGAVNVTQLDIRPQPPEKEDKLSVWPYWATKMRTSSSQAEGASREFQVATLEFIGEDGRLTHVKCCQVDEKRRPIAGTEFFIKADLAFIAIGFAGPVEDSVVKEMDGKLEIATDRRGSKSVKANDRDYRTNVDKLYAAGDIRRGQSLVVWAIREGRQAAHAIDADLMGSSVLPR

SEQ ID NO: 65506 - protein, 302 aa, Vibrio cholerae
PSYSQQIVTLTYPHIGNTGTNSEDEESTAIHAQGLVIRDLPLIASNFRSEQSLSDYLKSQNIVGIADIDTRKLTRILREKGAQNGCIMAGDNLDEALALAKAKEFPGLKGMDLAKVVSTKEAYAWKQGSWTLEGGLPEAKADSELPYHVVAYDFGAKRNILRMLVDRGCRLTVVPAQTSAEEVLALNPDGVFLSNGPGDPEPCTYAIEATRVFLEKNIPVFGICLGHQILALASGAKTVKMKFGHHGANHPVKDLDRGVVMITSQNHGFAADEATLPDNLRATHKSLFDGSLQGIHRTDKPA

SEQ ID NO: 65507 - protein, 467 aa, Brucella suis 1330
MNTISKPSVDLHREEEPHLARNLSNRHLQLIAIGGTIGTGLFMGSGKAVSLAGPSILLIYAITGFMLFFVMRALGEILLSNLQYRSFADFAGDYLGPCAQFFTGWTYWLCWIVTAVAEVVAVSGYVSFWFPHLAPWIPALGLITILLILNLPTVRNFGEIEFWFALIKIITIIGLIITGIYMLMTGFVLPNGTQASIAHLWNHGGFFPNGSLGFIAGFQISVFAFVGIELVGTAAAEAENPMRNLPKAINNIPIRIVLFYIGALFVIITVTPWNQVDPNSSPFVAMFSLAGIGIAAHFINFVVLTSASSSSNSGIYSTSRMVYGLATVGLAPKAFSKLSNRKVPVHALIFSCIFLLSSVVLLYAGQSMIQVFTLVTTISALLFIFIWSIILVSYLQYRRKHPERHEKSTFKMPGRRASVVMVFIFFAFVLWALTQEPDTLAAMKVTPLWFVLLGIAYRVMKLKQKQS

SEQ ID NO: 65508 - protein, 326 aa, Rhizobium leguminosarum bv. trifolii
MILCCGEALIDMLPRDTTLGEKGFAPYAGGAIFNTAIALGRLGIPTAFFTGIADDMMGEILLETLKASNVDYSPCAITPRPSTIAFVKLVNGQATYAFYDEGTAGRMITTADLPDLGDDCEALHFGAISLIPSPCGETYEALLDREAASRVISLDPNIRPGFIKDKPSHMARIKRMAAKSDIVKFSDEDLDWFGLQGDHDALAAHWLNHGAKLVVITKGAEGASGYTKDRKVTVPSERVTVVDTVGAGDTFDAGILASLKMDNLLTKRQVASLDEQALRNGPDPRRQSRRRHRLPRRRQSTLGARDWSLRLEQDSDPHPPDDTFSP

SEQ ID NO: 65509 - protein, 270 aa, Shewanella sp. MR-4
MKPEELIDEVIAIATDAGRTIREIYLKGNFERETKSDNTPVTSADLAANKLICERLAALTPDIPILSEEAADIPLSVREGWKRYWLVDPLDGTGEFIAGSGDFSVIIALVEHNRPVMGVVYVPMTQVCYYAIAGLGAYKRTDKQEVRISSRQIQHREQVSLRLAVSRRQDPQSVLTLFNQPKHCELVVMGGAALKSCLVAEGRADCYVRVGPTGEWDTGAAQIIIEEAGGQLMDTELQPLTYNERETLENPNFIVVGAPNLEWDKILIGE

SEQ ID NO: 65510 - protein, 171 aa, Lentisphaera araneosa HTCC2155
MNDKKNNQKDNSSDAPELDERVVTINRCSKVVKGGRNFSFSALVVVGDHKGNVGVGLGKANEVVDAIKKGVNLAKAHMVNVPLHKMTLPHESTAKHSGAKVVIRPASEGTGLIAGGGMRAVLELAGYRDVLAKSLGSNNAMNVVHATMKAIQQLESRDEILTKRGLKKENA

SEQ ID NO: 65511 - protein, 338 aa, Arabidopsis thaliana
MADKKIRIGINGFGRIGRLVARVVLQRDDVELVAVNDPFITTEYMTYMFKYDSVHGQWKHHELKVKDDKTLLFGEKPVTVFGIRNPEDIPWGEAGADFVVESTGVFTDKDKAAAHLKGGAKKVVISAPSKDAPMFVVGVNEHEYKSDLDIVSNASCTTNCLAPLAKVINDRFGIVEGLMTTVHSITATQKTVDGPSMKDWRGGRAASFNIIPSSTGAAKAVGKVLPSLNGKLTGMSFRVPTVDVSVVDLTVRLEKAATYDEIKKAIKEESEGKMKGILGYTEDDVVSTDFVGDNRSSIFDAKAGIALSDKFVKLVSWYDNEWGYSSRVVDLIVHMSKA

SEQ ID NO: 65512 - protein, 1121 aa, Streptococcus suis
MIPIQQHGKRWLILTLTLSTSVLALASIGTSQPVVFADENSHSQSPKNTNKIEVLNWEAFSKKLKDYSSDQRQFHVLKLGFENRLGTLSTREELEEFGKNNNFLVINGKVTQNIHDFPHILVMNKGDVIAHNEEDYHNQMRELRFSGNGDLHNSMEPKRIHALFKIELDSNKRQLLNAAGLGTAENSLKNINGMTIYSHGLTVDNKYYEDYSKYTHNSVKNINVTKERFIANDDLIHKLIESSEAMKQSSERDKVKAFVQYVANHTTYDWEAANKAVQNYADINYYLGSDLFAVTERQKAMCVGFSTTAARAFNMLGLPAYVVVGKNAEGVPHATARVYYDKKWHTIDGTGFITGNKHQRSAKYSEKHFSTIGEDSYDVVEAGQEPKAERNYMIIDSNYESWAMKQKTADLLLFNKEKSLVGLDYIAYVEPTYITENKKNHLLDIYKALKRKVEETKATDKDDKDDKQEGYDRVLQFVNSDIDKLSALSKITEEEFKALENSMDLARVFLGQMNAKAGKEFSEGETYQSYLKNRQKNNTNSDDDRNRNELQENQANSDEVSQNSKDASAPSVNSAQQSEELEGTPSTQETISAAPSQQTPAAPKALQAKTELEDKTETSSLGNTEMVSPSSETAQNTVDSKEESDAKLPYVEPSSKESSEAQVNTVSSPQVSSASPTSSETISTDTVTASQEKAESRVSAPQVISASQTSPETNSAEVVTTSQEVAKAPVSAPQVSSEIQTLSETAPTEVATEAPELSALESNPAPQTSLETTPTEEVTETPEPSVVESNSASPTSPETNSAEAVTTSQEMAEPSVSAPQVSSEIPTSSETAPAEVATEVSEESSSASQPSPETTPTETVTTSQEVAEAPVSAPQVSSEIPTSPETASTEVVVAKQEVADSPVSAPQVISEIPTSSETAPAEVATEVTEPSVVASSSASPTSPEANSTEVVVAKQEVADPLVSAPQTSSASLTLEVPKNEHLDEKADATTPNGVEANTHEAVSVPTSDIRVQDAGSDTVPQPYSLSATLFEEAISTVEPVGVATSSQERSAVAGKVKVTTSLERSNNSVEEEKVVDSNATIENREPEKKEILTSENVLNSLVTIWVALSTSFFMRYFSRGK

SEQ ID NO: 65513 - protein, 62 aa, Oryza sativa
AELRFFHFSLVTVPQGSLCNLNLKFKAGLPPDAVYNIIIDPENKRVFKNIKVCISKFLNRIV

SEQ ID NO: 65514 - protein, 196 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGV

SEQ ID NO: 65515 - protein, 472 aa, Mycobacterium sp. MCS
MNRRGKIVCTLGPATGSDDAVRKLVEAGMDVARLNFSHGDYPDHEANYKRVRAASDHTGRAVGILADLQGPKIRLGRFADGPTVWAEGETVRITVDDVEGTHDRVSTTYKRLAEDATPGDRVLVDDGNVALVVNAIEGNDVVCEVTEGGRVSNNKGMSLPGMNVSAPALSEKDIEDLEFAVRLGVDLVALSFVRSPADVELVHEVMDRVGRRVPVIAKLEKPEAIDNLEAIVLAFDAIMVARGDLGVELPLEEVPLVQKRAIQMARENAKPVIVATQMLESMIENSRPTRAEASDVANAVLDGADAVMLSGETSVGKYPLEAVRTMARIIIAVEENSVVVPPLTHVPRTKRGVISYAARDIGERLDAKALVAFTQSGDTVRRLARLHTPLPVLAFTALPEVRSQLALTWGTETFIVPQIGTTDGMIRQVDKSLLELGRYKRGDLVVIVAGAPPGTVGSTNLIHVHRIGEDDV

SEQ ID NO: 65516 - protein, 502 aa, Mycobacterium sp. MCS
MADPTGFLKVPKVEAAKRPVDERVGDWHEVYERQSLPERAEEVSQQARRCMDCGIPFCHSGSAGCPLGNLIPEWNDLVRRGRWDAASERLHATNNFPEFTGRLCPAPCEAACVLSISEDHTGGSVTIKRIENTIADQAWALGLVDPQPASIRTGRRVAVVGSGPAGLAAAQQLTRAGHDVTVFERDDRIGGLMRYGIPEYKLEKRTLDQRLAQMRAEGTRFVTECEVGVDLTVEQLRERHDAVVLAVGALRARDNDVEGRHLDGVHLAMEHLVPANKECGGDGPSTLSARDKHVVIIGGGDTGADCLGTAHRQGAASVTQLDYNPEPPETRDDTRTPWPMWPLVLRTRLSPAHAEGGQRRYQVAVQRFLGDEQGRVRGMEIAEVKVERDAEGRRQIVPVGETLEIPCDMALLAIGFEGVEHMPLLDGLGLSLNNRGALPCGSDWQTDAPGVFVCGDAHRGASLIVWAIAEGRSAAHAVDAYLMGESDLPAPVRPGALPLAVV

SEQ ID NO: 65517 - protein, 300 aa, Myxococcus xanthus DK 1622
MASKTSKVEPLIRKCVIPAAGLGTRFLPATKAVPKEMLPIVDTPTLQYIVEEAVSAGIEDVVLINGRGKGAIEDHFDIGFELETTLRARGKDSEADKLRAIADLVRVVSIRQKEPKGLGHAVLCAKSVIGDEPFGVLLGDDMIDAEEPGIRQLARVYRQYNQAVIALMEVPESETHMYGIAAGTDLGDGVMRIDRIVEKPKKGTAPSNLAVIGRYVLPPDIFPILENQTPGVGGEIQLTDGLATLQQSKGLLGYRFKGQRYDAGDKVGYLKANIAYALKRPDLRAGLLEYMREVVKTEKP

SEQ ID NO: 65518 - protein, 405 aa, Vibrio cholerae O1 biovar eltor str. N16961
MSGAAPTPASLSPFKVRSPMSELIQNVTTTFAQLFGYDATHLVQAPGRVNLIGEHTDYNDGFVLPCAINYQTVVAAAKREDFLVRLVAVDYDNDTDEFDLREEIAFQPKKMWSNYIRGVIKCLIERGFEFNGADIVVSGNVPQGAGLSSSAALEVVIGQTFKELYQLKISQAEIALNGQQAENQFVGCNCGIMDQMISAQGQANHAMLLDCRSLQTEAVAMPEQMAVVILNSNKKRGLVESEYNTRRQQCEAAAKTFGVKALRDVTLAQLTAKQAELDPVVAKRARHVITENERTLHAAQALREGNMPRLGELMAASHASMRDDFEITVKEIDTLVEIVQSVIGDQGGVRMTGGGFGGCVVALVHPKQVEAVQQAVAEHYEAATGLKASIYVCHATSGAGLVELA

SEQ ID NO: 65519 - protein, 205 aa, Escherichia coli
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSI

SEQ ID NO: 65520 - protein, 412 aa, Rickettsia sibirica 246
MKENFNVSKLKNGLTILTYNMPYVNSVAINLIAKVGARYENAEEDGISHFLEHMAFKGTKTRTAKQIAEAFDSIGGHFNAYTGHENTVYYARVLSENCDKALNILADIIQNSIFSDEEIAKEYQVIMQEIAHHQDNPDDLVYEKFYNKVYREQPLGKSILGTAKTLATFTKEHFFNFIDKHYNAENLYLSIAGNIDHDKIVIIAEQLFSSLKQGVKSSFIPAKYIGGNGFINKELEQTSLVLGFEGTSYINLEKLYQTHLLSIIFGGGMSSRLFQSIREKLGLAYAVGSYNSAYFDSGVFTIYASTAHDKLELLYREIKNEIIKMTEQVSTEEILRAKTQIRSNLQMAQEKNTYKSEEIGKNYSVFGQYISPEEIMEIIMSIKADDIINTANKIFSGTTTSAIIGPNDLQGF

SEQ ID NO: 65521 - protein, 188 aa, Shigella flexneri
LKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGF

SEQ ID NO: 65522 - protein, 266 aa, Bacteroides thetaiotaomicron VPI-5482
MKITIIGAGNIGSAVAACLAKGHLYNEKDIIISTPHTDKLENLHKQFPAIRIMTENQYAISEADIIILAVKPCIVDEVLSPLRFSRTQILVSLVTGISISHLAHLSETEMPIFRVVPNIAITEHSSLTLITSRKAGKEHQQLIKQTFEEGGKCLFAEEKQLDIISALTSSGIAFALKYIHAAMQAGIELGISAEDAMRMTAYSMEGATELILNHDTHPLLEIEKAATPGGATIKGLNELEHRGFTSAVIHAIKSSATVSTDKETEE

SEQ ID NO: 65523 - protein, 604 aa, Ostreococcus tauri
MSLGRAARAATGTAVAITATALAVRGFALSSDDELPRDPWSEQGRPLPTRAETIASLKRARTTPHDVLIIGGGATGSGCALDAATRGLSVVLVEGEDFGAGTSGRSTKLVHGGVRYLEKAVFQLDPGQLKLVFEALQERRRLLANAPHLTRALPIATPCYEWWEVPYYWAGMKAYDLVAGSQGLTMSSYARASTVSRMFPQLAETRLDIGRRSMKGAIVYYDGQFDDARMNVALACTAAHAGAAVVNHTKVIKFYKDGDKIVGVRARDMLTGSEYDVYAKVVINASGPFTDEIRKLSDNEAQKIMTPAAGTHLTLPAYYCPSDLGMIIPKTKDGRVVFVLPWLGACVAGTTDTLSEVTMTPSATKDEIDFILESIAPFLKVEARRADILSAWSGIRPLAADPGAKNTENMSRDHVIAVEKDGMVTVTGGKWTTYRRMAEEAVDKAVEIAGLAGEAGKCRTLSMGVVGAHGYTNDLFVRVAQRGGSGFGGPPDEAVAKHLATSYGDRALVVADLAAYSHLSKRLVPNHPIIEAEVVYAARAEYCQTAVDFLSRRTRLAFLDVEAAEKSLPRVVSLLGTELNWSYMRRRRELANAKAFLSTFRAAT

SEQ ID NO: 65524 - protein, 371 aa, Ipomoea purpurea
MLSTITATVPSRVERLAGSGIQRIPKEYIRPEEERRSIRDIFEEEKIAGGPQVPTVDLKGINSEDLEVREKCREELRKAAVDWGVMHLVNHGIPEELTGRVKAAGEGFFGQPIEEKEKYANDQAAGNVQGYGSKLANNASGQLEWEDYFFHCIFPEDKTDLSIWPKNASDYIDATREYAKQLRALATKVLAVLSLGLGLEEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNREKVRVSWAVFCEPPKDKILLQPLPETVSEAEPPRFPPRTFARHIKHNLFRQSDQEAAHTPKPDNDDDHQSN

SEQ ID NO: 65525 - protein, 252 aa, Ostreococcus tauri
MSVGASVKKLEQNAYAAILKAMAVTGLTWEREEFLGRLRLELNVSSEDHMRLREQMDSDENVSRLRHGYAEHRDTQEAKRQRVDAAAAYGSVASRAAPRRKPQHSSVRAPKMTPAQLVAIGVNEYICKKCKRFWPSEGGWFDCVITDYNPETKQHCLTYDINTPNESYEWADISTFTKTEFKIEEGRVDINELQAFTQGPAPSPGAPVDNFVAAASKAKDPQKFEAVKSTLTAEEEALRQQLAALEDSDDED

SEQ ID NO: 65526 - protein, 509 aa, Zea mays
MSTIAASRRSSSSSSSATAKRPAIADGPGGPKATAAQAKKRVALGNITNVAARGGRASVGGSLGNVMAPTSSAKLNPTVPLKKPSLATSARSVSSSIRGSADKPASIKPAPPVARHGSATQRHNNVPPPKVPTIADVPSRAPALVSCTGLVSPGRSGDSVSSDETMSTCDSMKSPDFEYVDNQDTSMLASLQRRTSEHLRISEDRDVEENKRKKNAVAPMEIDRICDVDSEYEDPQLCATLASDIYMHLREAETKKRPSTDFMETIQKDVNPSMRAILIDWLVEVAEEYRLVPDTLYLTVNYIDRYLSGNEISRQRLQLLGVACMLIAAKYEEICAPQVEEFCYITDNTYFRDEVLDMEASVLNYLKFEMTAPTAKCFLRRFARAAQACDEDPALHLEFLANYIAELSLLEYSLLSYPPSLIAASAIFLARFILQPTKYPWNSTLAHYTQYKPSKLSECVKALHRLCSVGSGSNLPAIREKYSQHKYKFVAKKQCPPQIPTEFFRDTTC

SEQ ID NO: 65527 - protein, 921 aa, Oryza sativa
  misc_feature (23)..(23): Xaa can be any naturally occurring amino acid
MKKSLQKSLRDPMVKSFDQGLPXWEAAFVVTLSLLFCIHGQLDNLGFISIDCGYITRPSYPDFKTNLTYVADVGFTNTGFIHTVDVGNLQRDLAQRYTTVRYFPNGTRNCYTLKQLTRGGKYLVRATFGYGNYDAFNSPPAFDLYLGANYWVKVNITNSSRAYVHETIAVSPSEFLQVCLVNTGSGTPFISGLDLRPMWHNVAQSLVLLSFFRETVSFGFNRFHFGTDEHHIRYPVDRYDRFWQRYEDIPGWEDVPDKINGTVKSPQNDTYGAPSDLMRSASTAVNASRMDLPWSSDASMDVGIGPEYIVVLYFAEVQAISDNLLRQFLVSVDNTPLAAAFSPRHMLADVFSGTVLGSDQHSISLITTIISDLPPLISAMEIFLGRTLNESSTGSSDAIAMMTIQTKYSVKRNWEGDPCAPEAFVWDGLSCIHTSIGDIQYNPRGLHRITALNLSFSELIGDIDASFGQLLLLRHLDLSYNNLSGSIPDFLGQMPLLTFLDLTGNNPNLCGNHTCDPISNKNKRNKFIGFVIAAAIVATVFALSLSALFIWYRRRKTNPDVLPEADPYKSRRFKYKELQVITNDWRNVIGEGGFGHVYAGQLEDVTDVAVKVESQTSLRGNHKQFLAEVQHLTRVHHKNLVSLIGYCNDKKHRCLVYEYMDGGTLEGRLRGREDPPEPPLTWLQRVNIALGSANGLNYLHTMCSPRLIHRDVKAGNILLTANLEAKISDFGLTRPSIHGTVETRTITQLAGTPGYMDPESLQASHPSESNDVYSFGVVLMVVITGRTAIVTINGTEKNLAQCVRDWLSSGRGIEAIADPMIRDDCNLSSVEMVAQLALDCTEPAGQDRPTMADVVTTLTESLQLEMSWSSPHSMRSSTTISSSAGFTGSGRADHDAAADSIAVLQVEQAVVETSTRYVTCE

SEQ ID NO: 65528 - protein, 430 aa, Robiginitalea biformata HTCC2501
MAQYKKNSLSLTGAVSLGTGVMIGAGIFALLGQVAELSGQWFPIAFLVGAIISGFSAYSYIKMSNAYPSAGGIANYLKKIYGKSALTASGALLMAFSMVINESLVARTFGSYTLQLFDVGDDSIWVPILGVLLLVVAFLINISGNNVIGKSSLVMAILKIGGISIFAIGGLWAAGYSFGEVLPSGDLGEYPITSYLGALALSILAYKGFTTITNSGDEIVNPNKNVGRAIIISLGICTLVYLLVAFAVSSNLSIEEIIKAKDYSLAEASKPAFGKYGLWFTVGIAIVATISGVVASVFAVSRMTAMLTDMELIPHNHFGMSGGIQRHMLVYTVVLAITLTVLFDLTRIASLGAILYLIMDIGIHWGILKNLKKEIKANTYIIATAIFLDFIVLGAFLYIKALSDILVVVVAAVLMVLIFTGEKWFLKRKD

SEQ ID NO: 65529 - protein, 339 aa, Pichia pastoris
GCVKDRIALRMVEQAEKEGRIKPGYTLIEPTSGNTGIGLALVGAVKGYRTIITLPEKMSNEKVAVLKALGAEIIRTPTEAAWDSPESHIGVARRLEKEIPNAVILDQYGNVNNPDAHFYTTGAEIWDQTNGKVTHGVAGAGTGGTITGIAKFLKSKNPNIQIIGADPHGSILALPESLNTSNEQYKVEGIGYDFIPEVLDREIVDTWYKTDDKDFFKLARQLISEEGILVGGSSGSALSAAVKIINDAKLDESAVVVVVCPDSIRSYLTKFADDDWMKLNGFTEDEPAPLKRKSSFSKDTLSSYTIKDLALKPVVSVTIDDSIESTINILQTKGFDQPP

SEQ ID NO: 65530 - protein, 299 aa, Oryza sativa
  misc_feature (190)..(190): Xaa can be any naturally occurring amino acid
  misc_feature (221)..(221): Xaa can be any naturally occurring amino acid
  misc_feature (249)..(249): Xaa can be any naturally occurring amino acid
  misc_feature (281)..(281): Xaa can be any naturally occurring amino acid
KTWGLLAVAAASRILWIPRGCRNFGRLFQAIHPNLKSQSPFLKQPLPPQGTNFGRALGGGTLSSRSRPPSPEAGSVFFFFFLFPPSGEAGGNTNGFSNPSPNPAVHPGNGLTFGGAFAGPGNFFSGGFHFSPCNGRLSLASKGPKFAGFRPKVNKISFLTVNTSAAGGFNPEIFGGSMVLFVGRKFAEKXLPVFVITSYSTVTSFTLGFNLNKGPFKNLSXKANGCFVCSGQPSLTCFNKSWPITTANXTAKGGSVNGSPGFNFAFSGITNNKAVLTSWIXGSNLRQYSLVGFFFTLRD

SEQ ID NO: 65531 - protein, 573 aa, Staphylococcus aureus subsp. aureus MRSA252
MWDKSLVFTFFRRRFGMALSTFKREHIKKNLRNDEYDLVIIGGGITGAGIALDASERGMKVALVEMQDFAQGTSSRSTKLVHGGLRYLKQFQIGVVAETGKERAIVYENGPHVTTPEWMLLPMHKGGTFGKFSTSIGLGMYDRLAGVKKSERKKMLSKKETLAKEPLVKKEGLKGGGYYVEYRTDDARLTIEVMKRAAEKGAEIINYTKSEHFTYDKNQQVNGVNVIDKLTNENYTIKAKKVVNAAGPWVDDVRSGDYARNNKKLRLTKGVHVVIDQSKFPLGQAVYFDTEKDGRMIFAIPREGKAYVGTTDTFYDNIKSSPLTTQEDRDYLIDAINYMFPSVNVTDEDIESTWAGIRPLIYEEGKDPSEISRKDEIWEGKSGLLTIAGGKLTGYRHMAQDIVDLVSKRLKKDYGLTFSPCNTKGLAISGGDVGGSKNFDAFVEQKVDVAKGFGIDEDVARRLASKYGSNVDELFNIAQTSQYHDSKLPLEIYVELVYSIQQEMVYKPNDFLVRRSGKMYFNIKDVLDYKDSIIDIMADMLDYSPAQIEAYTEEVEQAIKEAQHGNNQPAVKE

SEQ ID NO: 65532 - protein, 411 aa, Vitis vinifera
MNALAATNRNFRHASRILGLDSKLEKSLLIPFREIKVECTIPKDDGSLATYVGFRVQHDNARGPMKGGIRYHPEVDPDEVNALAQLMTWKTAVVDIPYGGAKGGIGCTPKDLSMSELERLTRVFTQKIHDLIGTHTDVPAPDMGTNAQTMAWILDEYSKFHGHSPAVVTGKPIALGGSLGREAATGRGVVFATEALLAQHGKSIKGLTFVIQGFGNVGSWVARLIGERGGKIIAVSDVTGAVKNQNGLDIVDLLRHKEETGCLTNFSGGDHMDPNELLTHECDVLIPCALGGVLNKENAADVKAKFIIEAANHPTDPEADEILSKKGGVILPDIYANAGGVTVSYFEWVQNIQGFMWEEEKVNNELQKYMTKAFHNIKAMCQSHNCSLRMGAFTLAVNRVACATTLRGWEA

SEQ ID NO: 65533 - protein, 2619 aa, Aspergillus nidulans FGSC A4
MESAEPLEGLRGLYQDLSALSDSSLLNIDRLRVELETHIHDFRTLLDKPTKSNESRMSVLSGKITIDDVEYSVNDEFQQGTLQVADALDLDELLAALLFFKAQETSQEYDRPPVITAIINFHQRRHFLLESLRLIFQESFEVEREATQEMMQEMLAHVVEIKDGQLRNASLYTRKCLKSMEDIEKWLSLLGEQIQKASIVGQSEDQLVMEAIEHQRFTLLQQHESLGAILCYLFKGPYTSPEDLRVLLKHLRKLDRFDGVLVHYVPAIIASFVQHGSPERSGNYQEARSLNTAVISTKDGQNWAHQPFHSAVIALWLSVYSAWDYDGPSSAPPGVDLEKEAEERTKTFMTALDDGGLDLLVSICSGVSGEEWSDPARSELVTMLLRESASWLKESGSATLEADSCSPYLKTLLMENFEVFAESCIANMPDAVRRLKTEEDSQRLDQITALRDGLTSNLHRDLVEARTHLESFLLIMAFAFEGRPDAAQEFWADPDGNLYGFLQWSSKRQTVPRVSAFCELLCSISGGEDNAAAAHRFLLEEDKFMSSKFKRSASMNWAQMFAELQIYATRITEKPSTAQTIQRTRKFEPADMSEPESPVMLSCYLRLIGHLSRQSAAVRDWMLHHSSSNIVSTLLTLCSGPLPSHLRATVFQALAGLMTDRSVENGNEMWLAIDQWISSGAMSASAHNKVPLVSNPLIWHEQQAFEKIGESFDQANAFVVLILSLVAPAIDSAEYAIWVPFPESLGSSYRMPGIEPYIDFIMGQALSRKVPDLNERQSRLLTYNSLDFVLTCLRSFNETIVTALNETPATAEPNLKTSALLSYVRLHPFARVAEWLYNEDVIKTIFATANQEIADISRASPDSVLVSSLVKSIEVMCSIIDLQSTYLNIVRPFIKSQPGSRLNVANSALSAFEDCILNNLQIIPKLCLYCGTGHQELTVSSLALLAKLSSSTRLNKLSTPELSRWRSSNKIVEVLSAENLDSLSLPFISQMEPEVRELDAGPQASGYLIRHNLLELLNSSLTMIPDRPTVAHLLLGFGSVGNVLDVSSDGLFAAGRSLLHAILGFVQTYPDQLDDNIVSWMLHLKRTAFEVLKHLWSSKLSSYFTLAEMRASGFLVSLFASQPLVGPHTLWDGLPIAAEQFWVCDSTDALAEFLLYRSYLFDYATTEIRSAAKMGSPTLLESILATLFGNSTLDNGATIANPTVYDLFDFADLDVQFHAPPPNVEYLGGLNIDICEKPVEDGSLVLFNVAQVKELVKARREELLSNGELRPQDDELFMAEADNLIEFLQARNQSRLINFNRHMALSSWAELLITILKCSELDRGRKSTFILHAIQLILPKLETAIEDNLPEALDLARLAESLVESLDATPAKLMPLRRNGDLIDEKLHQLFQICLRGIILSNGGVLLKETFYNICSIYVARIVSPDTGNATMRQHSQQVVKSSGRALIEAICDDAYTGQETCRVSAVLLLNSLAALDKQADATLAESIAQSNYLSLFLDSIRVLPLELKNAPANGRIPYIPTANVANLSLTDTPLLLSYYQSLLSLLQQLCQTKPGATHVLKAGLFDAVRESHLFAADPDLGIATDIDNADALRKYYDLLDSVLRVIVTATFSRGLQNELMIEQTRAFLTENRQSMVGIFKRFAKIGGSAAPDHHDALTSIAKSYTALVAATNFLEPRLTLRNAAYVIKRGIIFISDWDRTLRRSLNPSFFVQLPAPYSIKPPYIKTSQNWKLAAMVLVMQQNSRSPPEQRSGKRKATGKRKFPDQGELSQQPRHQQATISELLHRNQAQNQAQEQDDEHLPPTNKRVRPSSSSIAANQPESGDMYSFSTAEPKPNGPNTGGLTLSNSTLQARPGTSSHQSNFTPHTGARRLVVKNLRTGPRLNQDSYFDKVWGQLDAALSAIFSGGKPEISLEELYKGAENVCRQGRATILAKRLQERCRQHVTGKLHGSLVDKAQMAYNIETLRSVVEAWKEWQSMLITVRWIFYYLDQSFLLHSKEHPVIREMGLQQFRQHIYSDPTLQEKILQGACDLVSADRSDENGIVADSSLLRNAIELFHSLDVYVSGFEPVLVSGSKDFFSLWAQQEATGYLASYVENSHRLIEREMNRCEQFSFNRTTKQKLSESLDQTLVTDQESVLLSQKDVLGLLRIGNKIALGQLYTLLERRDLGAKLKGAFSTYIVEEGTGIVFDESEADMVVRLLSFKKQLDDIWNESFRRNEGLGHALRESFESFMNKGRKSDATGGTDNPKTGEMIAKYVDRLLRGGWRLAPTREAENMPLADEDAEINRQLDQVLDLFRFVHGKAVFEAFYKNDLARRLLMGRSASDDAEKSMLARLKTECGSSFTHNLESMFKDMEVARDEMSAYNSIKRERQTPLPVDLHVSVLSASAWPTYPDVQVRIPPEIATAISDFEKFYDTKYNGRKLAWKHQLAHCQLRARFPNGNKELVVSSFQAIVLLLFNELPEGGTLNYRQIQEATTLSDQELTRTLQSLACAKYRVLSKKPKGRDVSPTDEFSYNASFTDPKFRIKINQIQLKETKEENKTTHERVAADRHYETQAAIVRIMKSRKTITHAELVAEVIKATRSRGVLEPADIKKNIEKLIEKDYMEREDGNRYQYVA

SEQ ID NO: 65534 - protein, 457 aa, Agaricus bisporus
MVLPHEPEFEQALHELETSLQPFLTTNPQYKKALEIIQVPERVLQFRVTWEDDQGKPQVNRGFRVQYNSALGPYKGGLRLHPTVNLSILKFLGFEQTFKNALTGLSMGGGKGGSDFDPKGKSDNEIRRFCVAFMSELFRHIGQDTDVPAGDIGTGAREIGFLFGAYRRLKNEFTGMLTGKGINWGGSFIRPEATGYGLIYYVEHMIAHACPEYSLDRPSTLVAISGSGNVSQFTALKVIELGATVLSLSDSKGSLISEKGYTKEAIEKIAELKLKGGALEAIVDDLGAGYTYHAGKRPWTLLPQVHIALPGATQNEVSQEEAEALVKAGTRIVAEGSNMGCTEEAIAIFENSRRASRAGVWYAPGKASNCGGVAVSGLEMAQNSQRLAWSTQEVDAKLKSIMAECYQICYTAGSRWSGEKVAEGVAEGEALPSLLSGANLAGFIKVADAMKEQGDWW

SEQ ID NO: 65535 - protein, 77 aa, Oryza sativa Indica Group
MGRRREVLDKAVAALRSHGLRAVGFEGDVRKQEDAARVVAATVQHFGKLDILVNGAAGNFLASPEDLTPKGFRTDVM

SEQ ID NO: 65536 - protein, 672 aa, Desulfovibrio vulgaris subsp. vulgaris str. Hildenborough
MQLPLLPDIVVLFCLSIGVLLVCHRVRLPAIVGFLITGVLCGPSALGLVSAVHEVELMAEIGVVLLMFTIGMELSGDELSRLRKPVFIGGTAQVGLTVAVFAGIALLHGQTLSEGILFGFLAALSSTAIVLSLLQQRAQTESPQGRIALSVLIFQDIAIVPMMLAIPLLAGTITADAKSLALSVGRTVAVLGGLVLLARYVVPPLMERVVRTRSRELLLLTTLGLCLAVALLTSSMGLSLSLGAFLAGLLLAESEYSLSVIEGVLPFRDVFTSLFFISVGMLLDVGFLFDNLGAVLAVAAALVVLKAAIATPAILLLGYPLRTCIIAALALAQIGEFSFVLARSGLEHGLLGKDAYQMFLAASIITMTLTPGLLAVAPRFARYVSTLLKSHETFDEAHGAALHDHLIVVGFGVGGKHLARVAREAGIAYTILEMNPDTVARYHGKEPIHHGDATHPLVLEHLGVRQARILAVVISDPAAVRGVTAAARALNPALHIVVRTRFLGEVTALRDLGANEVVPEEFETSIEVFSRVLTHYLVPRQTIDGFIDRIRAENYDMLRSHDLPGSTLAALEGGLPGVAVEAYTVEAGASIAGRTLLESDLRQRHGVTVVAIRRGETTLASPDGSMALLPGDVAYVFGEPTALHDAAALFSKATGDAPFAERVPSSVSETAA

SEQ ID NO: 65537 - protein, 450 aa, Laccaria bicolor
MVLPVEPEYEQALSELPNSLKPFLAANPDYGKALEIVPIPERVLQFRVIWEDDQGKAQVNRGFRVQYNSALGPYKGGLRLHPSVNLSILKFLGFEQTFKNALTGLSMGGGKGGSDFDPKGKSDGEIRRFCTSFMSELFRHIGQDTDVPAGDIGTGAREIGYLFGAYKKLQNEFVGMLTGKGLAWGGSFIRPEATGYGLIYYVEHMIAKAAPEYSLSKPETLVAISGSGNVGQFTALKVIELGATVLSLSDSKGSLIAEKGYTKEFIKEIGQLKLKGGALESLAQREGYTYHAGKRPWSLLPVVHVALPGATQNEVSKTEAEDLIKAGVRIVAEGSNMGCTEDAIAVFEESRKAGAGGVWYAPGKASNCGGVAVSGLEMAQNSQRLAWTTDQVDQKLKKIMAECYEICLSAGTKWSGEEIKDGVLPSLLSGANVAGFIKVADAMREHGDWW

SEQ ID NO: 65538 - protein, 302 aa, Vibrio cholerae
PSYSQQIVTLTYPHIGNTGTNSEDEESTAIHAQGLVIRDLPLIASNFRSEQSLSDYLKSQNIVGIADIDTRKLTRILREKGAQNGCIMAGDNLDEALALVKAKEFPGLKGMDLAKVVSTKEAYSWKQGSWTLEGGLPEAKADSELPYHVVAYDFGAKRNILRMLVDRGCRLTVVPAQTSAEDVLALNPDGVFLSNGPGDPEPCTYAIEATRVFLEKNIPVFGICLGHQILALASGAKTVKMKFGHHGANHPVKDLDRGVVMITSQNHGFAADEATLPDNLRATHKSLFDGSLQGIHRTDKPA

SEQ ID NO: 65539 - protein, 445 aa, Desulfovibrio desulfuricans G20
MNVCIVGTGYVGLVSAACFAEMGNTVRCVDVNPEVVETLKAGKVHIYEPGLEELVRRNYAEGRLQFTTSLEDGLKDSLFVFITVGTPSRDDGSCDLGFVEQVARQVGAGMTDRKIVVDKSTVPVGTADKVRAIIAAELEKRGVDIPFDVVSNPEFLKEGDAVNDFMKPDRVVVGTDSAETAEYLKQLYAPFARSREKLIVMGVRSAEMTKYAANCMLATKISFINEIATLCERVGADVRDVRTGIGSDHRIGYHFIYPGVGYGGSCFPKDVKALIHTAREYGFRPQLLEAVEDVNYRQKKHMAERILEYFAPQGGVQGKTIALWGLAFKANTDDMREAAALTIIQELTAQGMKVQAYDPVAADNARALLADNPLVTIVDEQYEAVEGAQALLVVTEWNQFRNPDFGRVRKSLTAPILFDGRNLYSPEFMAKEGFAYFCVGRPSGK

SEQ ID NO: 65540 - protein, 478 aa, Burkholderia vietnamiensis G4
MQRATKIVATIGPASSSPEILLQMMQAGLDVVRLNFSHGTADDHRQRAEMVREAARKVGREIAIMADLQGPKIRVGKFENGKTTLAPGQAFILDAGCELGNDERVGLDYKELPRDLKPGDLLLLNDGLIVLTVERVLGEEIHTIVKVGGELSNNKGINRQGGGLSAPALTAKDMEDIRTAMSLGADLVAVSFPKNATDMEMARQLANIAGAPYGIKPKMIAKIERAEAIPALQSILDASDGIMVARGDLAVEVGNAAVPALQKRMIRMARESNKLVITATQMMESMIHAPVPTRAEVSDVANAVLDGTDAVMLSAETAAGKYPVVTIETMAAVCVEAEKSEHVELDKDFLDRTFTRIDQSIAMGALFTAYHLGAKAIVALTESGATALWMSRHYTHVPIFALTPRVGSERTMALYRNVTPLHVDFNSDRDAALQAALEMIVKQGYVQHGDMVVLTVGEPMGQAGGTNTLKIVRVGEHY

SEQ ID NO: 65541 - protein, 175 aa, Oryza sativa Japonica Group
MAPTVMASSATSVAPFQGLKSTAGLPVSRRSTNSGFGNVSNGGRIKFMQVWPIEGIKKFETLSYLPPLTVEDLLKQIEYLLRSKWVPCLEFSKVGFVYRENHRSPGYYDGRYWTMWKLPMFGCTDATQVLKELEEAKKAYPDAFIRIIGFDNVRQVQLISFIAYKPPGCEESGGN

SEQ ID NO: 65542 - protein, 393 aa, Saccharomyces cerevisiae
MSLDRVDWPHATFSTPVKRIFDTQTTLDFQSSLAIHRIKYHLHKYTTLISHCSDPDPHATASSIAMVNGLMGVLDKLAHLIDETPPLPGPRRYGNLACREWHHKLDERLPQWLQEMLPSEYHEVVPELQYYLGNSFGSSTRLDYGTGHELSFMATVAALDMLGMFPHMRGADVFLLFNKYYTIMRRLILTYTLEPAGSHGVWGLDDHFHLVYILGSSQWQLLDAQAPLQPREILDKSLVREYKDTNFYCQGINFINEVKMGPFEEHSPILYDIAVTVPRWSKVCKGLLKMYSVEVLKKFPVVQHFWFGTGFFPWVNIQNGTDLPVFEEKEEESIEQANAGSPGREQTSTRFPTSTSMPPPGVPPSGNNINYLLSHQNQSHRNQTSFSRDRLRR

SEQ ID NO: 65543 - protein, 398 aa, Burkholderia vietnamiensis G4
MSQVKRLTDLIAAGQLAGKRVFIRADLNVPQDDHGNITEDTRVRASVPAIRAALDAGAAVMVTSHLGRPTEGEFKPEDSLAPVAKRLAELLGRDVPLVSNWVENGVNVAPGQVVLLENCRVNKGEKKNSDELAQKMAKLCDIYVNDAFGTAHRAEATTHGIAKYAPVACAGPLLAAELDALGKALGNPARPLVAIVAGSKVSTKLTILKSLAGKVDQLIVGGGIANTFMLAAGLSIGKSLAEADLVAEAKAIIDEARERGASVPIPTDVVTAKEFSPTAAATVKQVADIEADDMILDIGPDTARALASQLEKAGTIVWNGPVGVFEFDQFGNGTKTLADAIAKSSAFSIAGGGDTLAAIAKYGIHDQVSYISTGGGAFLEFLEGKKLPAVEVLETRAA

SEQ ID NO: 65544 - protein, 319 aa, Streptomyces lividans
MSGKYLVTGGAGYVGSVVAQHLVEAGNEVVVLHNLSTGFREVCRRVPRSSRRHPGRRQVRGRLSFDGVLHFAAFSQVGESVVKPEKYWDNNVGGTMALLEAMRGAGVRRLVFSSTAATYGEPEQVPIVESAPTRPTNPYGASKLAVDHMITGEAAAHGLGAVSVPYFNVAGAYGEYGERHDPESHLIPLVLQVAQGRREAISVYGDDYPTPDRPVCATTSTSPTWPRPTCWPCAAAPGEHLICNLGNGNGFSVREVVETVRRVTGHPIPEIMAPRRGRDPAVLVASAGTAREKLGWNPSRADLAIVSDAWELPQRRAGQ

SEQ ID NO: 65545 - protein, 481 aa, Helicobacter pylori J99
MVVRTQNSESKIKEFFEFCKENEVEFVDFRFSDIKGTWNHIAYSFGALTHDMFKEGIPFDASSFKGWQGIEHSDMILTPDLVRYFIDPFSADVSAVVFCDVYDVYKNQPYEKCPRSIAKKALKHLRDLGLGDVAYFGAENEFFIFDSIKIKDASNSQYYEVDSEEGEWNRDKSFENGVNFGHRPGKQGGYMPVPPTDTMMDIRTEIVKVLNQVGLETFVVHHEVAQAQGEVGVKFGDLVEAADNVQKLKYVVKMVAHLNGKTATFMPKPLYGDNGSGMHTHVSIWKNNENLFGGETYKGLSEFALYFLGGVLRHARGLAAFTNASTNSYKRLIPGYEAPSILTYSASNRSASVRIPYGISKNSARFEFRFPDSSSNPYLAFGAILMAGIDGIKNKMDPGEAMDINLFKLTLDEIREKGIKQMPHTLRRSLEEMLADKQYLKEGQVFSEEFIQAYQSLKFHSEVFPWESKPHPFEFITTYSC

SEQ ID NO: 65546 - protein, 368 aa, Aspergillus oryzae
MDKIDQGSKNFEAAAPPQPRSVPSSSLSGNPVLPVLAYCGSSILMTVMNKYVLSGLDFNLNFFLLCVQSIVCIIAIQTCKFCGLITYRDFSADEAKKWFPISLLLIGMIYTGSKALQFLSIPVYTIFKNLTIILIAYGEVLWFGGSVTGLTLFSFGLMVLSSIIAAWADIKHAVESSGDTSAQVSTLNAGYIWMLINCLCTSSYVLGMRKRIKLTNFKDFDTMFYNNLLSIPVLVVLTGLMEDWSSANIDRNFPQADRSSIMFAMILSGLSSVFISYTSAWCVRVTSSTTYSMVGALNKLPIALSGLIFFDAPVTFPSVSAIAVGFVSGIVYAIAKIKQNAKPKTGVLPTSNPLVSASSQSMRDSLRS

SEQ ID NO: 65547 - protein, 315 aa, Mycoplasma synoviae
MKKKIAINGFGRIGRLVLRRMLETSLTDKVEVVAVNDLTDAKTLAHLLKYDTAFKKLQFSVEEKDSSLWVNGKEIKVFAEKDPSNLPWKDLGVDLVVESTGFFTKKDLASKHLGAGAKKVLISAPAGSGLPTVVYNVNHKTLKSSDTVIFAASCTTNCLAPVVKVLVEEFGLKSGYMTTVHSYTADQKLQDAPHKDLRRARAAAENIVPTSTGAAKAIGLVVPQASNVLDGIAIRVPTLTGSLVDLSVRLEKSPSVEELNAAFKKAANESFNLKTDEIVSSDIVNSHYGSVFDSKLTNFVESKGRKIIQTIRMMR

SEQ ID NO: 65548 - protein, 209 aa, Aspergillus oryzae
MRECYSLQRIVEREREYILPSLKATASISPCNGQTPDQTLAALDAMISRMQGLKRKMENLHQEERKIHDQSRKRIEHLENLHQIHSLADVKYDQWSRVRLDRLVTDYMLRSGYTESARQLAHEKDIEDLADLNVFIQCQRVAESLRRGESKDALQWCSENKAALKKSQVCVQSTEIHRAAGLLAFPRDTMAEPYKVLFHIYLDQFLHLF

SEQ ID NO: 65549 - protein, 321 aa, Ehrlichia chaffeensis str. Arkansas
MKLHNVLKNNNKEDVVSNIEQFGGNADWFNAARVLSESLPYIQQFSGETFIIKYGGAAMKDRKLAENFAHDIVLLKQLGINPIVVHGGGSKINEFLEKINKKSTFVNGLRVTDAETLEIVEMVLCGLVNKDITQLINKAGGNAIGLCGKDANLIEAKKVCYTYKENQSNNVEKILDMGFVGEPHEVNTDLLFFMEESDFIPVIAPVCSGENDLTYNVNADLVAGALANALAAAKLIILTNVPGVTDVNGNLLSEISVSNAESLIEQGIANAGMIPKLQTCIKVVKEGYGSAHIIDGRIPHVLLLELFTIHGTGTMVLNTDI

SEQ ID NO: 65550 - protein, 207 aa, Shigella boydii
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 65551 - protein, 606 aa, Zea mays
MDTHIGSVNGAASNQTVGCPASAPGCPMASTPAQPAATLSAGEASLGRHLARRLVQVGVNDVFAVPGDFNLTLLDHLIAEPGLRLVGCCNELNAGYAADGYARARGVGACAVTFTVGGLSVLNAIAGAYSENLPVICIAGGPNSNDYGTNRILHHTIGLPDFSQELRCFQTVTCHQAVVNNLDDAHEQIDTAIATALRESKPVYLSISCNLPGLPHPTFSRDPVPFFLTPRTSNKMGLEAAVEATVEFLNKAVKPVLVAGPKLRVAKAGKAFVDMVDASGYAYAVMPSAKGLVPETHPHFIGTYWGAVSTAFCAEIVESADAYLFTGPIFNDYSSVGYSFLLKKEKAIIVQPERVIVGNGPAFGCVMMKEFLSELAKRVNKNTTAYENYKRIFVPEGQPLESEPNEPLRVNVLFKHVQKMLTGDSAVIAETGDSWFNCQKLKLPEGCGYEFQMQYGSIGWSVGALLGYAQGANHKRVIAFIGDGSFQVTAQDVSTMLRCEQNSIIFLINNGGYTIEVEIHDGPYNVIKNWNYTGFVDAIHNGEGKCWTSKVKSEEELTAAIETALGEKKDCLCFIEVIAHKDDTSKELLEWGSRVSAANSRPPNPQ

SEQ ID NO: 65552 - protein, 306 aa, Aspergillus oryzae
MEHITVTFLGPAASFSHQAAVEFFGKSAELLPCVSFTDAFTAVQQGEADYAIIPCENSTNGPVVQTLDLLADPNGFYEDVEVCGVHYLTVHHCLLARRGVFSSQQDYGSVAKLYTHPQAWGQCERFLGKYFRSIERQDVSSTSKAGEIVSKAKTEQSAAIASRFAAELHGLDVLEENIEDKTDNTTRFLVLRNKNSGRTAPRPFGDLDNRRVQGASAATARKTLISFMVRQYAPGALAEALLIFKRHGMNLTSINSRPSQKKNWQYVFLVECQTADNPGDKGVGIEILSHLQSVTETCRHLGTWSE

SEQ ID NO: 65553 - protein, 968 aa, Oryza sativa Japonica Group
MPCSPPSYLFIIVTGVLLVLVHSQTSLGNPLKMAGKNQITIICPQKITGAKSCYDQYFGKFLVVTDFVTRKQIKVDQRNNLGKQRLFSNGTYFHISVDEDFISIDCGLPSGFSYVDEKTNITYISDDQYIDTGENHNISSQLQGAEQFRSGLNLRSFPTGGRNCYTLYPAIKGQKYLIRGMFMHGNYDNKGQDLVSSPVTFDIRIGLNFWNRLNIINATMTYTSEAIVVAIVNSVSVCLVDNGEGTPFISSLEMRPMKSSNYPAATPNHPLLLQDRRSMGASRIIRYPDDPYDRVWWLPQITSGLIKISTRSLISRYTDDVYEVPVAVLKTAATTSSTSTALNFLWAAPTGWDATPGYLIGLHFTDFQQGQLREFDIYYNNDLWNYDNKKTKPPYLLANYINGTTPYTSDNYLYNISLVATNASVLPPMLNAIEIYYQVQQDEKMTYSEDVEAMMTVKIDYQVKKNWMGDPCLPEKYTWSGLKCRSQGVTSRIISLNLSNNDLTGSLPESLTNLPNIHVLDLSGNQLNGTFPEALCKNRALTLRYDTANGDPCSPRSSKKKHKAVLAVAVVVPVVIVVILISAMLMLLFWKKQAIVKSRGQEQYGDHIHIPENREFTYEELVKITNNFSVFIGEGGFGPVFHGQLKDGTQLAVKMRSPTSMSGKGMPEFLAEVESLTTVHHRYLVLLVGYCTDQDHLGLVYEYMPNGSLYDHLRGKNAIIQRLSWQHRAKIAHEAAQGLDYLHTGCVLPIVHRDVKSHNILLGCDLTAKISDFGLSKSYLNVAQSHITATAAGTLGYIDPEYCLSGRLTISSDVFSFGVVLLEIVTGEPPIIPTNGHIVQRIKEKVNMGNIEAIADPRLHGEFDISSIWKVVDIALLCTKEASSERPTMSMVVAQLKDALALEEARLSYSTSDISQGGANAELSINSMPTASLSNLEEYAKKSLLPAVALFALCLHGVSDKSGDIAST

SEQ ID NO: 65554 - protein, 714 aa, Pseudomonas fluorescens Pf-5
MTDAIRYEKGQDQIVVLTIDMPGQSANTMNALYRDAMAGAVARLQAERESIAGVIITSAKKTFFAGGDLNELIKVGRPEAKAFYGMVLALKGQLRALETLGKPVVAAINGAALGGGWEICLACHHRVALDDKSVQVGLPEVTLGLLPGGGGVVRMVRMLGLEKALPYLLEGKKVRPQQALQAGLIDALATDRDDLLAKARAWILANPGAQQPWDVRGYQIPGGTPSNPKVAQMLAIAPSILRTKTQGCFPAPEKILCAAVEGAQVDFDTAQLIETRYFTELTTGQVAKNMIGTFWFQLNQINAGSSRPQGVPPQVTKKLGVLGAGMMGAGIAYVSAVAGIEVVLKDISPEAAEKGKAHSAALLEKKVARGQLSREQRDATLARIRTTAEDADLAGCDLIIEAVFEDRELKAKVSRAAQQVVGGDAVIASNTSTLPITGLATAVPNPDKFIGLHFFSPVEKMPLVEIIKGAKTSDETLARGFDFVLQIKKTPIVVNDSRGFFTSRVFGTFTNEGIAMLGEGIAAPMIETEARKAGMPVGPLAISDEVSLSLMSHIRQQTAKDLQAEGKPAIEHPAFAVIDLLLNEYKRPGKAAGGGFYDYPAGAQKHLWPQLRTRFYKADGQISPQDVRDRLLFVQAIETVRCVEEGVLHSTADANIGSIFGIGFAAWSGGALQFINQYGVQDFVARAQYLAEQYGERFRPPTLLLEKARLGQLF

SEQ ID NO: 65555 - protein, 208 aa, Shigella flexneri
LRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQG

SEQ ID NO: 65556 - protein, 152 aa, Bdellovibrio bacteriovorus HD100
MEKVQAQAAELEERVVAINRVTKVVKGGRRFSFAALVVVGNKAGDVGFGSGKAGEVPEAIGKASRSAKKSAKSVALKEGRTIPHEVIGKFGAAKVIMKPAAPGTGVIAGGAVRAVLESVGVKDILTKCVGTRNPHNAVRATIDGLKQLKQQL

SEQ ID NO: 65557 - protein, 204 aa, Shigella boydii
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFS

SEQ ID NO: 65558 - protein, 229 aa, Pseudomonas fluorescens Pf-5
MSELISYHLEDGIATLTLSNGKVNAISPDVIAAFNAALDQATADRAVVIITGQPGILSGGYDLKVMTAGPKEAVALVTLGSTLARRLLSHPYPVIVACPGHAVAKGAFLLLSADYRIGVEGPFSIGLNEVQIGMTMHHAGIELARDRLRRSALHRSVINGEMFDPQSAVDAGFLDKVVAPDELQGAALAAARQLKKINMVAHKNTKLKVRKALLDALDNAIIQDQEHLG

SEQ ID NO: 65559 - protein, 208 aa, Shigella sonnei
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGT

SEQ ID NO: 65560 - protein, 202 aa, Shigella sonnei
KARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQ

SEQ ID NO: 65561 - protein, 565 aa, Geobacillus kaustophilus HTA426
MEGGSRTERLRRIGLFTAINKTRHPTLLQPNKRDGTARSIKTRRGNKEMKETANQQDTLAAELEKRAAEIKKGGAPKYHEKNAAQGKLFVRERLNLLLDNGLEVEDGLFANCLAGDLPADGVVTGIGKINGRTVCVMANDSTVKAGSWGARTVEKIIRIQETAEKLRCPIIYLVDSAGARITDQIEMFPGRRGAGRIFYNEVKLSGKVPQVCLLFGPSAAGGAYIPAFCDIVIMVEGNASMYLGSPRMAEMVIGEKVTLEEMGGARMHCTVSGCGDVLVKTEEEAIAYARRYLSYFPSNYSEKPPVVEAKPPKSFDKTIEDILPENQNAPFNMYDLIERIIDEGSFCEIKKLFAPEIITGLARLAGQPIGIIANQPRVKGGVLFHDSADKAAKFITLCDAFHIPLLFLADVPGFMIGTKVERVGIIRHGAKMIAAMSEATVPKISVIVRKAYGAGLYAMAGPAFEPDCCLALPNAQIAVMGPEAAVNAVYANKIAELPPEERAAFVEQKREEYRRDIDIYRLASELVVDGIVAPNDLRNELIRRFDAYMSKYMVFSERKHGVYPV

SEQ ID NO: 65562 - protein, 511 aa, Bacteroides thetaiotaomicron VPI-5482
MEEINKAYAMFQERDRIASLGGGVEKIEKQHESGKMTARERIEMLLDKGTFVELDKLMVHRCTNYGMDKNKIPGDGIVSGYGKIDGRQVFVYAYDFTVYGGSLSASNAKKIVKVQQLALKNGAPIIALNDSGGARIQEGIESLSGYADIFYQNTMASGVIPQISAILGPCAGGACYSPALTDFIFMVKEKSHMFVTGPDVVKTVIHEEVSKEELGGAMTHSSKSGVTHFMCNTEEELLMSIRELLSFLPQNNMDETKKQNCTDETNREDAVLDTIVPADPNVPYDMKDIIERVVDNGYFFEVMTNFAKNIIIGFARLAGRSVGIVANQPAYLAGVLDIDASDKASRFIRFCDCFNIPLITFEDVPGFLPGYTQENNGIIRHGAKIVYAFAEATVPKLTVITRKAYGGAYIVMNSKQTGADVNFAYPSAEIAVMGAEGAVNILFRKADAETKGKELEAYKEKFATPYQAAELGFIDEIIYPRQTRKRLIQALEMTENKMQTNPPKKHGNMPL

SEQ ID NO: 65563 - protein, 261 aa, Geobacter metallireducens GS-15
MGKLAGKVAIITGGSRGMGRATVEVFTKEGARVIIADVLDAEGTALAQEMGDGAIYRHLDVSDERGWGDVARSAIDSFGRIDILVNNAAIFLYALIDETRSEAFRRLLDINVIGPYLGMKTVIPIMKKQRSGSIVNVSSTDGLRGSCGMGAYNASKWGVRGLTKCVAMEVGPFGIRVNSLHPGTVDTPMFNPHGLDRDALNASFGKQFPGVSLSRVGDPSEIARASLFLASDDASYVSGAELAVDGAWTCGVYLQEKPEPN

SEQ ID NO: 65564 - protein, 517 aa, Sorghum bicolor
MDVPLPLLLGSLAVSVVVWCLLLRRGGNGKGKGKRPLPPGPRGWPVLGNLPQVGSHPHHTMCALAKEYGPLFRLRFGSAEVVVAASARVAAQFLRAHDANFSNRPPNSGAEHVAYNYQDLVFAPYGSRWRALRKLCALHLFSAKALDDLRGVREGEVALMVRELARHQHQHAGVPLGQVANVCATNTLARATVGRRVFAVDGGEEAREFKDMVVELMQLAGVFNVGDFVPALAWLDLQGVVGKMKRLHRRYDDMMNGIIRERKAVEEGKDLLSVLLARMREQQSLADGEDSMINETDIKALLLNLFTAGTDTTSSTVEWALAELIRHPDVLKKAQEELDAVVGRDRLVSESDLPRLTYLTAVIKETFRLHPSTPLSLPRVAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTAYKLDMEEAYGLTLQRAVPLMVRPAPRLLPSAYAAE

SEQ ID NO: 65565 - protein, 257 aa, Geobacter metallireducens GS-15
MHVSELFSLKGKTAIITGGSRGLGLMMAEGFAEAGASLVLCSRNLEQCEDAAANIRKLGVECDALRCDIGEQDEVKAVVAHTMNRFGKIDILVNNAGISWGGELQDTPLKKWDQLYSTNVRGNYFFTTEVVSPMIAGGGGNIINIVSIGGVRSTDPKVVTFPAYASTKGAIIALTKHLSRNWAKHNIRVNAIAPGIFPTEISKTLMVGPQKAVMEAAVPLGRLGEKDDFKGAALFLAADASRYVTGSVLWVDGGMLA

SEQ ID NO: 65566 - protein, 409 aa, Desulfovibrio desulfuricans G20
MRILVQKFGGTSVANLECMQQVKQKVLHARENGYKVIAVLSAMSGETNRLLNMAGQWSQCPDEAEVDALISTGEQVSVSLFAMLLQNEGIKARSVLGFQIPLKTNTAYSRARILDIRKDTLVELLEAHDVLAVAGFQGINDDNRITTLGRGGSDTSAVALAAALGCECEIYTDVDGVYTTDPNMCSAARKLDRISYDEMLEMASMGAKVLQIRSVEFAKKYKVPVRVRSTFTNDSGTLLTQEDSQMEAVMVSGIAYDKDQARITLRGVPDTPGVAASLFCPLADAGIVVDMIVQNPSLDGVTDMTFTVPRKDLTRALELVEKTRAEVGAKEVLHDLNVCKVSAIGVGMRNHSGVASKTFATLRRENINILMISTSEIKITCLIEEKYTELAVRTLHDAFGLDKDQSQAG

SEQ ID NO: 65567 - protein, 541 aa, Vitis vinifera
MEAVVSLLSILQGKRLFVGLEDRVLWNASKNEIFFVKSLYNTLDSSGSVPFPWRIIWSPCVPTKVLGIPERAVKPALKKLLDLYDGNWELIEAENYRALADAIFEYEEAKGLEDNEGAVSCDESEPPLKRSHRGQQENQVSSRMERSSTMWLPEKGEIAPKNFRQERMDSSRSSLKDRRRVTSSDSCREQFDDKKKCTTSSEIAAKDVKSTSERASSTVHFKQPMGGSNGALIIGTSKKGLNKMELRSSSDSFGLDVDSSQALTFCKRRSIHDINDITKGAENVKISLVDEIGSEGLPNFFYLPENTIYQNAYLHFSLARISDEDCCSSCSDNCLSSLVPCACARETAGEFAYTPRGLLKRNFLDTYISMSKEPQKHHYFYCEDCPLERSKNQYLPDPCKGHLVRKFIKECWRKCGCSMYCGNRIVQRGITFKLQVFMTHEGKGWGLRTLEALPKGAFVCEYVGEILTNMELYERNKQSNGNDRHTYPVLLDADWGSEGVLKDEEALCLDATFYGNVARFINHRDIDDSTAALHFDDEFFK

SEQ ID NO: 65568 - protein, 517 aa, Sorghum bicolor
MDVPLPLLLGSLAVSVVVWCLLLRRGGDGKGKGKRPMPPGPRGWPVLGNLPQLGSHPHHTMCALAKKYGPLFRLRFGSAEVVVAASARVAAQFLRTHDANFSNRPPNSGAEHVAYNYQDMAFAPYGSRWRALRKLCALHLFSAKALDDLRSIREGEVALLVRELSRHQHQHAGVPLGQVANVCATNTLARATVGRRVFAVDGGEEAREFKDMVVELMQLAGVFNVGDFVPALARLDLQGVVGKMKRLHRRYDDMMNGIIRERKAAEEGKDLLSVLLARTREQQSIADGEDSRITETEIKALLLNLFTAGTDTTSSTVEWALAELIRHPDVLKKAQEELDAVVGRNRLVSESDLPRLTYLTAVIKETFRMHPSTPLSLPRIAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLKVRPAPRLLPSAYAAE

SEQ ID NO: 65569 - protein, 581 aa, Oryza sativa Indica Group
MAAPNGGRGGRRLLGNRARRGGAILLGIAGEAADGVEPVLANDLLPCTADCRPPLLSLPPIGRRAREPLARTTAAMVLHHFSVEGVVAFGGGGVAVRERRKLTTMAFCAGLNFPYHTTVTRMSPRSTAPPWVCFIVQTPKLIKARISPSTVCHITGGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQALPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWGVAQIFGAECKKRGMLVKVVGDEIAMSPPLIMSQREVDGMKIALSVILNCFQLVSIYGEALKATEERVAELRSKKK

SEQ ID NO: 65570 - protein, 478 aa, Oryza sativa Indica Group
MPELCAVLSLSQTSDITTAVKAINLLKYVTSTGSLQGHTQNLCDASTRHFSSVPSPQSNSTEENGFKGHGMLAPFTAGWQSTDVHPLVIERSEGSYVYDIDGKKYLDSLAGLWCTALGGSEPRLAKAATEQLHKLPFYHSFWNRTTKPSLDLAKELLSMFTAREMGKVFFTNSGSEANDSQVKLVWYYNNALGRPDKKKFIARSKSYHGSTLISASLSGLPALHQKFDLPAPFVLHTDCPHYWRFHLPGTLNCKFTIAAFIAEPVMGAGGVIPPPKTYFEKVQAIVKKYDILFIADEVITAFGRLGTMFGSDMYNIKPDLVSMAKALSSAYVPIGAIMVSPEISDVIHSQSNKLGSFAHGFTYSGHPVACAVAIEALKIYQERNIPDHVKQISPRFQEGVKAFAGSPIVGEIRGVGLILGTEFADNKSPNDPFPAEWGVGAIFGAECQKRGMLLVSIYGDALKATEERVAELKSKKNN

SEQ ID NO: 65571 - protein, 515 aa, Sorghum bicolor
MHVPLLLGSLAVSVVVWCLLLRRGGDGKGKGKRPLPPGPRGWPVLGNLPQVGSHPHHTMYALAKEYGPLFRLRFGSADVVVAASARVAVQFLRAHDANFSNRPPNSGAEHMAYNYQDMVFAPYGSRWRALRKLCALHLFSAKALDDLRGVREGEVALMVRQLALHQHQHAGVPLGQVANVCATNTLARATVGRRVFAVDGGEEAREFKDMVVELMQLAGVFNVGDFVPALAWLDLQGVVGKMKRLHRRYDDMMNSIIRKRKAAEEGKDLLSVLLARMREQQSLADGEDSRINETGIKALLLDLFTAGTDTTSSTVEWALAELIRHPDVLKKAQEELDAVVGRDRLVSETDLPRLTYLTAVIKETFRLHPSTPLSLPRVAAEECEVDGFRIPAGTTLLVNVWAIARDPEAWPEPLQFRPDRFLPGGSHAGVDVKGSDFELIPFGAGRRICAGLSWGLRMVTLMTATLVHALDWDLADGMTADKLDMEEAYGLTLQRAVPLMVRPTPRLLPSAYAAE

SEQ ID NO: 65572 - protein, 2237 aa, Oryza sativa Indica Group
MEVEQAAEVGEVTAPKLPDKAVDKAQVHDDDKENLVNGNSNLQVKEAHNDEDDGTGSDGFELIDVKENFDSAKVVEEEKASPIEQGKTAALEEQALMRESAMLNQETKQLEELTRRIEELELEKEKLVKGVTEAENKQNLHYTSLQEAQRSLADKDKELADATQSLKELGFELESSKERIQEIEAELAASADKLHKLEELKDERSLHAAQEAKRASELDKTLETAQLNMKEMEAQISSLQEEIKGHQDKAIDHQQVEESLRSTLSELKMVQEALELSKSQVDDLEQKLASQDANISHLTEELSLHRSSEESLKEKTLKLENELSSAHEELQAKILNLQEMEIKLEEQAKEKQTWEATLEKQQEQILNLQTELDESKGGNETLRGTIADLNSKLAERDSLLRQAEDEHAKAQLLLSEALSHKDELEVNLKSINEQHGESRAAAENASQKILELEALLQTLHATEEALKLQLEEAEARVEVAEKKGSDLEQLLGESENKLVASSGELKLLEERVQQEAASSAEKEKLLEEATNSVEAYKEKINELQASLDSTTSKNQLLEQEVKDLSDKFTEHQEQAHSVHERSLELESLLHTSKSDAEVAHTRTQDLENELNTANEKFKEVEADLEQYRSKVSQLSDELEAYQTKAASLEAVMESASEKEKELVESLGQITEEKKKLELLVLEYEEKTEEYLKEKQSLEERLQSQESKVLALEESLVKMGEEKESHEGTIADLNLQLSNKNDMYMQLESQLSQAGDDHSKTRSLLSEAQLHKEELELNLKSLNDLHVESKTAAESALQRIAELETQVQELSAAEQSLKSHLTEFESKLASAEKKSMDLEQELKDATEECNSSRLRVDELSGELEEYKEKRTSLEASLLEAKQKEAELSEKLDQVNEEKEKFEELSKKATIKHLEAENQVQALQGELESARHKLEEVESDLEALGIRETSVLDKLKSAEEQLEHKGKALEHATSKKIDLEALYQSLLEDTEMKLQQAGENLTQKETECQELSEKLKAAEEQAASYQAKATAAAGEVESVKVELEAFETEISTLETTIEELKTKASNAESRAEQALVESAMMSETNQALKEDLDAKLAMLRELQEQFDSTHAEKEEVFTKLSAHEKTIEHLTEVHSRGLELHATAESKNAELEAQMHEALETIGKKDSEVKDLNERLAALESEIESLTHVNEAMKQEINAKLVKVDELQEKLSSISSEKEEVAEKVVVHEKTIEHLREEHSRGLELQSAAESRSAEIENELREVLETVAQKEAEVTDLKEKLVSLETENEKLVGINEALKGELDTKVAMFDELQEQFSSTHAEKEEAAEKLAVHERTISHLTEVHTRSLELHSAAESKNEEIESKLHEALEMAAQKEAEVKDLSKKLDALEIELGYYEEQATEAAAAEETHKIKFDEAVHKIKSLEEQLAVTENKVELFHTEKENLVIANSKLNEELELHQNKLNELQVALAAAVAEKEGSSEEIHSLRKTLDGMIQRKEELESQLYCYYIFCSFKKVISLSVSSTVEEHEELKSKYNITLEEKQLLNEKYESAKKELGEAIAKLEEQMNVDKSEKELHISKLERQITLSELKYMEEIQTMQVETTEKDEALTTKMQEHANLVHEKDALEQQLLEVRKELNDAYHTIANQEEQVSVREIKWDAYKKFSEDQLEAEQQHVAELEVQVSSLKQQLQEAEIHYKHKEEQVSLREVQWEADQEHSVSELKAQRQYAAELEKQIGALTQQLQLVEKQYEQKVTEEREKLALVNTEVSKLTQKLSKSAEMEKKIEHLEQKLQAKDSVESTSRDFSLDSSTLPSKQRDRSLAPETTPPNPTQQQELREPSGIMAFKFILGVALLSVLIVLTFFGGHVMHYFADKIMTHEKGEQSPWQGSYVYDSKGNKYLDTLAGLWCTALGGSEPRLVKAATDQLNKLPFYHSFWNSTAKPPLDLAEELISMFTAKEMGKVFFTNSGSEANDSQVKLVWYYNNALGRPNKKKIIAQSQALPAMHLKFDLPAPFVLHTDCPHYWRFGLPGEAEEEFATRLADNLENLILKEGPETVAAFIAEPVIGAGGVIPPPKTYFEKIQAVLQKYDVLFIADEVITGFGRLGTMFGSDLYNIKPDLVSLAKALSSAYVPIGATLVSPEISDVVHSQSNKIGFFAHGFTYSGHPVSCAVALEALKIYRERNIPAHVKQISPRFQEGIKAFAGSSIIGETRGVGLLLATEFANNKSPNDPFPVEWD

SEQ ID NO: 65573 - protein, 1024 aa, Oryza sativa Indica Group
MTIRAFHSKILRRFSLGTAVGFRIRKGDLTDIPAILVFVARKVHKKWLNPAQCLPAILEGPGGVWCDVDVVEFSYYGAPAQTPKEQMFSELVDKLCGSDECIGSGSQVASHETFGTLGAIVKRRTGNKQVGFLTNHHVAVDLDYPNQKMFHPLPPNLGPGVYLGAVERATSFITDDVWYGIYAGTNPGLLDLNQWPVINATSGVSGAGRKAAISNSFCEVSLQPYGVFNHRHHPEITTHLGTDVIFTPHLGSFPRGILETITCRLKPGVTKEQVSEVFTQAYADKPLVRLYDKGVPALKNVVGLPFCDIGFAVQGEHLIVVAAEDNLLKGAAAQAMHEEALERLFTALVNYRESHQRPLVIVHGGGCVVDELMKGLNLPVKKKNGLRVTPADQIDIITGALAGTANKTLLAWAKKHHIASVGLCLGDGDSVKVTQLDEELGHVGLAQPGSPKLINTLLEGGFLPVVSSIGVTEEGELMNVNADQAATALAATLGADLILLSDVSGILDGKGQRIAEMTAAKAEQLIAQGIITDGMIVKVNAALDAARTLGRPVDIASWRHAEQLPALFNGTPIGTRPAADQRFKQFNDSLRFDYRLAEQDIVGSVAWSKALVTVGVLTAEEQLQLEEALNNLLEEVRLDPQQILQSDAEDIHSWVEGKLIDKVGQLGKKLHTGRSRNDQVATDLKLWCKETVGELLAANRQLQSALVETAQNNQDAVMPGYTHLQRAQPVTFAHWCLAYVEMLARDESRLQDTLKRLDVSPLGSGALAGTAYEIDREQLAGWLGFASATRNSLDSVSDRDHVLELLSNASIGMVHLSRFAEDLIFFNSGEAGFVELSDRVTSGSSLMPQKKNPDALELIRGKCGRVQGALTGMMMTLKGLPLAYNKDMQEDKEGLFDALDTWLDCLHMGALVLDGIQVKRPRCQEAAQQGYANSTELADYLVAKGVPFREAHHIVGEAVVEAIRQGKPLEDLALADLQKFSAVIGEDVYPILALQSCLDKRAAKGGVSPKQVAQAITDAKNRLV

SEQ ID NO: 65574 - protein, 309 aa, Mycoplasma synoviae
MKLKKLLHLNFRKENMQVKSTPIARALAAKLGVDISQVKGSGFDGKVLYEDVKNFSPAAAATQPVAASASATAAPQVGAYSEAVKPIRKAIAKAMTNSWSNVAYTNLVHRVNMTKLWDLRSSIKDSLLKSEDVKITFLPFILKAVSVALKEFPLFSAKYNEAKSTLDFPGVINLGFAVDTEAGLMVPVIKNANALSVLDLAREVSRLASAARNKTIKPDDMKNAGFTVTNYGSVGSLWGVPVINYPELAILGVGAIQDEAFVEKGTLVAGKVMYLTVAADHRWIDGADVGRFASRVKQLLESPELLGVY

SEQ ID NO: 65575 - protein, 624 aa, Mycoplasma synoviae
MKMYTFKFADIGEGLHEGVVAEIYVKVGQQVKEGDNLFSVETDKVTSDIPSPVSGTVTAIKMAQGDTIHVGQDIFVFDDGKGDAPVAEAPAPKAEAKEEAASVVGEVKVNNDLIDFSKMFSGQPAPKAEEVKSSAAPAPSAEDKTFDEGKKYTGKVDESYDVIVVGSGPGGYLAAEEAGKAGLKTLIVEKKYWGGVCLNTGCIPTKTLLKSADVISYLEHAADYGIVAEKAKIDFSKSWVKMHQRKADVVKKISSSVEMLMKMSKVTSVFGEAKFVGARALEVNGKVYEAKNVILATGSTANKLLKVPGFKSGYKSGEILTSEEAINFDKKLPKKVTIVGGGVIGIEFANVFAKAGSKVTVVQNGPVLLPGMDSDVSKLAKEMLEGMGVEVLLNANTLGYEKKTLKVEVDSKTLSLKQDVVLTAIGRSANAINAAEVGVKLGERGEVLVDSLQRTNVAGVYAIGDVTNQKMLAHVAYAHALVAVFHILGDKQKGSYHPKAVPGCVYTSPEIAFIGMTEAEAKAQGRNVMTAKYSFANLGKAIASNKTKGLVKLVVDKEFGEILGAWMVGENVTDYIAEVAMAMENEISVHEIAHTIHPHPTYNEMIWEAARSASLTLTLAAMKK

SEQ ID NO: 65576 - protein, 204 aa, Geobacillus kaustophilus HTA426
MCGHATLASAHVLWERGEHRRDEAIAFFTNSGVLTAINNDGWIRLDFPNETPVRVESPPAALVGALPAEPLFIGRNRFDYLVEIGSEQEVRRLTPDFRLLQEVDARGIIVTSRSAAEEVDFVSRSFFPALGVPEDPVTGSAHCCLGPYWADKLGKTTLVGYQASARGGIVRVMVAGERVQLEGKAVTVLKGDLAAEAAFGLQPI

SEQ ID NO: 65577 - protein, 194 aa, Clostridium difficile 630
MSLVPHVIEQTGQGERSYDIYSKLLKDRIIFIGEEINDAIASLVVAQLLFLESEDPDSDIIIYINSPGGSATSGFAIYDTMNYVRCDVSTICIGMAASMSAFLLAGGTHGKRCALPNSEIMIHQPMGGAKGQATDVKIAVDNILKIKERLDKILSENTGKSIEDIRRDTDRDNFMTALEAKEYGLIDYIMNRNE

SEQ ID NO: 65578 - protein, 167 aa, Zea mays
MASRLLHLRRLITPPSTVPAASFSTAVSATPRVSALVDEICGLTLLEASSLADALRGRLGVDQLPPLAILTGGGAPLVGGGVGPGAAGEEAKAKEEKMAFDVKLEGFDAAAKLKIIKELRAFTNLGLKEAKDLVEKAPAVLKAGVPKEEAESIAEKMRALGAKIVLE

SEQ ID NO: 65579 - protein, 139 aa, Bordetella pertussis
LAALQAAPEQTIVVLHACCHNPTGVDPTPQQWEQIAAVVKARNLVPFLDIAYQGFGEGLEQDAAVVRMFAELDLTMFISSSFSKSFSLYGERVGALTVVAGSKDEAARVLSQLKRVIRTNYSNPPTHGGTVVSTVLNTP

SEQ ID NO: 65580 - protein, 271 aa, Mycobacterium sp. MCS
MALDETDLQGLVDEAAAILDAASEPFISGHRADSAVQKKGNDFATEVDLKIERQVVDALTAATGIEVHGEEYGGADIDSPLVWVLDPIDGTFNYAAGLPTAAILLGLLRDGEPVAGLTWLPFMSQRYTAVVGKPLYVNGLEQPALQPGALSDCVVGTGTFNIDSRGRFPGRWRMALLENLSRKCNRIRMHGATGLDLAYAAGGALGGAISFGHHIWDHAAGVALVRAAGGVVTDLAGAEWTPDSKSVLAGSPQVHGEILEIVASVGAPEEF

SEQ ID NO: 65581 - protein, 288 aa, Neptuniibacter caesariensis
MTDLPAIIAYQGVPGAYSHLSCRKAHPELEARACSTFAEAMFMVEGGEARLAMIPLENSTAGRVEEIYRLMPKTELHIVGEHFEPVNHCLLAAKGSKVEEISVVASHPQALAQCDGNIRQLNIQPIASLDTAGAAESLSNAPQQGHAAIASSLAAELYDLEILRDNFQDKSGNTTRFLILARDSHIPQLVNDARFMTSIMFTVRNIPAALYKALGGFSTNGVNMLKLESYMASDSMTATSFHLDVEGHPDQKAMKYALQELDFFAKDVRIMGTYPWHPFRTQANQIIE

SEQ ID NO: 65582 - protein, 441 aa, Glycine max
GKYLASGGEDGMVRVWKVVEDERSSELDILDDDASTIYFKINNFSCVAPLDVDKEKLVKTEKLRRSSEATCVIVPPKTFRISSKPLHEFQGHSGDILDLAWSKRGFLLSSSVDKTVRLWHVGIDRCLRVFYHNNYVTCVNFNPVNDNFFISGSIDGKVRIWEVVHCRVSDYIDIREIVTAVCFRPDGKGTIVGTMAGNCRFYDIVDNHLQLDAQLCLRGKKKTSGKKITGFQFSPSDPSKLLVASADSHVCILSGVDVIYKFKGLRSAGQMHASFTTDGKHIISVSEDSNVCIWNYTGQDRNTSKAKKIWSSESFLSHNAAIAVPWCGIESMPGTLLSPSLGEDVNQRCSLPSPDCFFLSRGFLSELIPKVSATWPEETLVDSSCQTQTVVSPTMCKSEYKFLRSACKGMSNSHLWGQVIVTAGWDGYIRVYQNYGLPVRG

SEQ ID NO: 65583 - protein, 525 aa, Aspergillus oryzae
MESRLPSKLEPLSTSNSDLVGPSNGNWVVQKFGGTSVGKFALNIIDQVVLPSLLDHSVAIVCSARSSSTKAEGTTNRLLRAARDAENAESKNYVSLVEAVRLEHIEVVESQINSKGLRLQLVTEINDECEKVLKVLEAAQTLGEISVRCVDKVMSTGEKLSCRLMAAFLQDRGVDSEYVDLAEIVDFTISSQGLDQEFYNNLASTLGKKIRACEGRVPVVTGFFGTIPGGLLDQIGRGYTDLCAALVAVGIRAKELQVWKEVDGIFTADPRKVPTARILPAITPAEAAELTFYGSEVIHPFTMEQVIRARIPIRIKNVMNPKGNGTIIFPDSSYKLEKAAIGHDPRLFRTRSPSLVQTPKRPTAVTIKHKILVINVHSNKRSLSHGFFAGIFSVLDRWRLSIDLISTSEVHVSMALHSESPLLNGVGRDEYQIIDEDLKGALRDLQKYGTVDIIPEMAILSLVGKQMKNMIGVAGRMFTTLGENNVNIEMISQGASEINISCVIEERDADRALNIIHTSMFTFLD

SEQ ID NO: 65584 - protein, 349 aa, Triticum aestivum
MKKPGKLALPSQDSTIGKFLTQSGTFKDGDLLVNKDGLRIVPQSEEGEAPPIKPLDNNHQLSIDDLDSIKVIGKGNSGTVQLVRHKWTGQFFALKVIQLNIQESIRKQMAQELKISLFTQCQYVVTCYQCFYVNGVISIALEYMDGGSLADFLKAVRTVPEAYLAAICKQVLKGLMYLHHEKRVIHRDLKPSNILINHRGEVKISDFGVSAIISSSSAQRDTFTGTFNYMAPERISGQKHGHLSDIWSLGLVMLECATGNFPYPPRESFYELLEAVVDQPSPSAPSDQFSPEFCSFISACIQKNAADRSSAQTLSAHPFLSMYDDLNIDLSDYFTTAGSPLATFKQIAL

SEQ ID NO: 65585 - protein, 506 aa, Clostridium perfringens ATCC 13124
MLKILLVDDEATEREGIEFLIKRYEFPLNIAKAVNGKEALEYIKKNHIDILFTDVKMPFLDGLELAKETFKYDPKIRIIIFSAYSEFDYAKKALEAKVVDYLLKPIEVDEFKRVMEEVIKSCIKRKEEEKEKELLMESSKKMLLYKLLANHNNQNDINEKLNVYNIQLKDKYLVLINIETRDNFFEEKEEIFFNLLNTYLKIPYEYINFYPNESYLLLHSNLKIKEDFLEEVCFKLAREIKLLANENSSFFISNVFCGIEKIYDKVKGLNNIKENIYDFESRIIRVNKDKTNDLYTLEIENVKENLKNSINERNLNDIEFYINKLIEYMLESGSLSTIYIHHLFYDLMEKLCKAFDIYNGEVKKRFIEKILKCNSSETLKAAFESIIKDIAKECDNDILDEKSIANKVIKIIKNEYSSELSLDYIADKVNFTPTYLSYVFKKETGSNIVKYITDFRMNKAKEFLEEGNMKIVQVGKACGYENQSYFNRIFKNYFGVTPNQFKRKNS

SEQ ID NO: 65586 - protein, 196 aa, Shigella boydii
LTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFS

SEQ ID NO: 65587 - protein, 336 aa, Neptuniibacter caesariensis
MTIKIGINGFGRMGRLAMRAAWEWPEFEFIQINDPQGDAATLAHLINFDSVHGTWGHEATADEGMMLIGDKQISVSRNEKIEDTDWSQCDLVIEASGVMKKKALLQSYLDQGVKHVVVTAPVKEEGVLNMVMGINHHLYEPGKYPIVTAASCTTNCLAPVVKVVHEKLGIKHGSMTTIHDITNTQTILDAPHKDLRRARACGMSLIPTTTGSAKAITQIFPELTGKLNGHAVRIPLANASLTDMVFELERATTVDEVNQLFAEAAANELHGILGYEERPLVSIDYRTDPRSSIVDALSTMVVNGTQLKIYAWYDNEWGYVNRTVELAKFVAIDSVK

SEQ ID NO: 65588 - protein, 411 aa, Aspergillus oryzae
MSEPIRNKKADFPVAPSLESPASKKVSLEQSPCQPLISNIVTLESLDHATAASLFARNPGLVSMIQGKLGSLVGRSSGYIESLPAPVRRRVAGLKGIQKEHAKLEAQFQEEVLELEKKYFAKFTPLYQRRATIVNGAAEPTDSEVDAGKGEEEDVDVKSEDESKKSEDKVSSTAGIPEFWLSAMKNQISLAEMVTERDEEALRHLTDIRMEYLDRPGFRLIFEFSENSFFTNKTISKTYYYKEENGYGGDFIYDHAEGTKIDWKDDKDLTVRVESKKQRNKNTKQTRVVKITVPTESFFNFFSPPQPPTDDDDTVATDIEERLELDYQLGEDIKEKLIPRAIDWFTGEALQFEELGDDMDPDEFDDEDEDEEEDEDDDDDDRKSDGDVDDDSDEEDGTSKPKKEAAECKQS

SEQ ID NO: 65589 - protein, 512 aa, Clostridium difficile 630
MSLLKVTNLSQCFMDKSLYEKANFDLFKGEHIGVVGQNGTGKSTLIKILLGEVVPDSGEIKWQPNINIGHLDQYAEINRDTTISLYLHTAFEELYKIEKEMNLLYQKSAISENEQYLIKASDYQEQLIANNFYSIDNEINKIANGLGLDSIGMNRVVRELSGGQRAKVILAKLLLSNHDVLLLDEPTNFLDKEHVEWLSNYLNTFNGAFIVVSHDFDFLEKISTGILDIEFGMIKKYHGKYSEFLKQKSRLREDYIRRYQAQQKKIEKEETFIRKNKAGVNSKIARGRQKQLDKIERIAPPSFTGKPNIQFSEIEISAQNALTITNLEVGYYYSLLPKLNFSVDGGQKIVITGFNGIGKSTLLKTLVKDIPRISGDFQFSEQVKIGYYEQDLKWENPDKTPLQIVADKYPKLNTKEIRRHLARCGVKEEHVSRSVSTLSGGEQSKVKLCCMMLSPCNFLILDEPTNHFDAETKDALQNALKQFRGSIILVSHEEKFYKGWIDKVFNIEKQLV

SEQ ID NO: 65590 - protein, 129 aa, Zea mays
MALAIHAPRVHTDTGRHTAQSPSRLAVVLTVLHSPVPILFRCRHPLRRPPRPAAATRPVSIAMTTSRRLADRKISRFEKNITKRGSVPETAKKANDYPVGPILLGFFVFVVVGSSLFQIIKTASNAGLF

SEQ ID NO: 65591 - protein, 376 aa, Populus tremula x Populus tremuloides
MASMYNPETSAVQDQQQNPTLLYDALYCSEENWVEEVREDWFQDELEGESYCSNNSNKLNTFPILLEQDLSWEDEELSSLFAKEEQNQLCKDLETNPSLARARCEAVEWILKVNEHYSFTALTAVLAVNYLDRFLFSVHLQKEKPWMAQLAAVSCLSLAAKVEETQVPLLLDFQVEDSKYVFEAKTIQRMEILVLSTLKWKMNPVTPISFLDYITRRLGLEHYLCLEFLKRCERMVLSILADSRSMPYVPSVMAAATMLYVIDNIEPSLAAEYQSQLLSILGIDKDKVEDCSKFLMEFALRDHFKLLSNKRKFCSLPGSPSGVVDVSFSSDSSNDSWSVASSVSSSPKPLSKKSRALQSLNNATTSDFSQHSSPVP

SEQ ID NO: 65592 - protein, 77 aa, Shewanella oneidensis MR-1
MSNIEERVKKIIVEQLGVKEEDVKPAASFVDDLGADSLDTVELVMALEEEFDTEIPDEEAEKITTVQAAIDYVSKNQ

SEQ ID NO: 65593 - protein, 56 aa, Glycine max
EKALLGRVSFRDMYSALNAVSGHYISFGPTAPIPAKRRARILEEVDTAEKALLRGR

SEQ ID NO: 65594 - protein, 248 aa, Shewanella oneidensis MR-1
MSINLSLAGKVALVTGASRGIGRAIAETLVEAGAVVIGTATSEKGAAAIQEYLGDKGFGLVLNVTDSQSVTDLFDSIKEKAGDVDILVNNAGITRDNLLMRMKDDEWNDIIDTNLTSLFRLSKPVMRTMMKKRFGRIINIGSVVGTMGNAGQVNYSAAKAGLIGFTKSLAREVASRQITVNAIAPGFIQTDMTDELTEDQQKAIMSQVPMERLGQAQEIANAVLFLASDSAAYITGETLHVNGGMYMV

SEQ ID NO: 65595 - protein, 207 aa, Shigella sonnei
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGT

SEQ ID NO: 65596 - protein, 582 aa, Ashbya gossypii ATCC 10895
MIHQKDVEKAASELSNTSAVQRVLKKRSSVLEESRLLEESRTNKRGLVRRCIDSFKPPVDGSFDPDNLKRTLKSRHLIMIAIGGSIGTGLFIGSGKALATGGPLAVLIGWTLAGTQMVGTIHGLGEVTVRFPVVGAFANYSTRFLDPSVSFVVSSIYVLQWFFVLPLEIIASAITMEFWTTSVDPVVWVAVFYTLIISINLFGVRWFGKPKFVFSVIKMVPICGFIILCLVLILGGGPTHEFIGARYWHDPGALANGFKGVAAVMVTASYSLGGSEMTCLASGETDPKEIPHAIKQIFWRIIFFFLVSLTLVGFLVPYTNDQLLGGSNVNNSPFVIAIKMHNIRVLPHIINGVILVSILSVGNSCIFASSRTLCSMAHQGLLPRIFGYVDRAGRPLTGILTNSLFGLLAFLVKSSSTGTVFTWLMAVAGLATAVVWLSINVSHIRFRLAMKAQGKSLDELEFVSAVGMWGSVYSGVMNVVVLVAQFYVSLWPIEGWKDPRGRTEAFFQNYLCALILLFMFVAHKIYYRSTTGQWWKILPLAEIDLESGRKNIDIEVVKHEVAARKKYISEQRWYIRYYHYWC

SEQ ID NO: 65597 - protein, 206 aa, Shigella boydii
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFSFQG

SEQ ID NO: 65598 - protein, 448 aa, Oceanicola granulosus HTCC2516
MIGDRPLTAEDAAGLENLFGCVCDLNGVLRGKRIPAEQIDNVLAGAVRMPLSICGLDIWGEDIEGSVMVFETGDADGICVPTGRGVLPMTWTSKPTALVPLWMMEEGGAPFLGDPRRALANVVERYAAKGLTPVVATELEFYLFDPADDLPAPPRSPVTGKRLMSDGALCLDELEHFDGFLNDVYAACRNQGIPADSAISENGAGQFEVNMRHVADPLRAADDALLFKRLVRGIARQHGFAATFMAKPYGDRAGSGFHVHFSLEDRDGVNLFDDGGARGTDMMLAAVAGLLETIQENALTFAPHENSFRRLLPGAHAPSNVAWGYENRTAAIRIPGGDSRARRIEHRVAGADANPYLVLASVLGGALLGIERDWRPPEPIEGDAYSLDLPHLPLDWATAIRAFQQGKLVPEIYARRLQRMFVEAKKQEQARFNRHVTGLEFHSYLEIV

SEQ ID NO: 65599 - protein, 258 aa, Ralstonia mannitolilytica
VANFKDIEVVAINDLLEPDYLAYMLKYDSVHGRFEGEVSVDGNTLVVNGKKIRLTAVKDPAELKWGEVGADVVVESTGIFLTKEGAQKHIDAGAKKVIMSAPSKDDTPMFVYGVNHETYKGEAIISNASCTTNCLAPVAKVLNDKWGIKRGLMTTVHAATATQKTVDGPSNKDWRGGRGILENIIPSSTGAAKAVGVVIPQLNKKLTGMSFRVPTSDVSVVDLTVELEKSATYDEICAEMKAQSEGALKGVLGYTEDK

SEQ ID NO: 65600 - protein, 340 aa, Geobacter metallireducens GS-15
MRAAVFHQIGKPLAIESLNDPIPLDGEVIVNVKACGICGTDIHATADKEMRLADGTVLGHEFAGEIVEVGPQVAVGWAQGDRLCTLPYIGCGHCLACLTGMPWQCKLKKVIGIQTAGGFAEYARVHVNEAVRLPVSVSWQEGALVEPLAIGLHAVRLSRGVAGKSVLVTGAGPIGLAVALWCRFFGARQVVVSEFDPERSKMALAMGATHAVDAKADVGAQYQEITGELPELIFECVGIPGLIAQCVDRAAFGAEIVVVGFCMRPDTFVPALAMLKEITVKFSIGNNKSDFQFIVDMLSSGRISVKPMITAAVSLDDLPKTFESLRTPGEHCKVVVEPGR

SEQ ID NO: 65601 - protein, 257 aa, Geobacillus kaustophilus HTA426
MFLPSFRLDGKTALVTGAGRGIGRAIAIGFAEAGADVALIARTEADLQETASHIEQFGRKAYIYPLDVIDRKAVHDAVANVKQQAGSLDIVVNNAGMNIRTPALDVTDHEWETIMNTNLKSAFLVSQEAGRVMKEQKQGGNIINIASVAGHVALRTGVVYAATKAALIQMTKVLAFEWGRYGIRVNAIGPWYFRTPLTKTLLEDEAYVNDILAVTPLKRIGELPELVGPAVFLASDASSYITGQTLFVDGGMTIHGF

SEQ ID NO: 65602 - protein, 460 aa, Oceanicola granulosus HTCC2516
MTKLSNSLGAADIATALHPYTNARRHEEAGPMVMRRGDGVRVEDAQGKTYIEALAGLWSVAVGFSEPRLVEAARRQMEALPYYHSFAHKAHEPAIRLGEKLVEMTPEGLDRVFFTNSGSEANDTVVKMVWYMNNALGRPEKKKFLARTKGYHGITVASGSLTGLPANHRDFDLPVIPVTHLTCPHHYRFGRDGESEADFTARLLAEAEEVIEREGPETIAAFIGEPLMAAGGVMPPPEGYWPGIEALCRKHDILLVSDEVICGFGRLGSPFGCTHYGFTPDIMVTSKQLTSSYMPLAAVIFSEKIYDAIADNSAKIGTFGHGFTGSGHPVATAVGLENLAIIEERDLMGNAARMGARLQEGLRRFAGHELVGEVRGTGLIAGLELVRDKATRESFDPVGKVGTLAFEIAHEEGMVIRNVGDTLALCPPLIVTEADVDEIVARMGRILDRTLEKVKAGALG

SEQ ID NO: 65603 - protein, 419 aa, Chlamydomonas reinhardtii
PPNALQDKYHLGRVIGAGSFGVVREVVEKATGKTAAVKTIPKVPKRGLPTPRYLLKLRTEVEIMQQLGYSLDAVNLRDVFEDDDSIHLVMELCEGGALLERIEAHKYSEKYIARLTRSILRFISQCHAKGIIYRDVKPDNFLFLRHDDESPLKATDFGLSIRHWPDEPKLTSRSGTPAYMAPELVLQSYDEKCDIWSVGMLTYQLLTGRFPFWEDTLSDVWKAILTQDVNWDAQELKQLSPSAVDLLKRLLQRDPAQRPSAFAALEHPWLSEEGRARDLPLQGSVVQRLQRFSTFGHLKQLVLKIIVEVAVQSSSKVMPEDLFNELDTDGSGAISFEELSSGLRRQGYVLADNEIENLMRRVDSDHNGTVDLSEFIATLMDWDQVQSEQNWQTYLDHAFRKMDHDGDGFISLDELLQQL

SEQ ID NO: 65604 - protein, 121 aa, Thermoplasma volcanium GSS1
MEKSYVKFETPEDVSQKALDLVESAFRSGKIKKGTNEVIKSIERGESKLVVIAEDVNPPEVVYYLPSLCEDKKVPYVYVKKKADLGSKVGIASAASVSIVDYGKNEELYKSIVSAVEQLKK

SEQ ID NO: 65605 - protein, 222 aa, Brassica napus
  misc_feature (178)..(178): Xaa can be any naturally occurring amino acid
MAAAARVQCHNNTSFTGSPLPRRHHNSSTLHASPNRVNFTPLKWIGDGSSSCTRTVSGRPLKGGGTTTARAAFEEEKKTDAVNEVAEEKRRFTCVMKFGGSSVATAERMREVADLVLTFPEESPVIVLSAMGKTTNNLLLAGEKAVSCGVSNASEIEELSVIKELHLRTVKELEIDPXSVVSSFLEELEQLLKGIAMMKELTLRNRDYLVSFGECCPQGILA

SEQ ID NO: 65606 - protein, 847 aa, Gibberella zeae PH-1
MNPITSILTCLTGKRASSPSSPPIREMKSNEKTLVTSQPVPYSDNAADQFVDILSTHEGSKQELHHRLKQVISTNGWTESLAEAIEHKIEKLLHDGAELAKPMAEAVKKATEIAWQFAKEHPVYAALIAAGTIIAIAVLAEFDLVWVLRALGFDPIGPRVGSFAARWMSKIGQVPKGSIYSYLQRLGMKIANNYQIMRTHPMVIPSNQISINDVRGSANWTSITTFAITPPFNVPSPTYKTPIFGLDPRLASIYEPPSAGFNGFPSRRSVVHSTEGIVAAPQPHAAKCGLEQDTDIAQDAAVAVAAGLNVTEPVSTGIGGDMFLLYFDAATKQVKSLNGSGRSGAKQTLETIRKALNIPGGKIGEIPTHGVHAATVPGAAAGWVDTVERFGSGKLSLSQILEPAIKLAENGHPVSEIASHSWQAQEKLLRDASPNFAEMLKQDPSAQDGVRAPLPGEVFKNPTLAKTFRALATEGKKGFYTGRIAEEIVKVVQDLGGYLELDDLKHHLETGTQNTDPISVKFRGQGLTSKDPNGGVELWEHPPNGQGIVALMALGIIEQLEKQGKIPTFGPEDHNSTVYLHAIIEALRLGFTDASWYVTDPDTTKVPTEGLISPEYLAERAKIFDATKAHDGVQPGNPDFVSPALRSSDTVYFTVCDAAGNAASFINSNYAGFGTAIIPKGCGFTLQNRGANFSLDEKHPNKLEPRKRPYHTIIPGMATNLSDGSLHSTFGVMGGYNQPQGTVQVLLNQVLFGLNPQQALDAPRICIGAGMPDEGNVLDWTVHVEEGISDKTVEELKGLGHNVVVLKDWKRAMFGRGQIIRYTVDPDGTPVWSAGSDPRADGAAYPQ

SEQ ID NO: 65607 - protein, 298 aa, Neisseria meningitidis FAM18
MNPTNDLKAWQQRAQAQTELLLERFLPSENEIPHTLHEAMRYAALDGGKRLRPMLVLAASELGEAVHEAVEQAMAAIEMIHVYSLVHDDMPAMDNDSLRRGKPTCHIKYGEANALLTGDALQTQAFDVLSRPTELPAARQLAMLSVLAKAGGSRGMAGGQAIDLANVGKQMVQADLEQMHSLKTGALIRAAVLLGATACPDLSDAELSVLDAYAAKLGLAFQVIDDVLDCEADTATLGKTAGKDADNDKPTYVKLMGLEAARSYAHKLVAEAVALLEPFGDKALRLRQLAEFAVARKY

SEQ ID NO: 65608 - protein, 310 aa, Chlorella pyrenoidosa
VPLYRHIADLAGNTKLVLPVPSFNIINGGVHAGNALAFQEFMIMPTGASSFAEAMRLGSEVYHHLKAIVKKKYGVDSVNVGDEGGFAPGIQSNEEGLVLISEALKAAGCEGKVKIAMDCAASEFYNEEEGKYDLNFKAKDNDGSYKKSGEEMAAFYSELCGKYPIISIEDPFNEDDWASYSAFTEKNLAQIVGDDLLCTNPTRVQKAIDTKACNALLLKVNQIGSLTESIKAVNMSKQAGWGVMTSHRSGETEDSFIADLAVGLCTGQIKTGAPCRSERLAKYNQLLRIEEELGADAVYAGENYRHIPIA

SEQ ID NO: 65609 - protein, 163 aa, Astragalus membranaceus var. mongholicus
HDLIVPALRKSLQTLQLDYLDLYLIHWPLTSQPGKFSFPIPVEDLLPFDVKGVWESMEESLKLGLTKAIGVSNFSVKKLQSLLDVATILPAVNQVEMNLAWQQKKLREFCNANGIVLTAFSPLRKGASRGPNEVMENDLLKEIADAHGKSIAQISLRWLYEQG

SEQ ID NO: 65610 - protein, 297 aa, Robiginitalea biformata HTCC2501
MQTILFSLPGNQELTELLAKKMNAEIGECAIRKFPDGESYTRILSDVKGKCVVLVCTLHEPDVKLLPLYFLSHTAKSLGAMCTCLVAPYLAYMRQDKVFNDGEGVSSTYFGKLISGFADSITTVDPHLHRISSLGEVYDIPNRVIHAADAISKYINENIHNPVLIGPDSESEQWVSDVAKKAEVPFTVLQKVRHGDRDVEVSVPNVAKYKVSTPVLVDDIISTAQTMIETTEHLKNAGMKPAICIGIHAVFSGNAYQDLWDAHVKDIITCNTIPHQSNGIDLSDVIAQEVTELMYHT

SEQ ID NO: 65611 - protein, 251 aa, Chlorella pyrenoidosa
NSIFFVGGNWKCNGTVKSNEELVKVLNAAEVPGTDVVEVVVAPAAVHIPQVLSSLRKDFSVAAQNCWVKAGGAFTGELSAEMLADLGLNWVVLGHSERRHIIGETDEFIADKVAYALSKGLGVIYCIGEKLEEREAGNTLDVNARQMKALADKIQDWSKVVVAYEPVWAIGTGKVATPEQAQEVHDAVRKWLADNVSADAAANTRIIYGGSVTAKNCGDLATQPDIDGFLVGGASLKPEFVDIIKSAALSK

SEQ ID NO: 65612 - protein, 299 aa, Glycine max
  misc_feature (115)..(115): Xaa can be any naturally occurring amino acid
MEAIVPVVDFQRLSEEEERKKLRKTCEKPGCFRIINHSIPLTLMADMKSVVKYLHDLPTEIKMRNKPSVPESGYRAASPTSPLYEGMGIYDMHASPQAFEDFCSNLNVSPRHRAXIKEYGQAIHDLASNLSQKMAESLGIMDNDFKDWPFILRTIKYSFTPDVIGSTGAQLHSDTGFITLLQDDEHVSGLEMMDDFGSFKAVPPIPGAFLCIVGDVGHVWSNGKFWNARHRVICKETGTRYSFGAFMLSPRDGNVEAPKKLVEVDHVQRYRPFKYEDLRDFRITTGKRDGEVLDQYRIC

SEQ ID NO: 65613 - protein, 147 aa, Thermoplasma volcanium GSS1
MDRTLVLLKPDAVKRRLVGKIIERFEEKGLKIVAMKFMQMTKDQAKTHYSVHQNKPFFNDLVNYITSGPIVAMILEGAHAIEIVRLMSGATDGSKAQPGTIRGDYSMGIEKNIIHASDSLEAYNHEMPIFFSDNEIIEWAYGDEVIY

SEQ ID NO: 65614 - protein, 642 aa, Arabidopsis thaliana
MSSTFRAPAGAATVFTADQKIRLGRLDALRSSHSVFLGRYGRGGVPVPPSASSSSSSPIQAVSTPAKPETATKRSKVEIIKEKSNFIRYPLNEELLTEAPNVNESAVQLIKFHGSYQQYNREERGGRSYSFMLRTKNPSGKVPNQLYLTMDDLADEFGIGTLRLTTRQTFQLHGVLKQNLKTVMSSIIKNMGSTLGACGDLNRNVLAPAAPYVKKDYLFAQETADNIAALLSPQSGFYYDMWVDGEQFMTAEPPEVVKARNDNSHGTNFVDSPEPIYGTQFLPRKFKVAVTVPTDNSVDLLTNDIGVVVVSDENGEPQGFNIYVGGGMGRTHRMESTFARLAEPIGYVPKEDILYAVKAIVVTQREHGRRDDRKYSRMKYLISSWGIEKFRDVVEQYYGKKFEPSRELPEWEFKSYLGWHEQGDGAWFCGLHVDSGRVGGIMKKTLREVIEKYKIDVRITPNQNIVLCDIKTEWKRPITTVLAQAGLLQPEFVDPLNQTAMACPAFPLCPLAITEAERGIPSILKRVRAMFEKVGLDYDESVVIRVTGCPNGCARPYMAELGLVGDGPNSYQVWLGGTPNLTQIARSFMDKVKVHDLEKVCEPLFYHWKLERQTKESFGEYTTRMGFEKLKELIDTYKGVSQ

SEQ ID NO: 65615 - protein, 286 aa, Chlorella pyrenoidosa
MTFGQALVHQRVQLPTVRRSSCHRASRCAVVMRGSGRFFIGGNWKCNGTLQSVTQLVDELNAGSVPDSVEIVVAPTFVHLDRVQRSLKSPFQIAAQDCWVSKGGAYTGEVSAEMLHDMGIPWVILGHSERRSLCREDDELVGMKCEYALSQGLKVIACIGETLEQRESGHMWDVLDAQLAAIARHTSLANWANMVIAYEPVWAIGTGVVATPEQAQEVHAYVRKWIAEHVSAEVADKLRILYGGSVNDANCATLANLEDVDGFLVGGASLKGPSFINICNAQNKHS

SEQ ID NO: 65616 - protein, 388 aa, Burkholderia vietnamiensis G4
MKIHEYQGKEILRKFGVAVPRGKPAFSVDEAVKVAEELGGPVWVVKAQIHAGGRGKGGGVKVAKTIEQVREYANQILGMQLVTHQTGPEGQKVNRLLIEEGADIKQELYVSLVVDRVSQKIVLMGSSEGGMDIEEVAEKHPELIHKVIVEPSTGLLDAQADDLAAKIGVPAASIPQARTILQGLYKAFWETDASLAEINPLNVSGDGKVTALDAKFNFDSNALFRHPEIVAYRDLDEEDPAEIEASKFDLAYISLDGNIGCLVNGAGLAMATMDTIKLFGGEPANFLDVGGGATTEKVTEAFKLMLKNPGLKAILVNIFGGIMRCDVIAEGVIAGSKAVNLNVPLVVRMKGTNEDLGKKMLADSGLPIISADSMEEAAQKVVAAAAGK

SEQ ID NO: 65617 - protein, 256 aa, Mycobacterium sp. MCS
MLELKTPREIEAMRTTGAFIAGLLDDLQTRARVGVNLLDLEQRARQLIDERGAVSCYWDYAPSFGRGPFRNVICLSVNDAVLHGLPHDYTLRDGDLLSMDIAVSIDGWVADSARSIIVGTPQAEDQRLIEATEQALVAGIDAARPGNRLGDISAAIGSVAADYGYPVNTDFGGHGLGRTMHEDPHVPNRGRPGRGLVLRPGLTLALEPWFARGTDRIVYDPDGWTIRSADGSRTAHSEHTIAVTDGDPLVLTRRAA

SEQ ID NO: 65618 - protein, 303 aa, Enterococcus faecalis V583
MNAVTIIGSINLDTTLRVKEMPKPGETIHAIEHFTAGGGKGANQAVAAKRSGAETYFIGAVGNDGAGAMMTDLMSQDEINLTGVTTLEKTATGQAFIMVDNAGENSIMIYAGANNAFTPKQVQEHQEIIEKSDFVIAQFESAIDSTIAAFKIAKKAGVKTILNPAPALEQVPEELLNVTDMIVPNETETEILTGIKITDEASMRKAAEALHQLGIEAVIITVGSKGAFYDVNGRSGIVPAFKVKAVDTTAAGDTFIGALSSILEKDFSNLEEAIRYGNKASSLTVQRFGAQPSIPYQHELADK

SEQ ID NO: 65619 - protein, 331 aa, Streptococcus pyogenes M49 591
MSIRSLFGGLREKILGKNMKIVFPEGNDERVVRAAARLKFEGLLEPIILGQSEEVRNLLTKLGFADQDYTIINPNEYADFDKMKEAFVDIRKGKATLEDADKMLRDVNYFGVMLVKMGLADGMVSGAIHSTADTVRPALQIIKTKPGISRTSGVFLMNRENTSERYVFADCAINIDPTAQELAEIAVNTAETAKIFDIDPKIAMLSFSTKGSGKAPQVDKVREATEIAKGLNPDLALDGELQFDAAFVPETAAIKAPDSAVAGQANTFVFPDLQSGNIGYKIAQRLGMFDAIGPILQGLNKPVNDLSRGSSAEDIYKLAIITAAQAIESQG

SEQ ID NO: 65620 - protein, 659 aa, Oryza sativa Japonica Group
MAISGALFLPGIFQSLSILAVLGVLVTKSGAADFQEQPACVPFSCGHLEGIRYPFRLQGDPLGCGDEAYELVCRDGRAIIHINTGKYFVKDISYNESRFWVVDANLDNSSCPLPLWNNLPYFNDMGTKLYTSAVRWATFLNCSRAINNGMYMPVACLSGNTSFVYVLTTSSSYYVQNIEPSCGYLAVIPVDDRTKNVPDYASYADVVKFMRNGFPVSFPRVESPSHSPVIKACARDTFQNFKEQMYSRNIQNWTSAIIGTELQFLGCVINYYSSATQVWVTLVLVFAVEIVKCIIVLCRFILAPLTVLTFLGYKYRKTRISIDAVEKFLRMQQAHGPKRYAYTEITAITGHFREKLGQGGYGSVYKGFLPGDGHVAIKMLSNSMCNGEEFISEVSTISRIHHVNVVRLVGFCSEELRRALVYEYMPCGSLDKYIFSPEKSLSWDKLNEIALGIARGIDYLHHGCDMQIMHFDIKPHNILLDSNFTPKVADFGLAKLYPRDDSLVPVSAARGTIGYIAPEMISRSFGTISCKADVYSFGMLLLDIAGGRRNREQHTSNSAHLYYPALVYDCLTQQEVSEISEDIGIHWVERKLCIVGFWCIQMKPAERPSMSEVVEMLESDDPDNLQVPPRPFFGVDDHISEMDDCCNSSSKSSAISEDD

SEQ ID NO: 65621 - protein, 241 aa, Aspergillus oryzae
MADERLEAIPSPAQGVGPIYRPDGEKPTATVSKDIPYENVHVLPQTPHMIRDKRTGRADFIFYSNRIIRLLVEEGLNHLPVVEQAVTTPVGRTYLGVKFEGKICGVSIMRAGEAMEQGLRDCCRSVRIGKILIQRDEETCKPKLFYEKLPADISSRWVLLLDPMFATGGSATLAVEILKAKGVPEDRILFLNLIASPSGVADFAERFPKLRVVTAFIDQGLDEKKYIIPGLGDFGDRYYTL

SEQ ID NO: 65622 - protein, 350 aa, Geobacillus kaustophilus HTA426
MNKVFAWMTWIGVPVSVIGGFLHWPTVLMFVLYCLTIIALASYMGRATESLAIVAGPRIGGLLNATFGNAVELIISIFALQAGLVDVVLASLTGSVLGNLLLVAGLSFFVGGLKYKRQEFNIYDARHNAGLLTFAIFIAFVIPEVFTMHMNHSEQVALSVGISIIMILLYAAALYFRLVTHRGVYQHKSEEVEEHEEPEWGKGKATAILALATVAVAYLSERLVHTFETVAESFGWSELFIGIIIVAIVGNAAEHASAVIMAYKNKMNVAVEIAVGSTLQIAMFVAPVLVLVSLLFPEKMPLVFSLPELVAMAASVLLMIVLSNDGDTNWFEGATLLAAYTIMGIGFYLL

SEQ ID NO: 65623 - protein, 336 aa, Nocardia farcinica IFM 10152
MTRAAVLGAGSWGTAFAKVLADAGTEVTIWARRPEIAEALATEHRNPAYLPDVQLPAVSATHDAEAALDGAQLVVLAVPSQSLRANLTGWRPALRAAIDEHDATLLSLAKGIETGTLLRMSQVIAEVTGAEERRIAVLSGPNLAREIAAGQPAATVIACSDAARAEAVQQASYTGYFRPYTNTDVIGCEIGGACKNVIALACGIAAGMGLGDNSIASLITRGLAEIMRLAVTLGAEPVTLAGLAGVGDLVATCTSPLSRNRSFGHVLGAGGSMEAAQQATHGQVAEGVKSCTSVRALAAAHEVEMPLTDAVHRVCHEGISVREAVGSLLGRRIKPE

SEQ ID NO: 65624 - protein, 499 aa, Zea mays
  misc_feature (48)..(48): Xaa can be any naturally occurring amino acid
MKDPAHRTKVVLRRLPPAIAQQDVVDQVDARFAGRYDWACFRPGNASXKNHRYSRLYLNFKRPEDVVEFAEVFNGHIFVNEKGAQFKAFVEYAPSQQVPKSNVKKDGREGTVTKDPEYLEFLEFISKPTEHLPSAEIQLERKEAERAAAGKEAPVVTPLMMYVRQQRAAKSMAQRPGSRLSRKVAGVVTSSSSPKRSFEKRRSSTYVVRDSIKEKPTYIMVPKREEHTQRGKIVSGNSDATSGGASGSGQSSDKIVILKGRGRVDSNTPDGAAQQSSTPVKNIPPSSSRLDKRSEANGRIIKTVLSNKEVRSSNPSQHEQEGHMFNTEKDKRPPRALNPRTIVKDQVVENAERSHFDEKNNYVHSSAPIGEKVERHARNRDRPDRSVWAPRRYDKSPPGGVSHALSSDFSQMQSHSGDNVSQLTDGHGDRKTDTRGHGGSRGVPVENGHRHANRRGTPCDPKETKISASVPDGKNSKRGSASYGAHERQVWVQKSSSGS

SEQ ID NO: 65625 - protein, 402 aa, Rhodopirellula baltica SH 1
MSDNKGVVYLGAGKVDVQSIDDPKLELSYRGKTRQCHHGVILKVISTNICGSDQHMVRGRTTAPAGMVLGHEITGEVIEVGRDVEFIKKGDICSVPFNIACGRCRCCKEGDTGVCENVNPDRPGAAYGYVDMGGWIGGQSRYVMVPYADWNLLAFPDRDQALAKIRDLTMLSDIFPTGYHGAYTAGVTTGSTVYVAGAGPVGLACAHAAQLLGAAVVIVGDMVEERLAQARSFGCETVDLKTDASLPDMIEQILGSREVDCAVDCVGFEARGHGGDSGVEKPATVLNQVMEVTRVGGGVGIPGLYVTDDPGGVDEAARTGNLSLRIGLGWAKSLHFTTGQCPVMKYNRGLMMAILHDRCQIAKAVNATVISLDDAPQGYADFDQGAAKKFVLDPHGVLAAST

SEQ ID NO: 65626 - protein, 711 aa, Ostreococcus tauri
MALAISSLSATSSRATVNVRGARRDHHVGHRRVACLALPTLPSSTKEQIEQCARAILEAQANGISTQAIELNLPLIGATDLDDWPGGVRQQYAALGPMVSEVLKRINAGTDGKPQQRIIDDADAVAAITLGSDVIVSFPTAEVLDDLRAIEKQAEYRLKIIANPQWNTSGAIIGDFGIGPWRKRAENFVAKFEPVYYLKEQRIQGEIVRTLKVYPNDWQVFALAPGADNKIVAEPLGTFTKRPLYDELKTLLESREGSVASMNWVERAKREATFNAKSLQQTPKEEIAALTRQITLLTLTRAHSSTMSRAQGGQPSIFQELFLVGCSAILSMIVLNFGLKRMDPNRQNSKAAIERKKELATRLGRPNLDTNVYEDVIAMDVANPDHIDVTFNSIGGLEDTKQSLYELVILPLVRPELFARGKLLQPAKGVLLYGPPGTGKTLLAKALAKESGACFINVRSSTLQSKWFGDAQKLVSAVFTLAFKLQPSIIFIDEIDSFLGTRKSGEHEATATMKTEFMTLWDGFNTDDSAQVMVLGATNRPWDVDEAILRRLPRAFEVGLPNVEQRAQVLAVTLKGENLDDGFISQERSCALWMIASETEGFSGSDLRDLCKQAAYGPVRDFLKIEREKASIGQRASGRPRAISYADFKAVLDTSPPSTEAASLYQQHDFRRRAARDVRNGERVNTEMQDLLAQLMKAIAMQNSDASDELD

SEQ ID NO: 65627 - protein, 275 aa, Oceanicola granulosus HTCC2516
MELQRDAQPEIMPGLGFGTYGRQGEDGISAILCALETGYRHLDTAQDYDTEAEVGEAIRRAGLPREALFVTTKVRPANFGPGDLVPSVARSLETMGLDRADLVLIHWPAPNGERPLSDYIPQLAEARAQGLTRHVGVSNFPVALLTEARALLGDVPILTNQVELNPWFRNRTLADHCMGAGIRVTCYQPIAQGRLGGDPVIARIAARHGATPEQVALAWELAQGYAAIPTSSRPEHIRGNWQAQQLDLSPGELAEIDALNRGRRSIDPDWGPAWD

SEQ ID NO: 65628 - protein, 260 aa, Geobacter metallireducens GS-15
MGKLDGKVAIVTGGARGMGQTTAEVFVQEGASVVIVDVLDVEGEALAKRLGRNTMYQHLDVTDEQGWEQLVEGIIDRYGCIDILVNNAAVFFSSPIDETRSEAFRRILDINLIGPYLGMKAVIPTMKKNRRGSIINVSSVNGLRGSSGSGAYSASKWGVRGLTKCVAMEVGPFGIRVNSLHPGWIVTPMNNPDGKSFEEVNAELKIKFPGIALSRVGQSEEIARASLFLASDDSSYISGAELAVDGAWSCGVYLQDKPMP

SEQ ID NO: 65629 - protein, 448 aa, Robiginitalea biformata HTCC2501
MKKYDVFIIGSGMSGMTIAYKCASKGLSVGITDELPYGGTCALRGCDPKKVIIGATEVRDFAKRLQGKGIDTIPDINWKDIMAFKQTFVDEMPRKIEKGYKKNGIDTFHSSAAFINENTLSVGNQTIQADNVVIASGSKPKVLDFEGGQLAQTSTDFLNLKELPESLLFIGGGYIAFEFAHIAARSGAEVTIVHRGKRPLENFDKDIVKHLVDATINLGVRLVLETEVSKIESEDGHFVTTGISEGMETTYKSKAVFNSAGRPPAIFDLELEKAGISFSKKGIAVNEYLQSISNANIYAAGDAADSRGLPLTPVAVLEGHVVASNIIKGNKKKVSYPPMPSVVFTLPTMATVGLLEDKAKEKGFDINVNFEKVGNWFNARRLNVDEYAFKTIIDKNSNTILGAHLIGPHCEETINLFAMAIKTKMTISDLRTMIFSYPTMVSDLTYML

SEQ ID NO: 65630 - protein, 293 aa, Desulfovibrio vulgaris subsp. vulgaris str. Hildenborough
MSEACSGCSSTAQGGCGGSGAQDLEAMAAQKRLKDNLARIRHRIVVMSGKGGVGKSTVAANLAAGLALAGKRVGLLDVDVHGPSIPRLLCLDQSKVDVEGDLIKPVMWGDNLKVMSLGFFLPNGQQAVIWRGPVKIGFIQQLVGDVEWGDLDYLIVDCPPGTGDEPLSAVQLLNPGAHALVVTTPQAVAIDDVRRSLGFCAEIGIPVLGLVENMSGIVCSQCGNIEELFGKGGGEALAKEMAVPFLAALPLDPQVVRSGDEGWVYIKHHPERPTALALRPVIDAALGLDAAKA

SEQ ID NO: 65631 - protein, 596 aa, Oryza sativa
  misc_feature (146)..(146): Xaa can be any naturally occurring amino acid
  misc_feature (301)..(301): Xaa can be any naturally occurring amino acid
KLGSFLRKQPSFLLILLILHLGAREARALSSDGEALLAFKKAVTTSDGIFLNWREQDVDPCNWKGVGCDSHTKRVVCLILAYHKLVGPIPPEIGRLNQLQALSLQGNSLYGSLPPELGNCTKLQQLYLQGNYLSGHIPSEFGDLVXELGTLDLSSNTLSGSIPPSLDKLAKLTSFNVSMNFLTGAIPSDGSLVNFNESSFIGNRGLCGKQINSVCKDALQSPSNGPLAASADDFINRRNGKNSTRLVISAVATVGALLLVALMCFWGCFLYKNFGKKDIHGFRVELCGGSSIVMFHGELPXSTKEILKKLETMDDENIIGVRGFGTVYKLAMDDGNVFALKRIMKTNEGLGQFFDRELEILGSVKHRYLVNLRGYCNSPSSKLLIYDYLPGGNLDEVLHEKSEQLDWDARINIILGAAKGLAYLHHDCSPRIIHRDIKSSNILLDGNFEARVSDFGLAKLLEDDKSHITTIVAGTFGYLAPEYMQSGRATEKTDVYSFGVLLLEILSGKRPTDASFIEKGLNIVGWLNFLVGENREREIVDPYCEGVQIETLDALLSLAKQCVSSLPEERPTMHRVVQMLESDVITPCPSDFYDSE

SEQ ID NO: 65632 - protein, 213 aa, Aspergillus nidulans FGSC A4
MMLSRRACYKCGNIGHYAGKQPGHESSSCPRPRTTESLGHVQADCPTLRLNGANGRCYNCSQPGHLARNCPAPASGAPRGTGAPRGGFGGGFRGGYGGYPRAATCYKCGGPNHFARDCQAQAMKCYACGKLGHISRDCTAPNGGPLSSAGKVCYKCSQAGHISRDCPNNEATTESAIPAAATAPVAAPVAAAAAAVETDAGPVAAAAPTTAVA

SEQ ID NO: 65633 - protein, 506 aa, Sesamum indicum
MEAEMLYSALALTFAIFMVYRILSNSQDKRSLTKLPPSPPGWLPVIGHAHLMKNLLHRTLYDFSQKLGPIFSIRFGSRLVVVVSSSSLVEECFTKYDIVLANRPQASVDRRSLGFSTTSVIGAPYGDHWRNLRKLCDLEVFAPTRLASFLSIRLDERDRMISALYKISSAGFAKVNLEAKIVELTFNNIMRMVAAKRYYGEEAEDDEEAKRFRDLTKEALELTSASNPGEIFPILRWLGCNGLEKKLAVHSRKTDEFMQGLLDEHRRGERQNTMVDHLLSLQESQPEYYTDEIITGLIVALIIAGTDASVVTTEWAMSLLLNHPKVLEKARKELDTLVGHERMVDEHDLPKLRYLHCIVLETLRLFPSVPTLVPHEPSEDCKIGGYNVPKGTMVLVNAWAIHRDPKVWDDPLSFKPDRFEIMEVETHKLLPFGMGRRACPGAGLAQKFVGLALGSLIQCFDWERTSPEKIDLNEGSGITLPKAKTLEAMCKPRHVMEKVLRQVSNV

SEQ ID NO: 65634 - protein, 218 aa, Brassica napus
TEEYSHTAVNKFNVIPDSLPEWVFDFMPSHGGFFIGNVSPARMDFRWFALGNCIAILSSMATPEQSTAIMDLIESRWEELVGEMPLKVCYPAIESHEWRIVTGCDPKNTRWSYHNGGSWPVLLWLLTAACIKTGRPQIARRAIEVAEARLHKDNWPEYYDGKLGRYVGKQSRKCQTWSIAGYLVAKMMLEDPSHVGMVALEEAKQMKPVMRRSNSWTC

SEQ ID NO: 65635 - protein, 265 aa, Desulfovibrio vulgaris subsp. vulgaris str. Hildenborough
MQTTLGCIGCGNMGSAILRGLSGREGLRLVGCDPTGAKLAALADAGVEGVADIAAAVRASDIVLVAVKPGQVGAVLGAAMPELDSGKVVVSIASGVSVGSLREMSGGRCPVVRVMPNTPAMVGAGVFALCFEDATLDEVRRTLVKELFEALGRVLVLPEEKFNAFTAVVGCGPAYVFHFMEAVVEAAVTLGFPRHEATDMVVDLFAGSVKLAATSGTHLSLLREAVCSPAGNTIAAMNQFDRDAVRGRIIDAILAAYRRGQEMER

SEQ ID NO: 65636 - protein, 139 aa, Desulfovibrio vulgaris subsp. vulgaris str. Hildenborough
MVERTFSIIKPDAVERNLQGEVLAMIQGAGLKVVAMKMIHLTKAQAEGFYAVHRERPFFDSLTTYMCSGPVVCSVLEGENAISRYREIMGATNPANAAEGTIRKKYAVSLEANSVHGSDAPETAAFEISYFFNALEIVG

SEQ ID NO: 65637 - protein, 115 aa, Burkholderia vietnamiensis G4
MLYRGSCHCGDVKFDAQGDLQGVMACNCSICRRKGALLWFVPRAHVTFSTPDDNLATYTFNQHTIRHRFCKRCGIHTFAEATHPNGTEMVCINVRCLEDVDPDVLPVTHYDGRSR

SEQ ID NO: 65638 - protein, 430 aa, Arabidopsis thaliana
MITDLPKDLIEEILSRVSMTSMRVVRLTCKSWNTLSNSESFKKMHIGKVTSTREGESRVIMLIDYNLFLMSAVLMDDVDPSIEFKGKLSCLKEQVKISQVFHCEGLLLCILKDDTRIVVWNPYRQETRWIIPRYSHRPYVMNNIRYALGYENNKSGRSLKLLRFIDYCYTEKHICWHEIYDFDSDLWTTLDVTPHWYILSNWSCVQGVSLKGNTYWCAREENSDGYNHIICFDFTRERFGPLLPLPVNVIDNEYEYVTSSCVREGKIAALFQHNDSYPYELEIWITTKIEAEMVSWNKFLRIDIEPNNNIMVPFIYGGFFIDEEKKKVALGFDEEFGRKTFNIIGEDGYFREFDRITFNIIEEAGERAGVNCGSYVCSYVPSLVRIKKPAQGKRKRQSSLEKLRFDQNTWIFDSIYQATASQIRRRRPTR

SEQ ID NO: 65639 - protein, 181 aa, Prochlorococcus marinus str. MIT 9215
MQSESRESIFKTDSKTILILIISIVFISLLLFRNIFFKSTYLLKSFGELSVDPEIAFTNHKPTFLEFYAEWCEVCKEMAPKVSAFKDQYEKEINFVFLNVDNQKWGKYIQKFAVNGIPQINLFDNKGNLIFTFIGKQDEMKIREAINNLGRDEKPYEEIINSEFSSIQENKNNAVSPRTHG

SEQ ID NO: 65640 - protein, 349 aa, Vicia faba
MDMPPPIMHDSDRYDFVRDIGSGNFGVARLMTDKLTKDLVAVKYIERGDKIDENVKREIINHRSLRHPNIVRFKEVILTPTHLAIVMEYASGGEMSDRISKAGRFTEDEARFFFQQLISGVSYCHSMQVCHRDLKLENTLLDGDPALHLKICDFGYSKSSVLHSQPKSTVGTPAYIAPEVLLKQEYDGKIADVWSCGVTLYVMLVGSYPFEDPDNPKDFRKTIQRVLSVQYSVPDFVQISPECRDIISRIFVFDPAERITIPEIMKNEWFRKNLPADLVNENIMDNQFEEPDQPMQSMDTIMQIISEATVPAAGSYYFDEFIEVDEDMDEIDSDYELDVDSSGEIVYAI

SEQ ID NO: 65641 - protein, 439 aa, Thermobifida fusca YX
MGVSTYTSDLVVVGLGYVGLPLAHEACRSGLKVTGLDVNQRVVDGLNAGKSHIDDLSELDIADMRAAGFTATSDPSVLRNAQTIVICVPTPLSEEGSPDLSAVTSAAETIAAHLSPGTLVILESTTFPGTTDEVLRPILERSGLVAGKDFHLAFSPERIDPGNTLFGVANTPKVVGGYTELCGEIAAAFYGKFVRTVVRARGTREAEMAKLLENTYRHVNIALVNEMAIFCRELGVDLWDAIACAATKPFGFQAFYPGPGVGGHCIPIDPNYLSYKVKTLGYPFRFVELAQEINSRMPDYVLWRVQDMLNEAGLALSRSTILLLGVTYKANIADQRESPSRAVAAKLMQKGATLLFHDPHVPEWQVNGSPIPRADDLEQALGEADLTVLLTDHSEYTPKMLLERCQRLLDTRGVLRRADSELPGGRLTASISRKGVQVL

SEQ ID NO: 65642 - protein, 436 aa, Mycobacterium sp. MCS
MSIPVPALTPEQIRALDAAHVWHPYSTIGAGALPPVVALAAKGVWITIDHPAGGGPVDVIDAMSSWWTAIHGHGHPVLDAAITRQLATMNHVMFGGLTHEPAVRLAQLLVHITPPGLDTVFFSDSGSVSVEVAVKMALQYWRAAGRPGKTRLMTWRGGYHGDTFTPMSVCDPDGGMHSLWTDVLTRQVFAPPVPRDYDPGYVAAFERRLAEHADELAAVIVEPVVQGAGGMRFHDPRYLSDLRTLCDRHGVLLVFDEIATGFGRTGELFAADHVGVSPDIMCVGKGLTGGYLTLAATLCSAEIARVISTGEAGALMHGPTFMANALACAVGVAAVELLLAGDWRSTIATIERGLTEGLAPAREVSGVADVRVLGAIGVVELDRPVDMATATAAALSHRVWLRPFRNLVYVMPPYICTPEEIAQITSAVVGVARALA

SEQ ID NO: 65643 - protein, 326 aa, Sinorhizobium fredii
MQNNNILVVGGAGYIGSHTCLRLAEKGYHPVVYDNLSNGHEEFVRWGVLEKGDIRDRRRLDEVLARHKPRAVLHFAAMIEVGESVKDPVAFYDNNVIGTLTLLSATLAAGIEAFVFSSTCATYGLPDSVPMDETHKQAPINPYGRTKWVCEQALKDYGLYKGLRSVILRYFNAAGADFEGRIGEWHEPETHAIPLAIDAALGRRDGFKVFGTDYETRDGTCVRDYIHVLDLADAHVRAVDYLLEGGDSVELNLGTGTGTTVKELLDAIEKVSRRPFDVSYVGRRDGDSTTLVANNDKARQVLGWEPQYDLAAITESAWNWHSRRNG

SEQ ID NO: 65644 - protein, 209 aa, Shigella dysenteriae
LRRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQGT

SEQ ID NO: 65645 - protein, 426 aa, Mycobacterium sp. MCS
MSAELSQTPRTSPITAADIDEAAQRIVDVVVRTPLQFSERLSEVTGAQVYLKREDLQAVRSYKLRGAFNLISQLTEEEIAAGVVCSSAGNHAQGFAMACRTMGIKGRVYIPAKTPKQKRDRIRYHGREFIELIAVGTTYDLAAAAAIDDVARTGATLVPPYDDVRTMAGQGTIAAEILDDLDAEPDLVIVPVGGGGCIAGITTYLAERTSGTAVLGVEPAGAASMIAALSAGEPVTLDHVDQFVDGAAVNRAGRLPFAALQAAGDMVSLTTVDEGAVCSAMLDLYQNEGIIAEPAGALSVAGLLENNVEPGSTVVCLISGGNNDVSRYGEILERSLVHLGLKHYFLVDFPQEPGALRRFLDEVLGPNDDITLFEYVKRNNRETGEALVGIELGSAADFDGLLTRMRSSDMHVEALEPDSPAYRYLL

SEQ ID NO: 65646 - protein, 208 aa, Shigella dysenteriae
RRELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGLAAMIGVAMIVGFSFQGT

SEQ ID NO: 65647 - protein, 791 aa, Pseudomonas fluorescens Pf-5
MVEYVVSLDKLGKHDVEHVGGKNASLGEMISNLAGAGVSVPGGFATTAQAYRDFLELSGLNDQIHAALDALDVDDVNALAKTGAQIRQWIMEAEFPERLNTEIRTAFAALSAGNPDIAVAVRSSATAEDLPDASFAGQQETFLNIRGVDNVIRAAKEVFASLFNDRAISYRVHQGFDHKLVALSAGVQRMVRSETGTAGVMFTLDTESGFRDVVFITGAYGLGETVVQGAVNPDEFYVHKNTLEAGRPAILRRNLGSKAIKMIYGDEAKAGRSVKTVDVDAADRARFCLSDAEVSELAKQAMIIEKHYQCPMDIEWAKDGDDGKLYIVQARPETVKSRTQANVMERYLLKETGTVLVEGRAIGQRIGAGKVRIIKDVSEMDKVQAGDVLVSDMTDPDWEPVMKRASAIVTNRGGRTCHAAIIARELGIPAVVGCGNATELLKDGQGVTVSCAEGDTGFIFEGELGFDIKQNSVDAMPELPFKIMMNVGNPDRAFDFAQLPNAGVGLARLEFIINRMIGVHPKALLNYAGLPQEIKDSVDKRIAGYHDPVDFYVDKLVEGISTLAAAFTPKKVIVRLSDFKSNEYANLIGGKLYEPEEENPMLGFRGASRYISESFRDCFELECRALKRVRNEMGLTNVEIMVPFVRTLGEASQVVDLLAENGLKRGENGLRVIMMCELPSNAILADEFLEYFDGFSIGSNDLTQLTLGLDRDSGIIAHLFDERNPAVKKLLANAIAACNKAGKYIGICGQGPSDHPDLAKWLMEQGIESVSLNPDSVLETWFFLAEGQGAA

SEQ ID NO: 65648 - protein, 428 aa, Panicum miliaceum
MAALSRAASCLTRRPQMQPSRLQAARAMASSLFGHVEPAPKDPILGVTEAFLADPSPDKVNVGVGAYRDDNGKPLVLDCVREAERRIAGNLNMEYLPMGGSIKTIEESLKLAYGEDSEHIKDKRIAAVQALSGTGACRLFADFQKRFLPDSQIYIPTPTWSNHHNIWRDAQVPQKTFTYYHPETRGLDFAGLMNDIKNAPDGSFFLLHACAHNPTGVDPTEEQWREISHQFKVKKHFPFFDMAYQGFASGDPERDAKAIRIFLEDGHQIGCAQSYAKNMGLYGQRVGCLSILCEDEMQAVSVKSQLQQIARPMYSNPPVHGALVVSIILSDPELKSLWLKEVKGMADRIIGMRTALKENLEKLGSSLSWEHITNQIGMFCYSGMTPEQVDRLTNEFHIYMTRNGRISMAGVTTGNVAYLANAIHEVTK

SEQ ID NO: 65649 - protein, 256 aa, Oceanicola granulosus HTCC2516
MTDLTMFDLTGKTALVTGAKRGIGRSMAEALAGAGADIVGVSATLEEEGSAVGQAVEALGRSFRGYACDFSDRAALGAFIARLEADGIVPDILVNNAGTIRRKPAAEHEDALWDEVIETNLSAQFVLSREIGRQMVARGSGKIIFTASLLTFQGGITVPGYAASKGGIGQLTKALANEWAGKGVNVNAIAPGYVATDNTRALQDDPARSRSILERIPAGRWGRPADFAGPAIFLASAASDYVNGEILVVDGGWMGR

SEQ ID NO: 65650 - protein, 193 aa, Shigella flexneri 2a
TMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVG

SEQ ID NO: 65651 - protein, 312 aa, Brassica napus
MASSLTAAGTQPSAPSFSGLRRTCLKLEAAVSFSHRVNSSIRLVSSSQRSPRGVVAMAGSGKFFVGGNWKCNGTKDSITKLVSDLNTATLEPDVDVVVSPPFVYIDQVKSSLTDRIEISGQNSWVGKGGAFTGEISVEQLKDIGCKWVILGHSERRHVIGEKDEFIGKKAAYALSEGLGVIACIGEKLEEREAGKTFDVCFDQLKAFADAVPSWDKVVVAYEPVWAIGTGKVASPQQAQEVHVAVRDWLKKNVSEEVASKTRIIYGGSVNGGNCAELAKEEDIDGFLVGGASLKGPEFATIVNSVTSKKVAA

SEQ ID NO: 65652 - protein, 505 aa, Oryza sativa
MGHELWVLWATLAVSLLCYLYLTSHRLGSRRRRWPPGPRPLPLLGNLLDLRGGNLHHTLARLARAHGAPVMRLQLGLSPAVVISSPGAAREAFTAHDRRLAARAVPDANHALGFCDRSMIWLPSADPMWRTLRGVVAAHAFSPRALAAARAVHERKVRDLVAYLRGRAGREVDVKDAVYGGVLNLVSSALFSADVVDVGGESAQGFRELVEELIESIAKPNVSDLFPFLRPFDLQGWRRWTSGHLAKIYKVLDDIIDRRTAEDDAAMDKRGDFLDVLLELMSTGKIAREYLTNILFDVFTAGSDTMSLTVVWAMAELLRNPGVMAKARAEIDAALGGREAVEEADVARMPYVQAVLKEAMRLHPVAPVMLPRKAAEDGVEIGGFEVPRGCAVIFNTWAIMRDPAAWERPDEFVPERFVGRSRATEEMDFRGKDFGFLPFGSGRRLCPGVPMAERVLPLIMASLLHAFEWRLPDGMSAEQLDVSEKFTTANVLAVPLKAVPVVIAC

SEQ ID NO: 65653 - protein, 162 aa, Oceanicola granulosus HTCC2516
MALTTGDTLPDATLLRIGNDGPETVDLGAMLAGRKVVIFGLPGAYTGTCTSAHVPSFIRSMDALGAKGVDAVVCTAVNDPFVMKAWGESTGAAEAGIEMLADASGQFAKAIGLDFDNPAVGFYGRSKRYALMAEDGVVKVLNVEDSPGVCDMSGGETMVDAL

SEQ ID NO: 65654 - protein, 4202 aa, Gibberella zeae PH-1
MIVYPVLADDEYITITKPYRGSVTALYTVPPQGDEPGIIIVEQPGGSSAPENVVIPATDDRSYVIVIRPYKGAKSISAPITQVVPPRDGRPGQIIIETPETAAAALTPGVLFPVTLEPQYANDYVTVLQPVAGTLASLQLITITPTGTNRGSVIVNIPASSFNRGNAQGITLQPDAEGDYVTVLQPAGVSFTGTTPVRITVPPSGDRPGTIIIQTPIPGLLRPVSLETLSSNSLSALGLLAGQTITLQPTDATGYVTIIEPAEGSVTPTAPIRTTIPPTGTKPGTVLIQTPPGGNNGQPGGGASTDAVGATIPPTRTRPGGAIPYTTVTRGVSNNFGDSGSGSGNGSADGNGDGDGEDGSNEDDDSGSGGVQGRPGQGQGNNEGPRETLTIPPEGGRPGTVLVLTPDGQSDSQTDDDSDDSPGSTQPTGGSDTGGQTGSSNGDSQSGSGSSGSSGSGSSGSSGSGSGSGSGSGSGSGSSGSGSGSGSGSGSGSGSGSGSGSGSGSSGSGSSGSGSSGSGSGSNGSGQGGSSGNGDSNGNDDDETGSGGVQGNGSGSQGDDGEGDTDGDSSGNGVSSGSGSANTNGKGSQPGANPDGSSDGTSGSGDSGGSKGGNGGGAGSGNGRSSTKSAGTSKNTKGASNDDSDDDDGDSLNEGTLGGGGRPGGDGNANDKSSRSSGRKSSTSKRSTSTKSPVVVTEPTTYTTTSDKTVKTITSNIVKTLSDSKSSTRQSPTTKRTTSLKGNLEGLGGGSAAGSTTFTRPANSRSTSSKEASTSKDNGNAGKDPAASTVLTNAPPEASPGPSPESTKTSSSKSTFSGSIDTAVRPGGSGISTTSRKSTASPSQTTKGSSKTSSNVNGGPDKTDASTSKTGSSTSTVGSKSTLSSTKSGQGSSGSVVASSRASSSTSSTASLKGNPEGLGTRTDDTEESTTQRNTGSSSVITSSTSHSSTTKSSGTTSPIVNTRPGGDTAGQGSSTSSRPSSSQTITKTSTTTSKEVINIDTLIGSQSVAESDRVPQGDEETSTARRTTSSSTSSSRDEDQESATSTSESSPDAETTSTIDGSTATARDGEGDNDSSSTEAGLTGEPAGGPGRTTIVDEEDPEPSTVISNGAPIVVEPSSSATSDDADSEESSSGSEDGASETGEDDDEESSATDTATAQDPDAEETSSETQSDGAQETEDPGSDDEGTSLITPQMPVPTSPLLSTVSGDESLSDNEDPDAETGDIITDEPTGSATAGPDASDAASDGETSETDDSDAEETSATEGSEPAETSDTDGDGGGDSATATATATDDSGSNTEDGNQATTDVSTEIPSDTITEDGTQTTEEPDGDLSTVTFFREGQGPFRTTVYIPPQETGDPWTVIIETLVSDTQSEGATARGDDDAVATAPAITGTANITLFRGGSIRRTFYMTPSASDQPGTVIIETPTGAIPSTTAFTTIFSAGTGSATVTIYYPPDDPDEPGTFVIETPVSGADEASASEDVNEGTDSDATITPAPSDILSPEVEGNLTLYRSGEESTRQTIFIPPTSSGDRWIVIIETPASETELEETGTAATVPGFQTTIASVTGTANFTIFTTGTATTRKTSYIAPKTSGEPGTIVIETPVPISSSSGLTANPEALTTDDAISVESTTTVFIQGTGTRATTYYVPPAVTGVPGTLYIEAPATGSSDENTETDLPPGVLPNVTISSGVPGSVTRTVYVSPTASGEAGTIIIEVPTGGSGDNDDDGDIISAATTVTSFRGGPASVTITSYIPPTVSGEAGTLIIITPTEGSGASTTGGEDAVETGDPSDPNADSISATTTTTVYQGGPGSIRSTSYIPPTASDEPGTLIIVTPTDGSEASATDDEDAEETEDASKTDSITDIDVIEATTTFTSFTEAGSPTAVITSGGNVTIYSGGPALSTTTRYIPATVSGEQGTVIIETPTSGPQATGIGNVTIVTGGPATITQTIYIPATGTDEPGTIVIETPTSGVDEDIMINSTIYSGVSATGTRTVYVSPTASGEPWIIIIETPAVKAPENVTVYTGISATAATTRFVPGTDSDDIGTIIIETPLDSPTYVTVYTGGPGTATTTIYLTPSASGDSTTMVIQTPTQGDGDAEPSDTGAISVPGNVTVTSGGSGSATSTIYVAPTASGQSGTIIVEYPTGDTGDDDAITIAPTGSGGNSTITRGGPASVTTTIYIPPTASGEGGIIIVETPTDDDGETNVPETGTITDEPGATGQPGNTTIFSEASGTAAETLYYPPDDPSEPGTVVVVAPSRPTATTIYSGGPVTSPRTLYISATVSGELDTVLIETPTTGVEAEISEAESGQRTTTIFGGGSGSATRTIVISATVSGEPDTVLIETPTGAEVEATTITRGGSVSVATTVTVPGVSGGPDTVYVETPTVSDEDAASETDDDQVEATTITRGGPASVATTITVPGVSGGPDIVYVETPTTSLNDAASETADGEVQAITITRGGPVSAATTYTIIGAPGEPDTVYVETPTMSADDPTGSNGIDATTITRGGPVSVATTITVSGVSGQPDIVYVETPTTAADGAASETGDDLEPTTITRGGSVSEATTITIPGAPGEPDTVYVETPTAPAGGNDATTITTGGPVSVATTITISGVSGEPDTVLVETPTTSAGEVEATTITRGGTVSAATTITIPGEPGEPDTVVVETPAESSRSAVEYTTVTRGGPVTAATTVTVQGISGEPDTVFIETPTESPSDTEPEYTTITRGNTVSAATTITIPGVSGQPGTIVVETPAETTRDGEVEYTTITRGGSVTAAITVTIPGVSGGPDTVFIETPTEPAAGSGELEPSTIITGGPVTAATTITIPGLSGAPDTILIETPTEFSGDEPSVTDNGSDEETIATTITRGTAVTAATTLTLTGQSGEPGTVIVETPIDGLEDEETATDTATGVVVSPQGRPNTTVYFGGPVTAPQTRYVSATVSGELDTVFVETPTAGSNEDEVEYTTIFSGGSGTAVRTTTLQPDDPDDLGTVIIVTPTGSGETTTDDAEEVEYTTIFSGGSETTIRTTTLQPDSPDELGTIIVITPTGSADTTTDDAEEIDYTTIFSGGSGTAIRTTTLQPDDPDELGTVIVVTPTDAGETATDDAEDVEYTTIFSGGSGTATRTITLQPDTPGELGTVIVETPTGAEVTATDDADDIEYTTIFSGGPVTAATTRTLQPDIPGELGTVVIETPTAPGDADDVEYTTIFAGGPGTVIRTTTLEPDAPGDIVTVIVETPIGYDDDVEYTTIFSGGPVTAATTRTLQPDIPGELGTVVIETPTATGDSVDIEYTTVFTGGPGTAIRTITLEPDSPEDLVTVIVETPTAIADDVEYTTIFSGGPVTATRTITLEPDTPGDLGTVIIETPTTTLDEIEYTTIFSGGSVTARRTTTLQPGSQGDLGTVVIETPTSADEEAQYTTIFVGGPANVPRTTTVTPESSGALGTVIVETPTGDNAIEYTTILSGGPVTALRTTTIAPGSPDDLGTVIIETPTGGNEEEIEYTTIFSGGSGTASRTTTLAPGSPGDLGTVIIETPTNGEGTAEIEYTTVFSGGSVTASRTTTLAPGSPGDLGTVIIETPIIREGTAAADETSYTTIFSGGPVTASRTTTLAPGAPGDLGTVFIETPTTAAAGEITYTTIFSGGSVTASRTTTLAPGSPGDLGTVIIETPTTAAEIRYTTIFSGGSVTAPRTTTLAPGAPGDLGTVIIETPTSAVGRNTTIYSGGSGSVATTIYYPPATNDPDQVGTILIETPTPTPSPTPPPVIQNVTQTIGGPAGITTTIYYSPAAPNEPGTVLIQTPTTTIEPVIQNVTRTIGGPAGITTTIYYSPAAPNEPGTILIQTPTTTLVVQNVTRTTGGSVATTIYLTPGAAGDPGTVIIQTQTTPAVIVPTTTTTIFRAASSTATAGTTFYIPPAASGDPGTVIIETLVSSTTSSSSTSTSVAATGMPTFDCNGYGYIVSSLLAPSLTRVDLVTGERLQIASGVGPGLSVQAVGFNPTDNYIYGFASRGLILSVLCLLVPCQQVQLIRIASNGNYELLPLYIKSSAISMGDFDNTGKLWVSEGGVKWWSIDLQKGSPNFATIINSGTSFGTGLLVAVGDWSYLPGMGNNLFSVQTSVIGNGLVRTNVVRWSMATQTWTTYRTYPSLLLTALNLLWGATIAAPNNVLFAQENLLGQTWRFDLSSTTSANPTPIPGGAILNLNGDGAKCASGVV

SEQ ID NO: 65655 - protein, 335 aa, Xylella fastidiosa Dixon
MTQTITVIRGDGIGPEIMDATLSVLNALQANLNYEFADAGLSALEKHGDLLPEATLNSISKNKIALKSPLTTPVGEGFSSINVALRRKFDLYANVRPAKSFPNTKSRFSDNVDLITVRENTEGAYLSEGQTISPDGEVATSSARVTRKGSERIVRYAFDLARTTGRKKVTAVHKANIIKSTSGLFLKTARDVASQYPEIDFQEMIVDNTCMQLVMRPEQFDIIVTTNLFGDILSDLCAGLVGGLGLAPGANIGNEQAIFEAVHGSAPDIAGQGKANPCALLLGAVQMLDHIGQPQNAERLRNAIVATLNAKDSLTPDLGGNGNTMGFAKAIASRL

SEQ ID NO: 65656 - protein, 202 aa, Oryza sativa Japonica Group
MATFKQSFLKNLLSSLKSSSKNKAAMSTLSERKRAIKSSADIAMATARTGIAGAARWPHAILASSSSSSSSSSSSSSSSSMPRTTFPCKMMQGKVRRRCKSIVRRRTPLMSSSSEVARRLVKKRDKVLRRMIPGGELIADEISLLHEAMDYVVHLHAQVDVLRRVSRAAVARRSSASSSSSGGLAQLKERTVQISGETENPC

SEQ ID NO: 65657 - protein, 386 aa, Geobacter metallireducens GS-15
MNIHEYQAKAILRNFGVPVPDGHVCYNGASAREWAKRLGDGPWVVKAQIHAGGRGKGGGVKLARTNQEVQQIARDMLGMTLRTHQTGPEGKVVTRVLVENGCNIDRELYVSLLVDRATSRVTVMASTEGGMDIEEVAAKTPEKIFREAIDPLVGLTPFQSRNLAFSLGLTGKLTPKAVNLLEGLYTTFLACDCSLLEINPLVVTKEGDLLALDAKFGFDDNAVFKHPGIADFRDYNEEDPNEVEASQHDLSYVSLNGNIGCLVNGAGLAMATMDIIKFSGGEPANFLDVGGGATIERVTEAFKIILSDKNVKGIFVNIFGGIMKCDVIATGVIEAARQVSLQVPLVVRLEGTNVEIGKKMLAESGLNIVAADGMADGAQKIVQAVA

SEQ ID NO: 65658 - protein, 303 aa, Triticum aestivum
MGDGVAFEAARKIIMHPLYASRSSPWLDLKVFYVRVSNCMVDESAPDHLTLNHIPLSPDTVIEVNGRRSSMHTEFVSSSLRRDRIDKKTEEATYVSTDSIRMTGSVRFQVFDKNDLLLTGDLELCNANGVVGEPKSSSKKWNIKCHSSASSSGFLKGKMSTGPDSAHPVVEVYVAGTFSGTPIILTKTVQFISRRKSQMKLKLDFIPENEATELHTENSHGDSLKISEFYDPKSETDMDMDYNSLYSRQDFLEGEDGELSWFNAGVRVGVGIGLPICVGVGLGVGLLVRTYQGTSRNFRRRLP

SEQ ID NO: 65659 - protein, 1509 aa, Oryza sativa
MSWSGDYEKYMATAAAVAGTAMVVRGVVSELVPDELREMLRSAARGIRARVSSTHTVVIDETEGLSTNQIYDAARTYLAARINTDMQRLRASRVDDAQGIMITMDQGEEMLDVHDGVEYTWRLVSRDTAAAATAHAAPYGIGGGGAANRRGRSRFEVKSFEVSFHKKHKEKALRSYLPFVIDTAKAMNDKHRNLKMHMIEYDAWTAVDLRHPSTFDTLAMDHSLKHSVMYDLERFVKRKDYYRRIGRAWKRGYLLYGPPGTGKSSLIAAMANYLKFDIYDLELTEQRDEGEIKRAKPTYSGEENEDKVTLSGLLNFVDGLWSTSGEERIIVFTTNYRERLDPALLRPGRMDMHIHMGYCTREAFRVLASNYHNVENHAMYPEIEQLIEEVLTTPAEVAEVLMRNDDVDVALQVLAEFLKAKRNEPGETKAENKNGNQKINKYEQSMVHNQPYNTLVGIKSSDRTTIFPKGKVCPVKKSPMKVHSRKRFRFYYDVNSDLNMIGVRRVRATAAAAVAAVVAEEGEEAEGGLAEGGGRAGGGGEGAERGVEHEGIGGAGEGGKEAEHGVGRGERGVGGLWSGGERLSAMPSRRAWRASGWSVAATRMAASMASSRASPRYSPSRGQTALRRNRMDSSAGDPGDGVPSKRARTERDPYRVETMEFLVLVKSELPDDVYSHFVRSMIKIRRQRNMSIEKCKEIILEILDGQPEAIQVFEHFIQGYSPCRAKMRSKAHNFVERVKACPDISREDFHALLNVLAKYYKNEIKTSEEVLEKVERIIGNYPEFLEEFKIFVPHHLRAHLPNEKSCTSPKSSRVSETFVSFTLDAMNKLDGLRVKATNGRNQATPLKYTQDQNQNHEGRGYSLRHKQTKRTTGLIENPRKQGDDKSPHAEDDEEHKAEPLLQWSTSRENELPLKVDPSNCKHCTPSYCLLPKNCVTLQSSYQTELGRSILNDSLVSVTSGREDCYKFRTKNQYEENMFKCEDDLFESDMLLQRFRATADFIEDLQYRFGSNVKIQEHLTPLHKRCIEQLYDDSGIDMLDALSESENTSSALAVILSRLNQKIGDFSEARLSLNKMCPDTVANNYYRSLDHCSPSFKQLDMEKDEPKSISLAALLAEDKQISRIKSHTDIHIHEDVGVIINYAYSRSCSTEDKPMMNWTKLVKAFVSVKFQWPDLKDTVSRRNVCEHCGMSRDFLNNIPVAVLTNEFVFSSKEVESLRAKSNESTSSLDHFDAEVEEGEFIPDVENIQLRVRCLPTNNSMHSTYGHWSGSEEHKSSRDDSNNEVGSSEYFGRTSKECDANRGISCCTLAVLCRLLQVMYERLLVAKNLSEGASTHDSYAHFKEKLCSLIDGSTDNWNFEQHCLKFLGPNSYVLFTLDKLIDRVIKQICKIYPSREDSSVLQRQERSRRTFNILKDPALPARRTNSSKELLHHQNARGTSIELPKQGREEAKGGCESHGDTGKMKQNHFQRSPAEGYRFARIFQHKMCTAQQLFEDIWREAEIFMEKQDTA

SEQ ID NO: 65660 - protein, 474 aa, Bacillus subtilis
MATEYDVVILGGGTGGYVAAIRAAQLGLKTAVVEKEKLGGTCLHKGCIPSKALLRSAEVYRTAREADQFGVETAGVSLNFEKVQQRKQAVVDKLAAGVNHLMKKGKIDVYTGYGRILGPSIFSPLPGTISVERGNGEENDMLIPKQVIIATGSRPRMLPGLEVDGKSVLTSDEALQMEELPQSIIIVGGGVIGIEWASMLHDFGVKVTVIEYADRILPTEDLEISKEMESLLKKKGIQFITGAKVLPDTMTKTSDDISIQAEKDGETVTYSAEKMLVSIGRQANIEGIGLENTDIVTENGMISVNESCQTKESHIYAIGDVIGGLQLAHVASHEGIIAVEHFAGLNPHPLDPTLVPKCIYSSPEAASVGLTEDEAKANGHNVKIGKFPFMAIGKALVYGESDGFVKIVADRDTDDILGVHMIGPHVTDMISEAGLAKVLDATPWEVGQTIHPHPTLSEAIGEAALAADGKAIHF

SEQ ID NO: 65661 - protein, 478 aa, Pseudomonas putida
MTQKFDVVVIGAGPGGYVAAIKAAQLGLKTACIEKYTDAEGKLALGGTCLNVGCIPSKALLDSSWKYKEAKESFNVHGISTGEVKMDVAAMVGRKAGIVKNLTGGVATLFKANGVTSIQGHGKLLAGKKVEVTKADGTTEVIEAENVILASGSRPIDIPPAPVDQNVIVDSTGALEFQAVPKRLGVIGAGVIGLELGSVWARLGAEVTVLEALDTFLMAADTAVSKEAQKTLTKQGLDIKLGARVTGSKVNGNEVEVTYTNAEGEQKITFDKLIVAVGRRPVTTDLLAADSGVTIDERGYIFVDDYCATSVPGVYAIGDVVRGMMLAHKASEEGIMVVERIKGHKAQMNYDLIPSVIYTHPEIAWVGKTEQALKAEGVEVNVGTFPFAASGRAMAANDTGGFVKVIADAKTDRVLGVHVIGPSAAELVQQGAIAMEFGTSAEDLGMMVFSHPTLSEALHEAALAVNGGAIHVANRKKR

SEQ ID NO: 65662 - protein, 141 aa, Oryza sativa Indica Group
MAGCTDDLRKLLTPRKSSKQPFRVKNFDPSSIEPPQRMLHGFGCDLFSVAIGADRIVCGGEDGAVKVWNFSEALEIEKRAQALRSMRQENRMRRKKAQVEMNANGRRSDQCGSIAMKRNQLKGDKSVTWHSKRAINDKVKS

SEQ ID NO: 65663 - protein, 137 aa, Oryza sativa Japonica Group
MAARVEARGFIFGPPIALAIGAKFIPLRKPNKLPGEVMSKEYELEYGADCLEMHVGAVQPGERALVVDDLVATGGTLCAAIVLLERAGAEVVECACVIELPELKATESVASHTCLTLPKGRERLNGKPLYVLVESHS

SEQ ID NO: 65664 - protein, 429 aa, Marinobacter sp. ELB17
MEHIDFNNDLLSFLNQSPTPWHAVATMKKQLDSAGFHPLDEKDDWSLQAGTGYYVIRNGSSIVAFRTGNTDTTKAGVRMVGAHTDSPCLKVKPNPVLRRKGFLQLGVEVYGGALLNPWFDRDLSLAGRVTYVDGNGQVQDALIDFRKPVAFIPSLAIHLDREANSNRTVNPQTDLPPVLMQVPEDDTTDFSSLLITQLKAEKGVTAERILGYELSFYDVQQAGFVGLRNNFIASARLDNLLSCYIGLQALLEATGEQPALLVCNDHEEVGSMSAEGAQGPFLSSVLERWCGAGKNRAIAHSMMISADNAHGIHPNFMDKHDENHGPQLNAGPVIKVNHNQRYATNSRSAAVYRHLSDQLGLPHQTFVVRSDMGCGSTIGPLTAANLGVTTLDIGVPQFGMHSIREMIGADDAYTLFKVLTGFYQSPQVF

SEQ ID NO: 65665 - protein, 486 aa, Burkholderia vietnamiensis G4
MSFESLGLAEPLVKAVNELGYTSPTPIQQQAIPAVLGGGDLLAGAQTGTGKTAGFTLPILQRLHTFYTEHRGAKRAVRALILTPTRELAAQVEESVRAYSKYVKLRSTVMFGGVSINPQIDALKRGVDIVVATPGRLLDHMQQKTIDLSDLDILVLDEADRMLDMGFIHDIKRVLAKLPPRRQNLLFSATFSDEIKALADSLLDSPALIEVARRNTTAETVAQKIHPVDRDRKRELLTHLIREHNWFQVLVFTRTKHGANRLAEQLTKDGISAMAIHGNKSQSARTRALAEFKNNTLQVLVATDIAARGIDIDQLPHVVNFDLPNVPEDYVHRIGRTGRAGATGEAVSLVCVDEKQLLRDIERLIKREIPQEVIAGFEPDPNVKPEPIQQRRGQQPRGGGNGGGGGGGGGNRQPRAGGSGQAGAKRDANAQPKAAKAAKPRAAGGASGNANGGGRPAGGGNGARPANGNAAHPNRNRSSRSGQRGH

SEQ ID NO: 65666 - protein, 453 aa, Arabidopsis lyrata subsp. petraea
MESSISQTLSKVSDPTTALLIVVSLFIFIGFITRRRRPPYPPGPRGWPIIGNMLMMDQLTHRGLANLAKKYGGLCHLRMGFLHMYAVSSPDVARQVLQVQDSVFSNRPATIAISYLTYDRADMAFAHYGPFWRQMRKVCVMKVFSRKRAESWASVRDEVDKMVRSVSCNVGKPINVGEHIFALTRNITYRAAFGSACEKGQDEFIRILQEFSKLFGAFNVADFIPYFGWIDPQGINKRLVKARNDLDGFIDDIIDEHMKKKENQNAVDDGDVVDTDMVDDLLAFYSEEAKLVSEAADLQNSIKLTRDNIKAIIMDVMFGGTETVASAIEWALTELLRSPEDLKRVQQELAEVVGLDRRVEEADIEKLTYLKCTLKETLRMHPPIPLLLHETAEDTSIDGFFIPKKSRVMINAFAIGRDPTSWADPDTFRPSRFLEPGVPDFKGSNFEFIPFGS

SEQ ID NO: 65667 - protein, 546 aa, Burkholderia vietnamiensis G4
MTGFDWHNPYPTTRIPVFARNVVSTSHPLAAQAGLRMLWKGGNAVDAALAAAAAITVVEPVSCGLGGDAFALVWDGERLSGLNASGVAPAAWNPDYFRRRHGEDAHGIAKQPTRGWDTVTVPGVIAGWEALHAKFGSLPFADLLEPAIEHAERGYSVSPIVAHKWAAAVPELHALPGFAQTFMPRGRAPLVGERMCLPDHAQTLRTLAHDGPRAFYEGALAARLAAFAREGGGALTEADLRAYRPEWVEPIGKRFGRHTVHEIPPNGQGIAALIALGIAEHVGVTDWPVDSADSQHLQIEAMKLAFADVYRYVADPRAMDVTPAEMLDDAYLAERAKLIDRTRATHFAAGRPHSGGTIYLSAADERGMMVSFIQSNYMGFGSGLVVPGTGIALQNRGHGFSMDPRSPNVVAGGKRPFHTIIPAFVTEQVDGRTEAVMSFGVMGGDMQPQGHLQTIVRMLGYHQQPQAACCAPRWKVNRDFTLDVEATMNRQTVDALAARGHTIKSVDDPYMDFGSGQFVWRLDPDDPERGYVAASDSRRDGLAAGF

SEQ ID NO: 65668 - protein, 484 aa, Geobacillus kaustophilus HTA426
MDAGWKFDNSYARLPERFFSKVLPTPVRAPKLAVLNRSLAVKLGLNEEALRSEDGVAVFGGNQIPGGAEPLAQAYAGHQFGYFTMLGDGRAVLLGEHVTPSGERVDIQLKGSGRTPYSRGGDGRAALGPMLREYIVSEAMHALGIPTTRSLAVVTTGETIMRETELPGAVLTRVASSHLRVGTFQYAAQWGTIEELRALADYALWRHFPGFEEAENRYLFLLEQVIERQAELIAKWQLVGFVHGVMNTDNMTISGETIDYGPCAFMDTYSLETVFSSIDTEGRYAYGNQPYIGGWNLARFAESLLPLLDENEEKAIALAQGALDEYPKRYHHHWLSGMRAKLGLAEEQEGDQELIADLLRLMEAHRADYTNTFRALTLGEYTGMALFDSAEFREWQERWQTRLSQESVSREEAYERMRRHNPAVIPRNHRVEEALAAAVHDGDYSVMERFLEALSDPYAYSPEQEKYAELPPPSDRPYRTFCGT

SEQ ID NO: 65669 - protein, 199 aa, Escherichia coli O157:H7 EDL933
MMSAPDIRHLPSDTGIEVAFAGRSNAGKSSALNTLTNQKSLARTSKTPGRTQLINLFEVADGKRLVDLPGYGYAEVPEEMKRKWQRALGEYLEKRQSLQGLVVLMDIRHPLKDLDQQMIEWAVDSNIAVLVLLTKADKLASGARKAQLNMVREAVLAFNGDVQVETFSSLKKQGVDKLRQKLDTWFNEMQPVEETQDGE

SEQ ID NO: 65670 - protein, 469 aa, Brucella suis 1330
MEKADIGMVGLGVMGSNLALNIAEKGYTVAVYDRDEPVLKAFIEKAGRLRDKIIPCPTFEELAANIRKPRPIIFLIKAGAPVDTETTRLKAFLEKGDIMIDAGNSDYRDTVRRLKALGPNDPTFVGMGVSGGAEGARHGPSMMVGGTEQAYERIAPILLAVAAKYQGEPCCALVGPDGAGHFVKTIHNGIEYADMQMIAEIYGILRDGLGLSAPAIGDVFEKWNEGPLNSYLIEITAKVLKSTDPETGKAMVDMILDEAGQKGTGRWAAIEAQILGVPATGIEAAVAARSLSSMKGEREEAAKAYKSGARTLDIANQTRFLSDLEQGLLAGKIAAYAQGFAVMEAASREHGWNIPLATTARIWRAGCIIRSQLLDDIAQAFEGNESRNLLMAPAFVPRMETSVKSLRQIVAQAALASLPLPALGSALSYFDSYTQALGTANLIQGQRDFFGSHGFKRIDKEGDFHGPWG

SEQ ID NO: 65671 - protein, 335 aa, Nocardia farcinica IFM 10152
MKLAVIPGDGIGPEVIAEALKVLDVVVPGVEKTEYDLGAKRYHATGEILPDSVLPELREHDAILLGAIGDPSVPSGVLERGLLLRTRFELDHHVNLRPSRLFTGVRSPLAGAPDIDFVVVREGTEGPYTGTGGAIRVRTPHEVATEVSTNTRFGIERVVRYAFAKAQARRKHLTLVHKTNVLTFAGSLWQRTVDEVGAEFPEVTVAYQHIDAATIHMVTDPGRFDVIVTDNLFGDIITDLAAAVSGGIGLAASGNIDASGTNPSMFEPVHGSAPDIAGQSKADPTAAILSVSLLLNHLGDTEAAARIDAAVAKDLAARSGTASTVEIGDRIAAAV

SEQ ID NO: 65672 - protein, 158 aa, Picea abies
  misc_feature (75)..(75): Xaa can be any naturally occurring amino acid
VAWSRDGSRLACSTMDGTIAIFDVPRAKFLYNLEGHYMPVRSLVFSPTDSRILFSASDDKHIHMYDVDNKSLICXMSGHASWVLSIDVSPDGLAVATGSSDRTVRLWDLSMRSSVQTMTNHTDQVWGVAFRPTGSPGSRAGRLASVSDDKSISLYDFT

SEQ ID NO: 65673 - protein, 196 aa, Escherichia coli
ARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIV

SEQ ID NO: 65674 - protein, 451 aa, Novosphingobium aromaticivorans DSM 12444
MAVSDHVDLPTFMEGVKKRNPYQPEFVQAVQEVAEDIFDFIEDKEEYHAQQILRRIAEPDRVVSFRVCWEDDNGNVRVQRGWRVQNNNAIGPYKGGIRFHPSVNESVLKFLAFEQTFKNALTGLPMGGGKGGSNFNPKGKSVREIMRFCQSFMTELYRHIGADVDVPAGDIGVGGREIGYMFGQYKRITNHFTGVLTGKGLEWGGSLIRTEATGYGAVYFLANMLATKGEDLRGKTAVISGSGNVATHAAEKIVQLGGKVLTLSDSGGFIHDPDGIDQEKIDWVKTHKTHRRGRIEEYVDAFPGASFHAGKTPWGVPCDVALPCATQNELLGEDARTLIANGCKGVAEGANMPTDLEGVHVFKAARILYAPGKASNAGGVAVSGLEMSQNSERRSWKEHELQQMLKDIMAGIHKSCLTYGDQGGGYIDYVKGANIAGFKKVADAMLAFGVV

SEQ ID NO: 65675 - protein, 205 aa, Escherichia coli
RELKARHLTMIAIGGSIGTGLFVASGATISQAGPGGALLSYMLIGLMVYFLMTSLGELAAYMPVSGSFATYGQNYVEEGFGFALGWNYWYNWAVTIAVDLVAAQLVMSWWFPDTPGWIWSALFLGVIFLLNYISVRGFGEAEYWFSLIKVTTVIVFIIVGVLMIIGIFKGAQPAGWSNWTIGEAPFAGGFAAMIGVAMIVGFSFQ

SEQ ID NO: 65676 - protein, 361 aa, Burkholderia mallei ATCC 23344
MSEKVYRIAVIPGDGIGVEVMPEGLRALDAVSRRFGLRFAYEPIEWASCDYYAKHGQMMPDDWKTQLSGMDALLFGAVGWPETVPDHISLWGSLIKFRREFDQYVNLRPARLFDGVPCPLAGRKAGDIDFMIVRENTEGEYSAVGGTMFEGTEREFVVQQAVFTRHGTERVLKFAFELAQRRAKRLTVATKSNGIAISMPWWDARAAEMAARYPDVTWDKQHIDILCARFVMQPDRFDVVVASNLFGDILSDLGPACTGTIGIAPSANLNPERNFPSLFEPVHGSAPDIAGKHIANPIAMIWSAAMMVDFLGAGTGRAREAHDAIVAAIEHVLKHGPRTRDMGGRASTREVGDAIVAHLLG

SEQ ID NO: 65677 - protein, 313 aa, Robiginitalea biformata HTCC2501
MSYTVPEPKLFACTQSQALGKEIAKAYGADLGKVIFSRYSDGEFQPSFEESIRGARIFIIGSTHPGPEHLMEMLLMLDAAKRASARHITAVMPYFGWARQDRKDKPRVPIAAKLVAKMLETAGATRIITMDLHADQIQGFFEKPVDHLFASTLFLPYLRKLKLDNLTIASPDMGGSKRAYAYSKALESDVVICYKQRAKANVISHMELIGDVADKNVVLVDDMVDTAGTLTKAADLMMERGAKSVRAITTHGLLSGSAYERIENSRLEELIITDSIPPRQESPKVKVLSCAELFADVMHRVHHNTSIASKFLM

SEQ ID NO: 65678 - protein, 1379 aa, Oryza sativa Japonica Group
MGCRALGPARFYWAVPGPIRMSSKKVPFHRHKENEEARKKREQDEAARVYEEFVESFKGDSTSGSKFVRGGVIDPNAKLRIDSEGGKSKDGGSVPKKGSRYVPSFLPPSFGKEPDKKKEEERPKEKERRKPRVIDEFMEELKFEKELRQKRNQEREQWREGRHTDTSASSSRFDELPDELDPIGKLPGSFDDGDPQTTNLYVGNLSPKVDENFLMRTFGRFGPIASVKIMWPRTEEERRRQRNCGFVAFMNRADGQAAKDEMEGVVVYDYELKLGWGKSVALPSQALPAPPPGHMAIRNKEGGTVILSGPGGPPLASVKPQTSELVLTPNVPDIVVAPPDDAHVRHVIDTMALHVLDGGCAFEQAVMERGRGNSLFSFLFDLKSKEHTYYVWRLYSFAQGSGDSILLEVNCDSKEGDTLQRWRTEPFIMITGSGRWVPPALPSSRSPEREKESTFAAGRSRRVEVERTLTDSQRDEFEDMLRALTLERSQIKEAMGFALDNADAAGEIVEVLTESLTLKETPIPTKVARLMLVSDILHNSSAPVKNASAFRTKFEAALPDVIESFNDLYRSITGRITAEALKERVLKVLQVWADWFLFSDAYLNGLRATFLRSSHLGVIPFHSLCGDTPEIEKKASSEDGSDGFRLNEDGALATGKAAATRELLGLPLAELERRCRHNGLSLCGGKEMMVARLLSLEEAEKERVYEKDAGIKYGQGESHRTGRDDIAVNARNASRPGEGTDSGESDMLGLSHYAMEAGYKRSNESTPAEPVPSKKPKVDPVLPASKWSREDDVSDDEDRKGGRGLGLSYSSGSDIAGDSGKADATEVSTDHSNHHQDTILDEEHRKKLRQIEIAVMQYRESLEEKGLRNTEEIEKKVASHRRRLQSEYGLSFSNDGANSRRSSERTSSDRRDRHDDSSRKRHRSLSRSRSPPRGSLERVREHNRNRDTDRSHGNDAGRERDRVREKSASRGRDDHYDRSRDREKDRRKGRLKVHYSHPLRLYNCILPVWSGLKCAKEKWMLRLETVSFCVLHGSSTDTCVMSVRFLFLFFSILLHQHWCFAYLLINMGIYLSTPKTDKFSEDGENDKLKLGLSSMQGWRANMEDAHSALLNLDNETSFFGVFDGHGGRVVAKFCAKYLHSQVLRSEAYSAGDLGTAVHRAFFRMDEMMRGQRGWRELSALGDKINKIGGMIEGLIWSPRGSDSNNGQDDWSFEEAYNLSRDHKPELEAERDRIVKAGGFIHMGRINGSLNLTRAIGDMEFKQNKFLPPEKQIVTANPDINVVELCDDDDFLVLACDGIWDCMSSQQLVDFIHEHIQKESSLSAVCERVLDRCLAPSTIGGEGCDNMTMVLVQFKKPITQNKKADVGEQSVKGVEEAEIK

SEQ ID NO: 65679 - protein, 263 aa, Physcomitrella patens subsp. patens
GASASDAGLIDALPDDVFMKCLVRVPLQWHANLQRASRGLREVVQSRQYYAQRKAEGTSSSFVCLLQPMPMSTETLAEKSCTATPAACSLDSVYGISLVDVNENVWSRLPAIPGFPGGLPTYCRLVALKGVLVVLGGWWQSTWEPSKSVFVFNFSTQTWRQGADMTNVRNFFACGATGSKVYVAGGHDGSKKALASVEVYDVETNCWESLGSMREERDECTGVVMDGKFYVVSGYGSESQGVFSTSAEAYDYSTKTWSFIDNM

SEQ ID NO: 65680 - protein, 399 aa, Desulfovibrio vulgaris subsp. vulgaris str. Hildenborough
MTTSFEALKNREESLLCRTYGRYPISVQRAEGSRMWDHEGREYIDLLSGIAVTSLGHCHPELAEVMARQARKLVHVSNLFYQEEQLDLAEKLLSTLHCTKAFFCNSGAEANEAAIKLARRYMQRVRGVDAHEVVTLTGAFHGRTLATVAATGQERFQDGFAPMPAGFRQAEWGDIDALRAAITPATAGVLVEMVQGEGGVRPMTQDYARAVADLCREKGVLLMVDEIQTGLCRTGRFWAHQHYGVEPDIVTSAKALANGLPMGAMMTTDEVAQGFVAGSHATTFGAGALVSSVAAATLDIMKRDRLDERATAVGGRAMERFRAIGAKLPGTIEEVRGYGLMIGIVLTFSGKEVWKELVARGFVCNNTQEKVLRLVPALTIDEADLTAFADTLEDILARR

SEQ ID NO: 65681 - protein, 358 aa, Oryza sativa Japonica Group
MAKFVITKKLIILHIREYLQEGAQGFFFDMSWAAIENDPGIFTELLQQMQLKGLQVDELYSLDLDALNDLQPVYGLIVLYKWQPPEKDERPIKDPIPNLFFAKQIINNACATQAIVSVLLNSPGITLSEELKKLKEFAKDLPPDLKGLAIVNSESIRLASNSFARPEVPEEQKSSVKDDDVYHFISYVPVDGVLYELDGLKEGPISLGKCPGGVGDIGWLRMVQPVIQERIDRFSQNEIRFSVMAILKNRREKFTLELKELQRKRENLLAQMGDPSANRHAPSVEHSLAEVAAHIEAVTEKIIMEEEKWKKWKTENIRRKHNYVPFLFNFLKILEERQQLKPLIEKAKQKSHSSANPR

SEQ ID NO: 65682 - protein, 271 aa, Candidatus Kuenenia stuttgartiensis
MLKEKFGFIGGGKMAEALCKGIIRAGLSAGSNIIVSDVLAERRRLLKEEIGVQTTQDNHDIAAFADVIILAVKPQIIGEALENIKNDITPRHLIISIAAGIPLHFIESKLRENVRVIRVMPNTPCLIASSATAFAPGKHTTEGDKKLAHAIFNAVGKVFQLEEKYLDAVTGVSGSGPAYVYMFIEALSDGGVKMGLPREIATALAAQTALGAAKMVLETGQHPAQLKDAVTSPAGTTIEGVSKLEDGGLRAAVINAVEAAALKSKKLGELL

SEQ ID NO: 65683 - protein, 242 aa, uncultured archaeon GZfos24D9
MKEGKMELIKDGKRLSGRGFEELRPIKIEVGLLKRADGSCYFELGNNKALAAVYGPREMHPRHFQNAKRAVVKYRYNMAPFSVDDRKRPGPDRRSQEISMVSRKALDPVILRELYPKTAIEVYVEVLQSDAGTRTAGINAASVALADAGIPMRDLVSSVAIGKIDGEVVLDLDAKEDNFGEADVPIAMIARTNTITLLQMDGRLKKEEFERGLKLAMNGCRKIYELQKAALVEKYSKSGNEV

SEQ ID NO: 65684 - protein, 507 aa, Burkholderia vietnamiensis G4
MTQPNRYDLLVVGGGINGAGIARDAAGRGLSVLLCEQDDLASHTSSCSTKLIHGGLRYLEYNEFGLVRKALQERETLLRAAPHIMWPLRFVMPHMPNLRPAWLIRVGLFLYDHLAKRELLPGSRGIDMRRHAAGAPLIDSIKRGFVYSDGWVDDARLVVLNALDAQERGAEILTRTKLVSAQRVGDAWEARLQLADGSMRVVHARAVANAAGPWVGEVLHGALGRGAHHSVRLVKGSHIITRRLFEHDHAYIFQNPDKRIIFAIPYEHDFTLIGTTDVEYTSDPAKVAIDRDETQYLCESINRYFKRKISPADVHWTYSGVRPLLEDENAANASAVTRDYRLEMDDGAGAPLLSVFGGKITTFRKLAEEAGDMLCRALGRDAPTWTAGAPLPGGDIPGAKFDAFADAFATRHPWLPAALARRYARAYGTRAERMLDGAQSLAELGAEVAPGLFDAELRYLRDVEWATCAQDVLWRRSKLGLHVAPGTLDAVTAALDAWFTAAHAPHA

SEQ ID NO: 65685 - protein, 260 aa, uncultured archaeon GZfos24D9
MGQEVIEDIRKDYVYDLIEKGKRADGRGFLDFRDIIVERDLIKKADGSTRVQIGDTVVLVGVKVEPGAPFPDTPNKGILMTNAELVPLASPEFESGPPNEDSIELARVVDRGIRGSETIDLEKLCIEEGEKVWMVFIDIHTLDNDGNLVDAAALGAITSLLNVTIPYERYGLTGEDTLQIRDTPVAVTVVEIGGNLLVDPNVYEESAATSKLTVISNADGSISGLQKSGSTGLTEEKIVKMIEIGIEKAREIREKYLPKI

SEQ ID NO: 65686 - protein, 575 aa, Physcomitrella patens subsp. patens
MGGGDKAKEALPDGSRTLGRYIAARLVEVGVRDLFTVPGDFNLVLLDHLMAEPGLELIGCCNELNAGYAADGYARANGVGACAVTFTVGGLSVINAIAGAYSENLPVICIIGGPNSNDYGTNRILHHTIGEIDFSQEHRCFQQVTCAQVVIQSLDDAHELVDRAISTAIGQSKPVYVSVSCNLAAMPHPSFRSAPLPYSMTQGPDPRSLEAAVDAVSSLLASAVKPVLVGGPKLRVAKACDSFEQLATACGYAVAVMPAAKGLFPESHRNFIGTYWGAVSSTFTAEIVESADKYLFAGPVFNDYSSVGYSLLIKKENIISLEPDRVMIGNGPSFGCVLMKDFLEVLAKKIKKNTTSFDNYSRMYVPVSVPPKQKPGEPLKAVNLFKHIQAMLTKDSAVIAETGDAWFNCQKLKLPDGCSYEFQMQYGSIGWAVGATFGYAQGAKQRRVIACIGDGSFQVTAQEVSSMIRNGQNSVIFLLNNGGYTIEVEIHDGPYNVIKNWNYTALVEAFANGEGRLWTCKVRTEEDLEKAIATVHEKDSLCFIEVILHRDDTSKELLEWGSRVATANSRPPNPQ

SEQ ID NO: 65687 - protein, 525 aa, Xylella fastidiosa Dixon
MTYLIHMWPLRFNNRFIDVLPCDPEVSLRSRQVLEAWSGVAPTPVPVPCLLAYSSEVAAILNFDAEELVTPRFVEVFSGNALYPGMQPYAVNYGGHQFGQWVGQLGDGRVITLGELLGADGVYYELQLKGAGPTPYSRGADGRAVLRSSIREFLCSEAMHHLGIPTTRALSLIATGDTVIRDMLYDGHPAPEPSAIVCRVAPSFIRFGTFELPASRGDIDLLRRLVEFTIMRDYPHLHGAGETLYADWFAEICTRTAELVAHWMRVGFVHGVMNTDNMSILGLTIDYGPYGWIDNNDLDWTPNVTDVQSRRYRFGAQPQVAYWNLGCLARALAPLFSDAASLQAGLERFRATYLAAERRDAAAKLGFAACFDEDLALFDALRTCMHQAEMDMTLTFLGLADWEPNMLDSLSLWADAFYDPVKRDAQAPMLRDWLQRYAARLSVDPLPVAERHERMRLANPRYVLRNYLTQQAIECAEQGDLTELHALLEVMRRPYDFQLGREAYGMRRPEWARSRIGCSMLSCSS

SEQ ID NO: 65688 - protein, 602 aa, Ralstonia eutropha JMP134
MNQHDFLIALVVFLVAAVVAVPLARRTGLGAVLGYLLAGAAIGPFALRMVTNVESILHFSEFGVVLMMFVIGLELEPRKLWALRRSIFGYGGIQLAACALVIGILAALVGAPWPVALVAGLGLALSSTAIALATLGERNLFGTPAGGASFGILLFQDIAAIPMIALLPLLAAESAADASGGGWQSAAKAVAVIAAVVFGGRYLVRPALRFIARTDMREMFTAFALLLVVGIALMMDAVGLSMALGTFVAGVLLADSEYRHALEADLEPFKGLLLGMFFMAVGMSIDFAVLARAPGTVLGLVAVFVVAKTAVLMFLGRYFEIARGQRLLFALLISQGGEFAFVVFGVAGTAGLLPRETEALLVLIVALSMVATPLLLLAYDRLVAPRLGVTKRRADEAITPQDNPVMIAGFGRFGQIIGRLLYAQGVGVTVLDHDPDQIEFLRQYGFKIFYGDATRLDLLEAAGIDKARILIVAIDGMDDSLQLIDRVRERYPDLQIYARARHVSHIYQLKDRGVNLFEREMFEGSLMLGRRVLEGLGFDPAEARNVALRFRRHNIQAIDRFYPHYTDQKKLVSLARQARDELQEMFRQDREQRRQREEAEWS

SEQ ID NO: 65689 - protein, 236 aa, Burkholderia vietnamiensis G4
MSFKSVSSAPADAFADLPLLESEPVPPRIAAALDALRAGRAVVLQDDHDRENEADLIVAAERITPETMALLIRECSGIVCLCLTDDKVRALELPPMVQTNESRNGTAFTVSIEAREGVHTGVSAADRVTTIRAAIADDAKPYDIVRPGHVFPLRAQPGGVLARRGHTEGTIDLSILAGLRPAGVLCELMNPDGTMTRGDDVERFAQQHGLPMLTIAELVEFREALAAARERCCEPA

SEQ ID NO: 65690 - protein, 462 aa, Thermobifida fusca YX
MEQPADSIPRPVGEEGLIPLAEKQRLRIAVLGTGYLGATHAACMADLGFDVLGLDTDQSKIASLSSGRVPFYEPGLEEVLNRNLAAGRLRFTTDYAEVAAFADVHFICVGTPQQANSNAADLRYVDAVVDTLAPLLTRPAVIIGKSTVPVGTAARLAARFRALAPAGEAVELGWSPEFLRESHGVEDTLNPNRIVLGTDSPRVEQVMREICASQIERGIPFLVTDLQTAELVKVSANAFLATKISFINAMAEVCEAVGADVIQLAKALSYDDRIGGKFLGPGLGFGGGCLPKDIRAFMARADELGVESALSFLREVDAINQRRRARTIDIARGLIGGSFAGRTVGVLGASFKPNSDDIRDSPALDVAATINSLGARVTVYDPEALENAKRAYPQLNFAHTMLEAVRDAEVVLLLTEWAEFRDADPDELGKVVAEKRIVDGRNALDPDYWRSRGWTYRALGRP

SEQ ID NO: 65691 - protein, 78 aa, Helicobacter pylori J99
MALFEDIQAVIAEQLNVDAAQVTPEAEFVKDLGADSLDVVELIMALEEKFNIEIPDEQAEKIVNVGDVVKYIEDNKLA

SEQ ID NO: 65692 - protein, 224 aa, uncultured archaeon GZfos24D9
MHRKEQIRGNVKRLLAELPKEVVLEAAAKTRTTEETLAAIEAGITIVGENYIQEAERAFEVIGRVVKWHFIGHLQRNKVKKAVELFDLIETIDSFSIAEEVNSVSSKIGKIMPILIEINSGREPQKFGVFPEDVAELVVKISALASVKIVGLMTMGPYEEDIEKSRLYFRAAKEIFERIKKSGIPSVDMRYLSMGMSDSYNIAIEEGANIVRVGTGIFGPRGRV

SEQ ID NO: 65693 - protein, 364 aa, Aspergillus nidulans FGSC A4
MADGGQSTPQQVPQQAAQQTQKVSDVIRSYRSTKVFKSTKQDSFVTSLDFDDQGEFVVSCGDDEIIQIFDVKAGKMTKSIPSKKYGAHLARFTHHSRQVLHASTKVDDSLRLLDLHSESYIRYFSGHTDKVTCLALSPGSDSVISCSKDDTVSIWDLGSRYAQGKLKLSTPYLVAFDPSASVIAIASQSTSSILLYDFRNYDKSPFSTFDLAKYEERYTPSTRGRAWTRLEFSNDGKYLLVGTDYHGHFVLDAFEGELKAFLVGKNGSPGRAAPVSTTGKPLGQGDACFTPDGRYVIGGSGDHHDLLVWDLQQTPDTNLCLQAMAKLPHRGKTAIVEYNPRFNMIASADKEVYFWLPEDTSKAV

SEQ ID NO: 65694 - protein, 376 aa, uncultured archaeon GZfos24D9
MEERGISKQELKSFLKEQRQKDLTYRKVLSSMCSYPHEMATYAHNLFLDSNLGDSGLFPGTKAMEDELIRMIGALLGNENAHGYISTGGTESNIQAIRAIRNRKRKERLQEMNIIVPKTAHFSFDKIEDLLSLEVKKAGLDDKLRVDVNLVEELIDDNTISIVGIAGTTEFGQIDPIKELADIAHDSDIFLHVDAAFGGFVIPFLDAEYQFDFSLDAVSSVSIDPHKMGMSTIPAGCILFRDESYLADLAVDTPYLTTNEQCSLIGTRSGAPVAATFAVLKYLGRSGLKAIVDDCMQLTRMLVRGAKAMDIYPVIEPVTNVVTLRFPDVDRVAKALEARGWRVSTTRAPKALRLVIMPHVTEDTIELFLNDLACVT

SEQ ID NO: 65695 - protein, 309 aa, Mycobacterium sp. MCS
MSLVVITTGGTIATSTDADGVRRPTRRGADLTAGLDVTVVDVLNKDSSQLTPADWDRIRDAVLAGTAGGAADGVVVTHGTDTMEETALWLELTYDGTTPVVLTGAQRGADAPDADGPANLRDAVTVAGDPEARGLGVLVSFAGTVRRPLGLRKVATEDLDGFDGPVVGRVADGRFTVTGPKVRPYLGDVSAERAPRVDIVTTYPGGDAAALSACAAAGARAVVLEALGAGNAAQPVIDGVRRLCADGVLVAVSTRVPGGRVRPAYGPGRDLADAGALMVPTLRPAQARVLLMAALAADVPAAEVLAEWG

SEQ ID NO: 65696 - protein, 402 aa, Enterococcus faecalis V583
MYQQPNFVRRTIMTPGPVEAHPSVLRQMGQPILGQFDPEFLQIMDEVREMIKVPFATKNQQAFAIDGTSRSGLEAGLFALIEPGDKVLVPTYGRFAYLLGEICERARAEVIYLEKDWLAPFEQTTVIEAIKEHQPKIVAMVHGETANAQMQPLDQIGAFCRENEIFFVVDMVATYGGVETKVDDWKIDIAVAGTQKCVSVPSGLSLITYNQRVADYLAGRYQKELGLGADARNERFIQSNYLDLSQLEKYWGPERLNHHTEATTMIYGLHEGLRLLLQEGMENVYARHRKNNRILVESLQKMGLEIFGKLDTKTPTVIPVVIPEGIDGEKVRSLLLDHFKVEIASSFGDLKGKIWRVGNMGYSSREDNVLHFLSAFETVLKHQGYQFEGGSGSTHALAEYLN

SEQ ID NO: 65697 - protein, 299 aa, Aspergillus nidulans FGSC A4
MPFTSALVALVQILIAVAPSLQLQGELQAKSEAVKKYKGVLHGVKVILQNEGPRGLFRGIGSAYIYQVLLNGCRLGFYEPIRNGLTTAVYNDSHVQSLGINVFAGASSGIIGAAAGSPFFLVKTRLQSFSPFLPVGTQHQYRNSFDGLRKIFASEGVGGLYRGVGAAMVRTGFGSSVQLPTYFFAKRRLVKHLGMEDGPALHLASSTASGFVVCCVMHPPDTIMSRMYNQTGNLYKGVFDCLAKTIRTEGLFAIYKGYFAHLARILPHTILTLSLAEQTNKLMRRVEDRLLSDSLKSRL

SEQ ID NO: 65698 - protein, 466 aa, Solanum lycopersicum
MAFAAQQKKAIHSMLANKLTHLKIPDSSSSSSPPPTDPDFDFSDVFGAPTSPSSSSSFLTDPQIIHSRSHSFVGPSPRITLSKPLPFHQEVDSEGESDSDKVNTHVGTHQTECSDGIEEISGDEGSAVTKFGPGDFEILRMIGKGSFGKVFQVKMKGYGGEGEGDGILAMKVMRKDTVIKNNHVDYMRAERDILTKVEHPFIVQLRYSFQTKSKLYLILDFINGGHLFYHLYRQGIFSEDQARIYAAEIVSAVSHLHQRGIVHRDLKPENILMDGDGHVMLTDFGLAKEIDESSRSNSMCGTMEYMAPEIIQSKGHNKDADWWSVGVLLYEMLTGQPPFTHANRKKLQEKIISEKLKLLPRLTGEAHSLLKGLLQKDPSKRLGSGPRGGDEIKSHKWFRTINWKKLDARELQPKFKPDVIGRDCTANFDKCWTTMPPDDSPASTPTTGEHFQGYTYVAPNPWLSSS

SEQ ID NO: 65699 - protein, 504 aa, Solanum lycopersicum
MANRNVPIPRRQLYIGGEWREPVKKNRIPIINPATEEIIGDIPAATAEDVDIAVEAARKAIARDDWGSTTGAQRAKYLRAIAAKVLEKKSVLATLESLDSGKTLYESAADMDDVAGCFEYYAGLAEALDSRRMTPVNLNSDSYKSYVLREPLGVVGLITPWNYPLLMAIWKVAPALAAGCAAILKPSELASITCLELGEICREIGLPSGALNILTGLGPEAGGPLASHPHVDKISFTGSGPTGSKIMTAAAQLVKPVSLELGGKSPIVVFDDIDNLDIAAEWTLFGIFANTGQVCSATSRLIVQENIASAFMDRLLKWTKNIKISDPLEEDCKLGPVVSAGQYEKVLKFISNAKSEGATILCGGERPQHLKKGYYVQPTIITDVNTSMEIWKEEVFGPVLCVKTFKTEEQAIELANDTKYGLGAAVMSKDVKRCERFTKAFQTGIIWINCSQPTFNELPWGGKKRSGFGRDLGKWGLENFLNIKQVTEYTSAEPLAFYKSPSKN

SEQ ID NO: 65700 - protein, 289 aa, Saccharomyces cerevisiae
MSNESNDLEKNISHLDPTGVDNAYIPPEQPETKHSRFNIDRDTLRNHFIAAVGEFCGTFMFLWCAYVICNVANHDVALTTEPEGSHPGQLIMIALGFGFSVMFSIWCFAGVSGGALNPAVSLSLCLARAISPARCVVMWFPQIIAGMAAGGAASAMTPGKVLFTNALGLGCSRSRGLFLEMFGTAVLCLTVLMTAVEKRETNFMAALPIGISLFMAHMALTGYTGTGVNPARSLGAAVAARYFPHYHWIYWIGPLLGAFLAWSVWQLLQILDYTTYVNAEKAAGQKKED

SEQ ID NO: 65701 - protein, 161 aa, Rhodococcus sp. RHA1
MRFVTIVQASAFVPVWLRVLLLMAAGAKVWGAGIYSGCYFGSRDVTMGLGTFVNRGVLFDGTAPITLGRQVAVGHRAQFITSTHEIGPSDGRGGRVVDRPIVVGDGCWIGAGAIILPGVTVGDGCVIGAGTVVTRDCESNGLYAGSPARRVRDLDSAPSVR

SEQ ID NO: 65702 - protein, 464 aa, Vitis vinifera
  misc_feature (6)..(6): Xaa can be any naturally occurring amino acid
MASNRXDPLTFINPSSSPITVSSAEGDSFLLEPASQIGSASGSFQNEGLLSGGDGTSDAEFGFSRPDFRQSPLAGTVQLYDRHVFLCYKHPQVWPPRIEAAEFDRLPRLLSAALMARKSEMKKQILMWFFGLLVFDDLNCVYGVSVDCMLFGVVSETRLTICEGHDGTETSNGDVLIFPDMIRYRRLTHFDVDTFVEEVLVKDGEWQPVTPEKLIGSCIFVCSHGSRDRRCGVCGPAVVARFKEEIESHGLQGKVSVSPCSHIGGHKYAGNVIIFGSNIDGKVSGHWYGYVTPDDVPILLEQHIEKGEIVYGLWRGQMGLSEEEQTKSQELRVQLNGGTGDGKPTKETLQTQTNEMDTAACGSQIEVMACCQENGNSSCCQNPVLSGKMEKLFEREAKVTPEKKKSSKMTISRSSSNKSACTRKVCAMPTWFESWEREDTYAALAVVCAAVSVAIACHCYKQLT

SEQ ID NO: 65703 - protein, 359 aa, Oceanicola granulosus HTCC2516
MTIGEPRHAMPAFVADAITDAVDGFSRYPVNEGAPELLAAISAWLCRRYGVSVEEDRLVALNGTREGLYNAAMALCPESKGGKPPVVLMPNPFYQVYAVAALSVGAEPVYLPATAETGHLPDLDAIPAETLARTAIFYLCSPSNPQGAVADAGYWARLLELSERHGFRIFADECYSEIYRGDAPPGILAAAERRGSDPESVLAFHSLSKRSNLPGLRSGFAAGGRESIARLRQLRAYAGAPLPLPLQQVAALVWADEAHVEENRALYAEKYRVADEILAGIDGYQPPRAGFFQWLPVEDGEAAALKLWTETGVRVLPGAYLGRDAGGGNPGASYIRVAMVAQLDEMRRGLTQIRACLYD

SEQ ID NO: 65704 - protein, 624 aa, Gibberella zeae PH-1
MTFDAEKIGAADFKSLGPLVAELDKHLTLRTYLNGYTLSEEDGKIWTALRTNKVAIGLVRKGAYTNITRWFKLIEEAHPEFNEKLNAGKEKRSGGANYNIGLSNTENGVVTRFPPEPSGYLHIGHAKAALLNDYFAKTSPDGNGKLIVRFDDTNPAKEKQEFEDAILHDLELMDIKYHKVTHSSDYFQEIYDLTEKMIQDGNAYADDTDPEVQSADRKNRLASKRRDRPAEESLAMFREMKAGTDLGRKHCIRARIAFDSSNGSMRDPVIFRFPNWKGEEPAPHHRTGWTWNIYPTYDLVVPILDSIEGVTHALRTTEYADRNEQYHWFLKALNLRQVHLWDFARINFIQTFLSKRKLTKVVDTGRVSGWDDPRMPTVRGIIRRGLTVPALREFMLKQGPSRNVVTMDWTTIWAINKRMLDPVVPRYMAIEEKDAVTVTITGGPEKSYKEDRPKHVKNPDVGTKQVTFGPKLLLDQVDVASFDDNEEITLMSWGNAIVRGINKTASPINELNLELHLAGDFKTTSKKVHWLAADPENLVKAELWEFGSLITKDTLEKDDNLDDFLNDNSATLTNALVDASIAELKENDFLQLERKGYYRVDKALGQGPDGRAVLFKVPTGGQKG

SEQ ID NO: 65705 - protein, 378 aa, Ostreococcus tauri
MISLAPTPATPARARTSARRSRRRDVVVRARAKASTGKTRSTTTTTRDEKPSTRTTTTSTPARAVWWPVDARTGKPPWWFQLVVFAASQVFVGTVMQPAAVLWARAFEPRGARDPSRTRRLARAMSSLRPDGRSREMLRRQRLHRSRVPSASGSAEYRIDGTIVVAAVHGPLRIAPWREAHDRGVIDVELSAPGWMSRDDQRACEGRLRGAIERCVELRDFPRFGLRISARVVSDDGNAEAACVNAVCCALIDANVPMRGLICANACALTREGSMVIDPTKREETEARAVVRACALSKHREKDEIAIVGCSTTGALTEKEYLDAIAFIVDATAAVVNIQKKSIARYEVHGKLHEDEAPKKRQNTEDAPMEGMENRPLG

SEQ ID NO: 65706 - protein, 763 aa, Bacteroides thetaiotaomicron VPI-5482
MAKITKEAALLYHSQGKPGKIEVVPTKPYSTQTDLSLAYSPGVAEPCLEIEKNPQDAYKYTAKGNLVAVISNGTAVLGLGDIGALSGKPVMEGKGLLFKIYAGIDVFDIEVDEKDPEKFIAAVKAIAPTFGGINLEDIKAPECFEIERRLKEELDIPVMHDDQHGTAIISSAGLVNALQVAGKKIEDVKIVVNGAGASAVSCTKLYVSLGARLENIVMLDSKGVISKTRTDLNEQKRYFATDRTDIHTLEEAIKGADVFLGLSKGNVLSQDMVRSMAPMPIVFALANPTPEISYEDAMSARPDVLMATGRSDYPNQINNVIGFPYIFRGALDTQAKAINEEMKIAAVHAIANLAKQPVPDVVNTAYHVNNLSFGPEYFIPKPVDPRLITEVSCAVAKAAMESGVARTEIKDWDAYCVHLRELMGYESKLTRQLYDTARRNPQRVVFAEGIHPNMLKAAVEAKAEGICHPILLGNDEAIGKLAEELDLSLEGIEIVNLRHPDESERRERYSRILAEKRAREGFTYEEANDKMFERNYFGMMMVETGDADAFITGLYTRYSNTIKVAKEVIGIQPGFNHFGTMHILNSKKGTYFLADTLINRHPDTETLIDIAKLADKTVRFFNHTPVISMLSYSNFGADTSGSPVKVHGAVNYMQKEYPELAIDGEMQVNFAMNRELRDAKYPFTRLKGKDVNTLIFPNLSSANAGYKLLQAMDPDTEFIGPIQMGLNKPIHFTDFESSVRDIVNITAVAVIDAIVVKKKNESR

SEQ ID NO: 65707 - protein, 248 aa, Neisseria meningitidis FAM18
MSTQDLSGKIALVTGASRGIGAAIADTLAAAGAKVIGTATSESGAAAISERLAQWGGEGRVLNSAEPETVENLIADIEKTFGKLDILVNNAGITRDNLLMRMKEEEWDDIMQVNLKSVFRASKAVLRGMMKQRAGRIINITSVVGVMGNAGQTNYAAAKAGLIGFSKSMAREVGSRGITVNCVAPGFIDTDMTRALPEETRQTFTAQTALGRFGDAQDIADAVLFLASDQAKYITGQTLHVNGGMLMP

SEQ ID NO: 65708 - protein, 521 aa, Neisseria meningitidis FAM18
MTQDKILILDFGSQVTQLIARRVREAHVYCELHSFDMPLDEIKAFNPKGIILSGGPNSVYESDYQADTGIFDLGIPILGICYGMQFMAHHLGGEVQPGNQREFGYAQVKTIDSELTRGIQDDTPNTLDVWMSHGDKVSKLPTGFTVIGDTPSCPIAMMENAEKQFYGIQFHPEVTHTKQGRALLNRFVLDICGAQPSWTMPNYIEEAVAKIREQVGSDEVILGLSGGVDSSVAAALIHRAIGDQLTCVFVDHGLLRLNEGKMVMDMFARNLGVKVIHVDAEGQFMEKLAGVTDPEKKRKIIGAEFIEVFDAEEKKLTNAKWLAQGTIYPDVIESAGAKTKKAHAIKSHHNVGGLPENMKLKLLEPLRDLFKDEVRELGVALGLPREMVYRHPFPGPGLGVRILGEVKKEYADLLRQADDIFIQELRNTTDENGTSWYDLTSQAFAVFLPVKSVGVMGDGRTYDYVVALRAVITSDFMTAHWAELPYSLLGRVSNRIINEVKGINRVVYDVSGKPPATIEWE

SEQ ID NO: 65709 - protein, 408 aa, Anabaena variabilis ATCC 29413
MDLLEYQVKEWFGEIGIPVLPSQRIDHPTDLKRLKIRYPIVLKSQVHAGEREKVGGVRMVETTIDAIAAAQTIFNLSIWGELPEVLLAESKYNSHQEFYLAVVLDTAVCRPVLLGSTEADIDLELADQKMQYVVVEQEFSPFYARRLALKMGLQGTLMQSVSTVLEKMYQLFVQKDLDLVEINPLGVNLAGEVMALNGKVGVNERAIGRHPEIAAMAAKIIPRHYDKSFSNGRDWNNLEKQRRIGILGNGTGSILATYDLVASGGGKPGICLNLRHAAITDLSPTKFGDRLTKGLNTLAADKNTQVILINLLGSIPQPEEAAQAIAQFIQQNKGEYPPSIAKSNGKNLSQHQSPQLVIRLAGSELNAAKEVLAALQTHEEGLILVEDLDEAVATAVRLTKSHAYKKVS

SEQ ID NO: 65710 - protein, 133 aa, Aspergillus nidulans FGSC A4
MQELYSTGSLEENERVIRSAQNSAGIQTLLDAEREAQKIVQQDRTKRIRDAKAEAQKEIEEYRKQKEEEFRKFEAEHSSGFKKAEDDANKEAEFKLEEIKKDGKEKGPKVVEKLIHALVDVKPEPSAKIVTKA

SEQ ID NO: 65711 - protein, 516 aa, Saccharomyces cerevisiae
MAEKSIFNEPDVDFHLKLNQQLFHIPYELLSKRIKHTQAVINKETKSLHEHTAALNQIFEHNDVEHDELALAKITEMIRKVDHIERFLNTQIKSYCQILNRIKKRLEFFHELKDIKSQNSGTSHNGNNEGTRTKLIQWYQSYTNILIGDYLTRNNPIKYNSETKDHWNSGVVFLKQSQLDDLIDYDVLLEANRISTSLLHERNLLPLISWINENKKTLTKKSSILEFQARLQEYIELLKVDNYTDAIVCFQRFLLPFVKSNFTDLKLASGLLIFIKYCNDQKPTSSTSSGFDTEEIKSQSLPMKKDRIFQHFFHKSLPRITSKPAVNTTDYDKSSLINLQSGDFERYLNLLDDQRWSVLNDLFLSDFYSMYGISQNDPLLIYLSLGISSLKTRDCLHPSDDENGNQETETATTAEKEVEDLQLFTLHSLKRKNCPVCSETFKPITQALPFAHHIQSQLFENPILLPNGNVYDSKKLKKLAKTLKKQNLISLNPGQIMDPVDMKIFCESDSIKMYPT

SEQ ID NO: 65712 - protein, 284 aa, Candidatus Kuenenia stuttgartiensis
MEFKNLSNNIKIPVIGLGTWTIGGGDEADTTYDKENISAIKTAIKLGITHIDNAEAYAQGHSEELVGRAIVGLDRKSLFITSKVSPEHLSYDNLLASAKGSLQRLNTDYIDLYLIHAPNPDIPIQETMKAMDFLVEQKLVRCIGVSNFSVDQIKEAQKYTKNKIVANQIEYNLLVRDKGRVTENMESEIIPYCQENNIFIIAWRPLAKGKLAKPGFKILDELADKYHKTQAQIAINWLISKKGIVVISKSTKVEHLEKNLGAIGWKLRQEDTDRLNNEFINSRT

SEQ ID NO: 65713 - protein, 122 aa, Xylella fastidiosa Dixon
MSLTNEKIVEAIAEKSIMEVMELVKAIEDRFGVSAAAPVMVSGSAAAAAPVEEQTEFTVTLKEAGAKKVEVIKAVRAVTGLGLKEAKDLTEAGGILKEAVSKEEAEKIKKELEAAGATVEVK

SEQ ID NO: 65714 - protein, 371 aa, Saccharomyces cerevisiae
MFRSVATRLSACRGLASNAARKSLTIGLIPGDGIGKEVIPAGKQVLENLNSKHGLSFNFIDLYAGFQTFQETGKALPDETVKVLKEQCQGALFGAVQSPTTKVEGYSSPIVALRREMGLFANVRPVKSVEGEKGKPIDMVIVRENTEDLYIKIEKTYIDKATGTRVADATKRISEIATRRIATIALDIALKRLQTRGQATLTVTHKSNVLSQSDGLFREICKEVYESNKDKYGQIKYNEQIVDSMVYRLFREPQCFDVIVAPNLYGDILSDGAAALVGSLGVVPSANVGPEIVIGEPCHGSAPDIAGKGIANPIATIRSTALMLEFLGHNEAAQDIYKAVDANLREGSIKTPDLGGKASTQQVVDDVLSRL

SEQ ID NO: 65715 - protein, 422 aa, Brucella suis 1330
MTPDLPLTRLAAFVRQQTIAPEPLTGIGGTVSDVSRSSIAVRGLSRDARLGDTVAIRAGEGAPSLAEIIRVADLQVLVKPFDDRIMPSLGAAVFEEGPLRIRPAPEWRGRVINALGNAIDGKGALKLGTRPMAAESLAPAALRRARVDRGLRTGVNVIDIFTPLCFGQRIGIFAGSGVGKSTLLAMMTRAADFDTVVLALTGERGREVREMLEETMAGHLGKTITVVATGDESPMMRRLAPNTATAIAEYFRDLGQNVLLIVDSVTRFAHAAREVAIAAEEPPVARGYPPSVFSQLPRLLERAGPGSAEAGGSIAGIYSVLVDGDDHNDPASVSRLAKHNWTPEQRKLVMQLRSMVARFEETRDLRAIGAYQKGHDGLLDQAVDFVPRIYEALQQSPETGLSDDPYNDLAAALRGDRQAQNA

SEQ ID NO: 65716 - protein, 366 aa, Helicobacter pylori J99
MGLSVGIVGLPNVGKSSTFNALTKTQNAQSANYPFCTIEPNKAIVNVPDRRLDALAQIVKPERILHSVVEFVDIAGLIKGASKGEGLGNQFLANIKECEVILQVVRCFEDDNITHVNDKIDPLNDIETIELELILADIATLDKRIDRLQKALKSSKDAKNLLECALSLKTHLEELKPAKTFPLNTSEAFLELDKELRFLSHKKMIYVANVGEEDLNILNEHAKKVENHAKVQNSEFVALCAKLEEEMVSMSGDEVKEFLQSLGVEESGLEKTIRLSFKELGLINYFTAGVKEVRSWTIKKGSSAPVAAGVIHKDFEKGFIRAETISYDDFIAYKGEAGAKEKGALRIEGKDYIVQDGDVLHFRFNV

SEQ ID NO: 65717 - protein, 947 aa, Aspergillus nidulans FGSC A4
MAQAEAQRAPGDGPRSSVSVSRASTIPAIVTSDPSGSTTNDYSLADEPSPITPVRSGLTRNSNSFPIGSAASDVASGSSGNLNQQDATTARKPLRPGPVPHGSGSGSGSGLVGRNSTSSPTVWESADSSAIDPLSQHIIKRTNTQKSIPLKLLGRASYEAEAGGSDRYSPVEQGPNRGDQAPQRPLKEKKKGVSFLSRILPGKKKDLFSDEDDNVSEMGNAGNNAAAAAQPIGFFPRFPPPPKYARVRAHYKKEKTFNRVFQAQELEGVDTSAQPDQDEHPDIGDSQNGKSTGKAIWALVFSKDGKYLAAAGQDRKVRVWQVIASPEDREVNESEGEDDELPRLKAPVFKEKPVQVYDSHSGSILDLSWSKNNFLLSSSMDKTVRLWHVSRPECLCCFKHSDFVTSIQFHPRDDRFFLAGSLDMKLRLWSIPDKSVAFNVTVPDMITSVSFTPDGRHSMAGCLNGMLNIYETDGLKPAGNIHVRSARGRNAKGSKITGIDSMVLPQNDPEGTVKLLVTSNDSRIRLYDFRDRSLEAKFRGNENACSQIRASFSDDGKHVICGSEDRRAYIWPMGPVEKDADKRAFEVLDTQSAMVTAAIMAPKSTKQILGLSEDPIYDLCNPPPVTLESNTKKENSRQSRLSTASKLAQESPGFQARSAHPDGNIIIAADYSGKIKVFRQDCAYHKRRYDSWDTHSTISRRLLRRSNSARQSIASSIGKESSHKTPSERIISWRNSVIGHDSTNNRDQQPPRTRSPSPQKAMREASRNSSPGRGSSGARGESRSAYTASPPPSAYKSSFSSPRSSFAEKRRPTGAGFGSKPEDSRAVPAPLSAAALIKGRDGNDNPRWLQGDQSYAFYNKITQDALAVHRNSPGLLDPNPRPSPERKLTRASILSSEYASSDASDADNDVLKCDSCWGTNFKATKGRNGKQRLICVRCSRPISSTAG

SEQ ID NO: 65718 - protein, 534 aa, Thermobifida fusca YX
MATQAPEPLPADQIDIRTTAGKLADLQRRRYEAVHAGSERAVAKQHAKGKMTARERIDALLDPGSFVEFDAFARHRSTNFGLEKNRPYGDGVVTGYGTIDGRPVAVFSQDVTVFGGSLGEVYGEKIVKVLDHALKTGCPVIGINEGGGARIQEGVVALGLYAEIFKRNTHASGVIPQISLVMGAAAGGHVYSPALTDFIVMVDQTSQMFITGPDVIKTVTGEDVTMEELGGARTHNTKSGVAHYMASDEHDALEYVKALLSYLPSNNLDEPPVEPVQVTLEVTEEDRELDTFIPDSANQPYDMRRVIEHIVDDGEFLEVHELFAQNIIVGFGRVEGHPVGVVANQPMNLAGCLDIDASEKAARFVRTCDAFNIPVLTLVDVPGFLPGTDQEFGGIIRRGAKLLYAYAEATVPLVTIITRKAFGGAYDVMGSKHLGADINLAWPTAQIAVMGAQGAVNILHRRTLAAADDVEATRAQLIAEYEDTLLNPYSAAERGYVDSVIMPSETRTSVIKALRALRGKRKQLPPKKHGNIPL

SEQ ID NO: 65719 - protein, 158 aa, Picea abies
VAWSRDGSRLACSTMDGTIAIFDVPRAKFLYNLEGHYMPVRSLVFSPTDSRILFSASDDKHIHMYDVDNKSLICAMSGHASWVLSIDVSPDGLAVATGSSDRTVRLWDLSMRSSVQTMTNHTDQVWGVAFRPTGSPGSRAGRLASVSDDKCISLYDFT

SEQ ID NO: 65720 - protein, 179 aa, Helicobacter pylori J99
MNEMLKEELLQSIREVKDYPKKGILFKDITTLLNYPKLFNKLIDALKKRYLALNIDFIVGIEARGFILGSAFAYALGVGFVPVRKKGKLPAHTLSQSYSLEYGSDSIEIHSDAFRGIKGVRVVLVDDLLATGGTALASLELIKALQAECIEACFLIGLKELPGIQLLEEHVKTFCLLEC

SEQ ID NO: 65721 - protein, 539 aa, Enterococcus faecalis V583
MFKKYTQMIRDEFKGYNQKKMKKDFLAGLTVAAVALPLALAFGVSSGATAAAGMITAIIAGIVIGSLSGGFYQISGPTGAMAAILMSIAAVHGMQGILLATFLAGIFLLLAGILRLGSLTSFIPSPVITGFTSGIAIIIALGQLDNFFGVRSEGHNLIEKISSYRSLGFDLSIPTTVMSILVVLGLVFFPKKWNAMIPASLVMIILATLATVVFQLPVATVGKIPTSIFSDTRLELGSLQLSAFQDILVPSISIAMLGMIESLLCGASAGRMTGKPLDSNQELVAQGIGNLILPFFGGVPATAAIARTSVVIKSGAQTRLAGIFHAVFLLLSMLLLSPVMSKIPMPALAGVLVVTAWRMNEWSVIKEFFQKRFHTALCLFFLTMVATVIFDLSLAIVLGVLAGCLFFIAKSAVITINVEEVDWSRMGLVPTDCTENWVVVYLSGPLFFMSSERLKQTLLQLETKSGVVFSMRGVPSIDSTALDILEEFCLAAEGRGQQVQFAALQPEVEKMIRTIQGNQEKEYHFSVAEFLQTVHVAEQ

SEQ ID NO: 65722 - protein, 460 aa, Thermobifida fusca YX
MTKVVIIGGGPGGYEAALVAAQLGADVTVIERDGIGGASVLTDCVPSKTLIATSVRTSYVKEAATLGINVGNEPEDKDLVRVELKTVNARVKRLAQAQSVDTANRLRTEGVEIIIGEARLVDPHIVAVGDERIRADVVLIATGAHPRELPTARPDGERILTWRQLYDLNELPEKLIVVGSGVTGAEFANAYQALGSDVTLVSSRDRVMPTQDADAARVLEDVFARRGMTVLGNSRAESVTRTDAGVLVRLTDGRVIEGSHCLMTVGMVPNTANLGLEEAGIRLDERGFVQVDRVSRTSTPGVYAAGDCTGVNMLASVAAMQGRIAMWHALGAAVSPLRLSTVASTVFTHPELAAVGATEDDVVSGRVDGRIVKLPLATNPRAKMHNTRDGFVKLICRQHTGIVLGGVIVGPRASELILAVSLAVQQRLTVDDVAHTFAVYPSLSGSVTEAARSLMQGFPE

SEQ ID NO: 65723 - protein, 212 aa, Triticum aestivum
  misc_feature (25)..(25): Xaa can be any naturally occurring amino acid
VHHRLMLMPETLYLTVYIIDQYLSXENVLRKELQLVGVSAMLISCKYEEIWAPLVKELLVLSDNAFSREQVLSTEKSILNKLQWNLTVPTVYVFLLRYAKAAMGDKELENMAFFYAELALVDYSMLVYSPSVTAAAAVYTARCTLNMSPGWSDILEHHTGLGESQLMQCARRLASLHSTAAGSSKQKVVYNKYANPKLGAVSLYSPAKRLAI

SEQ ID NO: 65724 - protein, 544 aa, Phytophthora infestans
MYSSGGDRYGDSSSRRDYGGGGSGGYGGGGYGGGSRGGGGGGYGGGGGGYSGGGGGYGGGGGGYSGGGRGGGGGGGFGGGGDLGSNLDTHIQWDLSKLPVFEKNFYYEHPDVTKRSEDEYEKWKRDNQIIVSGKGVPKCVLSFEEASFPEYVLEEVVRLGFDKPTPIQCQGWPMALSGRDMVGISATGSGKTLAFLLPAIVHINAQPYLQPGDGPIVLMIAPTRELAVQIQAECNKFGASSKIKNTCVYGGVPKGGQIADLRRGVEICICTPGRMIDMLSMGKTNLRRVTYLVLDEADRMLDMGFEPQLRKIVSQIRPDRQTLMWSATWPKEIVALANDFLTDFIQVTVGSLDLTANKRIKQIVEVMDDHQKYSSLQDHLRDIYEGGRIIIFCETKRGADELSRNLRNTRYICKAIHGNKSQEERDYVLREFKDGRTQILVATDVASRGLDIKDIRYVVNFDMPKNIEDYIHRIGRTARAGNKGTSISFFTASNNGRLAGPLVKIMEEAEQEVPRELRDLVGRGGGGGRGRGGFGGGRGGRGRW

SEQ ID NO: 65725 - protein, 710 aa, Arabidopsis thaliana
MATEAVDLPIHEHPLFPSARCIDDECDGCHVNGFMYAGYFCNEPYCYVWFHKDCAEAPGEISHSSHPEHPLLLTNDSKDGPCDLCGQKLLTPCYSCPTCEFKVDLTCGMKPSPPAIEHPLCHDHAVVFLKIREEKVPCELCKESIEGPSYSCLECDMYFHVNCVHLSEEVNHPCHSIHPLKLITSESLTDDAEKSCLLCGNIPAENMLYHCSVCNFTSCLGCTKNPPLLVIEHMKTHKHPLTLLPRRISCICDVCGKKCQFTAYVCLQCDFVTARKCIDRPRVININRHDHRIYLTHHLGTGYSECGVCHKNVSQYKGAYSCSVCPNYAVHSTCAVRTDVWDGVELEGTTEITEDISPFKVVGDNLICHFSHEEHQLKLHKEDVIHDERRRCEACIHPVQFGSIYVCEEEECCFVLHEKCANLPMKKRLVFGTRPYTLMKETTEITHCELCGILSDGFAYSSHEWSDVDVHCGSLNEPLVHDGHIHPLYFAKKEEHTCDGCQKSIEDYMLRCKACDFDLCLYCATLPEKIWHRNDGHPLTLCCGEKEEASGKYWCDICEKELDPSIWFYTCYDCGVTLHAQCVLGDFSRLVLGQIYSFGEKEIEFEAVPNNINTRPFCIQCNSRCKVSVILKILKDSEDGSDDGSDDVSDDVSDDPSNDVSDDTSDDDSDVVSDVVSDDASNDDSDDTSDDHNGYICSRSCLSSYLGEEI

SEQ ID NO: 65726 - protein, 440 aa, Mycobacterium sp. MCS
MRLSVIGTGYLGAVHAACMARLGHDVVAFDTDASKIAKLSAGASPLFEPGLDELLTAEMASGRLRFTQSPDEAVSGASVHFVCVGTPQLSDSDAADVSFVNSAVDMIATHADGEGLIVGKSTVPVGTAQRLDSELAARSLPHRMEVAWNPEFLREGKAIEDTLQPDRLVFGVTSESAEKTLREVYAELLDAGTPYLTTDLATAEMVKVAANSFLATKISFINAMAEVCEAVDADVVTLSEALGYDSRIGRRFLNAGLGFGGGCLPKDIRAFSARAGEVGASAALTFLHEVDKINIRRREKAVSVAGALLGGDFLGKNIAVLGAAFKPDSDDVRDSPALNVAAAMHLKGSYVRVHDPKAIANARARFPTLTYCESVQEACQNVDLIVLATEWDEYRNLDPVALRSTVRTQSLLDTRNALDAELWSGAGWRVYGLGRGQLNV

SEQ ID NO: 65727 - protein, 203 aa, Shewanella oneidensis MR-1
MSIKYVATSKLPTPWGVFAMHGFEDTETGKEHVALTFGSLSSDEPVLGRIHSECLTGDALFSLRCDCGFQLQTAMQNIAETGSGFILYLRQEGRGIGLLNKIRAYELQDKGANTVEANEQLGFPADMRKYDMIQPMLEKIGVKHVRLMTNNPRKVKAMKEIGIEVVERVPLQVGKNRYNEAYLKTKSTELGHMMSEYHFTDEE

SEQ ID NO: 65728 - protein, 656 aa, Arabidopsis thaliana
MDTSAVQLPFRDYSLQPAPRYINARCHICSVTGAIYNGYFCNDPIVWMHKECVELPSEINHLFHPQHPLLLTYEEGWWSCFCALCGETKPAKYFYSCSTCKIKVDLTCGMNPPPPAIEHPICHDHPLVFLKKRQEKTPCEVCKNRILGSSYSCLGCELYFHVGCIHLSKEVNHPCHSDHPLMLVESESLTDNDKKTCFLCGQQPHGILYHCSICNFTLCIGCIKSPPPLVVENVKTHKHPLTFFPRGVYCTCNVCGVKGLILSYMCLQCGFAVHCSCVDLPQVININRHDHRISFTQHLGPGYLNCGVCRRSVCQFNGAYSCLVCPNYAVHSRCATRYDIWDGVELEGKAENIEDIAPFKVVGDDLIRHFSHSKHSLRLHKNNIIYDDSTRCEACGHPVEFGRIYNCEECCFILHEKCANLPMKKRLVFSTLPFLLLGPGNDVCKVLDCKLCGMFFTGFEYKSQERRQSDIDVHCGSLTEPFVHDGHLHPLYFDQKQKELPCNACQKTIRDYMLCCADCDFNLCLWCASLPKKIRHSNDEHILTLCCGEEANGKYWCDICEAELDPSKWFYTCFGCGGTLHVECVLGDFSRLMPGCTIDYRVYTVEVVFNNHNTRPMCSRCHSRCKVSVILKFREGNIVYFFCSRSCFLMHFSYYL

SEQ ID NO: 65729 - protein, 317 aa, Zea mays
  misc_feature (81)..(81): Xaa can be any naturally occurring amino acid
  misc_feature (276)..(276): Xaa can be any naturally occurring amino acid
MEAQTDSAPGGGDDLAIMREQCRTLEESISTRREAQLDLIGSLQHLVPDLVPSLEQSLRLIAALNGRPFVPTLYPNASVHXRTPTLSPQHRRALPGPARSTRLKTSPGSSPASAAARCAGTSGGIHAVRTMVAVCLLELVPFAEIDAAALARRLQSETSSASEAERAALADLAAELGGSAPAAVALALRRIAEDSGGLQIEEAFIGGKQMTMVWAIDRSKLLKELPESASVLQIQPPPTPQVVPLDTDTNIIPRPPPLQQSDMWGNPMPPMFPRPXRGMTMPRIPPGLMPLQRPFHGTRGQFIPNGVVGPGPEFHNT

SEQ ID NO: 65730 - protein, 263 aa, Oryza sativa Japonica Group
MAAAEAAAEAAAALEGSEPVDLVKHPSGIIPTLQFSLGGYYMFEVLICLIDEKGGRSEIRESEKVEHAYIAACHSVPASMCSHKNIVSTVNLDCKLDLKAIALQARNAEYNPKRFAAVIMRIREPKTTALIFASGKMVCTGAKSEQQSKLAARKYARIIQKLGFAAKFKDFKIQNIVGSCDVKFPIRLEGLAYSHGAFSSYEPELFPGLIYRMKQPKIVLLIFVSGKIVLTGAKVRDETYTAFENIYPVLTEFRKVQQCLLPI

SEQ ID NO: 65731 - protein, 500 aa, Glycine max
  misc_feature (218)..(219): Xaa can be any naturally occurring amino acid
  misc_feature (403)..(403): Xaa can be any naturally occurring amino acid
  misc_feature (407)..(407): Xaa can be any naturally occurring amino acid
  misc_feature (409)..(410): Xaa can be any naturally occurring amino acid
  misc_feature (420)..(420): Xaa can be any naturally occurring amino acid
MGLVKKIGKYQLGRTIGEGTFSKVKLAVNGNNGQKVAIKVIDKHMVLENNLKNQAKREIRTMKLLHHPNIVRIHEVIGTKTKIYIVMEYVSGGQLLDKISYGEKLNACEARKLFQQLIDALKYCHNKGVYHRDLKPENLLLDSKGNLKVSDFGLSALQKHNDVLNTRCGSPGYVAPELLLSKGYDGAAADVWSCGVILFELLAGYLPFNDTNLMNLYXXIWKAEYRCPPWFTQNQKKLIAKILEPRPVKRITIPDIVEDEWFQTDYKPVFASEFDQNINLDDVDVAFNSIKENIRESTIPKSSSFINAFQLIAMSQDLDLSGLFEEQDEKKQRTRLGSKHTINETIEKIEAAATDVGLSIEKMNNFKIKMQPKQIMTRCSRSYLSAQVIEVAPTHCVIEISKXTGDXRXXHKFCESLSNXLKQKPDPSQSQDSVDCAAERKNKMLDATKSQKVKIANLFLAINLLEDGLNPCLFHFSEVHGSLTRMKQSTKKNHVANFLL

SEQ ID NO: 65732 - protein, 651 aa, Arabidopsis thaliana
MDTGAVKLPIHEHPIFPSARIVFSTCKGCGVEDFVYGGYVCNDSDCKARFHKECAEAPSEISHSFHQQHPLFLTNGLGDLPCDLCGQKRLEAAGYSCPTCEFKLDLTCGINPSPPAIEHPICHDHPLVFLKKREEKAPCEVCKDSIGGPSYSCLGCDLYFHVDCVHLSKEVNHPCHPSHPLKLIASESLTDNAEKICLLCEQQPENMLYYCSVCNFTSCLGCTKRPPPLFIEHTKTHKHQLTLFLNGISYQGSALTYNSRAYMCLPCGFVVNGNGINLPQVININRHDHRISYTHQLGPGYLNCGVCREIVDRDCGAYACVVCSNYAVHWECAVHDNVWDGVELEGTSEITEDIAPFKVMGDNLISHFSHEQHTLRLHKEGIIHDAYALCEACTYPIGFDPIYSCEECHFILHEKCANLPMKKRLVFATTPFKLVGASSRVRDVIDCGYCGECSTGFKYASQRGWEIDVHCGSLSEPFVHNGHLHPLYFDSKENHSCNACHKVTVHMLCCNACDFDLCLSCASLPLKIRHRNDEHPLTLSCGETANGKYWCDICETELDPSKWFYTSFDCGVTLHVECVLGDFSRLMPGRMVDTVGGKKFYVVLNNHNTRPLCSMCRSRCKVSVILKACDEDNVYICSRSCFSDMVSARSC

SEQ ID NO: 65733 - protein, 444 aa, Bacteroides thetaiotaomicron VPI-5482
MNAAKVLDDLKRRFPNEPEYHQAVEEVLSTIEEEYNKHPEFDKANLIERLCIPDRVFQFRVTWMDDKGNIQTNMGYRVQHNNAIGPYKGGIRFHASVNLSILKFLAFEQTFKNSLTTLPMGGGKGGSDFSPRGKSNAEVMRFVQAFMLELWRHIGPETDVPAGDIGVGGREVGFMFGMYKKLAHEFTGTFTGKGREFGGSLIRPEATGYGNIYFLMEMLKTKGTDLKGKVCLVSGSGNVAQYTIEKVIELGGKVVTCSDSDGYIYDPDGIDREKLDYIMELKNLYRGRIREYAEKYGCKYVEGAKPWGEKCDIALPSATQNELNGDHARQLVANGCIAVSEGANMPSTPEAVRVFQDAKILYAPGKAANAGGVSVSGLEMTQNSIKLSWSAEEVDEKLKSIMKNIHEACVQYGTEADGYVNYVKGANVAGFMKVAKAMMAQGIV

SEQ ID NO: 65734 - protein, 273 aa, Nostoc sp. PCC 7120
MGQQIIQVDAFTAKPFAGNPAAVCVLPTPQDDSWMQNVAQEMNLSETAFLVKQDDGFNLRWFTPTVEVPLCGHATLASAHVLWSEGHLSPDEVAHFHTKSGLLIAKRQGDWIELDFPVNHSQAITTPPELGEALGVPLKVVVQNSLGYLVEVESEDLVRQMQPNFSKLATLLTGNAIVTSQTRTDSQYDFVSRFFAPGLGINEDPVTGAAHCCLAAYWRDRLGKDEFVAYQASSRGGVVKVRYGGGDAYGGSQSDHRVFLAGQAVTVLRGELI

SEQ ID NO: 65735 - protein, 445 aa, Bacteroides thetaiotaomicron VPI-5482
MNIQKIMSSLEAKHPGELEYLQAVKEVLLSIEDIYNQHPEFEKVKIIERLVEPDRIFTFRVTWVDDKGEVQTNLGYRVQFNNAIGPYKGGIRFHASVNLSILKFLGFEQTFKNALTTLPMGGGKGGSDFSPRGKSDAEIMRFCQAFMLELWRHLGPDMDVPAGDIGVGGREVGYMFGMYKKLTREFTGTFTGKGLEFGGSLIRPEATGFGGLYFVYQMLQAKNIDIKGKTVAISGFGNVAWGAATKATELGAKVITISGPDGYIYDPDGISGEKIDYMLELRASGNDIVAPYAEKYPGATFVEGKRPWEVKADIALPCATQNELNGEDAQNLIKNNVLCIGEISNMGCTPEAIDLFIEKKIMYAPGKAVNAGGVATSGLEMSQNAMHLSWSAAEVDEKLHAIMHGIHAQCVKYGTEPDGYINYVKGANIAGFMKVAHAMMGQGVI

SEQ ID NO: 65736 - protein, 791 aa, Oryza sativa
  misc_feature (722)..(722): Xaa can be any naturally occurring amino acid
  misc_feature (774)..(774): Xaa can be any naturally occurring amino acid
MENGRLYPERPRTFSTVRTKSSLPPIFRVLMRINPRAFIVLLLLVFSGVLYVGASTSPIVLFVFCICTLSLFFSLYLTKWVLAKDEGPPEMSEIYAVFFIGCLLDVQISDAIRDGAEGFFRTQYGTISKMACILALVILGIYLFRSTTPQQEASGVGRTTSAYITVASFLLGALCSGIAGFVGMWVSVRANVRVSSAARRSAREALQIAVRAGGFSAIVVVGMAVFGVAILYATFYVWLEVDSPGSMKVTDLPLLLVGYGFGASFVALFAQLGGGIYTKAADVGADLVGKVEQGIPEDDPRNPAVIADLASLFCLSCNIIDKNAKLSSDNSYPSGFILFPLVVHSFDLVISSVGILSIRGTRDSGLISPIEDPMAIMQKGYSITILLAVVTFGVSTRWLLYTEQAPSAWLNFALCGLVGIITAYAFVWISKYYTDYKHEPVRLLALSSSTGHGTNIIAGVSLGLESTALPVLVISVAIISAFWLGHTSGLVDESGNPTGGLFGTAVATMGMLSTAAYVLTMDMFGPIADNAGGIVEMSQQPESVREITDILDAVGNTTKATTKGFAIGSAALASFLLFSAYMDEVAAFAQLPFKEVDIAIPEVFVGGLLGSMLIFLFSAWACSAVGRTAQEVVNEVRRQFIERPGIMDYNEKPDYGRCVAIVASASLREMIRPGALAIISPMAVGIIFRMLGHATGRPLLGAKVVAAMLMFATVSGILMALXLNTAGGAWDNAKKYIETGALGGKGSESHKAAVTGDTVGDPFKDTAGPSIHVXLIKMLATITLVMAPIFL

SEQ ID NO: 65737 - protein, 437 aa, Zea mays
MTVVPRQTIHRHTNTSRRRQRASLLSHASRQGRERDRRSPSRRRWCGCPPSSSEICLVTDLSDKMVKICCIGAGYVGGPTMAVIALKCPDIEVVVVDISKPRIEAWNSDTLPIYEPGLDDVVKQCRGRNLFFSTDVEKHVAEADIIFVSVNTPTKTRGLGAGKAADLTYWESAARMIADVSKSDKIVVEKSTVPVKTAEAIEKILTHNSKDTRIGPKFLNASVGFGGSCFQKDILNLVYICECNGLPEVANYWKQVIKINDYQKSRFVNRVVSSMFNTVAGKKIAVLGFAFKKDTGDTRETPAIDVCKGLLGDKAQISIYDPQVTEDQIQRDLAMNKFDWDHPMHLQPTSPAAVKQVSCVWDAYEATKGAHGLCILTEWDEFKTLDYQKIFDNMQKPAFVFDGRNIVDSEKLREIGFIVYSIGKPLDAWLKDMPAVA

SEQ ID NO: 65738 - protein, 228 aa, Streptococcus suis
VSEEQAHELLNDVNYFGVMLVYMGVVEGMVSGAIHSTASTVRPALQIIKTEPGVSKTSGAFLMVKGEERYIFGDCAINIDPDAQTLAEIAINSARTAKMFGIDPKVAMLSYSTKGSGSGPKVDKVVEATKIAQKLRPELDLDGELQFDAAFVPATGKLKAPGSSVAGQATVFIFPGISAGNIGYKIAERMGGFAAVGPVLQGLNQPVNDLSRGCNPDDVYNLTLITAV

SEQ ID NO: 65739 - protein, 392 aa, Arabidopsis thaliana
MVFSKDLPSPATMFSTYASLAGYIMMIKPMIHTIIPRPIQNFVFSYIKSFVGSPQAYLSSKISPDASKLRMTRDPNNKNVNLHLSQGEVVSDVYKGIELKWRYLEGRNKKTTVVGEETEEAIVNWQCFELSFDKKHKDLVVKSYIAYVERKAKVIKEERRIIKMHSYSSYTLRWQSVKFEHPSTFHTMAMTPKLKSSVMEDLDRFIKRKDYYKRVGKAWKRSYFLYGPPGTGKSSLVAAMANYLKFDIYDLQLANVQGDAQLRSLLLATNNSSILLVEDIDCSVDLPTRLQPATTTLGAPKGSTPLTLSGLLNCIDGLWSSCGDERIVIFTTNNKEVLDPALLRPGCMDMHIYLGHCSFEGFKILASNYLGMPHDSDDPHRLYPDIKRLIDG

SEQ ID NO: 65740 - protein, 335 aa, Robiginitalea biformata HTCC2501
MQRKNKTLGEFIIENQQEFQYSTGELSKLINAIRLAAKVVNHEVNKAGLVDILGAAGETNIQGESQQKLDVLANEKFKQTLQNREIVCGIASEEEDDFITINSQDEQHQNKYVVLIDPLDGSSNIDVNVSVGTIFSIYRRVTPIGSPVSLEDFLQPGVNQVAAGYIIYGTSTMLVYTTGHGVNGFTLNPAIGTFYLSHPNMQFPETGRIYSVNEGNYTHFPQGVKDYIKYCQKEEDDRPYTSRYIGSLVSDFHRNMIKGGIYIYPKSSTAFNGKLRLLYECNPMAYLAEQAGGRASDGYRRILEITPTELHQRVPFFCGSRKMVEKAESFMAQYA

SEQ ID NO: 65741 - protein, 520 aa, Geobacter metallireducens GS-15
MSSDIHSEKILILDFGSQYTQLIARRVREAHVYCELHPFDMDLAAIRAFAPRGIILSGGPKSVYEEGAPAVEEALFELGVPVLGICYGMQLMSRHFGGQVVPAGKREFGHADLLAVGTPGPLFDGFFVEGKSPVWMSHGDHVSLVPAGFQVVGETANAPVCAIQDLARNLYGVQFHPEVNHTPRGELLIDTFVRKICGCSGQWTPGHIIDDAVSRIRAQVGNDRVILGLSGGVDSSVAAALIHRAIGDQLTCVFVDNGLLRLSEGDQVMATFAENLGVKVIRVDAEDRFLTALAGESDPEKKRKIIGKLFVDIFEEESNKITDARWLAQGTIYPDVIESAGAKTGKAHNIKSHHNVGGLPDYMKLKLLEPLRELFKDEVRAIGEELGLPHQMVWRHPFPGPGLGVRILGEVKKEYADILRRADAIYIEELYAAGHYDKISQAFAVFLPVKSVGVMGDGRTYEYVVALRAVETKDFMTAGWYPLPYEDMARISSRIINEVKGVNRVVYDISSKPPATIEWE

SEQ ID NO: 65742 - protein, 683 aa, Oryza sativa Indica Group
MASGHREWMNSCPGLCRACSFGDETSPPVCTGIWGRSSISARTVRIGSEAALDLIWAVHCSQGTGGADEASRDPRLLLAAAARGFPNREIFFSPKKPNKEKSLRANSTRSEARIEVGFHNFMDFDCKTARGDSSSVNRSCIVTEGTVVQAKPVSHNGKAKHWNSLSTLNNQKCSYELLSDPKKNVETSDGETASKCDSWCFTDLPSALVCEVLEHLDPKELGIVSCVSTLLHTLATDHQGWKKFYCERWGIPTPPVTLNGPLVPGGTSDWKSWKTLFVEREFRSKSFMGRFSVDVLRDHSEDVRTVFLLASVNLIFTGGNDSVIRMWDLEEGLLIDKSRPLCCTIRAIAADTRLLVTAGTNAFIHCWRAVEGNSYPFHISGNGTDQSPEFRLWGHEGPVTCLALDSLRIFSGSWDMTVRVWDRSEMKCVQKFMHADWVWSVAPHGNTVASTAGRDAYVWDIRSGELENVISNAHYGNAFSLARTHLADVLFTGGEDGAIRLFNVSEVSDDEDIKPAATWVPHTGPVHSLAFEYPWLVSASSDGRVALIDLRKLLTPRKSSKQPFRVKNFDPSSIEPPQRMLHGFGCDLFSVAIGADRIVCGGEDGAVKVWNFSEALEIEKRAQALRSMRQENRMRRKKAQVEMNANGRRSDQCGSIAMKRNQLKGDKSVTWHSKRAINDKVKS

SEQ ID NO: 65743 - protein, 318 aa, Saccharophagus degradans 2-40
MPQIAAIGEVMIELAPAGTDATSGKAMNTLSFAGDTYNTVVTLARLGIDASYVSRLGDDRFSDNIIANLSDENVATNTIERAKGEVPGLYMIQNTPDGEREFFYWRGQAPAKQMFTSANTPALLDSLSAHPWLYFSGITLAIISEQARITLFGFLASYRANGGKVAFDSNYRPRLWANPELAQQATIAALAQTDLALLTLDDEALLWGDSDDLLADAQKRYQSLEISELVFKRGADDVIIVQGDSEQRVSVPKVENIIDTTAAGDTFNAGYLSARLKGEPPVKAAQEANRCANIVIRHRGGVIPKEVFLEEHRALLKQ

SEQ ID NO: 65744 - protein, 363 aa, Xylella fastidiosa Dixon
MGIKCGIVGLPNVGKSTLFNALTKAGIAAANFPFCTIEPNVGVVPVPDPRLNQLAEIVKPQKLLPTAIEFVDIAGLVAGAASGEGLGNKFLAHIREVDAIAHVVRCFEHGEIIHVAGKVDPLADIEIIDTELILADLDTVEKACNRIMRAAKGGGKEAIARKSVLERLQVALNEGKSARSAGLDEDERALVRDLFLLTLKPVMYIANVLENGFQDNVYLETLRVRAASDNAQLVPISAVIEEELAQLEDVDRDAFLVDLGLEEPGLNRVVRAAYALLGLQTYFTAGVKEVRAWTVKSGATAPQAAAVIHTDFEKGFIRAETIAFDDFIKYKGEAGARDAGRMRLEGKEYRVQEGDVLHFRFNV

SEQ ID NO: 65745 - protein, 164 aa, Anabaena variabilis ATCC 29413
MKKRYFLQTSAALVGTALLPPYIFQRSSIMAASNTKFEIAKSEQEWQTILTPEQFRVLRKHGTERAFTSSLDKEYSEGTYVCAGCGQPLFTSDTKFNSGTGWPSFFTPIEGAIGTTTDRSFFMTRVEVHCSRCGGHLGHVFDDGPAPTGKRYCMNGVSLKFEPA

SEQ ID NO: 65746 - protein, 322 aa, Xylella fastidiosa Dixon
MPTIQDERNLMVFSGNANKPLTQSICKELGVRMGKSLVSRFSDGEEQVEIEESVRRQEVFVVQPTCAPSAENLMELLVIIDALKRASVSSVTAVIPYFGYSRQDRRMRSLRVPITAKVAAKMISVIGADRVLTIDLHADQIQGFFDVPVDNVYASPLLLADIWRAYGTDNLIVVSPDVGGVVRARAMAKRLGDTDLAIIDKRRPRANVATVMNIIGEVNGKTCVLVDDLVDTAGTLCAAAVALKQNGATKVVAYITHPVLSGPAVDNINNSELDELVVTDTIPLSDAARECRKIRQLSVAELLAETIRRIAFGESVSSLYVD

SEQ ID NO: 65747 - protein, 400 aa, Aspergillus nidulans FGSC A4
MAPRTMKALNYVGPFNVKVQEVEMPCLEHPDDIIVKITSAAICGSDLHMYEGRTAAEAGITFGHENLGIVEELGDGVTLLKKGDRVVMPFNVADGRCRNCEDGKTAFCTGVNPGFAGGAYGYVAMGPYRGGQAQYLRVPYADFNALKLPPGTEHEADFILLADIFPTGWHGIEISGFQPGDSVAVFGAGPVGLMAAYSAQIRGASRVYVVDRVPERLRAAEKIGAVPIDFTAGDAVDQIIAANGGEMVDRSVDAVGYQAVSGTKDNATEVPNIVLENMIRVTRACGGLGIPGLYVPSDPGAGDTATAKGMISLSFGKLFEKGLTLGTGQCNVKAYNRQLRDLIIAGKARPSFVVSHEISLDEAEIAYDKFDKRIEGYTKVIIHPNGGFQDKRPPVVNSPL

SEQ ID NO: 65748 - protein, 506 aa, Shewanella sp. MR-4
MIYAQPGTAGAIVNFKEKYANFIGGKWVAPVNGEYFDNRSPVNGQNFCKIPRSDYRDIELALDAAHAAKDAWGKTSVTERANLLLRIADRVEQNLEYLAVAETWENGKAVRETLNADLPLFVDHFRYFAGCIRAQEGSAADIDGNTVSYHFPEPLGVVGQIIPWNFPLLMAAWKIAPALAAGNCVVLKPAEQTPVSILVLLELIEDLLPPGILNVVNGFGAEAGQALATSKRIAKLAFTGSTEVGYHILKCAAESLIPSTVELGGKSPNLYFADVMDHEDEYLDKAVEGMLLAFFNQGEVCTCPSRVLIQESIYDRFIEKVLARAQTIKQGNPLDTATQVGAQASQEQFDKILSYLAIGKDEGAQVLLGGSLCQLEGEQSKGYYISPTIMKGHNKMRIFQEEIFGPVISVTTFKDEAEALAIANDTEYGLGAGVWTRDMNRAQRLGRGIQAGRVWINCYHAYPAHAAFGGYKKSGIGRETHKMMLNHYQNTKNLLVSYDINPLGFF

SEQ ID NO: 65749 - protein, 336 aa, uncultured archaeon GZfos1D1
  misc_feature (112)..(112): Xaa can be any naturally occurring amino acid
MMKLAINGWGRIGRLVFRAALQDHSALDFVAINSRSAGASWIEHLLTYDSVHGKQEGEIRAEKDTLFVNGKEIKILSESDPENLPWRDLGVDVVVESTGQFRDRKGASKHLXAGCKKVIITAPGKEPDVTLVPGVNDAMYNPATHNIISLASCTTNCLAPVAKVLEDEFGINRGFMTTVHAYTGDQKLLDGRHNDLRRARAAAMSIVPTTTGAAAALGVVLPSLAGKMDGISLRVPTTNVSVVDLVAELGSEVTREAVNSAFEEASKTSLAGILSVSHLPLVSIDYNGSSFSAIVDAEYTNVVGGRLVKVLAWYDNEWGYSCRVVDMIKRLEAEGV

SEQ ID NO: 65750 - protein, 404 aa, uncultured archaeon GZfos1D1
MNDKLKEFLTIDDFDLYGKTVLFRADINSVIIDGQVQMKERIVENAKTIQKLLDKKAKVVILAHQGRAGQADFLHLEQHAQLLRNFMDLKYIDDIMGPSARAAIKGLDHGEVLLLDNVRMLAEETLNKTPEEHSHSFFVKSLAPLADIYINDAFSVAHRSHASVLGFPAVLDAGIGRLMERELKTLERAVYKIKSPCVYILGGVKPEEVFDIIDVTLKRKRVDTILTTGALGTLFLYARGIIEPGEEQKVDTHFMWNVEQAKRFLEMGKDIIKYPEDVAVAVDGERREIPVAQLKPNQPAYDIGEKTSEEYSEQIKNARTVIMKGPAGLYENKAFAKGTRDIFEAISHSKAYSLLGGGHTSAAISEVGIDRKTMSNAHVSLAGGAFLRYFVDKHLPGIEVLKKH

SEQ ID NO: 65751 - protein, 409 aa, Zea mays
MAAALQATPIKTLATSRWRVEGAEARPRPRPIAVSFRCSAAARSYNITLLPGDGIGPEVVAVAKDVLSFAGALEGVELRFQEKLVGGSALDATGVPLPDETLDEAKGSDAVLLGAIGGYKWDTNEKHLKPETGLLQLRAGLGVFANLRPAAVLPQLVDASTLKKEVAEGVDIMVVRELTGGIYFGKPRGFGTNDKGDDIGFNTEVYSASEIDRIARVAFEVARKRRGKLCSVDKANVLEASMLWRKKVTALASEFPDIELSHMYVDNAAMQLVRNPKQFDTIVTNNIFGDILSDEASMITGSIGMLPSASVGESGPGLFEPIHGSAPDIAGQDKANPLATILSAAMLLRYGLGEENAARRIEAAVTETLNHGFRTGDIYSPGTTLVGCKRMGEEVLKTVESLKEVAAVN

SEQ ID NO: 65752 - protein, 218 aa, Brassica napus
  misc_feature (123)..(123): Xaa can be any naturally occurring amino acid
  misc_feature (131)..(131): Xaa can be any naturally occurring amino acid
  misc_feature (145)..(145): Xaa can be any naturally occurring amino acid
  misc_feature (171)..(171): Xaa can be any naturally occurring amino acid
  misc_feature (180)..(180): Xaa can be any naturally occurring amino acid
  misc_feature (185)..(185): Xaa can be any naturally occurring amino acid
  misc_feature (200)..(200): Xaa can be any naturally occurring amino acid
  misc_feature (204)..(205): Xaa can be any naturally occurring amino acid
MSAFTSKFADELIANAAYIGTPGKGILAADESTGTIGKRLASINVENVETNRRALRELLFTAPGALPCLSGVILFEETLYQKSSDGKLFVDILKEGGVLPGIKVDKGTVELAGTNGETTTQGXLDGLGERXCKKYYEAGARFAKXGRAVLKIGENEPSEHSIHETAYGLAXRYAVIWPGXNGLVXHCLEPENPSVDGSMXIPQXXAAGLERGLAGLAT

SEQ ID NO: 65753 - protein, 163 aa, Staphylococcus sp. MRCNS378
MNNTNVDLVEKHLSNHTGGLKMIKKNKEELNDMEYLVTQENGTEPPFQNEYWNHFEKGIYVDKLSGKPLFTSEDKFESNCGWPSFSKALNDDEIVELVDKSFGMIRTEVRSEKANSHLGHVFNDGPKEKGGLRYCINSAAIQFIPYDKLEELGYGDLIKHFKK

SEQ ID NO: 65754 - protein, 251 aa, Azotobacter vinelandii
MFERMREDIRSVFQRDPAARNALEVLICYPGLHALWLHRLAHGLWCSDWKLLARLVSHVGRWLTGIEIHPGARIGRRLFIDHGMGVVIGETAEIGDDVTLYHGVTLGGTSWNKGKRHPTLEDGVIVGAGAKILGPFTVGAGAKIGSNAVVTRAVPAGATAVGIPGRIVARPDDEQEARRRAIAEKYGFDAIALGQNTPDPVAQAIGQLLDHLQAVDERLEGMCQALRALGSDYHAKELPALREEDFAGRQG

SEQ ID NO: 65755 - protein, 127 aa, Azotobacter vinelandii
MQPMLNIALRAARSAGELIFRSIERLDVISVDEKDAKDYVSEVDRAAEQTIIATLRKAYPHHAILGEESGQQAGSGEGADYQWIIDPLDGTTNFLRAVPHFAVSIACKHKGRLEHAVVLDPVRQEEF

SEQ ID NO: 65756 - protein, 158 aa, Picea abies
  misc_feature (3)..(3): Xaa can be any naturally occurring amino acid
  misc_feature (47)..(48): Xaa can be any naturally occurring amino acid
VAXSRDGSRLACSTMDGTIAIFDVPRAKFLYNLEGHYMPVRSLVFSXXDSRILFSASDDKHIHMYDVDNKSLICAMSGHASWVLSIDVSPDGLAVATGSSDRTVRLWDLSMRSSVQTMTNHTDQVWGVAFRPTGSPGSRAGRLASVSDDKSISLYDFT

SEQ ID NO: 65757 - protein, 343 aa, Alkalilimnicola ehrlichei MLHE-1
MPPTATQTTVTPGATEPDRRLSVAPMMEWTDRHARYFLRLLAPRTLLFTEMVPALAVWHNDPERFLAYSAAERPLAVQFGGSDPEQLAHCARLAEAWSYDEVNLNVGCPSDRVQAGAFGACLMADPGRVADCVAAMAESTRLPVTVKHRIGVDHLDSYDHLTGFVDQVAAAGCRTFYVHARKAWLQGLSPKENREVPPLDYGRVYRLKRDFPALEVILNGGITRTETLLETLDRGLDGAMVGREAYTNPWALAGWDRALFGAAGAGVPDRHAAVRAFLPYVETELAGGARLQHLARHILGLFNGCPGGRRWRRHISEQAHRSGAGPEVIEQALALVPEAPAVA

SEQ ID NO: 65758 - protein, 345 aa, Streptococcus pyogenes M49 591
SKPIKKRGIPYEKSIRSTCPEQAKTFGGKLEVQPKVDIKTKHDLSIAYTPGVASVSSAIAKDKTLAYDLTTKKNTVAVISDGTAVLGLGDIGPEAAMPVMEGKAALFKAFAGVDAIPIVLDTKDTEEIISIVKALAPTFGGINLEDISAPRCFEIEQRLIKECHIPVFHDDQHGTAIVVLAAIFNSLKLLQKSLDEVSIVVNGGGSAGLSITRKLLAAGATKVTVVDKFGIINEQEADRLAPHHLDIAKVTNREFKSGTLEDALEGADIFIGVSAPGVLKAEWISKMAARPVIFAMANPIPEIYPDEALEAGAYIVGTGRSDFPNQINNVLAFPGIFRGALDARA

SEQ ID NO: 65759 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEERVRAAFAFPAPVANVESDVGCLELFHGPTLAFKDFGGRFMAQMLTHIADDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSFGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 65760 - protein, 408 aa, Oryza sativa Japonica Group
MDKKQGFFSALREEVARGLSPARARRRSQAAAAAEVAAALRAPDPESGDGGKSSFVGGGGEEGRVGPLGCAANFSRAPLTAGAAVVAAGCCGGAARRNDLRLLLGVMGAPLGPVHVAAGEPLPHLSIKDTPIETSSAQYILQQYLAASGGQKLLSSVRNSYAMGKVRMVATEFETGGRVVRNRMAARATESGRFVLWQMAPEMWYIELAVGGSKVHAGCNGKLVWRHTPWLGAHSAKGPVRPLRRALQGLDPLTAASMFAGARCIGERKDLTSPGIQSTTGGDAVYWETTINSFIEDYRPVEGIMVAHAGRSAVTLFRFGEVAMSHTKTRMEEAWSIEEVAFNVPGLSIDCFIPPTDIKSGSISETVELPHGEKSKVGLLQCHSAKVAALEKADDNVAWSGALQRDFK

SEQ ID NO: 65761 - protein, 1755 aa, Candida glabrata
MSNSDYFSHKPADSTGTPGTGTGTGTGTGGGTGTGTGTGSRRLAKEYLPARSRSSSSDARNPYMYHYNPRDAAGAGAVTGSGSGSNVGTPPGFHTTSPQSGYMSSRIGGPESLMQHHTGLTFDSMMQNPVLSMGPLSPGISPLTNLNAFGKNSTGVPKQPSSGNNTISFAPVPSPTSTSARSSRRASVVSNSSQGIHSLPKIATQIHQGQGQQVQQQSPNKKPYKIYNSQDGNPSITNTASKIRTSSIAMDSSTSTITTPTLVISPDMAAGSLPSNLGSTPSESTLKHSSGKHSAMATPGGTASNAVNMGSVGSLQDMATPGASTRSATIQNGSTASLRTFKKQYVLNEQLYLEKMRRNVPDDYYTRGIGPTSVTDEDEEFDIEMDEVFDQSGSNNKLSELDGNVDIQDDVDFGTKFINPDADRNENLVALSSRFLSRKLDWAFPSKKVREDQSSSTPTESRRSPADINDGNNNNINNNINNNTNDNNNTNSNRNNSNNNNNNNNNKDSNGTSDTAITTTSTTNNSADVTPRKSTPNNSVSDTPAPQENLSANEHFISQLLQDPAVVKRFEWQTMLANVLKGDIVKSEKTKIAKEVKGPGFTTQYSDDIWLELKAWMNGRNVDDQKKSLKLLRESADEVFQRVLDFRLPDGLTSDEGEVEIAKLMNKYYRVIKLWSNMKRLYQDKPIAKTEAFRNRIDTLDSWLNFKRNFEEKIHYIRNWVVGTKDPETQVVVDINDDDAIFRHYAHEFADQMIKEKDIEAIFQKRIFFPLAPWILKAKLFFLKNRDTLNELNLMYLNDQLEMLLMFPMRLVKDIIQLRLSYAKKLQKPTMMMIDQMIDDFNSYIRVAVQMKFTVISYCQGWQFTVNIDPQFDDTVVEAIRHLFILLELKLLDGGGKSTNAFKEPDILLKYWDGLKNCGHYIDGAGKVIAIEFTKLTLRLVHRLHSYLLQQQNSPPKLTNEAEAEKWLVQLFETLGSMKRKLNRFTNVLMKAFQNSVTYRIDDHAQLMNGLKDTGHFLVYTGGKLEKQGIYLIASPELLGCPENEILKVLYNSDSGCDLIPKLEIENSLTLYNAVAEKWDLSTSIVQGVGKDGLPRYYLQNGNVDAQFRPPNLNSGKSHVAEMYNDDRDPDADILELEMKLNSLGYILVLCPQEPMLWSGEVFNLSEFTTEEINDLDFKTRPDTIKLMCQSSSYALEYQCDRFLQSASDCVTFLEKRCSFEVVENNLQKLNKAYFRCTYSVLKNYHKIVKTFKKVCPNNDLLNGIFLFARDFGLNFLRINVASNEKKSLIILLLVRLSVGWLQFLSVDCDPTDPRTFRWCVTAMEFAMHMTSGWNILALDENQFSSLKHKISACMSLLISHFDVMGARAVELEKNSQQPRPNINIEDVFDDDSMLQKNSELRMQSIKALEENVTRGTHRIGKVLDDTDKGNKYISSLASSISNVSIRWQKRNFIGGGTFGSVYSAVDLDNGEILAVKEIRIQDSKAMEKVFPSIKEEMNVLEMLNHPNIVQYYGVEVHRDKVNIFMEYCEGGSMASLLEHGRIEDEMVTQVYTLELLEGLAYLHESGIVHRDIKPENILLDFNGIVKYVDFGAARKISKKGTKRTKMPGADNDMKEDKIVPDSTGLNDLIGTPMYMAPESITGSTNKGHLGSDDIWSLGCVVLEMITGRRPWANLDNEWAIMYHVAAGHIPQLPAQDEVSSAGRRFLKRCLVQDPKRRATAVELLMDPWIVEIREQLFSSDDVDTNSVSSSQERK

SEQ ID NO: 65762 - protein, 182 aa, Pseudomonas fluorescens Pf-5
MAFDSFDIKSLIRPVIDFPKPGVIFRDITPLFQSPRALRLVADSFAQRYVEEDFSHIGAMDARGFLIGSIIAYQLNKPLILFRKQGKLPADILAEGYRTEYGEAFIEVHADSLCEGDSVLLIDDLIATGGTLIAAANLVRRMGAKVYEAAAIIDLPELGGSQKLQDMGIPTFCLTQFSLTER

SEQ ID NO: 65763 - protein, 355 aa, Coccidioides immitis RS
MSTTPPAKPTNPLKLDPKYDDYDFPTTAPVAQSGHPGHTTPEQDAQVAQLRMMLEALGYTDRLDTLTLLRFLRARKFNVEAAKTMFVACEQWRRDFGTDSLVTDFHYTEKEQVFEYYPQYYHKTDKDGRPVYIEQLGKIDLTAMYKITTSERMLKSLVCEYEKLADPRLPACARKSGHLLETCCTIMDLKGVGISNAASVFGYIKQASAISQNYYPERLGKLYIINAPWGFSTVFSVVKGFLDPVTVSKINVLGSGYEKELLAQVPAENLPKQFGGQCECPGGCPFSDMGPWQESEWAKPPKWAKKDDKGEEGEKKEEGKAEGEEEKKEDADKEKAAAAPAETTSAPAQKDQISA

SEQ ID NO: 65764 - protein, 206 aa, Zea mays
FFSPATLVLICYCFLFEQCLRKNAMELEKKEQKEKELRAQIIAEAEEFKKAFFEKRIQNCASNMVNNREREKIFVASQEKFHANADKQYWKSISDLIPHEIATIEKRGKKDKDKKPSVTVIQGPKPGKPTDLSRMRHILVKLKHAPPSHMLQPPPAPAAKEGAKDGGAKDGAAAPANDAKQPAESQETSTANGPSEAEKEQPAASE

SEQ ID NO: 65765 - protein, 225 aa, Streptococcus suis
RFNFSHGDHQEQGDRMATVRRAEEIAGKKVGFLLDTKGPEIRTELFEDDAKEYAYTTGDKLRVATKQGIKSTKEVIALNVAGGLDVFDDVEVGKQILVDDGKLGLTVVEKDAVNREFVVLVENDGVIAKQKGVNIPYTKIPFPALAERDNADIRFGLEQGLNFIAISFVRTAKDVEVVRNICKETGNDHVQLFAKIENQQGIDNIDEIIEAADGIMIARGDMGIE

SEQ ID NO: 65766 - protein, 155 aa, Zea mays
ITNTSDPSPIIAPPVAQVGLGADLVRIDAHSMCSPGFSCDSAYQVTYIVRGSGRVQVVGPDGRRVLETRIEGGSLFIVPRFHVVSKIADASGMEWFSIITTPNPVFSHLAGKTSVWKAISPEVLQASFNTTPEMEKLFRSKRLDSEIFFAPPSSN

SEQ ID NO: 65767 - protein, 480 aa, Arabidopsis thaliana
KVFGSAEASNLVTELRRSFDDGVTRGYEWRVTQLKKLMIICDNHEPEIVAALRDDLGKPELESSVYEVSLLRNSIKLALKQLKNWMAPEKAKTSLTTFPASAEIVSEPLGVVLVISAWNYPFLLSIDPVIGAISAGNAVVLKPSELAPASSALLTKLLEQYLDPSAVRVVEGAVTETSALLEQKWDKIFYTGSSKVGRVIMAAAAKHLTPVVLELGGKSPVVVDSDTDLKVTVRRIIVGKWGCNNGQACVSPDYILTTKEYAPKLIDDMKLELEKFYGKNPIESKDMSRIVNSNHLDRLSKLLDEKEVSDKIVYGGEKDRENLKIAPTILLDVPLDSLIMSEEIFGPLLPILTLNNLEESFDVIRSRPKPLAAYLFTHNKKLKERFAATVSAGGIVVNDIAVHLALHTLPFGGVGESGMGAYHGKFSFDASSHKKAVLYRSLFGDSAVRYPPYSRGKLRLLKALVDSNIFDLFKVLLGLA

SEQ ID NO: 65768 - protein, 734 aa, Haloarcula marismortui ATCC 43049
MAKDLERDLGLLSVVAISIGAMVGSGIFILPALAVKDAGAGIIAAYLLAGVLVLPAALSKAEMATAMPEAGGTYVYIERSMGPLLGTVSGLGTWFSLSFKGALALVGGVPYLVLLFDLPIRPVAITLAAVLILVNILGAEQTGRLQIGIVAVMLVAIGWFVAGGGPAVNTATYGGMWEYGVEGIFAATGLVFVSFAGVTKIASIAEEVEDPDRVIPLGMLGSLAFTTLLYVLVVAVVVGVIPLDQLAGSTTPIADAAEATLGTAGVAAVVLAAILALVSTANAGILSSSRYPFAMSRDGLAPDLLSTVSDRFGTPVTAITLTGGVMLLLILFVPILEIAKLASAFKILVFALINVALIGFRESDAPDYDPSFEVPLYPWTPIFGTLTGFALLTQMGLIAIVGAVGIVIASVVWYLGYVRPRVTREGAIKESVRRSIGDRALDRTEETLDETAETSVLVALPEGASRQSEATLLEVGAALSPTDSSLSVVQFDEVPDQQPLDYASGVQSPDDLEFECRTDTLAAALDTPVEYGELVSHHPERAVANAVDERGVDVLLVERGASFEDSLLGDSIDRIRKQADCDTIAVDAQPLDALETITLITTRGPYDPLKVRVGNAVATATGTDLQFLYPLDERQSAEERQQLEAYHDDLLDLCDVPTERTFVDRDDLSAAMDAADNDRTLLIHASNGGLSARTSNDNGTTQSAIQDSNHASMEVDTKRHPGGVVGRLLERLAF

SEQ ID NO: 65769 - protein, 401 aa, Pisum sativum
MATKRSVGTLKEADLKGKRVFVRVDLNVPLDDNLNITDDTRIRAAIPTIKYLTGYGAKVILSSHLGRPKGVTPKYSLKPLVPRLSELLGSEVTIAGDSIGEEVEKLVAQIPEGGVLLLENVRFHKEEEKNDPEFAKKLASLADLYVNDAFGTAHRAHASTEGVAKYLKPSVAGFLMQKELDYLVGAVSNPKKPFAAIVGGSKVSSKIGVIESLLEKVDILLLGGGMVFTFYKAQGYSVGTSLVEEDKLGLATSLIEKAKAKGVSLLLPTDVVIADKFSADANDKIVPASSIPDGWMGLDIGPDSIKTFNEALDKSQTVIWNGPMGVFEFDKFAAGTEAIAKKLAEISGKGVTTIIGGGDSVAAVEKAGLADKMSHISTGGGASLELLEGKPLPGVLALDDA

SEQ ID NO: 65770 - protein, 111 aa, Arabidopsis thaliana
MASSMLSSATMVASPAQATMVAPFNGLKSSAAFPATRKANNDITSITSNGGRVNCMQVWPPIGKKKFETLSYLPDLTDSELAKEVDYLIRNKWIPCVEFELEHGFVYREHG

SEQ ID NO: 65771 - protein, 233 aa, Bacteroides thetaiotaomicron VPI-5482
MNWENHLIKDLQWSNEIINREAKERVAREIAATAKTGDVIGAGSGSTVYLTLFELAKRIHEEHLYLEVIPASQEISMTCIQLGIPQTTLWDKRPDWTFDGADEVDPDRNLIKGRGGAMFKEKLLIRSSGKTFIIVDPSKLVNILGSKFPIPVEVFPHALSYVEKELRRLGASEISLRPAHGKDGPILTENGNFILDTRFHYIDASLEEQLKTITGVIESGLFINYDIEVVVTR

SEQ ID NO: 65772 - protein, 783 aa, Oryza sativa Japonica Group
MAAAAILPELAAQVVIPVAAAVGIAFAVLQWALVSKVKLTAEPRRGEAGGAAGGKSGPSDYLIEEEEGLNDHNVVSKCAEIQTAISEGATSFLFTEYKYVGLFMSIFAVLIFLFLGSVEGFSTKSQPCHYSKDKTCKPALANAIFSTIAFVLGAVTSLVSGFLGMKIATYANARTTLEARKGVGKAFITAFRSGAVMGFLLAASGLLVLYIAINLFGIYYGDDWEGLFEAITGYGLGGSSMALFGRVGGGIYTKAADVGADLVGKVERNIPEDDPRNPAVIADNVGDNVGDIAGMGSDLFGSYAESSCAALVVASISSFGINHEFTPMVYPLLVSSVGIIACLITTLFATDFFEIKAVSEIEPALKKQLIISTAFMTVGIALVSWLGLPYTFTIFNFGAQKTVQSWQLFLCVAVGLWAGLIIGFVTEYYTSNAYSPVQDVADSCRTGAATNVIFGLALGYKSVIIPIFAIAFSIFLSFSLAAMYGVAVAALGMLSTIATGLAIDAYGPISDNAGGIAEMAGMSHRIRERTDALDAAGNTTAAIGKGFAIGSAALVSLALFGAFVSRAAISTVDVLTPKVFIGLIVGAMLPYWFSAMTMKSVGSAALKMVEEVRRQFNTIPGLMEGTTKPDYATCVKISTDASIKEMIPPGALVMLTPLIVGILFGVETLSGVLAGALDYNCIQWSVLLIRFTFSQIAISASNTGGAWDNAKKYIEAGASEHARTLGPKGSDPHKAAVIGDTIGDPLKDTSGPSLNILIKLMAVESLVFAPFFATHGGILFKLF

SEQ ID NO: 65773 - protein, 184 aa, Candida albicans SC5314
MFSFTRAVPKSQLRFTVRNSFRTYVSIGDKVPATPVFEGSPGNDINLAEETASGKTILIGVPGAFSPACSASHVPGYIKNIRAFNDKGYQRFFVVAVNDPFVTKAWGEQLLESVAGQQIRFFADSTGAFTKELDLLFDARKAFGNERSKRYALIIEDGKVVKSFVEPDNTSVDVSAAQKVLEEA

SEQ ID NO: 65774 - protein, 89 aa, Oryza sativa Indica Group
MDKGRALPKFGEWDVKNPASAEGFTVIFQKARDDKKTTGPGNARVGIPPAFRSTDDDGGYRPEFKPAESYQQHTPPKRVKKKWAFCAGC

SEQ ID NO: 65775 - protein, 667 aa, Oryza sativa Indica Group
MGKSSKKSAVEVAPTSVSVSEGKSGKKGKRNAEDEIEKAVSAKKQKTVREKVVPSKEEAKKVKKQPPPKKVESSSSEEDSSESEEEVKAQPKKTVQPKKAAQPAKEESSDDSSDDSSSDDEPAKKPVARPNKAALSTNSSSSDDSSDESLSDDEPVKKPAAPLKKPVALATNGSKKVETDSSSSDSSSDEESDEDDKDVPTKAPAVAKKKEESSESSDSESDSDSDDEAAKTIIPAKAAAVKKEEESSDSSDSDSESESDSDEPAKPTIPAKRPLTKDTKKGQSKDESEDSSDESSEESDDEPPQKKIKDSTTSGTTKPSPKATKKEISSDDESDEDDSSDESSDEDVKQKQTQAKKVQAPVAQESSSSDESSEEDSDMESDEPAKTPQKKIYVSKSFFILQETAVSVGSNKSATKLGQEEPKTPASNQNQATGSKTLFVGNLPYNVEQEQVKQFFQEAGEVVDIRFSTFEDGNFRGFGHVEFATAEAAKKALELAGHDLMGRPVRLDLARERGAYTPGSGRDNSSFKKPAQSSGNTIFIKGFDTSLDIHQIRNSLEEHFGSCGEITRVSIPKDYETGASKGLYVDEARPRPDNNREGGFSGGRDFNSSGRGGRRGGRGDGSRGRGDRGRGRGFGRGDRGRGGRGTPFKQSAGTPSAGKKTTFGDDD

SEQ ID NO: 65776 - protein, 432 aa, Xylella fastidiosa Dixon
MTLWVLGLNHQTAPMELRERASFVGDALPRALDSLRNLPNVNEAALLSTCNRTELYAETTNAQMLLNWLEQHRPGLQNHLYQYSDAAAVRHLFRVATGLDSMVLGESQILGQVKDSWSMARTHGTLGNTLDRLFQHSFSVAKHARTNTRIGTNPVSIASTAVRLAQDAFSPLNESTVLLIGTGETIQLAAKHLSEGRVQRLLIANRTHAKAQMLASQHGGYALPLTELNLHLAEADIIFSATAAPTPIVTQSNVESALHIRKRKPMLLFDLAIPRDIETEVGTLTDAYLYTIDDLERAVEENRRSRREAAETAEAIIELQVKRYMDTLQAHAHQAPLRRLRTFGTTTRDELLTRARQQLANGRPAGEVLEQLAHGLTNRLLHPPTAALREAALANNTELVRAAEQLFPEKPGYHHPTLQTTIVKTDETDPAS

SEQ ID NO: 65777 - protein, 291 aa, Bradyrhizobium sp. BTAi1
MSRRHPIISITGSSGAGTTSVKKTFENIFRRENVKAAYIEGDAFHRYNREEMRRKMVEEAERGNKHFSHFSPDTNLFEELEKTFRDYSETGTGMTRHYVHDEEEARLYDTRPGNFTEWSRLPDDSDLLFYEGLHGAVVTEKVNIAQHADLKIGVVPVINLEWIQKLHRDRASRGYTTEAVTDTILRRMPDYVNYIIPQFSETDINFQRVPTVDTSNPFIARWIPTPDESMVVIRLKNPRGIDFPYLLSMIQGSFMSRANSIVIHGSKLDLAMQLILTPMIMQLMDRKRRTL

SEQ ID NO: 65778 - protein, 253 aa, Haloarcula marismortui ATCC 43049
MDLPPVGLGTMGIEDEAVVRTAIDCGYRHLDTAQIYDNESTVGAGIAAADTDRADLTVATKLWIDALEATAVRPATEASLDRLGLDAVDLLYVHRPRGDYDPETTLPAVEAVREAGLTAHVGLSNFDPDQLVVAREFLDKIAAHQVEFHPLFWRESLLTDAQKHDYPLVAYAPLAGGRVFEEPTILNIAAQHETTPAAVSIAWVTSYENVVTIPKASSQSHLEANLAAADLELTDAEIARIEAIEREEELFPE

SEQ ID NO: 65779 - protein, 347 aa, Bradyrhizobium sp. BTAi1
MAREWPMEQSPTLQAHLALQNADADCAAVIEALADAARELARQIAIAPLAGFDEGAATVNADGDVQKALDIVADNLMRDALRKAPVAGILSEEVDRPETVNAAAPLCVAIDPLDGSSNLQNNISVGTIFSIRPRGRDVLSSFFEPGTAQRAAGFFVYGPQTCLVLAIDHRVDLYVLHPTLREFVLARSGLRIPQDTPEFAINASNRRHWSGTVRNYVDECLAGAAGPRGRDFNMRWIASLVAEAYRILMRGGVFLYPADSRPGYREGRLRLVYEAHPMALIMEWAGGSASSGRSRILELSARSPHQRAPLIMGDVRLVRDVDQLHEGVEPLFETSDAPLFARRGLFR

SEQ ID NO: 65780 - protein, 572 aa, Oryza sativa Japonica Group
MGKASKKSVAVAVAPAAVPAKGKGGKKREAEDEIEKAVSAKKQKAAAAPPAKAVPAPKADAKKAKKQPPPKKAASSSSGSSSEEDSSESEEEVKVQVKKTTKPVKQESSSDESSDESSDDEDAKPADPVANNGLKKGKPASSDSESDSDDEMDEDEKPAAPVKKTSVTAQKKKDDSDSSESESDESDSDEDVPTKSKAPAVAAKNDDSTDGSESESDSEDEDAAPKGAAKKESSSDEEDDSSEESSDDEPKQPQQKKAQEESSEESSEEDSDEEDEKLAKTPKKKTPAATKSQNDEPKTPASNQSQGTESATLFMGNLSFNLNQDQVKEFFQEVGEVISVRLATHEDGSSRGFGHVQFASSEEAKKALELHGCDLDGRPVRLDLAHERGAYTPHSRNDTGSFQKQNRGSSQSIFVKGFDSSLEESKIRESLEGHFADCGEITRVSVPMDRETGASKGIAYIDFKDQASFSKALELSGSDLGGYNLYVDEAKPKGDSRDGGGRRGGRSGDRFGGRSGDRFGGRSGGRFGGRDGGRRGGRGGRDGGRRGGRGGFQSRQSAGTASTGKKTTFGDE

SEQ ID NO: 65781 - protein, 300 aa, Glycine max
MEEEKAAAYYDELSRKGEGAARFKQGLGFSSSAPNDDVPKPSSFLSKFVKASSTAPSNSEKQAQLQSIHHKLKKKPSSESRVSSSDSDRSRRRSRDRYRESRRRSRSRERHRHRERGRRRSRSVSPRKQRRSEKDANDRGKVSETKKRKNAEIDYYKLIPGYDRMSSAERVKAKMKLQLSETAAQDSEKGEGWERFEFNKDAPLDDEEVEVAEDDASLVKHIGQSFRFSAVKARREEQIQAAHEEAMFGATALLPPTSTDSEPERDNEKETDKKELVTSLLSETVLAKQNGSWRDRVRQT

SEQ ID NO: 65782 - protein, 1029 aa, Aspergillus nidulans FGSC A4
MTGSECQPRHSASSGTGRDIHTLSWDGDHDPANPFNWSISRKWAVTYLAALISFLTMMNGTIITVAHFEIAELFNIDETAFPHTYWPVTTWAVGGAFSALFLLPLAEDFGTRPVFLVTYFAFVCFLIPQAVAQNFATLVATRFFAGACVAILANTAAGVIGNVWDTEWSRSIPVSLYIFGYMAGSSMGPVIGAAVLQSLSWRWIGYMQLIWFGALFPIYYFFFYESRGDIILAQRDRKMGKNGKDILPGHPAHSKLNLQNLAVSSTRPVILFCTEPVLFVSTLWSAFTVGTIFLFTQSVEQVFIGTYDWTISKTGYVQAAVVIGEGIGFFFSFLSRELYFASASRNTEVPNSLIPEARLYMAVLGGLFGISGGMFTYAWTSYPFIPWIAPAISLAMVGAGSVLVVTGVSDYVVDAYSQYAGSAIGAVATGENIFSAFLPLATMSMYNNLGFQWASTLLAFVSLVLALVPTLMFVWGRELDNYALPTIATYAYSPANHYCTTQQAFQCHCSNFPSLHSCPTTTRHRPTNHLLKMPSLANTLKDPTLFIESSYIDGKWVTSSSSRTFNVYDPATEEFIGTCPESNIDDINSAIRAAATAFPKWRALSGRQRGRILRRWFDLIVENKEDIGKIITAENGKAKGDAEGEALFSAGFFEWFSEEAARIYGDVVPHSNPSSRVQVLKEPVGVCGLITPWNFPMAMGARKVAAALAAGCTVVLKSDGLTPYSSNVLALLAERAGVPGGVFNVVTALENTPALGLALCESDNVKKISFTGSTRVGKLLMKQSSHTLKKLSLELGGNAPFIVFDDADLETAVTSAVACKFKVTGQTCVCANRFYVQEGIYEAFSKRFVEEVKKCQVGHGLDPGVTHGPLTNGIAKTQEHIQDALNKGATVLLGGSRLPSLGKNFHELTILGDVDDSMKVASEETFGPLAALSKFKAEDEVVRRANGVEVGLASYLITSDLGKAHRVSEKLEFGMVAINTGVISDSAAPFGGVKHSGMGREGSKYGIDDYLNIKTIVTGGIHTAYSAHL

SEQ ID NO: 65783 - protein, 357 aa, Marinobacter sp. ELB17
MSRAILLLPGDGIGPEIMGEAEKVLRRVNESFKLDLSFQHGLVGGAALDDSDTPLPDETLELATKADAILLGAVGGPKWDGLPMAKRPEKGLLGLRSKLELFANFRPAILYPQLASASSLKPEVVSGLDIMIIRELTGGIYFGQPRGVRQLESGERQGYNTYAYTETEIRRIGRVAFETAQQRGKKLCSVDKANVLEVTVLWREIMNELKLEYPNVELSHMYVDNAAMQLVRAPKQFDVIVTGNMFGDILSDEAAMLTGSIGMLPSASMNSAKQGLYEPCHGSAPDIAGKGIANPLATILSVAMMLRYSLDEGAAAAAIEAAVGKVLDQGLRTADIMSEGCTRVSTREMGEAVLAQL

SEQ ID NO: 65784 - protein, 159 aa, Enterococcus faecalis V583
MKIKLVTVGKLKEKYLIQGINEYLKRLNSYAKMEIIEVPDEKAPEKLSDAEMLQVKEKEGQRILGKINDNEYVFVLAINGKQLSSEEFSKEIEQLGISGKSNLTFVIGGSLGLSDSVLQRSNQQISFGRLTYPHQLMRLVLVEQIYRGFRIMKGEPYHK

SEQ ID NO: 65785 - protein, 410 aa, Thermobifida fusca YX
MNDLRRNPASESQGRTLVDLFEYQAKALFAEYGVPVPQGKVASTPEEVRAIAEEFAAAGKPRVVVKAQVKTGGRGKAGGVKVADGPDDAVAKAKQILGMDIKGHTVHRVLVEEASDIAEEYYFSFLLDRANRSFLSICSAEGGMEIEEVAATNPDAVAKVPISPLKGAPADVAADIVAQGKLPEAAAQGAVDVITKLWKVFVEKDATLVEVNPLILTKDGRVVALDGKVTLDDNAEFRQDLESLASAAEGDPLEVKAKEKGLNYVKLDGEVGIIGNGAGLVMSTLDVVAYAGEQHGGVKPANFLDIGGGASAEVMANGLEIILSDPAVKSVFVNVFGGITACDAVANGIVQALELLESRGEDVTKPLVVRLDGNNAELGRSILNERNHPAVRQVDTMDGAAALAAELAAK

SEQ ID NO: 65786 - protein, 344 aa, Arabidopsis lyrata subsp. petraea
LNSKFVRDEDERPKVAYNEFSDEIPVISLAGIDDVDGKRGEICRQIVEACENWGIFQVVDHGVDTNLVADMTRLARDFFALPPEEKLRFDMSGGKKGGFIVSSHLQGEAVQDWREIVTYFSYPVRNRDYSRWPDKPEGWVKLTEEYSERLMSLACKLLEVLSEAMGLEKESLTNACVDMDQKIVVNYYPKCPQPDLTLGLKRHTDPGTITLLLQDQVGGLQATRDNGKTWITVQPVEGAFVVNLGDHGHFLSNGRFKNADHQAVVNSNSSRLSIATFQNPAPDATVYPLKVREGEKPILEEPITFAEMYKRKMGRDLELARLKKLAKEESDHKEVAKPVDQIFA

SEQ ID NO: 65787 - protein, 492 aa, Xanthomonas oryzae pv. oryzae KACC10331
MHCSMRMAPIGRRFGDRKSAAAQRYNRLQRWQGTVRCGHWEPHRCPGLCMSSTVPPLSFARILALNAGFFGVQYSFGLQQSNMSPIYNYLGADHANLPYLWLAGPMTGLVLQPFVGAWSDRSVTRWGRRMPYMVLGALVCSLCLLAMPFSTVLWMAVCLLWMLDAANNVAMEPYRALVSDVLAPPQRPLGYLMQSAFTGLAQTLAYLTPPLLVWMGMNQDAANAHHIPYVTIAAFAIGAGFSAASILLTARSVREPAIPPAQIARLRQTGAGLGATVREIGSAVREMPPTMRQLAPVMLFQWYAIFCYWQYIVLSLSTTLFGTTDATSHGFREAGLVNGQIGGFYNFVAFLAAFAMVPVVRRFGPKFTHAACLVAAGIGMWLLPGIESRWLMLLPMIGIGLAWASMMGNPYLMLADSIPPERTGVYMGLFNLFIVLPMLIQIVTLPLYYDRLLHGDPRNVIRLAGALMLAAAVAMVCVRLRKPKAVLVESRS

SEQ ID NO: 65788 - protein, 331 aa, Zea mays
  misc_feature (46)..(46): Xaa can be any naturally occurring amino acid
  misc_feature (152)..(152): Xaa can be any naturally occurring amino acid
MSGHGDTATSAKMAKLKELLQKSENHICADCGASDPKWASANIGAXNRSANIGVFICVKCSGVHRSLGTHISKVLSVTLDKWSDSEVDSMIEVGGNSQANAIYEAFIPEGYQKPHSDSTQEEREKFIRSKYELQEFLKPSLRIVSHQPSDSXKHAGNASHSDGSKSQVGMIEFIGILNVKVIGGTNLAIRDMSSSDPYVVLTLGQQKAQTSVINGNLNPVWNEELKLSVPQQYGPLKLQVFDHDMVSKDDLMGEAEIDLQTMINAAAAFGDPELLGDIQIGRWLKSEDNALVRDSAVVVSGGKVKQGMALKLQHTESGELELEMEWMPLNV

SEQ ID NO: 65789 - protein, 356 aa, Coccidioides immitis RS
MAAKGTMKAVVFKGPYKVELEDRPIPQIQSPKDIIVKVTYTALCGSELHVFRGHQPSGAGFIMGHEYTGIVTEVGSDVKTVKPGDKIVSPFTSSCGECFYCKRGFSSRCEQSQLLGSATLDGGQAEYVRMPNADGTVMKAPEGINDHALVLMADIFPTGYFAASNAFREFTKEQISELTVVLIGCGPVGLCALINAEDYKPKHLLAVDSIPSRLELARSLGAEPWNYQTDREGLDKRVKELTEGRGADVVIEVVGLSPALKMGFELLRPWGTISSVGVHNGEIPWTGNQAYGKNLKVQMGRCPVRSIFPQALDMLKKKQHLLGFMADKIMPLSQAVEGYGIFDKMQVQKVIFDASQ

SEQ ID NO: 65790 - protein, 223 aa, Helianthus tuberosus
NEGVGAFYKGLSAGLLRQATYTTARLGTFRILTNKALEANDGKPLPLYQKALCGLTAGAIGACVGSPADLALIRMQADATLPAAQRRNYTNAFHALYRITADEGVLALWKGAGPTVVRAMALNMGMLASYDQSVEFFKDSLGFGEGATILGASSVSGFFAAACSLPFDYVKTQIQKMQPDAAGKYPYTGSMDCAMKTLKSGGPFKFYTGFPVYCVRIAPHVMM

SEQ ID NO: 65791 - protein, 64 aa, Zea mays
IPVTYAGGVSTMDDLERIKKAGKSRVDVTVGSALDIFGGDLPYKDVVLWHKKQSMVGQVSRNMW

SEQ ID NO: 65792 - protein, 395 aa, Zea mays
KAGWYRSGIPGIPTATFTKVFNQQFRGPVSRNINRSFYATMRAARYYGIKDIRVEQVPEPSVQPGQVKVAPKYVGICGTDLHEYLGGPNFCPTKPHPLTSESIPVTLGHEFSGIISEVGPGVTGFEVGQPCAVQPTLFCGHCAACHTSAENVCHTGGFLGLSGGGGGLSESVCVNATHVFALPKDLPLEIGALVEPLSVAWHAMSAASEINEKSKVAILGGGPIGLAMILCLKAKGVSEIIVSEVASSRQEFARQFGATTVVNPIKEDLKEIALGLTGGLGADVVFDCAGVPASVKGAFEVVRTRGTVVNIAIWEKEIPFNPNWLTFKESAYKSVLGYQREDFQAVIDNLASGAIKPHQMITRKIKMENIVEDGIKALITDKDNQVKILVDVDEK

SEQ ID NO: 65793 - protein, 153 aa, Triticum aestivum
SVTIKHMIEDGCADDGIPLPNVPAKILSMVIEYCNKHAADAAADDTNKHVADPADADEDDDNNNNNASAGEKEDLKSFDASLVAVDQAMLFDIILAANFLSIKGLLDLACQKVADDIKDKSVEEVREIFKIENDFTKEEEEAVRKENAWAFNE

SEQ ID NO: 65794 - protein, 505 aa, Oceanicola granulosus HTCC2516
MCATSHPLAAKVAVQMLEAGGNALDAAIAGGVLLNICEPMMTGLAGDCFALVSEPGQPVVAVNGSGRAPQGLDAEALRAKGPTMPVYDVDAVTVPGAIDAFCKMSERWGRMSLGDVLAPAVYYAEAGVPVGPRSAHDWARATHLKGAAQRFFTNDGKPLGIGDVFTALGQAEVLRQIAVDGRAAFYEGEIAEDMVQSLQALGGSHTMADFAAVETEFSSPVTGRYGGHELLEHPPNGQGAAAILLLNILSHFDLPGLDPLGAERAHLEAEATKLAYDARNRFIADPDQTARLEHMLAPETAAGLAKLIRKDAVLPQSPPGAEEVHRDTVYITVVDGAGMAVSLIYSIFHAFGSGLASDKFGLLFQNRGAGFTLEPGHPNEAGPGKRPMHTIIPGMLAREGRVMMPFGVMGGQYQCTGHARLVSNLLDYGMDVQAAIDAPRLFAENGRLTLERGFAPEVAQALSELGHDVVMAETPLGGAQAIRMHEGRVLEGGSDPRKDGCALGY

SEQ ID NO: 65795 - protein, 483 aa, Burkholderia mallei ATCC 23344
MGVHVIKMPDIGEGIAEVELGLWHVKVGDRVKEDQATADVMTDKASVEIPSPVTGVVVALGGKEGDVLAVGSELVRLEVEGDGNHKAEPDGGARAAAAQPERVADTAHAHASAAAKSARGEHGAGHGRDDARAASSGTSSGASHTQHAEREARGHRESSEYREDRSVSRGASQTDVERGPASPPPARRPGERPLASPAVRKRAWDLGVELRYVHGTGEAGRILHEDLDAYLQGRGAAAQRARGGQAAYVERHDEEAVPVIGLRRKIAQRMQDAKRRIPHFSYVEEIDVTELEALRAELNRKYGDTRGRLTVLPLLARAMVIALREFPQINARYDDEAGVVTRHGAVHLGIATQSKAGLMVPVVRHAEARDPWSIAAEVARLADAARAGRAERDELSGSTITITSLGALGGIASTPVINSPEVGIVGVNRIVERPMFRGGAVVARKLMNLSSSFDHRVIDGMDAAEFIQAVRALLEQPALLFVE

SEQ ID NO: 65796 - protein, 127 aa, Arabidopsis thaliana
  misc_feature (21)..(21): Xaa can be any naturally occurring amino acid
  misc_feature (55)..(55): Xaa can be any naturally occurring amino acid
  misc_feature (68)..(68): Xaa can be any naturally occurring amino acid
  misc_feature (90)..(90): Xaa can be any naturally occurring amino acid
  misc_feature (97)..(97): Xaa can be any naturally occurring amino acid
  misc_feature (117)..(117): Xaa can be any naturally occurring amino acid
  misc_feature (123)..(123): Xaa can be any naturally occurring amino acid
MASSMLSSAAVVTSRPQATMXVAPFTGLKSSASFPVTRKDNNDINSIKSNGGRVXCMKVWPTIGKKKXFETLSYLPDLSDVELGKEVDYXLRKKWIXCVEFELEHGFVYREHGKTPXYYDGGXWTMW

SEQ ID NO: 65797 - protein, 438 aa, Edwardsiella tarda
MRLPDAQKILDRLDCPTLPSVTDVRLEGRLLTVGATLLRAHLPGVGLGEQCTLPDGSPAEVVAIEGDQALLSPYHAPLGLANGMLVTPSGAQARIGVGEALLGRVIDALGQPMDGSAPPQAAQWRSLESPAPDPMQRAPIDTLLPMGVRAIDAALSVGVGQRLGIFSPAGCGKSTLLGMLAAHSQVDVVVLALIGERGREVREFIEQIISPELRARSVVILATSDRPALERIKAADTATVIAEYFRDRGHHVLLLVDSLTRYARAIREIALAAGEPMVSGGYPPSLYARLPRLLERAGPAACGSITAFYTVLVEQKSDPLAEEVRSLLDGHIVLSRRLAEASHYPAIDILASISRVMSQVVTPQHRQAANRLRHLLATWQEIALLVRVGEYRAGQDADADDAMARREAIASLLCQQTDERCPLSATLSALYSAVGQPC

SEQ ID NO: 65798 - protein, 217 aa, Oceanicola granulosus HTCC2516
MSLRLNDTIPDLTVETDQGTFSLHEFVGDSWTILFSHPKDFTPVCTTEFGAVARLNDAWEARGVKVIGVSVDKVEEHKRWKSDIETVAGGPAGFPIIADEGLEVSKAFDMLPADAYLPDGRTPADSATVRAVYIIGPDKKLKLSMTYPMTVGRNFAEVLRAVDALQTSSRENVATPADWTPGEDVIVPVAVSDEDAIAKYGEIETVLPYLRKAKLPA

SEQ ID NO: 65799 - protein, 466 aa, Burkholderia mallei ATCC 23344
MSDTKTTTLLVIGGGPGGYVAAIRAGQLGVRTILVERDRLGGTCLNIGCIPSKALIHAAGEFDKVRGFAGDSPLGIRTQAPAIDIARTVAWKDGIVKKLTGGVGALLKKNGVEVVHGDARVVDGKTVDVDTGGGARVRIQCEHLLLAAGSEPVELPAMPFGGNVISSTGALSPGRLPKRLVVVGAGYIGLELGIAYRKLGVEVSVVEARERILPIYDAELTKPVAASLKRLGVRVLLGHKVLGLNARGDAVCVQDDAHAQTELAADQVLVTVGRRPRTQGWGLETLQLDRAGAALKVDDMCRTSMRNVWAIGDLTGEPMLAHRAMAQGEMVAEIVAGKKRHFMPAAIAAICFTDPEVVSAGLAPDEAERTFGACVSASFPFAANGRALTLESADGFVRVVARRDDHLIVGWQAVGAGVSELAAAFSQSLEMGARLEDVGGTIHAHPTLGEAVMEAALRALGHALHI

SEQ ID NO: 65800 - protein, 165 aa, Anabaena variabilis ATCC 29413
MTMSIRIGNGYDIHRLVSDRALILGGVHIPHELGLLGHSDADVLTHAIMDAMLGALSLGDIGHYFPPTDPQWAGADSLVLLNQVNELIRAQGWRIGNIDSVVVAERPKLKPHIKTMRDKLANVLQLEPNQIGVKATTNEKLGPVGREEGICAYAVVLLVSSDPVN

SEQ ID NO: 65801 - protein, 133 aa, Saccharomyces cerevisiae
MTNMAKAPKANTPKVTSTSSAVLTDFQETFKTSKRAYFAQIEKYPKLKLIDTFCFFLVLLGVIQCTFIILIRDNFPFNAFLAGFIICVGQFVLLMSLRLQLCNSFPGISKNRAFAEFIVASLILHFVCLHFIN

SEQ ID NO: 65802 - protein, 309 aa, Thermobifida fusca YX
MRVFVDCDPGIDDALALAYLAADHRVEIAGVGAVYGNTGVESTAENAVRLLQLFGRPETPVAVGAARPLMQQPRLARHVHGDNGLGGIELPEAAKRPVSESAAELLVRLARSAPGELNVLALGPLTNLAVALALEPRLPELVNRVVVMGGAVRSPGNVTPWAEANVNNDPEAAEAVLGAGFDLTLVALDVTMRALATESWLEELAALPGERAQYAHRFLAYYVGWYTSFLGQRACPMHDPLAAAVLVDPSLVKESETVPVLVELAGAHTRGMTIADLRPRREETSRPAVVLPTEVDVPKFLSRMLRALA

SEQ ID NO: 65803 - protein, 303 aa, Glycine max
GGVGICAESELEKQVDAFTESVFKGNPASVCFLEEKRDKKWLQGVAAEFNLSVTCYLTRITESHGTTSNPRFRLRWFTPVSEINLCGHATLAAAHTIFSSGLVDTDVVEFVAISGILTAKKIPAINITSASDLQKGEAQDGFYVELNFPADPVVEFNFDETSQISGALNGASIIDIKRTQDGGDLVVVVTSGRVVEELQPQLDAIVKCPGRGLIVTGIAPPGSEFDFCSRFFCPKLGVNEDPVCGGAHCALAPYWSKKLGKCDFKAYQASARGGVLNVHLDEQNQRVLLRGKAVKVMEGCVLV

SEQ ID NO: 65804 - protein, 357 aa, Triticum aestivum
MDSFFQRAFGDPMCSEDSNVVQQGIEKCPFLRNINEPTSFSLTSVNFPAPATGAKGPIFEDGPNFDTAFRVFHGRDGVVPLSEGAFAHIEKPLPKPTPEFNPLAAKAATISLSGFGGFFSFGDFSNKRNKQNSNKKNPNNLPQNKGQSNNNHEAMSNDWLENGQCPLAKSYRAIGGVVPLVAKLLTPPAGMKLTCPPAIVAARAAISRTAFAKGLRPQPLPTKVVVIALLGMAANVPLGIWREHTTKFSVQWFAAVHAAVPFIGMLRKSILMPKSAMALTIAASILGQTIGSRAERIRLKRAKLAAEGHGHEHATRIEAPVTLKTGSSGAVQLWDPLGLRVKGAVSPALVPTVGAMY

SEQ ID NO: 65805 - protein, 495 aa, Mycobacterium tuberculosis H37Rv
MSDSATEYDKLFIGGKWTKPSTSDVIEVRCPATGEYVGKVPMAAAADVDAAVAAARAAFDNGPWPSTPPHERAAVIAAAVKMLAERKDLFTKLLAAETGQPPTIIETMHWMGSMGAMNYFAGAADKVTWTETRTGSYGQSIVSREPVGVVGAIVAWNVPLFLAVNKIAPALLAGCTIVLKPAAETPLTANALAEVFAEVGLPEGVLSVVPGGIETGQALTSNPDIDMFTFTGSSAVGREVGRRAAEMLKPCTLELGGKSAAIILEDVDLAAAIPMMVFSGVMNAGQGCVNQTRILAPRSRYDEIVAAVTNFVTALPVGPPSDPAAQIGPLISEKQRTRVEGYIAKGIEEGARLVCGGGRPEGLDNGFFIQPTVFADVDNKMTIAQEEIFGPVLAIIPYDTEEDAIAIANDSVYGLAGSVWTTDVPKGIKISQQIRTGTYGINWYAFDPGSPFGGYKNSGIGRENGPEGVEHFTQQKSVLLPMGYTVAGSHHHHHH

SEQ ID NO: 65806 - protein, 530 aa, Arabidopsis thaliana
  misc_feature (197)..(197): Xaa can be any naturally occurring amino acid
  misc_feature (217)..(217): Xaa can be any naturally occurring amino acid
  misc_feature (268)..(268): Xaa can be any naturally occurring amino acid
  misc_feature (284)..(284): Xaa can be any naturally occurring amino acid
  misc_feature (362)..(362): Xaa can be any naturally occurring amino acid
  misc_feature (366)..(366): Xaa can be any naturally occurring amino acid
  misc_feature (393)..(393): Xaa can be any naturally occurring amino acid
  misc_feature (460)..(460): Xaa can be any naturally occurring amino acid
  misc_feature (487)..(487): Xaa can be any naturally occurring amino acid
MAKPEEVSVPIFTSLEPVYGEGSLLQEATQRFDVLKANFNDVFGASPQLFARSPGRVNLIGEHIDYEGYSVLPMAIRQDTIIAIRKCEDQKQLRIANVNDKYTMCTYPADPDQEIDLKNHKWGHYFICAYKGFHEYAKSKGVNLGSPVGLDVLVDGIVPTGSGLSSSAAFVCSATIAIMAVFGHNFEKVLLSNRALXRTFINLLLIIEISKFSLPFXKELAQLTCECERHIGTHSGGMAQAISIMAKTGFAGLIDFNPVRATDVKLPXDGGSFVLEHSLGESQXAVTAAKNYNKRVVYCPLASIILGVRLVMEPKEAISIVETLSFVEGLCMLFAGARGSSDPLLAVEEYLRAEQKKNKIFXKIQXEKSPLVVNIDPTCLAVLNATTPLLPRXRAEHVHSHARWEHGLKNTVTSALSNAAYLKILVATLKESHNCSTAIYKCSRPAPKGLVHVGKENRAXGDNDCPASLDAARVCVVALLTEFDETXLFLPVKEKHYNKREDREQKSVKEEDPASLTFWPPRLRAGAAVL

SEQ ID NO: 65807 - protein, 388 aa, Escherichia coli
MKLYNLKDHNEQVSFAQAVTQGLGKNQGLFFPHDLPEFSLTEIDEMLKLDFVTRSAKILSAFIGDEIPQEILEELVRAAFAFPAPVANVESDVGCLELFHGPTLAFKDFGGRFMAQMLTHIADDKPVTILTATSGDTGAAVAHAFYGLPNVKVVILYPRGKISPLQEKLFCTLGGNIETVAIDGDFDACQALVKQAFDDEELKVALGLNSANSINISRLLAQICYYFEAVAQLPQEARNQLVVSVPSGNFGDLTAGLLAKSFGLPVKRFIAATNVNDTVPRFLHDGQWSPKATQATLSNAMDVSQPNNWPRVEELFRRKIWQLKELGYAAVDDETTQQTMRELKELGYTSEPHAAVAYRALRDQLNPGEYGLFLGTAHPAKFKESVEA

SEQ ID NO: 65808 - protein, 528 aa, Thermobifida fusca YX
MSVAGAPESTFDTVLVVDFGAQYAQLIARRVRECHVYSEIVPPTMPVEEMLAKKPKAIILSGGPSSVYADGAPQAPPGLFDTGVPILGICYGFQVMAQTLGGTVERTGRSEYGRTTINVATDSLLFHSLPQQQTVWMSHGDAVSQVPDGFTVTGQTADAPVAAMEHRDRALYGVQFHPEVVHTEHGRAVLQHFLYEAAGCRPTWTMVNIVEDQVARIRAQIGSKRAICGLSGGVDSAVAAALVQRAIGDRLTCVFVDHGLLRQGEAEQVEKDFVAATGASLKVVDAQERFLTALAGVTDPETKRKIIGREFIRVFEQAAREIVAEAGEGDEAVEFLVQGTLYPDVVESGGGNGTANIKSHHNVGGLPDDLQFTLVEPLRELFKDEVRRVGEELGLPAEMVWRHPFPGPGLAIRIVGEVTAERLEILRAADAIVREELTRAGLDRAIWQCPVVLLADVRSVGVQGDGRTYGHPIVLRPVTSEDAMTADWARVPYDVLATISNRITNEVPDINRVTLDITSKPPGTIEWE

SEQ ID NO: 65809 - protein, 348 aa, Ipomoea alba
ETLAGSGIERIPKEYIRPEEERRSIGDIFEEEKMGGGPQVPTVDLKGINSDDLEVREKCREELRKAAVDWGVMHLVNHGIPEELTGRVKAAGEGFFAQPIEEKEKYANDQAAGNVQGYGSKLANNASGQLEWEDYFFHCIFPQDKTDLSIWPKTPSDYIAATREYAKQLRALATKVLAVLSLGLGLDEGRLEKEVGGMEELLLQMKINYYPKCPQPELALGVEAHTDVSALTFILHNMVPGLQLFYGGKWVTAKCVPNSIIMHVGDTVEILSNGKYKSILHRGVVNKEKVRVSWAVFCEPPKDKILLQPLPETVSEAEPPRFPPRTFAQHIKHKLFRQSDQGADTPKT

SEQ ID NO: 65810 - protein, 238 aa, Streptococcus pyogenes M49 591
  misc_feature (116)..(116): Xaa can be any naturally occurring amino acid
MTQVFQGRSFLAEKDFTRAELEYLIDFSAHLKDLKKRGVPHHYLEGKNIALLFEKTSTRTRAAFTTAAIDLGAHPEYLGANDIQLGKKESTEDTAKVLGRMFDGIEFRGFSQRMVXELAEFSGVPVWNGLTDEWHPTQMLADYLTVKENFGKLEGLTLVYCGDGRNNVANSLLVTGAILGVNVHIFSPKELFPEEEIVTLAEGYAATKLSPPQRIRSTFSTPRLAARSSAKSPFSSTI

SEQ ID NO: 65811 - protein, 407 aa, Chlamydomonas reinhardtii
MAPPPEAGATAAAEPSKPLNELFSSLPTTIFEVMSKLAMEHASVNLGQGFPDAEGPEAMKQIASASMYDFHNQYPSLLGVPELRQAVAAHSEREQGILVDWATETLITVGATEGLASAFLGLINPGDEVIMFDPMYDSYTSMAKRSGAVIVPVRLRLPDFSVPLEELAAAVTPRTKMIMINTPHNPSGKVFTRPELEAIAELCVRHDLIALSDEVYEHLVFGGAAHVSLRSLPGMKERCVRLGSAGKTFSFTAWKVGWMTGPARLLNPIVKAHQFLVFTVPSSLQRAVAHGLDKEADFYHSLGPSLEAKRRYLEAELTALGFDCLPAHGAYFLVADFQRPGEDDADFAKRLTAEGGVTTIPISGFYVGPRPPTHLVRFCYCKEDIKLQAAVERLKAYVGPGGKGAPQ

SEQ ID NO: 65812 - protein, 100 aa, Triticum aestivum
MAAAEGGGGGGGGKVSFKVILTSDPKLPFKVFSVPEAAPFTAVLKFAAEEFKVPPQTSAIITNDGVGINPQQSAGNVFLKHGSELRLIPRDRVGATVPSF

SEQ ID NO: 65813 - protein, 887 aa, Alkalilimnicola ehrlichei MLHE-1
MTAATVPELLSARPPDGVAAVAITRDGAEECSRGELLERAGRLAAGLVSAGLDKGDRIALVAHNSVDWVAAALGVMQAGGVVVPLDTQMPLKEFHFVLRDAQPRWVFTTGALVDRVIGAEVDPEPTLYRLDGDERAPEHWRSLWADEPIVPDVAPEDLATMFYTSGTTGAPKGVPLTHKNLASNVSSLVQENVAGSDDRVLVPLPFHHVYPFTVGILVPLRLGAPLILPFSLVGPQIVRALQLGQPTIMLGVPRLYDAVWTALEDRVAGRGAVAEKLFHGMLALSMQARKRWGLRLGRRLFRSLHQRLAPSLRMVVSGGAALDPTLTEKLRALGWEVATGYGLSETAPILTYNPPERLRVESAGMALPGVELAIDPPGEIGEVLARGDNVFHGYWRRPDKTREVLQEDGWFRTGDLGELDGDGYLYLQGRRSAMIVLPGGENIDPERVEGVLSQAEGVREVGVLESGGRLVGVAVPEPALLRAHQGEALRERLISAVQAAGRALPSHHRPGRLQVAVDPLPRTRLGKLRRHELQHLYDRLAEQGGVSAAKAEPIPRESMAPEDQQLLTDPSAEATWEYLVEKYPDFRLTPDTSLSLDLGLDSLAWVNLSLTLRDRVGVEFDDDAIGRIETVRDLLREAAGAGQSEGTAEGAGDLVAELRRPESNVPEDLQRWLEPRSALSAVSARLLWALASLFTRVWVRVEVRGRLPDDGPVLIAPRHLSVLDPVVLSHAVGLRRMLHLRWAGWTGLLFQGPVSRWFSRAAGVLPVDPASAPRRSLALAAMTLQRQDSLVWFPEGARSPDGRLQPFQPGVGLLLRAWPVPVVPVWVEGTRELMPKGRRLPRFGRATVVVGEPISAERLKALGDDEHAIARLIHDEVAALEPGSPRS

SEQ ID NO: 65814 - protein, 374 aa, Triticum aestivum
RDENHTEDTPTQHALSPYLDYMAYLYQRMDPLPEQERFEINYRDFLQSPLQPLMDNLEAQTYETFEKDTVKYTQYQRAIAKALVDKVSDDEVSTTRTVLMVVGAGRGPLVRASLQAAEETGRMLKVYAVEKNPNAVITLHSLIKLEGWESMVTIISSDMRCWDAPEKADILVSELLGSFGDNELSPECLDGAQRFLKPDGISIPSSYTSFIQPVTASKLHNDIKAHKDIAHFETAYVVKLHRVARLAPPQEVFSFAHPNFSPKATNQRYTKLQFELPQDTGSCLVHGFAGYFDAVLYKDVHLGIEPNTCTPNMFSWFPIFFPLRKPIYVPSESPIEVHFWRCCGATKVWYEWALVAPSPSPIHNSNGRSYWVGL

SEQ ID NO: 65815 - protein, 349 aa, Oryza sativa Japonica Group
MPIMHDGYRYELVREIGSGNFGVARLMRNRASGDLVAVKYIDRGEKIDENVQREIINHRSLRHPNIIRFKEVILTPTHLAIVMEYASGGELFERICSAGRFSEDEARFFFQQLISGVSYCHSMQVCHRDLKLENTLLDGSTAPRLKICDFGYSKSSVLHSQPKSTVGTPAYIAPEVLLKKEYDGKIADVWSCGVTLYVMLVGAYPFEDPEDPKNFRKTIQKILGVQYSIPDYVHISPECRDLITRIFVGNPASRITMPEIKNHPWFMKNIPADLMDDGMVSNQYEEPDQPMQNMNEIMQILAEATIPAAGTSGINQFLTDSLDLDDDMEDMDSDLDLDIESSGEIVYAM

SEQ ID NO: 65816 - protein, 219 aa, Oryza sativa Japonica Group
MAASRLALLLLVLAVAAARHALPAAGSDAHPGDSMANGTLYNLSELKMECHMGTHVDAPGHMNQGHFAAGLDVDKLDLDLLNGPTLLVDTPRNTNITAKAMESLNIPKGVRRVLFRTLNTDRKLMWKKGGDLSYVGFTEDGAQWLVDNTDIKLVGIDYLSVAAYDHLITAHVVFFKFPNIILVEGLKLDDVKAGIYMLHCLPLRLVGSEGSPIRCILIK

SEQ ID NO: 65817 - protein, 416 aa, Escherichia coli
MESKVVVPAQGKKITLQNGKLNVPENPIIPYIEGDGIGVDVTPAMLKVVDAAVEKAYKGERKISWMEIYTGEKSTQVYGQDVWLPAETLDLIREYRVAIKGPLTTPVGGGIRSLNVALRQELDLYICLRPVRYYQGTPSPVKHPELTDMVIFRENSEDIFAGIEWKADSADAEKVIKFLREEMGVKKIRFPEHCGIGIKPCSEEGTKRLVRAAIEYAIANDRDSVTLVHKGNIMKFTEGAFKDWGYQLAREEFGGELIDGGPWLKVKNPNTGKEIVIKDVIADAFLQQILLRPAEYDVIACMNLNGDYISDALAAQVGGIGIAPGANIGDECALFEATHGTAPKYAGQDKVNPGSIILSAEMMLRHMGWTEAADLIVKGMEGAINAKTVTYDFERLMDGAKLLKCSEFGDAIIENM

SEQ ID NO: 65818 - protein, 288 aa, Triticum aestivum
MASWLVPAAHGTHGWSTYYIYPTNSPGTTHTPSFPSPRVSHLASHRDIQLILPRHHSPAPLSPLDRRPAETIHPSMGSKPADAAGSRQQQQVKEESSMADVYNHELTPLQKHAAFFDRNRDGVIYPSETYQGLRAIGCGVVVSAAGAVFINGLLAPKTVPANVKPPAFKFPIYVKTIQQGKHGSDTDVYDTNGRFVPEKFEEIFKKHAHTRPDALTSKELGEMLKANRDPKDFKGRVGAFGEWRLLYALCKDKEGFLHKETMKAVYDGRVFEKLEREKKEAKEFAKKK

SEQ ID NO: 65819 - protein, 337 aa, Thermobifida fusca YX
MNVLLTGGAGYIGTHVAVELLENGHDVVVVDNLRNSHAEAVRRVERITGRSVHFYVGDCADRELMDRVFTEHRIDAAVHCAGLKAVGESVELPLLYYRNNLDALLTVCEAMDAHGVRSLVFSSSATVYGDPDRVPIPEDAPLRATNPYGATKLFAERILSDLVASAPDWRIITLRYFNPVGAHPSGLIGEDPEGVPNNLFPYIAQVAAGRRERVLVYGDDYATPDGTGVRDYLHVMDLARGHVAALERLGDAYGMRTYNLGSGHGVSVLEAIAAFERACGKTIPYEVVARRPGDIAVCYADPSAANRDLGWKTAYTLDEACAHLWRWQTMNPNGFAG

SEQ ID NO: 65820 - protein, 457 aa, Anabaena variabilis ATCC 29413
MEALDLKWIRGQFPALTQKINGQPAIFFDGPGGTQVPGSVLDAISDYLVRSNANAHGAFATSARTDALIIAARTAIADFLGCHSDEVVFGANMTTLTFSLSRAIGRTLQPGDEIIVTRLDHSANVSSWEALAEQGAVIRYVDVKVDDCTLDMNDLEQQINSRTKLVAVTYASNAVGTINDIAAIVKLAHAVGALVFVDAVHYAPHGTINVHALGCDFLACSAYKFFGPHVGILYGKREHLTNLQPYKVKPAPNEVPSRWETGTLNHEGLAGLVAAINYLAKLGCHVSPKINQELVSALIEADKEGLEHFQCPRFLTSPEQPSSTLASAYHSRRAALVAAMSAIQQYERELSHKLISGLLEIPGLTIYGITDPERFAWRTPTVAIRLQGKSPESIARTLGDRGIFSWHGNFYALNLTEKLGIENDGGLLRLGLVHYNSVEEIIQLLQALKEIGSAISL

SEQ ID NO: 65821 - protein, 269 aa, Brassica napus
  misc_feature (255)..(255): Xaa can be any naturally occurring amino acid
MEGRRKALLFTLCFFFFSLPSLSSLPAYQTLVPTSHSLPSASPISFQPESEPVSESLIGSGSDSESSITLNLDHIDALSTNRTPEELFSSRLQRDSRRVKSIATLAARIPRRNTTHAPRPGGFSSSVVSGLSQGSGEYFTRLGVGTPARYVYMVLDTGSDIVWLQCAPCRRCYSQSDPIFDPRKSRTYSTIPCSSPLCRRLDSAGCNTRRRTCLYQVSYGDGSFTVGDFATETLTFRRNRVKGVAVGCGHDNEGXLFVGAAGLLGLGKG

SEQ ID NO: 65822 - protein, 567 aa, Arabidopsis thaliana
MAAYGQISSGMTVDPQVLSSSRNIGVSLSPLRRTLIGAGVRSTSISLRQCSLSVRSIKISEDSRKPKAYAENGAFDVGVLDSSSYRLADSRTSSNDSRRKTKIVCTIGPSSSSREMIWKLAEAGMNVARLNMSHGDHASHQITIDLVKEYNSLFVDKAIAIMLDTKGPEVRSGDVPQPIFLEEGQEFNFTIKRGVSLKDTVSVNYDDFVNDVEVGDILLVDGGMMSLAVKSKTSDLVKCVVIDGGELQSRRHLNVRGKSATLPSITDKDWEDIKFGVDNQVDFYAVSFVKDAKVVHELKNYLKNISVIVKIESADSIKNLPSIISACDGAMVARGDLGAELPIEEVPLLQEEIIRRCRSIHKPVIVATNMLESMINHPTPTRAEVSDIAIAVREGADAIMLSGETAHGKFPLKAVNVMHTVALRTEASLPVRTSASRTTAYKGHMGQMFAFHASIMANTLSSPLIVFTRTGSMAVLLSHYRPSATIFAFTNQRRIMQRLALYQGVMPIYMEFSDDAEDTYARSLKLLQDENMLKEGQHVTLVQSGSQPIWREESTHLIQVRKIKIGG

SEQ ID NO: 65823 - protein, 605 aa, Thermobifida fusca YX
MPHRTRLPARGGKRRPLPPPGARKGGGDPAHQMTAARLGPQERDAALRAMADTELDVLVVGGGIVGAGVALDAVARGLSVGLVEARDFASGTSSRSSKLIHGGLRYLEHLDFPLVREALTERGLLLSRIAPHLVRPVPFLFPLRSHWERPYIGAGVALYDALALSGTRTRGLPGHRHLSRRAALRIFPALRRDALVGAVQYWDAQVDDSRYVVMVLRTAATYGAHIASRTQAVGFLREGEHVTGARVVDLETGREFAVRAKQVVNAAGVWTDEIQEMVGGRGQIHVRASKGVHLVVPRDRIHASSGLILRTEKSVLFVIPWGRHWILGTTDTAWDLDKAHPAASRTDIDYVLNRVNAVLKTPLTRDDVEGVYAGLRPLLAGESEETSRLSREHTVAHPVPGLVLIAGGKYTTYRVMAKDAVDAVAHGMGGGVPPSVTDRLPLVGADGYFALWNQRRILARRTGLHVSRIQHLLRRYGSLIHEVLGLIAEQPDLKQPLTGADDYLRAEVVYAVRYEGARHLDDVLSRRTHIAIETWDRGLAAAEEAAQLMAGPLGWDDAQIAREVEYYRARIEAERAAQEQDSDQEADAVQHGAPDIVPQATTVRV

SEQ ID NO: 65824 - protein, 202 aa, Brassica napus
MLLIVWSTTREDLSTQLSPIEAVNFQSEKMQQRKTTAAAAGRPSGTDGSDFSYRMVVDSRYTKVTKGRSRLRLLILVQATIYLIGLSCAFMTSTKNEERNTLGIASASIGLLFAFIGDFGCRRSRVNLLRLYTAASTVVMVLSVFSAVRSRLTMEERNSSGTAANLELLGFISAQLGAVVQILAIIVTGSLVNNMSPPTKTE

SEQ ID NO: 65825 - protein, 1136 aa, uncultured archaeon GZfos26D6
MKIGVYICHCGTNIAATVDVEEVAKFAETLPDVAVSRDYVYMCSDPGQELIKKDILDAKLDRVVVASCSPRMHEVTFRSACEEAGLNAYCLEMANIREQCSWVHSDREKGTEKAKELVASAVAKASLLESLEPMRVGVTPSALIIGGGIAGIQCALDIADAGFQVYLVEKEPSVGGHMAQLDKTFPTLDCSACVLTPKMVDVARHDKIKLITYATVDSVEGYIGNFKVRVKKTPRYVDEDKCTGCGECANVCPIKDVVPNDFDLGLSKRGAVYIPFPQAIPMVYTIDKMGGIPPCRLGCPANVNVQGYVALIAQGRYREAIDLIREVNPLPAICGYVCPHPCEEECNRTEIDDPIAIAALKRFAADNIDYDDETEEADETEDATKEERAEKIAIIGSGPAGLTAAFYLAKSGYQVRILEKLPVPGGMLAVGIPEYRLPRDILKKEVEYIKREGGRIEIETGVEIDKDGFEKLNRDYNAIFVSIGADKSRALGIEGENLKGVVHGVDFLRELNLGNTVELGKKVAVVGGGDVAIDAARCALRLGSDVTIVYRRSREEMPARDEEIADAEAEGVKITYLTNPSRIIGDDIVQGMECVRMELEEPDESGRRRPVPVEGSEFILDVDTVILAVGQQSALGFLEGSGIELDGNWIKADGHGRTNVECVFAAGDAVTGPATVIDAIAGGKRAAEATDRYLRGEPLPELDSEEKKRIELEDIKARLPELEKNERRKVAKLPAERRKDSFEVVELGFAEADAIEEAKRCMKCGICADCRLCETVCEADAIFHEMEEELVELEVGAIIAATGYDLFDPSLEPNYGYEYDEVITSMEFERLCNASGPTTGHIEINGKTPKEVVFISCVGSREGGKGQRERGERAGNEYCSRVCCMYIAKQAHLVREHISDANATVFYTDVRAFGKGFEEFYWRVKEEGVNYIRRELTDELKVDKDGNGQLRVKTVSDGVPIEKEADLVVLATGIVPKEDVRETARKLKITQSGDKFFLEAHPKLRPVDTLTNGIFIAGCCQSPKDIPDTVAQASATASRACSILCKEYVEVEPITAEVDETLCCGCAICESVCPYGAIEVVDTEEGRRARVTSVKCYGCGTCGSSCIKKAVKMHQFTDEQLIAQERAALAAEEVVF

SEQ ID NO: 65826 - protein, 496 aa, Mycobacterium avium 104
MTDTATETLVQFDLLIGGESSSAASGLTYDSVDPFTGRPWARVPNAAAADVDRAVGAARAALNGPWGALTATARGKLLHRLGEIIAREADQLAELEVRDGGKLVREMVGQMRSLPDYYFYYGGLADKLQGDVIPVDKPNYFVYTRHEPVGVVGAITPWNSPLLLLTWKLAAGLAAGCTFVVKPSDHTPTSTLAFAKLFAEAGFPPGVINVVTGWGPETGAALASHPGVDKVAFTGSTATGIHVGKAAIENMTRFSLELGGKSAQVVFADADLDAAANGVIAGVFAATGQTCLAGSRLLVDRSVADALVEKIVARAATIKLGDPKDPTTEMGPVSNLPQYEKVLSHFASAREQGATVAYGGEPASDLGGFFVKPTVLTGVDPSMRAVAEEIFGPVLAVMTFEDEDEAVAAANGTEFGLAAAVWTKDVHRAHRVAAKLRAGTVWVNAYRVVAPHVPFGGIGYSGIGRENGIDAVKDFTETKAVWVELSGETRDPFTLG

SEQ ID NO: 65827 - protein, 855 aa, uncultured archaeon GZfos26D6
MSVLVIGGGYAGLKAALDCAKDEEVFFVLRTPNIGGFFSKLHLVEEKHPFDILSPLIEQIKENDKIHVFTNSAVERMKEEDHGFRVSVRRKPITIDETKCDSCGECWKMCPVTSPDRCNGWLSNRNAIYTPEDALSYAIERETPFCQATCPVSLDIRGYAGFIADGKFKEAYDLIREKVPFPGVLGRVCTHPCEDLCKRGLVDESISIAKLKRFVADHVYENYGEEIKLEPIPATKGKKVAIIGAGPAGLSAAYDLKTFGYDITVFEKLPVVGGMMAVGIPKYRLPRATLEREIGFVRAVGVEIKTNVEVDTDMFAELRRTYDTTFISVGAHVSGKLGIPGEDLEGVIPDIDFLRALNLNLNLGNEVKIGKSVVVVGGGNVAIDAARSVLRLGSKVFIVYRRSRAEMPASREELESLEEEGIKIIFLANPTKILGSSRVEGVECVRMELGPPDDTGRRRPVPVEGTEFVIDVDTVIPAIGQASDLQFLEGSGVDTPGGRRISTFEDGRTTVAGIFAGGDAATGAKTVIEAIAAGKRAALSINEYLSGEKRADFKVESEIDLGEREAREKSNLSRNYFPIMDIALQKRVKMPKLPGEERITNFEEEELGYDAKMAVEEANRCLSCRKCIGCGICAEVCPQDAIVYDQTEERLELKVEKLIFAADMEENVPPGEYMYSNVVTQIEFERMLSESGPYGGIIMRPFDGDIPREIAFIHVLDADEDECSPLAFEFLVQEAKSAKERDVDSCIFARELYEDTGDIKSVKIDDITVTELEETKNLRLQYVVEGEKEKEKEEKEVDMVVLSVGFSLPEYVKKRGELVGIKPEELKSKMWGKPGKGLVEVEIMKTEKEGVFIAA

SEQ ID NO: 65828 - protein, 500 aa, Streptomyces refuineus subsp. thermotolerans
MSALGACVNPSPGVAARAFLSRPHLLFIGGRFVASATGRTFATVDPSTGERLAQVAHAGPEDVEAAVAAARTALEGAWGALPAAERGRLITRLADLVERNAEELAELESLDVGKPIAKTRALDVPAAAAQFRYFGGWPTKIEGETIPVAVPDTLCYTRKEPVGVCAQIVPWNFPLLMAAWKLGAALAAGCTVVLKPAEQTPLTTLRLAELIAEAGFPEGTVNVLTGDGPTGAALVDHPGIDKIAFTGSTAVGREIGAKAGARLKRVTLELGGKSPNIVLPDADIEAAISGAAEGIFFNTGQACNAASRLYVHRDVFDDVVEGVLARARRARVGPALDPATEYGPLVSAEQYRRVRGYLLDGVSEGAVLRAGEVPAADPGGGYFVRPALFTNVTPTMRICREEIFGPVLVAAPFETVDEVVRLANDTEYGLAAGVWTRSLSAAHGLAARLKAGSVYLNSWAPGDPASPFGGLKASGVGREMGRAGLDAYLELKTVWTSIAP

SEQ ID NO: 65829 - protein, 354 aa, Streptomyces refuineus subsp. thermotolerans
MIDVRAAQIVGYGEPLQVREVPDPAPEPGGVVVAVLATGICRSDWHGWRGDWEWLGGRIALPRTPGHEIAGEVVAAGPGVRGVRVGDRVTVPFHLACGTCAHCRAGQANLCDEMEVLGFWRDGGYAEYVRIPHADFNCVRIPDGVTPLTASAIGCRFMTAFHAVDGQGRVRPGEWVAVHGVGGVGLSCVQIASAAGASVVAVDIDPAKLALAEQQGAAHTVDAGAEQDVPAAVREVTGGGAHVSIDALGIRTTVVNSVRSLRKRGRHVQVGLTGAEDAGEIALPIDLITLGELTVVGSHGNPHAAYPRLLSLIESGRLAPQTLVQRTVSLDQAGDVLAAMDAFATSGLTVIDRF

SEQ ID NO: 65830 - protein, 427 aa, Alkalilimnicola ehrlichei MLHE-1
MSFDSLGLSAVLLRAVAEQGYSKPTPVQAQAIPAILQGGDVMAAAQTGTGKTAGFTLPMLERLSQNRPEGGRRRVRALILTPTRELAAQVRDSVKTYGGKLPLKTAVIFGGVGMNPQIQTLRRGVDIVVATPGRLLDHMGQGTVDLSGVEMLVLDEADRMLDMGFIRDIRRVIAAVPKQRQTLMFSATFSKEIRQLAEGMLRNPTQIEVAARNTAAENVNQRVHPVSRGEKRALLSNLIQDGDWRQVLVFTRTKHGADRLARQLDQDGLSSAAIHGNKSQSARTKALAQFKQGRVRVLVATDIAARGLDIDQLPHVVNYELPNVPEDYVHRIGRTGRAGRGGEALSLVCVDEHKLLDGIHKLLKRPIDQHIVPGFEPDPSERPQPLFKKPAGRGAGGGRRPNGAPAGNRPQGGRRRGGRPGQSARQG

SEQ ID NO: 65831 - protein, 621 aa, Streptomyces refuineus subsp. thermotolerans
MTPAERPPVPDRTPTSRPWSSGMLPSKPELTGTLGAVASTHWLASAAGMRILANGGNAFDAAVAAGFVLQVVEPHFNGPGGDVSIVVHRAGSGDVQAICGQGPMPRAADIDTFTDLGLSSIPGSGLLPACVPGAFGGWMRLLAEFGTMRLADVLAPAIGYADNGFPLLPETATAIEVLAPLFREEWQGSARTYLPGGKAPAAGSRFRNPALAGTYQRLIKEAEAASADRDAQIQAAHDAFYKGFVAGEIADFLASGPVLDATGRRHKGLLTGDDLAGWEASVETAPSRVYKSYQVFKPGPWSQGPVFLQQLALLDGFDLAGMGLGSADYLHTVVECTKLAMADREAWYGDPAHSDVPLAALLDEEYTRRRRELVGARAELTLRPGEPGGRTSFIPSLSAPDDPEPDTEWMSQLRNGLPTILRATAAKGDTCTVTAVDRHGNMVAATPSGGWLKSSPAIPGLGFPLGTRGQSMFLVDGHPNSLAPGKRPRTTLSPTVVLRDGRPFVAFGTPGGDRQDQWTLQFFLNVADFGLDLQSATETTAFHTDQVPASFTPHAHRPGVLVAEETCAPEVVEELGRRGHEVELVPAYSLGRVCATGLTDGEGFVRAAASPRGRHAYAVCE

SEQ ID NO: 65832 - protein, 341 aa, Arabidopsis thaliana
MKDNKTPHFVFSLDDQKEIYVASLSTTSVGSGFDRSSLDYSYLIHLKKGRGSEPQHLVGKLKVSTLFSVSSTNEKTVERQFVLFSSGGNPQLPCHKDIRKNRGLPKKVVDALKSTKRTSRQRSISRFSRTSSIPDFCSWEPFQEHDSDLEPISLLDNDLPPNLETSAVVVREQFPVEEEEEEEVEKVGGWGMKFLKKIPLARTKDASKCSKHSTSIDVVIPLGIHGGPRNRNGGPSSLIQRWKSGGCCDCSGWDLGCPLTVLKGQARKDQSEGQCNLFELFTEGLMQGSPGLRIMNVRDGLYFVQSQAKISVLQSFSIALAYIHSQSQRLRPWSSKKCTEA

SEQ ID NO: 65833 - protein, 343 aa, Thermus thermophilus
MKVAVLPGDGIGPEVTEAALKVLRALDEAEGLGLAYEVFPFGGAAIDAFGEPFPEPTRKGVEEAEAVLLGSVGGPKWGTGSVRPEQGLLSLRKSQDLFANLRPAKVFPGLERLSPLKEEIARGVDVLIVRELTGGIYFGEPRGMSEAEAWNTERYSKPEVERVARVAFEAARKRRKHVVSVDKANVLEVGEFWRKTVEEVGRGYPDVALEHQYVDAMAMHLVRSPARFDVVVTGNIFGDILSDLASVLPGSLGLLPSASLGRGTPVFEPVHGSAPDIAGKGIANPTAAILSAAMMLEHAFGLVELARKVEDAVAKALLETPPPDLGGSAGTEAFTATVLRHLA

SEQ ID NO: 65834 - protein, 90 aa, Zea mays
MAQPAFLSSLRSRLGSAPPPPPNHRLLPRRGYHVELGAREKALLEEDVALKRFKSYKNSVKQVSKIGNALTLAVVLACSYELAVLATSTK

SEQ ID NO: 65835 - protein, 218 aa, Zea mays
  misc_feature (192)..(192): Xaa can be any naturally occurring amino acid
MESVEALVAHIQGLSGSADELAQLHGLLKQADGDALRVHSAGLLPFLSHLHPGAHSLGYLYLLDSFVSSSANLRAHAGGDLLVTVADFLTSCSADQIRLAPDKFLNVCRVLKNEVMQLNAPIRGIAPLRAAVRKIQTSSEQLTPLHAEYLMLCLLAKQYKAGLSVLEDDIFEVDQPKDLFLYCYYGAMIYIXLKKFRKALELLQHAGTAPMSSLNAIT

SEQ ID NO: 65836 - protein, 320 aa, Physcomitrella patens subsp. patens
MVGSGSKKGDGLPAISSTNIFAALERRRSKSSSRRKLQREKSKGKEESGEAKQEEQAQFWSATQVSVKSWADCDDEDDYFATTAPPPDIDVAPVPVPKEALSQGEETEGDEDGEGEDEVDDEVEEEAENESGAAQRTDEIPSKPDVVVPPVSREPERQLSKKEIKKKELADLEAVLAEFGLEPTEEKDENGSNPHADDKKDFETVNGNEEGAGGVPALTNSKSSKRRKAKKEKSFKERDGDVTPTPDNEQKEEEVAAEEVSETVDPKEILKRMQSLKKKKAGDSDSSAAKAAAREAAARAAKLAAAKKKEKSHYNQQPVR

SEQ ID NO: 65837 - protein, 229 aa, Bacillus clausii KSM-K16
MSVNVAENVANIKMRVRQACERSGRAIDDVRIIAVTKYVSVATAKQAVEAGIADIGENRIEGALEKAAAIGQARLHFVGSLQSRKVKNIVNVVSCIHSLDRLSLAKEIDKRLEPGKTIDCFVQVNVSGEQSKNGLSPDEVRPFINELAAYPAVRVIGLMTMAPFEQDAERTRPIFSKLRELRDQIKADKLSSAPCTELSMGMSNDFEVAIEEGATFIRLGTSLVGKEES

SEQ ID NO: 65838 - protein, 189 aa, Haloarcula marismortui ATCC 43049
MTRIDVIDNHGQFTHLEQRALRDMGVDVSLRDNTTPPEEIDADGIVLSGGPDMDDIGNCPEYLDLDVPVLGICLGMQLIADELGGRVGGGEYGGYADVTVDILDDDDPLLGSLYPETRVWASHADEVKEVPPGFERTATSDVCGVEAMSNTDEAIYGVQWHPEVAHTEEGEEVFENFLSVCDQQSVARQ

SEQ ID NO: 65839 - protein, 712 aa, Oryza sativa Japonica Group
MASAAANNSSSAAYDAAETGGLLRRRNTTAAARGNAGEEEEEAEAVAPSVEQAFADKPVPSWREQLTVRAFVVGFLLSIMFNIIVMKLSLTTGVIPSLNVSASLLGFFLVRLWTAAIERVGFLKQPFTRQENTVIQTCVVSAYGVAFSGGFGSYLFGMSETIAKQATEANDPMNIKNPHLGWIIGFMFLVSFVGLFALVPMRKVMIVDYKLTYPSGTATAYLINGFHTPEGADLAKKQVRTLGKYFSISFLWAFFQWFYTAGDNCGFSSFPTFGLEAFKNRFYFDFSPTYVGVGMICPYIVNVSLLIGGIISWGIMWPLISKKKGSWYPETLPESSLLGLQAYKVFITIAVILGDGLYNFVKVFGYTIKGFIVMYKNKNSNTLPISDNGTPANATEEESFDDKRRNELFLKDQIPKTVAIGGYVVLAVITSGCLPLIIPQLKWYYILIAYIFAPIMAFCNAYGSGLTDWSLATTYGKLAIFVFGAWAGASHGGVLVGLAACGVMMNIVGTASDLMQDFKTGYMTLASPRSMFVSQVIGTAMGCVIAPCVFWLFYKSFNIGASDGAYPAPYTIMYRNMAILGVNGLSSLPKYCLTLCYIAFVAAFIINLIKDLVPERVAKYIPIPMAAAIPFYLGPYFAIDMFMGSVILYFWEWRNKDEAQSFGPAVASGLMCGDGLWALPQAVLSLVNVNPPLCMKFLSRAANAKVDTFLGN

SEQ ID NO: 65840 - protein, 215 aa, Triticum aestivum
  misc_feature (142)..(142): Xaa can be any naturally occurring amino acid
  misc_feature (155)..(155): Xaa can be any naturally occurring amino acid
MAATAAASPFSLVLSRRHGASLSSSSASRAGASRLRAPRCVLVTTEHLLVVHTWKRGFFVHPWAAPWTLGRAEHDAMFTPLPQEARDSRLKISSAAYNRPLSQDIASSLGVDLGKILIKRFGDGEVHLHTVQSVTGCHVRLXQTTCSRVNQDVMXLAMMSDEPRGPSGRSMTVVSRPSACAKAQRTAQGRQANSCAHRPQASRTAHRGRGRPPAR

SEQ ID NO: 65841 - protein, 436 aa, Wolinella succinogenes DSM 1740
MHYLIVSYSHKNTDIATRERLAFDNGVRSESFLRELVANKFINEGILLSTCNRVEFILSVKEAHKAGDFLMEKLSEYSKIPKEELSERADVYEDTGAIHHLFCVCSSLDSLVVGETQIAGQLKSAFKFAYDGGFCSQKLSRAMHFAFKCAASVRNCTEISKNPVSVASASVSKAKDILGDLGGDTAIVVGLGEMSQLTIKHLTALGCNVILVNRDKAKAEAFAKEFGGMVSVEGFPRLGELLNHHKMLFSATGAPHTVISKDMVEPKSFRRYWFDLAVPRDIEAFESETIRIFAVDDLQEIVNKNLSLREEQAKRAYGIIGRFTQEFYKWLQSLSVDPIIKAMREQAKEAALKEITKAISKGYLPKECEKSVEKIIHNSFNTFLHHPTIKLKEISEEPQSDTVVEAVKLLFGIQEDGLMLDRYKCEYDTTSKEREE

SEQ ID NO: 65842 - protein, 190 aa, Glycine max
  misc_feature (99)..(99): Xaa can be any naturally occurring amino acid
  misc_feature (154)..(154): Xaa can be any naturally occurring amino acid
  misc_feature (181)..(181): Xaa can be any naturally occurring amino acid
MERKRSHASFTMFAMLVGVISQSLVIPVVSTTVEDQKNYYTPDPHAGSPPSGFSDSLCSHSSTPPSHGHGSSPPSHHHSSPSTPSTPSGGNCGSSPPQXMDPTTPSTPSTPSNPPSGGYYGGSPPTPVTVSPPTTPVDPGTPSIPSPPLIPSPXPFTGTCNYWRNHPAIIWGILGWWGTLXSAFGVTGTT

SEQ ID NO: 65843 - protein, 479 aa, Prochlorococcus marinus str. MIT 9215
MAERFSQKNLRVRPSSDEEKIVTNAKKHFEKTLVEISGELVGSVAALEHPTKNKKLNYGEIFLRDNVPVMIYLITQKRYEIVKKFLSVCLELQSANYQTRGVFPTSFVEENGKLIGDYGQRSIGRITSADASLWWPILCWYYVNKSGDYAFGKSQSVQRGIQLLLDLVLHPTFEGTPVLFVPDCAFMIDRPMDVWGAPLEVEVLLHGCLKSCINLMELSRADHVSRLLDQRLILTNQWVKDLGSFLLKHYWVTSQTMQILRRRPTEQYGDDQHFNEFNVQPQVVPSWLQDWLENRGGYLIGNIRTGRPDFRFYSLGNSLACIFGVLPSEEQRALFRLVLHNRQHLMAQMPMRICHPHMDVEEWQNKTGSDPKNWPWSYHNGGHWPSLLWFFGTAVLLHQKNYGSDDVILMEEMKSLIEESYWCQLNQLPKQEWAEYFDGPTGTWVGQQSRTYQTWTIVGFLLMNHFLRNGYKDLDMFKF

SEQ ID NO: 65844 - protein, 289 aa, Pisum sativum
  misc_feature (130)..(130): Xaa can be any naturally occurring amino acid
MEAKEQDVSLGANKFPERQPLGIAAQSQDEPKDYQEPPPAPLFEPSELTSWSFYRAGIAEFIATFLFLYITVLTVMGVVRESSKCKTVGIQGIAWAFGGMIFALVYCTAGISGGHINPAVTFGLFLARKXSLTRAIFYMVMQVLGAICGAGVVKGFEGKQRFGDLNGGANFVAPGYTKGDGLGAEIVGTFILVYTVFSATDAKRSARDSHVPILAPLPIGFAVFLVHLATIPITGTGINPARSLGAAIVFNKKIGWNDHWIFWVGPFIGAALAALYHQVVIRAIPFKSK

SEQ ID NO: 65845 - protein, 133 aa, Triticum aestivum
MASFTASASTVSVARPALLLKPTVAVSAPVLGLPPMSKRKGGVKCSMETKQGNVSAVGAGVSAAATAALTAVMSSPAMALVDDRMSTEGTGLPFGLSNNLLGWILLGVFGLIWTFYFTYTSSLDEDEESGLSL

SEQ ID NO: 65846 - protein, 117 aa, Oryza sativa
  misc_feature (22)..(23): Xaa can be any naturally occurring amino acid
HEVRRGYWGTNLGTPHSLPVKXXGKCGSVTVRLIPAPRGTALVASPAVKRLLQLAGIEDAYTSSSGSTKTLENTLKATFSAVSNTYGFLTPNLWKETKLIRSPLEEFADTLRDGKRY

SEQ ID NO: 65847 - protein, 885 aa, Schizosaccharomyces pombe
MLIELQQIVKSGLVRNGAKHCTKRSLLCSNASVIASKRFQGSFAPGQQQPLNPLAKPIEQDRDAIIRILSSIGSRREVEQYLRYFTSFEAQRFAIIKVGGAIITDELDTLAQSLAFLNHVGLYPIVVHGAGPQLNKILASRNVEPEYSDGIRITDAETLSVARKVFLEENAKLVDALEKLGTRARPITGGVFQAEYLDKEKYKYVGKIVKVNKAPIEHSIRAGTLPILTSMAETASGQLLNVNADITAGELARVLKPLKVDYLNEKGGLINGETKKKISSIYLDREYDGLMKQPWVKYGTKLKIKEIKELLDTLPRTSSVAIISTKDLQKELFTESGAGTLISRPFVINKHDSLDSIPDAALENLIIQKNSLAAPSESLKQFKDTLKDRKLRIYSDSFNESVAIVDTTDSSLPVLLAFGAADNNWLNNVVDSILTTLKADFPSLLWRLQPSAKNLEWFFSKSEGTLFANNFYYFWYGVKDLNKISKFIQSDKPFADAIIQTQSTKPPTASSTTNNPSSSQINQKRSYSTSSLFSKNKKMNRSLFLKGGKRFFSAEAQKTQKPLKAVSSKPAKVVLLGARGYTGKNLIGLINTHPYLELSHVSSRELEGTKLPGYTKKEIQYVNLSTDDVKKLEEEGAVDAWVMALPNGVCKPYVDALTSANGKSVIVDLSADYRFEPSWQYGLPELNDREALRNSKRISNPGCYATGSQVGLTPILSLIDGQPSIFGVSGYSGAGTKPSPKNDLNVLTNNLIPYSLTDHIHEREISYRLKQPVAFIPHVAQWFQGITLTINVPLKKSITSRELRNLYQDRYNGEPLIHVQGDVPLVKDNAHKHHVSVGGFGVHSSGKRAVIVVTIDNLLKGAATQALQNLNLSCGYDEYAGIHLD

SEQ ID NO: 65848 - protein, 401 aa, Magnetospirillum magnetotacticum MS-1
MPNQNGTAPKPSSQVPTFDAPRPPGATGALVLADGTVLWGKGIGAAGSNVGEVVFTTGMTGYQETLTDPSFAGQVITFTFPHVGNVGTNTEDLETTTAAARGLILRADITDPANWRSAKHLDSWLKSNNIVGLCGIDTRALTRRIRTKGAPNGVIVNAPDGEFDLPGLWAKAAGWPGLEGMDLALDVTCAQSYSWDETEWRLRGGYGRQDKPRFHVVAIDFGAKRNILRCLAETGCKVTVLPAEATAEQVLALNPDGVFLSNGPGDPAATGKYAVPMIQGVIKSGKPLFGICLGHQMLGLALGAKTFKMDTGHRGANHPVKDLETGKVEITSQNHGFVVDEKSLPAGVKVTHRSLFDGSVEGIALEGKPVFSVQYHPEASPGPQDAHYLFERFVGLMEKRG

SEQ ID NO: 65849 - protein, 716 aa, Debaryomyces hansenii CBS767
MNYDYLTDEQKQQLYFHQMQAEQQQHQQQLHYKQQQHIQQQQQHQQNQQNQQQQPQPPRQPFSTFLQNNGSNSDLPQMGTFQQDLQRQNIPNLRFSQQNQPSDLGQEFQDDDSFMDEDLTEIHEQPPMQELNSSPMTHPHSFQQNFQTPTKNDDANLRNQQFQSVDSERSLDFKPPVTFTKLNNNSNADLSSPTESSFLKSNLNLPNSNIPPAGASNDPNAQKSNYIYFNRQPNSLNKIAQDKASSIKLKLENYYQMSVAHAIERNQRRLDLEHKLLNEESGSSEERKNRQLQNLGKKESQFLRLRRTKLSLEDFNTVKVIGKGAFGEVRLVQKRDTGKIYAMKTLLKSEMYKKDQLAHVKAERDVLAGSDSPWVVSLYYSFQDAQYLYLIMEFLPGGDLMTMLIRWQIFTEDITRFYMAECVLAIEAIHKLGFIHRDIKPDNILIDIRGHIKLSDFGLSTGFHKTHDSNYYKKLLEKENPHHTNPQNGNLQAPSMATNNRNSMMVDAIHLTMSNRQQMQTWRKSRRLMAYSTVGTPDYIAPEIFVHQGYGQECDWWSLGAIMFECLIGWPPFCSETPHETYRKILNWQETLQIPDDIHLSPESEDLIRKLLTNAENRLGRYNGADELKLHPFFRGVDWDTIRKVDAPFIPKLRSITDTRFFPTDELENVPDSPALSKAMEQRDQVLQNGGNVKEDLPFIGYTYSRFDYLTRKNAL

SEQ ID NO: 65850 - protein, 212 aa, Physcomitrella patens subsp. patens
MTVKWLYYWQPSIGVTMSSQTLSIAIKRIEALHGVKTSRWQITASQFRPNQREPVPLVECARELLGVVFSEVPDKYYFALRQEHMVVEADATMQAIMEKLQVYRNRLTILFEGFQYELGDFHIKAGRAVLAHTENLRGIVLEVDYKPLSSVEQSRRVVQDFMEVWQKGETTGQFVPLDPNFSEFNLPDLYSWQHTALQYVTLMAFVFSQQRT

SEQ ID NO: 65851 - protein, 368 aa, Physcomitrella patens subsp. patens
MRVKQMLRKCLLLVVLASSLVLVCEGSDGDQRPRYRECVKGCEQTGCVDGQCYNSCNFQVNVDLEGNILPKKAQINSPHEKFLKEPLYLRWKKWDCISECRYQCMLREEADSEVPVKYHGKWPFVRIFSLQEPASVAFSVLNLLVHFQGFSSFLVLLYYKLPSRAKGPFYEYVGLWTIYGLLSMNSWIWSTVFHSRDMTFTEMLDYSSAIALIGYSLMLAIIRTGNLRSEAARVMVAAPIIAFITTHILYLNLYKFDYGLNMIVCVVIGVAQLLIWSTWGFITRHPARFKLCTVVFGAAFAMLLEVFDFPPLWGIFDAHAIWHGATLPITYLWWSFIKDDAIYRTEMLVKKNLTSSGSFSEAETRKTQ

SEQ ID NO: 65852 - protein, 381 aa, Candidatus Kuenenia stuttgartiensis
MKKNYLFTPGPTMVPPEVSLAEAQPMIHHRTPQFSQIFYELSEDLKYLFQTKTGEVYTLMSSGTGAMEACVANVLSKGDKALVITSGKFGERWVELCKCFGIETEVVSVEYGKGVEPSRVEEILKKNSEIKVVFATQSETSTGALHDIKAISQIVKKYSALIVVDAITGIGVHKFLMDEWNVDVAVTGSQKGCMLPPGLAFVCVNSGAWEAVEKGDLPRYYWDFRKMRKNLKNKTTPFTPAVSLVMAMKTAMEMIKKEGIENVWARHERLANATREGVKALGLELFAGNSSSNVLTAIKAPEGVDVDKIIKKLRDETGVTFTGGQDSLKGKMIRIGHMGYVNDFDIILAISALEKGLHEAGYPVELGKGITRVQSLLVKGR

SEQ ID NO: 65853 - protein, 289 aa, Bradyrhizobium sp. BTAi1
MDVMARIEKSLVAAVALADRPGCPPRLSAAMQAAVFPKGARVRPRLCHAVAAACGDDEPAATDAAGSAIELLHCASLVHDDLPCFDNAKLRRGRPSVHAAFGEPLAVLAGDALIVLAFQTLAKSRCSPLRLAQLIATIGDAVGVPHGIAAGQAWECEPEIDLSHYHRSKTGALFAAATVSGAAAAGHANPEAWRSLGEKIGEAYQVADDIRDAASDEEEAGKPVGQDAALGRPNAVLRYGLTGAVSYLHDLVADGIRTMPPCAHAHELRLLMEQEAKRLVPRRLAASAA

SEQ ID NO: 65854 - protein, 116 aa, Lactobacillus sakei subsp. sakei 23K
MYHIKINNMQFHSHIGVFQAEKDLGQRIEIDLKVAIMTPYQGDELTDTVSYADFYEVIAQLIAKSRANLVETIAHEIIQAIHALDPDRIGSVAVKVRKIAVPIEGIFDHVEIEMEG

SEQ ID NO: 65855 - protein, 664 aa, Arabidopsis thaliana
MEGRDDGGGKVIGLIEKATKSTAQEVDPRLLKAIKSIVRYSDSEVRLSSQTLMELMRHNHSQVRYLTLFIIDELFMRSKLFRTLIIENLDQLLSLSIGFRSNLPLPAPPAVATTLRSKAIEFLEKWNLSFGFHYKELRLGFDYLKNTLKLKFPDLQANAARIQRERQEREMKTKEILRNKFDSLRVSFGLFKYEIEVTIKEIKECMEIVQWRGDDGVPLAILDEEDFEEIRCSHLRQIRLDSLKQSEKVEETGENRIVFDVLREQCKLLVTKHLISVQEGISLLIRVDVSDNRTRDSMLKDLIDIRNNILAAKKKWEEAGFTMSRMTDIHGNEETNEEEEDIWEEDDGKVKTDSVKNVAHVMRTQQSENSSLPSSGEAKKSTSEARSNKVSNTKKVGSSGNSLRDKLISEAPVMNWGSQLTNWESTTEVRANYRGLEIESHWGRVDQDAIIPADKIAELNLQATVYREERTETPPCRASLKKGGLCQRRDLRVCPFHGPIVPRDDEGNTIIQESPLDESENQTSSTSGTNQDVSMDETTSDSDPNQLARQIAKEALKNIREKDKEVVRKRAKLVKVKVKEHNHEVLRGAAIASTSRSNAMDDEFDRVFAEKKNKKQTFSTRRKKTTAKDRISQRLFSNRVKGTNPQQLAQGNDEKCRDTSANQW

SEQ ID NO: 65856 - protein, 285 aa, Gossypium hirsutum
MAKDVEVGGEFQAKDYHDPPPAPLVDAQELTQWSFYRAIIAEFIAALLFLYITVLTVIGYKSQVDPDKGGQDCDGVGILGIAWAFGGMIFILVYCTAGISGGHINPAVTFGLFLARKVSLVRAILYMAAQCLGAICGCGLVKAFQKSYYNKYGGGANSLADGYSTGTGLAAEIIGTFVLVYTVFSATDPKRNARDSHVPVLAPLPIGFAVFMVHLATIPITGTGINPARSFGAAVMFNQDKPWDDHWIFWVGPFIGAAIAAIYHQYILRAGAAKALGSFRSSSAM
